United States Patent 10,724,096 (METHODS AND COMPOSITIONS FOR INHIBITING AND TREATING NEUROLOGICAL CONDITIONS) - sequence listing, part 32

SEQ ID NO: 381 - DNA, 49203 bp, Homo sapiens
gacgccttggacgcggttcaggaatccgccgccgctagccggctcgggcctgagcggggagggcgccaggcaggacctctcgcaggctcgctgcgcaggacggcgcccgcctggcgccgcttcccttccagcgtgccgaccggccccgcagcgcctccatccctccggcccgccccggagaagacgcacagctcgggccgcgcgggcgccggggccgcggaaccgcttctgccgggatcttccaggaggaaagcgaagttgcgagcggatgctgcccgcgccggaccccagccgcggagggtcggggccgccggtggagtctcggcggccggggtaagtggggcgccggcgtcctggaaccgccgcccagcccgggggaggccgcccagccgggagcccccgccttccgcgtccaggcgcgcgcgccagactttggagggagaagggggcgaagcggacggtgggaggtggagttcccagctcggggaaaagcccaggcaggcacccacaacccgctgcaaccggatcacacctgccaggtacacacagctcatcgccactcataccccgcacacggcgcaggctgatctgcgcacacccacaccggccaggcacatgccacacaccgaaatgcacattcctgggagcgcgggggatttggcctctacagcaggcacgtcctcacacccctccgtcacatccacggcctttgtctgctgcccccgcagcccccaaggagagggagcccccaaagcgcagcgggcaggagagaggctgcctgggttttgaaaacttgtggccagaaccccgagaccaaggggagcagatgttgcagtcggttctcggagttctgcaggagcgaatttggtgtggaaactcggtgtctgggtgatgtgtgagtgtgcgaagcccttccggaggcgaggcccggagagaggagggagtgattcataaactcagagccggcgtgccagggtctgtgagcagcgtggaagaggctggcaggccgttgctgcgctagacagaagggtagtggccgtgacagtcttccagggaagcagggacccttccccccagcggatgtgcttcctccagggacttccaagggaaccgggtgagcagattccagtcctgggtgtggacggggtaaggggaggtggggggatttaagcctaaaaggttagggagaaaccaaggcaggcctgacgccttcattattttccttgcacctgaagttgtgtttggtttctgatgcgtggtgttgctgggccccaggatgtacgggggattgtcctgggcctagcatagtgcctggcacagtgggcactcagtcagtacttgcttgatgaataatgacaccggtaattatcattcattatggactcactgtgcggcaaggccagtgggcctctgctgggttgaaattgattttccagcagagaagggggcctgagtagctcctaggagccctgcctgatctgcttgggccagtggcccaggcactgtgtgttccactgtgtcccgtgggctggccttgggagactggagctcatcattggcctctgcccctctaagagggcagcaggaaaagcttcatttctgtatctggctaagatggggttgatgtgggttttggtagatggcaggctgtttggcagattctgtggggtctcaattgaagaataactttagatctgcagcagagagaggggttggttccatcaaccctcccatctcctggctgctggagaagaggggtgggtaagtggagaaagagatgggccgtgctgctgggcatgtgctgggggtaggaggaacatgggaacatgtagaatttgggggcagccgtttttcttcctggctcctgatggcctggctggagatgggtctcatgaagggtctaggagctgtgttctgcagcagtggcttggctctgtggtggcagcaggtagagcagtggtcacagtccctgtactgagtattgctgtgggttctcctgtgccagcttgcatgagtttcccagaggagcagaaacattcgtgttcctggaactggattgccagtagtcttgggattgagagtgcacaaagatgtgggggtggcctgggcatgtcatccaaaagaaatgtgtcattccccacccctgcccccttgtgaagagctctgactaggttcagtgtgcatttcaaacttctaaatgctgaaattagcaaggcatgtgggcggcaccaaggactggcctcagatgaaagaggaggtgatctgggcttgggcacccccaatttcaggtggaaccctgcagccagttccttccctatatcacctttccaccttcattatgccctctgtgaatcgagagttctgtatacattttctaattaaatcattatatccctatgaggttagcatttcatctccattttgcagattaggaaactgaggaccagaaaagttaagtaactttttcaatgtcacacaggtagtgagagacaaagccagtgtttgtgtatttggtttttttaaactttatgttaggttcagaggtacgtatacaggtttgttacataggtaaattgtatgccatgggggtttggtgtacagattatttcatcatccaggtagtaagcatagtacccaataggtagttgttgggtttgtttgagacagggtctctattgctcaggcaggagtgcagtggcacgatcactgccactcaccatagcctcgacctcctggactcaggtgatcctcctgccccagcctcccgagtagctggcaccaccatgcctgactaatttttttgtattttttgtagagacagggttttaccatgttgcccaggctggtctcaaactctggagctctagcgatctgcctgcctccacctcccaaagtgctgggattacaggtctgacacactgcacaggcccgagatgggtggtttttgatcctcaccctccccactgtctccaccctcaagtaggtcctggtgtctgttgttcccttctttgcgttcagatgtacccaatgtttagctcccacttctaagtgagagcatggggcacttgattttctgttcctgtgttagtttgcttaggataatagccgctaactccatccatgttgctgcaaaggacatgatctcattctcttttatggctacatagtatttcatggtatatatgtaccacatttctttatctggtctaccgttgatgggcatttaggttgatttcatgtttttgctattgtgactagtgctatgataaacatacgtgtgcatgtatctttatggtagaacaatttatattattttgggtatgtacccaataatgggattgcttggtagaatggtaatcctactttgagttctttgagaactctccaaactgctttccacaatggctgaactaatttacatacccatcagcagtgtataagcactctgttttttgttttttgtttttggtgggagtggtgggatggagtcttgctctgtcaccaggctggagtacagtggtgcgatcttggctcactgcaacttccacctcccaggttcaagcaattcccctgcctcagccccctgataggcgtgcaccaccatgcgtggctaatttttttttttttttgtattttagtagagacgaggtttcaccatgttggccagaatggtctcgatctcctgacctcgtgatctgctcacctcagccccgcaaaatgctgggattacaggcatgagccgcctcgcttggccagcactcccttttctccacaacctggccagcatctgttaatgtttgactttttaataatagctattctgactggtatgagatggtatctcattgtggttttgatttgcatttttctaatgattagtgatgttgaccgttttttcatatgtttgttggacacatgtatgtcttcttttgaaaagtatctgtttgtgtcctttgcccactttttaatggggttgttttttgcttgttaacttgttcaagttccttatagattctggatattagacttttgtcggatgcatagtttgcaaatattttctcctgttctgtaggttgtctgtttactctgttgatagtttcttttgctgtgcagaggctctttagtttaattaggtcccatttgtcaatttttgtttttgctgcaattgcaaagccagtatttgaacccagattgtctaactccagaacccaccctgtctccaccatgccaggctgtctgcaaggcccttattggttctccatggcaacagggaaacagccctgatgcttcttactaacgtggtcccagggcctctgcttgcattcttctttttccatacactctgccgagcctggatataccttaggctgtgggaatcaaaggctgggtggtaccaggctgctggagccttctgtgtggctctggagtcagaaaactgtggagattttgggggggcacacagggagatgttgcagtaattccagtgagacatgactcactgcttatctgagaagttgggacaaagctgcctcttgtgaccataccgtgaatagggaagaaattgccaggtagaccaaacatcctcaaatgggttactgtatttttttcccctttttggtcctctccagggtaatctattacctggggaaatcagccttcacctgacacctcctattgtcatttacctggtgaacataaggggccatgtcacagctgtccttcccacccctgccacgtgttctggagagctggactcctcagcagcacctggtccacaggagagaagaatggggcagagccggagcagccaggggaggtgataaccacacgctcatctggtccccagctcttgcttttacatccacgccccacagggagacagcaattatctgttggccccactttacagatgaggacatgaggctcagagaggtgcagtggatgcccaaggtcacgaagccaggcatctgcaaaggcctgggacagccacgttttcagtcggggtggtattttctatccccggccccaagggctgagagtggttatccctgctggggcagggtcctcactgctccacccaccctcatctctgccctgagagcccccagtacagatgtccatagaacgggaaaggctggcgcccttcaaaggacgcaaagagcattggatgagcactgcccagctgatccctgcccaccttccacaggaagcccacctgggtgagttcttagagccttcctagtgctgagctgcaaagaaactggagccctctccccctccactgcagaggggacacagtgaccaggacggaagttgggggactgggtgtggggagaagccaccccactgcaggggccggggctgtccatctttgtacccctggttccatcccagtgcctgaggcatgggaagttcttggaaatgtagtcagatgctgggtgaagccccaggaggggccgtgaatgcttctgctgggaactcctagagtggcggcacagagagggtctttgctgcgaaggaacactcagagagtctctggctttcgtgaggttatgcctcaggagaggagacacttctccttttcattcgttaaacagaaatgatatttgccaccttttcttctctaaggcctaaagagatgacagaatgctgctggtcctaccctgagcgcgtggactccacagcggggtgtggggtggcccctggcaggcctggacggtttgttctgtgcttgccggtggacacgcttcagccctctgtctctattgccccaaatctggcctgtggctgctgggccgccaccagcttggagggcagggtgggccccgggagcccctgaccaccagtgacttcttgtctccagctgccctccgtcctcttgatccccctcaccccccaccacctcctcacaaagatggctgtgtgctgagggactgtggcttccctgggccctaggaaatttatcactgaggtttcagaggactctatgaaaaggatttggagaaaaagtgtggaaaataaacaagccagttcccagttcagcctctcctgaatgccgcaagtaaacaaccacctcggaggccagcccgggatgttcttatttggcctctgtggttacacctgccccctccccgcccagtccctcctccttaactttaagagcctcaaaagtcagggaacacaccctccgctggccagtccttgtgctgcagggacgctggtggctgggcacaggaggaacatgtatatgggagagaagacggccgggggtcccagctcagccctgctccctctgagtcagtcccaagcctggaccctccccagcaggcagacggtgacgtcttggttggttggtgagtttaactttgatggtgcagaatgatgagacttttctccattttgtggcatctgagaagctttgcttcttaaacattgctttagggtggatagaccaaagctaattttcccgttatgtctctccaagacggggcctacctgtgagcaaaccctcatagattcatttactttgtaggctacctggacaaaaatgtcaggtttctttgctttgggctggagtcctatcagctcaggggtggtggtgtaaggtcacaccaatgatttccagaaactcaagcactattctgagtgactaagtctgtgggataggaagcacattttccatctcttaataacttcaatttacttagtgaccaactttaaaaccaggcacccggttagaagggggagagccagggcttggcagcggagggtcctcaccttgcatccagggagtggctgagggcccttctcgttctctgtggctgtgctgagctgagtcagcgagccctgaagcctctgggatttggggagtggggcactgctggaaggttctggttcctgctttgttctgctgctgccaggcttctggagagggtggttgtggggtgagtcctgcgctccgcacgtccacatgttcgtattctacatattgggcttctgaaaaaagttctggttcataagacggcttcacagcttagccgtctgcagaccagtctgcaggttgatcagctttctgtcatgtgtgtgctgttcctgttcacacatgctgcgccgatgcccgcctgtgcctgtgccagccccagcccacacagctacctgagatttagccctgggcatctcccctaccctttcccgcttccccctcctctcctcccttcctctccagctgcctcgccatctgcaagattctggaaagtgctaatgtgtctgagccaaacagtgctatctgaggaaatattttgaaaacacactgggccacccccgtccccgcactgtgactacactgattttcagcaaggaatttcactccagccacagggcagggccgcaggtgcctggctttcctctggagacttccaggggcttgttagagacacggagagaagctgagggcctgtcctgcaggtttgatgtgtctgaagaggccccgagaatagaaatctagaacctgccagtcacgaagcagtgtcacccaccagaggatgaagaactgactgtgacctcgcaggtcacccacttgctttctttttaccgagacatgctatttctctttcacttttcttccttctcttgcatctggtgtaggtgcctgggggtagcgtgcccaggaaacaataatagtaagagcagctggtgtgcctaatactgccctgagcacctacaaggcgtcctcaccgagttctcaccagaagctctagaggtggctccggttattcccaccattttacagatgggaagacagaggcagacagctggataagttgctgacatgccacagccggtgaggggcaaagccgggcctgagccccacagctgactccagagtctgtgctctcagtaccacctgtgcgtgcgtctgtcccgttgtggctgcaccgagaggagaaacagcacacaggcattcattttcaaaccgtggccagtgcatgtcattgcgttctgactgggaagctctggcaatgttggcgttgcatggcctattgtgggcactaccagtgagcctcggccttctccaggtctgactccagtacctgccggctgccctgggcagggcattttggatcctgcctcagggtcttttgcccgctctgctgatgccactcccctgtgccctgacctggtcacaggaagggtgcagatggcagcgagtgtggtctcagttagcaagggggagctggcagatccagggacttctgcctccctagtggccattccagcaagacaggaaccccaccccgagtgatgtctggccctgtgacctttcagcaaatatttcttccccagcctcacctggactcggtatcccatgttccaaattgtcctaatttcccagacacacacaccctgctctctgtagccttcccagctgccaagaacattccctccttcccccttttccccttggcttggatgccaccttctcctggaagcctgggtggtggccctccccatggctgcccacaggtccccctcactgccctttgcctgtggtattatgattgctggttcagtgatctgtggtctgcaccaggcaatgggatgtgcaagggcaggacagctgtctgccttgtccatccttgtagcccccgacttagcagtgaatgctgctacctgattatggaaggaatgagtgactgatgtggcacagagccctcagtggggcaggcccagtccaggatgcttctgtgagggagcgcttcgagtctggggagggtggcaggagtcgtggtgagcgggaggggtggctaacgtgggccaaggaagggacagacaggaagagtgggaccccggcacatggcctcttgaggtcattaccccatgggtattgggctgggatactgaggatgagcctgaaacccttccagaagcccctccagtcctgccacttgtctgcctgcctgccctggatgcccgtttttgggctggtggctggctgcactctgggcccactgctcaaccccaccagcaagtggagagccattcaacagccccagggtccagttcccatctgcaagtaacgaggcctgccgtggctgagtcgtttccctgagcagagagaaggaagccctactggccggctgcctccccaggggtgggtagaactgttctgtggccccacctccagccctcaagctgtctgtccttgcaaaagtagtggggcacagagtgctgggttcttgggcatcacctgtccaggtcctgcgcgcctatgctcatgctgacactgcaagatggtgggataacaggagggactttcaagctggaagagaggagagctgggtgccccagtaaccacctttgagtcccactgtgatgagcccacagaggtggacatgagggaagacttggggaagccttcctagaggaggcaggcattccagtgcatgagggaagctgggcaaaggcacgaggatgggaaagttccgattgaagacagggactggtgaggagtctggctggactgaactgaaatgtataggatacacgaggagagacaggcaggatggagttgtggttacgcacacaggctctagagccgggctgccttcacgggaaccccaactccccacttactggctgtgtggccgtggccaagttgcttaccttctctgagctcagttttctcactactggtaccccccacatggggaagacatgggaataaaatgtatttctatacaagtgttgagagcagtgcctggcacactgagcatcaggaagggtgagctattattatataggtatatgttttaatgcagctagaaaaggaaattgaggtcagatcatagaggcccttgaatgtcattctttccattcactaagcacctgccatgtgccagattcttcacagtcattctcaccaagccccctacaacccggcaaggttgttagcaatgtctccatttcacagatgaggaaactgaggctcagagaggttgagtaacctgcctaaagtcactcagtcagggagagtcagagccagtaataacacccaggtctgctgtcgcttgagtcttccctcaaagtgaagattggagagacatggcaggggcatcacagggatgagccctgggctggggccgcagccaggagcagagcaggaatgtggcaactgtgggtccctggggcagggtggagacggggagagatgccaggcgggcctggagggtagggaggactggaggctacagcatacagctcaccattcatagcccagggcaaaccattgagtcatttggggaaaacatgacatcactgagtctcactgtctgccgcccacctgctgtctgccctctatggttctcctgatgacctcagtgccccaagtcctgcaaggggacccgcacaccccatgtagcagggccaggtcagcactccagcttcctgcactgggttctcctccccagccactgtctcccaccttcccaccactcccttccctgcctgggtcccctgccccagccctactcatacacactgctgaggcagaagcttctggaagtggtgatgggcatgaagagcttccagaagggcttccatgccaagcccttgattggaattctgggtggggaggggacagctcagaagcctgtgtcgagcttttagagttgcttttccttgagaatggtgcctgctgtttgggtgggatcacttttaaaaagtaaagcctggtagagctatgtgaccagcactatgccatgacctagaggagattcagactgacgggcaggccctgccttcctgcagaatacagttgagtgtctgagagttctttctgtactaagcatctttgaactgagtgctttattttcgtccatctgattgcgcgaggtagtcttattttacagatgccatccccgaggcccagagaggttaggcaacttgtccaaggccacacagccaggattcacacccataactgtccaactccagatgtgctcttagccactctgccatccggccacaaataaagccaccagagaaccacagaaggtggaacatatccaacatttgcccgataaattgtatagtgcagacaggaagtacagggagttttcatctcaaagtgtaggtcactccccagagtggcttgaagtctgtagatccatttaggagaacatccagcttcactggctgtgcaaatcccacccatgcggctgtttggggtgagaagtttctttaaatgtctgttgactctcttctctggaaggagcacgggggctcagggggcgcctgtcctggcattggtggccacacctagaaacggactatgaatcaagccaggggcccagtgccagcttccttggcctgtctgtgggcgcagatgccagcctttgcagctgctgctgcaactcacagctctctcccggtgccgccctcagtcaggccagctggagtggaggggccagtggccgtgccctgtgcagaatgacatcctctcaccttcacaagggaagcgtgattatccttgctttccaggtgaggacactgaggcctagagaagttttctggctgtctgagctcccttggcctgagctcccgcggtagaaccgagactcaagtcttctttctgcaggcagatggccagtttcttcctggaggagggaggagccagcttgccctctgacactgggtagcacagccctgttcgattctctgttcggggcttgcacttctgattcattctgcagtcactggctctttgtggttcgggaaaatgaccctctagggtaggagaaaagctcttggagcacttttgaagccatagaggccctttccaggctttggaaaatgttccttctccacccagatgccaacaccaccctggtcctggcagtacttgtccctggaagggcctcactgcggtgactcattacccagcatgcagcacattgccattgctctcagtgggcaggtgctgtggggacacgggtctgcgggcctgctgtcttcaggggtcccccatgccttttaacgcgtgtatcagtgtaccccaagcctcagttctgtgtagtttgtacaactctggcccctaccccaaggatttctgggaagcccccaggaatgctgataagttcacagtctgccctccccagccccagtctcatcaggcttcaggggtggccattcctcccctccaggagagagagaactcaaaccagtaactacccctcctcaggctcaggcccaatggttgctgtaataatttctggggagctgtctttgctcttgcagagaaggcaggccttgaattcagactggaggggccatttttcttccagttgccctcaaattttcctttctgtgataggatttgtcctttgtctctgcttaaattcaaagacttgttaaaatgacttttctcaaacaagaggctaccctcaaaagaactttgcctctacggatagaaaactggaacctacttttattttggttttagttttattaaattgtataaaatcaataatacatgtccatggtgcaaagttgaaaaggcacaaaacagtctatgtgtggtctctttcccatgccggactcagacactcagcattgttagttttgtgtgtgtgtgtaagctgtgtttaaattgtccagctttaaaacaaaacccttccctgtttcacaattaggttgaccgaggcacaacctgaaaaataacctggaaatagcatcgggccccctgcagcgtccagctcttcccgaggactgttattatgataacgatcattgctaaggctgtcccttcccaaaaagtgttgctgcccacagtcccagcccccagacctgagcagtcacccacacagcatgaatggggccagccccagcctgcccgctcagcttccaagcctagcagtctcaggctctgggctaaccctggcctcccagctgccccttcaacattgtcccctcttgtcttgcagggcagtagccacagctggggctgtggggtcagggcatggcaagggtgatctgaccaaactatgctgcctcttagccagactgtatattcggagtcccctaagctcgatttttttttttttttttttgagacagggtctcactctgtcacccaggctggagtgcattggtacagccatagctcactgcagccttgacctcccaacctcaagtgatcctcccacctcagcctcccaagtaggtgggactacaggtgtgctccacctaatttttaaatttttttttagagaaggggtctttctatgttgcccaggctggagcttgattgtttgtttgtttgtttgtttgaagacagggtcttgctcagttgcccaggtttgagtgcagtggcgtgatctcagctcaccacaacctctgcctcccagattcaagtgattctcctgcctcagcctcctgagtagctgggattacaggtgtgcaccaccacacccagttaatttttgtgtttttagtagagacagggtttcatcatgttggccaggctgatttttttatttttttaaagaaggtctcccaccagctggatctgagccactggctgagaagtgaagtccatgaagcattcagcaatagtaacagcaccaccacctcctcatattgaacctgcctctgtgcttcttcctacgccttcctatgcctctatgctgacttctggagaagccagtcacttgcccggtcacactgtacaaagtggctcagggctggactcactggcttatgcctgtaatcccaacactttgggaggccaaggtgggtggatcacttgaggtcaggagtttgagaccagcctgaccaacaaggtgataccccatctctaattagctggacgtggtggcaggcggctgtaatccagctactcgggaggctgaggcaggagaatctcttgaaccagggagacggaggttgcggtgagccgagatcacaccattgcactccagcctaggcgatagaccgagcctccgtcttaaaaaaaaaaaaaaacaaagtggctcagctgggcttggatctccaacatgctgggccccagtcaccagattcctaaccccgtgctgccaggcttccccggacaatatcatgaactcaacaatccgctcccttcctctgcagggcaacctctcattccccagagctcatttaataacaagagtagtaatcatagttaaccttctttaccctttactatgtgcaaggcattgttctagaagcgcacacatcgatcatttagtcctcacagcgctcccatgtggtaggtgctgtccttatactctttttgcagataagcccaaggcacaggagcctgcctggtaagcagcccatgtctaaagggcagtgaagaaccggcctctagggaatgcagggctcctcttgtacccagaggggaggcgccctgcctcttctctgttgagcctttggaaatggcctccgaggggcccctgctcagcacagctctgtgggccaagagcaggagtgtttgaggcacagatagacgatgtctggacccctccccaggatgcctccccatgtctgaccttggggagtccagtgccaagggggaagttcaataacataccaggtttctccttggccctgggacaggttccttccctttccttccctcctccctgcatccttccttcctttcttccttctttccttacatatttattcagtgccatacagcgatagcgcacacgtgttacctctaatacaaggtgaaaagtgatatgaatggtgcaaggtagagagaggaatggtgctgggagaggaacgtgtggtaggaggccctcccttcacatcctggcctcaaacctccagccggtggccttgggcgggtcgctcagcgtgtctggacctctgtttctcatctggataatgaaggagagggtggaggtgaggacccaggttgcctgccaggctcttgtgagaattggaggtgtaaaagggctttcttttttgtttttttagacggagtctcgggaggggggttagatggcgggagaggggttagatggcaggagaggggttagactagtcccctgggggattggttatggctgtgggggaagtcggagggaggctctggggatgtgtagggtttgggctcggccttaagggatgggtggaatttggccaggcacagatgggggaggggtggtgctttgggcatcaccagccctaggctcatggttgccaccctcccttccggtaccgccttcccttttctgcatttccacccagagatggactctcagctttgaattctttttaggaagtgactttattgtttttattttttttctctatctaaggtagtcagaatattatttttgtgataatgctagatgcttagtatgtaaaattcaagtacaatgggtaaatacagagaagaatgcagcaaatcaccaccactcccaccacccagatggaactgtttagttatttggtccgtatgcgtatagacacctcagtaggcctacccggtgggtgggagtgggagcatgggggctggagggccagaaagttttataagcacagggaaaatgcacagtttaaatttaccttcaggccagagttggaaagattgtctcacctgaaacagtccttcccttctgtccgctgcctacatgactgtatcggatggggaaagagggaatggggaactttcaggccatggccttcaaaacctccccattcagacaaattacagaaaaggagccagtctcagtgagcatattccagctctagaacagtggctttccaacttttagactaaaacctcagacacagacacccacacataactgaaacaaaagccttatgaaacccatattttagctgggcacagtggctcatgtctgtaattccaaacactttgggaggccgaggtaggaagatcacttgagcccaggggatcaaggctgcagtgtttgcagcgttgtactccaacccgggcaacaaagtgaaaaaagaaactcatgcttatcaactcatgcttatcattatgatacagaggcattctgatattttctaatctacacaatgctgttgtgtttaaaaaagaaaaaaaaagcttatcttaacctaccaaattgttggcacagcctgcagtttgagaaatgtcactgttgaccagcgattttcaaacgttcgtgtgcatcagactcaactgcagagtgtgctaaaacaatctgctcccctctcctgaggttctgagtcattagttctggagtgggacctgaggattcgcatttccaccaagttcccaggaggggctgatactgccagtctggggaccccactttgagacccaccctcctggggtgtttttaaggcaacatgctcccttggcaaagaccatcaggggatttgctttattgaatggatgagaattgctgattgctaacatccgaacggtggatctctgagatacttgaggatgctggtcaggcattgtcgttgggatctttaacaccaccctcctaaaatccagctcacactattaatataaagtgttgcatgtagaaaaggcctgctaagcaaagggacatttatgcctagccctagttgaattccctgcctctcaaatcccagacctgcagaacataaaaccctcccagcctttctgaaaacactgttcttctaaaggcaatgaaaggcgctatttagcatgtgggtttcaactttctgttttttcaaagggaagaaggtaggtcaagcgtgactgccccatggggaaggctgtccccgctggctctggtaggggtctggtgggtttcactggcggtccccagtttcccagctttaaccggaaattttcctggcattgtatcacgcggcagcacctcggccttgcagcctgccagctttggagactggcctgtatcccaaactgcttctgctctccaaccagggactgtcagcccccacccctaagcctcctcctctgtagccttggggcctccatgggcccctccccagcctcgcagccctccagaagccagccctcagctgggagcagctttgcgagggaggggaatgttcagtgggcacagagcacttctgttccagtaacaatggcccgttgatgactagattctgcccaggtcagctccctcaactggactttgaggaggagaaaggactccagcccccccaggcagccatttctgggtgtgaggttgattcagaggcctgagcctctgtctgcccacagaacctcattcttcaggccctggtgcagcagggagaaacgcccatcccagggcagtgtaaggccccaggagtgattccgttctgtccaattcaacagtcagttattgaatagtcctggccactgaggtttggtgctaagtagctgtggggaataagaataactgctgacatgaattcaatgcttcttactgtcaaccccgcccctggctgcccagtagtctctagggaacttataaaaattcccaggcacagattcctcccacctcagaatcttcaggggtgaacccttggcactgatattttttaaaagctctcagagtgattctcatgcccagcagggatgcagcatcactggcctccagtctgtcagatgctgtgctaagcatttaacttggagtaccccatttaaggaagcaggtgcttatgggatgctgaaatgtggcccccacagatgtccacgtatgagccaccagcacctgtggatatgtgagcttgcatggtaaggactgtccagatgggattaagttaaggattttgagttgagagattatcctggattatccaggagagccctaaatataatcacaagtgtccttataagagggaggcagaagatttgactacagaagaggagtgtcagaataatgcatggtgaaaaaaactatcagccattgctggtttgcagatggaggaagggggcatgagccatggaaagcagatagcctccagaagctgggaaaggcaaggctgcagactctccagaaggaacccaggccttttggcaccttcatgttaagtcagtgaaactgacctcacacttctgacattcagaactgtacgataatcagtgtgttgttccagctgggcacggtggcttatgcctataattacagcactttgggaggctgcaacgggaggatctcttgaggccaggagtttgagaccagcctgggcaacctgatgaaacccctgtctctacaaaaataaaaaaattagctgagtgtggttgcacgcatctgccccggctattcagaagctgaggtgggagaatctcttgaacccgagagattgaggctgcagtgggccatgatcatgccactgcactcagcctgggcaacagagcatgaccctgtctcaaaaaaaaaggaaagaaagtaagtgttatttgaaggtactaagtttgtggcaatgtgttacaacagcagtaggaaacagatacggggctgtcattaaccctgctttacagatgaagtacgggggccaggcagtcacctgggctcacccagctagtgggctaccgagctggaagaaccaggttgtccgaccccttcttcactgcccaccacacctcaccacactgccccctcttggcagtcagacagacatgggttcaatctcagctctgtcatcttctgtctgtgtgtcctgtgctgctggtgaggcttgtttggccagggggaggccccaggaaggggaggggtggagaccagttggaaagatagggtgggccaggttgtccccaggtggaagagtttggacttgattttggaggaatggagcccacagggcactgtctggtctcctctgccatatttcttgatgatgcctcagacccgcaggcctgctcagtctttgagatctgacataatgcagcaacccagctcccattgagaacctcaggattgggaccagaatcatcattctactccttgtcacccacagccagtgacagccatttatctgggacggccagtgagctcctgtttcccaggaagccagcagtggccctggtgcctccaaaatgtttcttccaagattctcctagaaccatgcatttgggaccatgcctttttttttgaaaaggagtcttgttctgttgcccaggctagagtgcagtggctcaatcttggctcactgcaacctctgcctcccgggttcaaacagttctcttgcctcagcctcctgggtggctgggattataagcacatgccacgatgcctggctattttttgtattttcagtagagacggggtttcaccatgttgttcaggctggtctggaactcctgaactcaagtgattcacctgcctcggcctcccaaagtgctgggattacaggcgtgagccactgcgcctgcccaagaccatgcatattttttagagtaaaagtatgaaatacaaacaaatacagagagttttccagatgaggcaggaaaatagggtctagaggcagggaatgtaaggccaatcacacttcagctataacaggaaataccctctccatagctcgtgctctgtaaatgactttgtaactttacttcatcctctccatttacatagggcgtacccaaaataacaaatggaatcctctagagggtatttaaactccccaaaattctgtaacgggccttttgtttgtttgtttgttttgagacacagtctcactctgtcacccaggctggagcgcagtggcgcaatctcagctcactacagcctccgcctcccaggttcaagcaattctcctgcctcagcctctcgagtagctgggattacaggcatgcgccaccgcacccagctaattattgtatttttagtagagacggggtttcatcatgttgtccaggctgggttcgaactcctgacctcaagtgatctgcccgcctcagcctcccaaagtgctgagattacaggcgtgagccaccatgctcggctgacggccttttgagctcctgtgctcgggccgccccacgctgtggagcgcactttctcagtaaatcccttcatcccttccttgctttgtgcgttttgtctaactctgtgttcaagacaccaagaacctggacaccctccacctttaacacaaagccacaccacaagttggtgacaggtcctgaaagatcagttcctgactaggactctgatctgtccactgctgtacagctgctcccttctggctaaatcagcttgctcagacacagagcatagtggttgaatttgtggactgtggagccaggcttcctgtgttccgatcccagctctgcctttaactcagggtaagttttctcatccccttgcctttgatggggatggtgactattatccataagcattatccagggttcttccaaagattaagtacatttatgtacatgaagtacttggaacaattccttgttcactgtgttaacttctgttactattcagctcctctagggcaggggctgtgtcttttccttcctgttcctagtgcctggttccatgcttggcccagagcaagtcctcagcaaatgaatatacttgtttcatgtgagcttttgtcactcagagattctttaggtactttcccaaaagcttgcactcttacaaatttccatcttagttcttcaaatctttcttctcctccttcctgccgcagaattgccatagagcagcctgaagcttgctctgccccttgcaaagtccagtgagccgttcaaagataacccagatgtcccaagcctcccagccagagtgcctgtgctgcgcagctggcgtggttgccccagtctccttcgccccaaggccatgcttggccgaccccctgacccgctgaggttgcgcagagctttttgggccctgtagcagcactgcttgggcaccaagccttgcatggtctcatgggactcactgcctgcagccgctagtcccagctcccctccttaccagaacccacaccatgttgtccagctgatgggggatcacatatcatgctattccctccaggatcctgtcccctgtttttctccccctgccatgaggagtagcatcctcatttagcctttccctcagaaagtccccacgcttatcactacacatgaatagatcccaggaaggtcactttctcatggttctgcaaaaagccaaactccagttgaggtccagtttgaacccaactagttcactcctctgccctagaaaggccatttctgctcaatcttactgccccacctctacttccaacttgcaaagatctcttgaaaccctgcctcctgttgtgggagctagttttcttttcttttttttccttttcattacacagtttcattttgacataacagtagattcacacgcaattttaataaattgtacagagaggtctcatgaatctgttacccacttccccctatggtaacattctgtgaaagcctagcctaatgtcacaatcagaatgttgacttcatacagaatcccctgtggtgcccttttataactacactcacttccctcctgcccccaccccttccttgacccttggcaatactagtctgttctccattcttacagttttgtcatttcaggaatgttctataaatggaattatgcagtgtgtaaccttttgtgattggctgttttcactcagcacagttccctggaaattcatccaagttattgtatgtgtatcagtgttgtttttttttactaagtaggtaaaacaagggacacagacctgttctcctggcatccctccctggttagcaagagattcagcaggccgctgccactctggccttgctgatagctagtgtgtgtgcaggcagcagctcccgctgtctgtaagagcgccagggtagtgaagttgggtgctctaaaagtagtggctctccatctttgctgattctaggttagaatcacctaaggagctttaagtaatcttgatgcccaggccacaccaatgcaatctgaatctggaggtggcacccaggcctcagtgatttgtaaacttctctggatgattcttatgctgtcagagttgaaaaccagtcctctaaaacagccgcagcagattcacaatagctgtgccatcctccacccatgatagatgtcacagagcaatcgcagcactcgtattttcaaatacggcgctccaggcagccccttcccatctgtcagctttggcccggggtggaaattgacttgccctcttagctgagaaaccgtttggccatggccatgtccaggtgtgcccaggcccgaggcctgacatgttaggtgagtgtccctgtaagtaatgctggaaaggtgggcccttgaccgataggaatagttgcagcaggcagagatcgcctggggctggttctataagataaacccgaagtggatcagccagtgtccctcccctgcagcccagcatggggagagatgtacccaagaaataccaaccaacagtgccattggcatagacgggctctggctgacatttgttcagaccagcaataatgcccagcctgtgtgcaatcttcccaattttcggagctcacacagcttccttgatgctcacaacaaccctgtggggccagcctaagctcagagaagttaaattcctcacccaacgtcagcagagagtaagtgggagagctgggacccactccaagtctgtccgagttcagggccatctgtccaacgctcagagcagttagacaattgacctctgtttccactggcagaccgagtgtagatgggctcctctgtggccatagatcagtcagaggatagcagcagacacatgcggaccaagcctcctgctgcccaagacccctgtggcccctctctccctaaccgctgcttctcctacagatctagtgcagagatgttggacagaacacaagaggttgaagtcagggcgggagcaggaaaaaaaaaaagaataagaagaaaagaggctggagttcctcctttcatcacaggaataaaaccccttcctgctgtcaatgggaccattaagtgggagtttgaggaagctccagaggattcaaattctgttgccactgtatagaaacagaggagaccgacgcagtgactcacatctgtaatcccagcactttgggaggctgaggcgggcagatcacttgaggtcaggagttcaagaccagcctggtccgcatggtgaaaccctgtctgtactaaaaatacaaaaaaattagctgggcgtggtggtgcctaactgtaatcccaactactcgggaggctgaggcaggagaatggcttgaacccgggaggcggaggttgcgttgagccaagattgtgccactgcactccaccctgggtaacaagagtgagactgtctcaaaaaaaaaaaaaaaaaaagacagaggaaatagaagtagggttggaagaaaacagggagcagaagaaattctcctctctgtcctgtcccttacttgatcattctccaggatcagaaagcctccttagaaggtcaggaaggaggatagagcaagaattagggatcctagacttatgcatggagagtttttctctacccggttatctcagaaatcctgtaatggagccgtctttccagaggtgcagaacaaaatgggaagctgtggccattgtgtagccattgaaggctagcccatggtcccctcacagcttccatgggcttctcccgagcatgtgcacgtatgatgcacccattgcatgtatacgtacatgcacacatttctggtcaaaaggttgatgattgataaaactgacaaaagctccaaaccccacaaatgagcacagcgttttgtaataatgagcatgaccaaaatgggaaaaaatagggcacatgagggatgagggaagaaaaaggactccagggcccagaagattcctaggcttccttagccacctcctcctaaagtaggggtaataagtacatggcacatgtgccagcccttcccctgtgatatagttgggatatttgtccgcacccaaatctcatgttgaattgtaatccccaatgctggaagtggggcctggtgggaggtgtttgagtcatgggggtggatccctcatggcttggtgctgtcttcctcatagtgagttcttgccagatcaggtcatttaaaagtgtgtggcacctccccattctctatctctcattcctgcttttgccatttgaagtgcctgctcctgctttgctttccgccatgattgaaagctccctgaggcttcaccagaagccaagcagatgccagcaccatgcttcttgtacatcctgcagaaccaagagccaattaaactgcttttctttataaattacccagtctcaggtatttctttatagcagtgcaaaaacagcctaatacaccctatctatacacacagcagacatcactactcaactgccatgttctttcccacagaaaacaagcctgatctcaggattcttctcatcaaagtgctccaggctgccaattaccaacctattagcttttactcatgagatgaaaatgatttgccaggccgggtgtggtggctcacacctgtaatcccagcactttgggagtccgaggcaggtggatcacttgaggtcaggaattcgagaccagcctgaccaaaatggtgaaaccccatctctacaaaaatgtaaaaattagccgggcatgctggcactcacctgtaatcccatctactcaggaggctgaggcaggagaatctcttgaacttaggaggtggaggttgcagtgagctgagattgcgccactgcattccagcctgggcgacagagcaaggctctgtctgacagaaagaaagaaagaaaaagaaaggaaggaaggaaggagaaaataatttgccagcctcagcttgagcccaggagttcgagacaagcctggacaacagggaaagaccctgactctccaaaaagctttttttaaaaatagcgaggtgtggtggcacatgcctgtgatcccagctatttgggaggctgaagcaggaggatcacttgagtccaggaggttgaggctgcagtgagccatgatcacaccaccgtattccagcctaggcagtggagcaagacccgtcctcaaaaagaaaaaaaaaagttggaaacctgatacagtcaccatttttgtcaggatccctcttgcttgttctgggttaggttcatcacaaagctgcttagatggacttggttattcaagtaaatattaagcgctaactgtgtgtaggatgatggattgggacacaactccatatgctttttatttccattatttttataactttctcttatattgatattttagtaacatggtaacaaatttaaacaatagaagaaagtagaagttaaaagtcagtgacagttcccacccattccccagttccctcaaccactcttgtcaatctcttctttccatctccaaagatatccagcatttgcatggatccagtccagtttgtaggcagttggtagcatgccacgcatactcttgcccttgcttttatcactcatgtcttgaacagcattttatgtcagccctccagaacttcctctttctttttaatcattacagagtattgcactgataaatgtacctaacattgagctaacaagttgctgttttttgttttggttttggttttgcctattaacatgcattaatgtcatggttagccttttgtaattataatcgatttattgttgtatatgtccttgttgtatccatgcaaatatatcagcaagattagttcctagaagtggaattcctgggtcgaagagtgttatagcagtcctttggggctgctataacaaataccatacactgagaaacttacaagtagcagaaatttattgctcatggttctggaggctgggaagtccaaaatcaaggagccagcagatttgatttggggagggctgctctctgcttccaagatggcacctacctgtggcgtccttacctggtggaaggagcagacaagctcccttagggctctaataatttttctttttttttttgacacggagttttgctcttgttgcccaggctggagtgcaatggtgtgatcttggctcaccgcaacctccacctcccacgttcaagcaattctcctgcctcagcctcctgagtagctgagattacaggcatacgcctccatgcccagctaattttgtatttttattagagatggggtttgtccatattggtcaggctggtctcaaactcccgccctcaggtgatccacctgcctcggcctcccaaagtgctggaattacaggcatgagccaccatgcccagcctctaaaaagaacactaatcccattcatgagggctccacactggtgacctagtcacctcccaaaggccctacctgttaatgccagcacactgggattcgattacaacacaaaaattttagaggggcacaaacattcagcccatagctaagagtatgcatatttaaaacttgtgatggtttggccaaatcatccttcagaaaggacactcccatgaacattatgtattaggacgggacgggctatgctgtaggaacaattagtcccccaaatcttagtatttaacacagcaaaggcttgttttttctcttgcgtcacatctgatgcagatggggtggctctctaagcagcatcccagggatccaggctgcttccattgtgaactaagccagttggaacatgtggcctccactgttgccacagccaggggagagaggcctggatgaatgtgtgggaaaattttaagcaaagtggcttacatcactttcacccacatcctacctgtcagaaccagtcatatggcctcagcctgactgcaaaagagtctgggcaatgtggaggagcccctggccactcgatgagcctcacgtctctgccagtcggttccccagaaattcacccacacagtatattccagggcgttttgttcttcgctaattaaatatatgaaaaatggcgtcatgtagactgtcgttctgccctgcacgtctgtgctttctttgggcagttgccctccgcctttttctgctgaaatattcataggggattatgttcactccagacacactccagtggccttccccaaattttcccaaaaccccaaaaccttttgtggggaagccctaagacattctatattttggctgttacaggcatacctcagaggtattgcaggttcagttccagaccactgcaacaaaattaatatcacaataaagcaaatcacacaaatttttttgtttcccagtgcatataaaatttacatttacacggccgggtgcagtggctcgcacctgtaataccagcactttgggaggccaagtcaggcggatcacctgaggtcaggagttcgagaccaccctggccaacatggtgaaaccccgtcactactaaatatacaaaaaattagccaggcatggtggcaggcacctgtaatcccagctactcgggaggctgaggcaggagaatcgctggaacccgggcggcagaggttgcagtgagccgagatacatgccattgcactccagcctgggcaacaagagcaaaactctgtctgaaaaaaaaaaagttacttttatactatactgtagtctattaagtgtacagtagtatgtctaaaaaaagtacataacttaaaaatactttatttgctgaaaaaaatgctaacaatcatctgagactttagcaagcgacttgtagtctttttgctggagagggtcttgcctcaatgttgatggctgctgactaactgctgaagagtagggtggctatggcaatttctttctttctttttattttttttgtttttgttttttgtgttttgagacagggtcttgctctgttgcccaggctggagtgcaatgccacaatcatggcttgcagcagccctgatcaccttggcaatgccccgacctcagccttccgagtagttggaaccacaagtgcatgtcaccacacccagcctatgtttttattatttgcagagacacagtctcactatgtttcccaggctggtctcgaactcctgggctcaaggagttcctgggcccgcttgggcctcccaaagtgatgggattacaggtgtgagccactgcacccagccacaatttcttaaaataacacaacaataaagtttgctgcatcaattgactcttcttttcatgacggatttctctgtagcatgcaatgctgtttgattcacagtagcacttctttcaaaattagagtcaattctttctaactctgctgctgctttatcaactaagtttatggaatattctttttttttttttttttttgagatggagtttcacttttgttgcccaggctggagtgcagtggcacgatctcggctcactgcaacctccacctcccagattcaagcaattctactgcctcagcctccagagtaggtgggattacaggcgtccgccaccacgcttggctaattttttgtatttttagtagaggcagggtttcaccatgttggccaggctggtcttgaactcctgatctcaggtgatccacctgccccggccccccaaagtgtggggattacaggtgtgagccaccactcccagacaatttatagaatattctaaatcaagcttgtccaacccgcaggccacgtgcagctcaggacggctttgaatgtggcccaacacaaatttgtaaattttcttaaaatattatgagattttctttgcgttttttgtttgtttgttttctcatcacatatcgttagttgttagtgtattttatgtgtagaacaaggcaattcttcttccagtgtggcccaggaaagctaaaagactggacaccctgctccaaatcctttgttgtcattcacagcatcttcaccaggagtagcttccatctcaaaaaccactttcttgactcatacataagaagcaactcattcattcaagttttatcatgagattgcagcaattcgctcatatctgcaggcttcatgtctaattctagttttctcttattacttccaccacatctgcagttcatttctccactgaagtcttaaacccctcaaaatcatccacatggatccacttcctccatccacttcttagcatccacttcttctaaattagcatccacttcttccacattcctattcatgttgatattttcacctcctctcctgagtcacaaatgttcttactggcatctacaatggaaggttttcagtttactttgcccagatccaacagaggaatcactgtctattgcagctatagccttacaaaatgtatttcttaaataatgtaacttgagggtcagatatggtggttcacgtctgtaatctcagcactttgggaggccaagggaggaggattgtttgaggccaggagttcaagaccagcctgggcaacatagtgagacatctctacaaattaaaatttaaaaattagccaggaggccgggtgcagtggctcacatctgtaatcccaacactttgggaggctgaggtgggtggatcacctgaggtcaggagttcaagaccagcctggccaacatgatgaaaccctgtctctgctaaaaatacaaaaattagccaagcgtggtggcgggcacctgtaatcccagctacttgggaggctgaggcaggagaatcgcttgaactcgggaggcggaggttgcagtgagccgagatcacgccactatactccagcctgggtgacaaagcgagactccattcaaaaacaacaacgaaaattagccaggtgaaataccatgcacctgtagtcccagctacttgggaggctgagacaggaggatcacttgagcccaggagtttgaggctacagtaagccataatcatgctactgcattccagcctgggtgacagagtaagaaaaccctgtctcaaaaaaaaaaaaaattaattaattaaaaaacagacttgaaagtcaaaattactccttgatccatgggctgcagaattaatgttgtgttaacaggcatgaaaacattactctcctcttacctgtccatcagagctcttgggagaccaggtgcattgtcaatgagcagtagtattttaagcagtaggtgtcaacagtgggcttaaaatattgaataaatcatactgtaaacagatatgctgtcatccaggcctgttccatttacaagcacaggcagagtacatcttgcttaattgttaaggtccctaggagttttagaagggtcaacgagcattggcttcagcttaaagtcaccagctaccttagcccctaacaagagaatcagtctgtcctttgaagctttgaagccaagcattgacttctcctctctagctatggaagtcctagatggtatcttctttcaatagaaggctgtttggtctacatcgaaaacctgttgattattgtagccaccttcgtcagtgatcttagctagatccttgggataacttgctgccaattctccatcagcacttcctgctttaccttgcacttttatgttatggagatgtcttctttccttaaacctcatgaaccaaccaacgctagcagcttccaaattttctgcagcttccttgtctctctcagctttcctagaattgaagagagttagggacatgctctggtttaggttttggcttaagggaatgttgtggttggtttgattttctatccagaccactcaaactttctccatatcagcaacaagtctttttcacattattataatttgtgtgttcactagagtagcccttttcatttccttcaagaacttttccagccgggtgcggtgactcacgcctgtaatcccagcactttgggaggctgaggtgggcagatcacttaaggtcaggagttcgagaccagcctggccaacctgatgaaaccccctctctactaaaaatacaaaaattagcctggtgtggtggcaggcacccgtaatcccagttacttgggaggttgaggcacaagaatcacctgaacccaggaggtggaggttgcagtgagccgagatcacgccactgcgctccagcctgggcagagcgagagtctgtctcaaaaaaaaaaaaaaaaaaagaatttgtctttcgcactcacagcttggctaactgtttggtgcaagaggcctcacttttagcctttctggctttcagcattcctgcctcactaagctccatcatttctagcttttgattttaagcaacaaaagcgtgactctttctttcacttgaacacttagaggccatggcagggttattaattggcctaatttcaatattgttgcatttcaaggaacaaggagaggcctggagagagggaaagagaccagggaatggctggttggtggggcagtcagaacacagacatttatcgattaaatccattgtcttctatgggtgtggtttgtggcaccccaaaacacttacaatagtaacatcaacaatcactgatcacagatcaccataacagatataataataatgaaaaaatctgcactattgcgaaaattaccaaaatgtgacacagagacacacagagagctcatgcttttggagaaatggcactgataagacttgctcaagacagggttgccacaacctttgatttgtagaaaacacagtatctgtgaagcataataaagcaaagcacaataaagtctgtcctgtttgtattcacaaaaacatataaaggcatgtgagtaataatataaaattagctgggtcaagatcgttgccagctgtggtgtggaatggattggcagcagttctgtgccatttcccaggctctctgtgcctccacctcctccctcattcatgaaagacaagccaagcaagggacaaaggtatacaatagttgctgtaaatgtccctatttcacctatgagaaaactgtactcaaagaggtttaaattccttgcctaaggtcataggacctcaaagacaataagcaaaagcaaggaaactgaacgcactcatagctacacagagattcattgctaactttgtcagacgttgtgccaagactctctctctttctctccctctctctgtctctctaccaacccccccccaacgtatgtgtctctgcgtgtgtgtgtgtgtgtgtgtgtgcatatgcatgtatacacccacttttttttttataaaatagactgcaactggagatactggtgtgtcctattttttggtgcagcgtcataacataagcatctttctaggcaataaattaactttatgctggccttcttttttcagtggagtattaattaagcatcttgtatgtgcccaatattctgctggttctgggggaagaaggccagcctacaggaaacaacagctaactctttaaggcagtgcataagtccattcatttgcttcacaaacattcattgagccctgccacgtgccaggcactgtgggtatcgtggagaacaagactactgtccgaggcaagagctgggctcctcctagcttcctctgtccccctaacctcctctcacccacaggcattgctgggggtattttcctgggttggttggtttgttttgttttttgttttgttttgttttgtttttttgagacagggtctcactatgttgctcaggatggtctcaaactcctgggctcgagcaatctcctgcctcggcctcaccgtgcctggccgttgtttatttatttattgtggtcaaatgtacatagcataaaattgaccgttttaactattttcaagtgtacagttcagtggcactaagtacattcacactgttgggtaaccctccccactcttccactgcagaacccctttcatcttgcagaaccgaaactgtccccattaaacatcaaccccccggcccttcatcccagcccctggcagacacccttctgtctgcctctatgattttggcgctctgggtacctcatagataagtgagattgtatagtatttctcctttggtgaccagcttatctcaccaagcgtgatgtcctctgggagcatccgtgtggaagaggtgctagcatcattttgacttctcaaacatctcgtgggtgtcacctccccctctacctctctgccactgcctcgctcagccacctgctctctcctggacccttgcagaagggactgactgggctcctggcctccagtcctgccctcttctaatgtatttttcataccacttccaaagtgataatacattcctcttttgaaattttagatttggttactaaagcaatacaggtgtatggttaccaaaaattcaaacagtgtaaaagagaataccagcctgggcaatgtagagagaccctgtctccataaatttttttttttttttttttgagacggagtcttgcagtggtgggatctcggcgcactgcaacctccacctcccgggtcctcattcaagcatttctcctgccttagcctcctgagtagctgagattacaggcatgcgccaccatgcccagctaatttttgtatttttagtagagacggggtttcaccatgttggccaggctggtcttgaactcctgacctcgtgatccacccaccttagcctcccaaagtgctgggattacaagcataagccaccacgcccagtctccataaatgatttaagaaaaaatgtagccaggcgtagtggcacgtgcctgtgctcccagctccttgggaagctgaggtgggaggattgcctgagtgtgggatgtcgaggctgcagtgagccaagatcatgccactgtaccccagcctgggtgacagagtgcgaccctgtcccccccaaaaataaataaatcaaagggcataaggtgaaaagaatcgtaacattatgtttttgtagctctgcctctgtgatggtgccccctgcatggcttgctttcactgtgccaatgcaccacagttacccagcctgccggctctgataagatgctcgccatgcttctcccatgctggacttgggccacgtccttgggcatgaatcttggtctatgtccaggtcggttctgaatgagccagcagactcctcccggggctgcccggctacatggttgagggcatcctggacaccagcttcagccacagctcctgaccaggcaggtgcagtgaagccgggaggtgtaggtcagttcctacctctccaacctgaggtcctgcacttcctgcagctgttggaagggatcgtatccaatgggagcaagaaagtgtgctcccccacagccccactcaggcataaagggccgaggggcagccaggcctgtcctggctagggctggctcagagtctgtggcagccccacccctgccaggctggcccttagccccaagatccacctatggcactcgcccctttacagctacgtggacatccactgacactcaggtgacacacctttgcctgcttctactcagtcttggcagcagttggacaaaaggaaatcaaagatcggttctttcttgggagaggaagagcaagctggagccctggggtgctcagatgctcttgggagtaacatagccccatagccccggggctatactgggtgcaggggggtggaggtggtgggggagctgcagccaggcattcattcacttcccgttctttcattcctgctcttcttttgctcactgactcattcagcagcctctgggctgggcgtttactctcctgtcaggcaacacactcctgattgggtggccttggccttcccaagctgtctctggctgtccccaagtgaaacggaatctgggctggacaggccaccggatggacaagctcttctcatctaaaaccaaggcagttgacattgtgggctaaatgataagaacaaaattaaaaaataaaaaccaggcaggctggcataggagctccatttccctgccctactgtgccagtggcctgggggctcccctgccgcctctctccactctgcagattctgagaaaactcacaaaagagcccactccaaggtgtttggcaacaaggtgggggcagcctcccagcacccagcacacatggagctttcccgcagtgggtttcagcgctcccactctgcctcggagctactctgtcaccagctcttgccctcccttggctcctctttcccatgcagctcctcctccagctcgtgggaaaggccgagaggccgggccagcaacagctgagcatcccctcaacctctccctaccccaccccaccccactgtgctcttggccccaggcaggcgaggggagtggagttttgctgcctgatgcaatgtctggcagggccgtcccttatcacagccgacttgctgggacccccaccttccccggaggaggccggaacaggccgcagtccattttgggcctcagtggaagggcctggttggaggccatccaagtagaaaactcgttctctgggaggcaccttgccaagtcacgagggaggcctgagcagaaagacccctgggggagagaagggagggaagccgaagcctcacttgctggggcttgcctggcctcagctcgcagccccctttttccacagcgttctctccctcacatttgtctgcagatggcttaggctgttttctgccctcccccttgttaccccacagctgtgagaggctggatggaaacaagaattcaagagactaaagttatgtgcggtcccaagtgtgaagttttgcccacagttggtggccatggttcgcaccgtggtcccagcacacgccctcagcatgcacctgtggcccacacgctcatgctcacagccactcatgtatggagcaattgcctttttttcttcctcttcatatcttctgtcaacttagaacgattaagcatcttgcagtaggctcaatgctttgggaaggacattgattcgttcattcattcattcattcattcagcaagtatttatgaagcacccactctgtgccaggtacagttctgggcactggagatgcaagggtggagcagacagatgaagctctcctctcccggagtcaacgttctgggggatgagaggccatcagcaagtgcatttccatctatgaagggagtaaagcagggcgccaagagggaaagtgatgggggtggcccacattaggtcaggggtcagggaagtactccagagctgggggggcatttgagctgagtcctgattgcttagaaggagccagccagagcagatctggcccgggcagaggtaccagctgatgcagaagcccccaggtggggagtggcaggaagggccagggtgggggtgttgggagaagaggtgggaagggtgagcagggtctggatcttgaaggcccttacagggcttttattttaccaagtagtgcatagagtgtttgaagcagaagctgccttattgtctgtgcctccgagaagtttccatgtggctgagaagctgggtggcagcacagttataatcagtgctcaggtgttcccctgtctgggtggctgcccacatgtgatcccatagaagaggctgggcctgaggaagccagggaagcaggagggggtgtggggaggccagcaggggtgtgggcctcagcggggagggaggaggtgatgcagcatggaagatgagaagcccacaccagccacactaggcccccaggagattgtggacgccgtcgggagcattattcggtggaggggtgcggggcagaagccagatgagacagctgggaggtggcaggcaggtgagaatgtgagacagagggaggacagtgatttgagaactgtatcgtaggtgggataggagtccacatcccagccagcacctagaaggttgggctggctctgcccagggcctggcacgtggtgtgcactcaccagatggtcgccgccctgaaagaactcagcactgtgcctcttttcctgcctctggtgtttgctgtcaatatgcagagtgctggacaaaactgggccaagggagctgtcccactgcctgctgccctcaagcagagctgacctggcacatgcctctggcatacttcctgttggccctggcaccctgcaaagaggcccccagtgggcccaagcaggggataccacccgttccttgggctgttatgtagttgctggggcattgaggggatgaaaggtttttttgttttttgggttgtttttttttttgagacagagttttactctgggtgcctaggctggggtacaatggcatgatctcggctcactgcaacctccacctctcaggttcaagcaattctcctgcctccgcctcccaaatagctgggattacaggcgaccaccaccacacctggctacttcttgtatttttagtagagacagggtttcaccatgttggccaggctggtctcaaactccagacctcaggtccacctgccttggcctcccaaagtgctgggattacaggcgtgaaccatcgtgcctggccggatgaaaggtattgagtactaggggctaggagggaccaagagaaggaggaagagatttttcggttctacccatgaactaagcaagggaggcaggcctagcccttgcaccatggaagtgggagagaagtgatacaaaggtgtatctgatgtcacaggtgtcacaggcctgcttcttgtaaagggcctcctgcatggtgagttctgcgtggggctttgctgagtaacccccatccgggctctatccccttccctcatggccctgtgacttcctggcaccatgaccctctccccgcttctggctctgggaagctccaaacctctctcacctgcctgcccacctgcctgctaggtttccaaagctaaacagaggggcagctgtctgggcagggcaagggagccaacagcctgcctgggtttcctgtccaagtgtccagctttgcttcttcctcttagggcagcgtcaagaaggatcttaggaaagctgtgttgctctggggatgaggaggctggaacagcaacttaaaaaaagaaatagtccctggaagggagggaaggagaaggttcagaggcttgtcatttaggcaccccaacttctataccttaccaaggtgccaggcccagagggaagggggtagccagggcagctccccgacccgcacctgccttttcacccctctcctatttcacaagcatttaccatgcatcaacagatatgttcctcacagcacctttatcagcagggactgcccttttcatgctacaaacaggcccagagaggttgtcacttatacaaggttgcacagcatggtagagacacaggaaggactagagcccaggacttctaaccctagctccttctgcttccctcacatcatcagctccagacaacctgagattggagaggacagaaagtcaggatttcaacacctcgtactctgaaaactcagtggtggttctcaccctgtcagtggggcaggtggcctcacaccccaccacaggctaaacagggtgcatgggggacgtagccccactggccattctacacattcatgccaacagctaccaggcaccagcctcaccattgatttttggacagctggtctgtgccaagtgccattctagatgcgagtcccgactttggggtgcttgcattctgggaagggagatggtcagccagaaagccccaccataggagctaggttgggggtccccaaggtacaccaagaagctcaagtgacctggacctgggaggggtggccagaggcttctgctggaggaaccttaggtcagttacctaacctgtctcaacctcagtttcctcacctgtaaaatgggctagttgctgcctcacagggctttgctgaggatttgatgagtgcaagtgcttagcatggcacctggcacagagaaatatgcactcagtaaacttaagctgcccatatcattggttggccctcccaaccagagtgcaagccccgggagggcacagaccatacctgcttgttcaccgccatattttcagtgcctaggccagaagccagcacaaggtaaatgctcagaaaatattaacttaataagttcatgagaaaaggcccaggaaaattaggaagaggcaggactattccagttaggaatagactctcctatgccaggcacagtggctcacacctgtaatcccagcactttgggaggccgaggcaagcagatcacctgaggtcaggagttcgagaccaacttggccaacatggtgaaaccccatctctaccaaaaaatacaaaaattagctgggagtggtggcacacgcctgtaatcccagctactcaggaggctgaggcacgagaattacttgaacccaggaggcggagattgcagtgagctgagattgcaccactgcactccagcctgggttgcagagcaagactctgtctcaaaaaaaaaaaaaaaaagggaatagactcttctttctgcagctgtatttgctctagctgtaaacaactttgtagccaagtgcagtggcacacctatagtcccagctactccggaggctgaggagggaggattgcttgagcctaggagttggaggccagcctgggcaatatagcaagaccctgttagatattatctatttagataataataatgacctgtaatcccagtactttgggagaccaaggcaggtggatcatctgaggtcaggagttcaagaccagcctgggcaacatagtgaaaccccgtctctactaaaaatacaaaaattagctgggcgcagtgatgcatgcctataatcccagctactcgggaggctgaggcaggagaattgcttgaggcagaggttgcagtgagccaagattacgccattgcactccagcctggacgacagagcgagactccatctcaaaataataataataataatgatacatactatttcagtcgagggtcattttttcctttatccatctgttgttcaccaactgtgtatctcttgcctggcccaggattgagagataatgaggggcccagatgaactccctgtcctgcctgaagggatgttcagtattgaacaattgttgctttatggctttatgacaaagtcccaggtgctcatgataatctttgtacagtggtggggctgtagggagccctaacatagcctgggggaggctgcctagaaagtggagacctgaaggctgaggccatgttaaggatttaggtagaatttatgcgctatgatatttttttctttcgttaattttttataatttacgtatacacatggtaaaatgtgtaacaaggcacagtgttacatagcaaacataagcctcactccaccttctctctccacctacctgtccaccttctagatgcagccattgttaccaggccttgcgttttcctgcagccagagtccatttgtatcccgcatctatattttcttcccggcatttgtttctgaatgggagcttgctacatcggagtctctccaccttggatgatttgtcaccccccaccttcccaccccaggagacacttagcaatgtctggagatatttgatggttacagatgagcagtgggggccaggcgtggtggctcgtgcctataatcccagcactttgggaggccgaggcaggtggattgcttgcactcaggagttcaagaccaggctgggcaacatggcaagaccccatctctacaaaaaattttaaaaattagctgggtgtggtggtgtgcacttgtggtgactaagggggctgaggtgggaggatcaattgagcctgggaggttgaggctgcagtaaactatgatcgtgccactgcactccagcctgggcaacatagtgagaccctgtctcaaaaacaaacaaacaattattggcaattagtgggtagaggccaagactgctgtcaaacattctataattcacaggacagtccccacttacctggtggaaaatgtcaacagtgctgaggttgggaagccccgtcctgcataagcacagggtctgcacctttgtgtgtgtgtgtgtgtctgtgtgtgtgtgtgtgtgtgttctcatgtattttctggatcattcacatttatacatccacctcattattctttgtggccacataaaaatccattacctggatgctccaccattttcatttaggtgtttgcactctttttgctattataaacatttatgctacaaaggttattcttttccgtgcacaggcctttgatgtgtgaggtcaagggagaaactgatggaggtgggatggatgaacccgatggttcattagcattttaaatgacctattaaagagaccttcagtgtctctggggcacagtctgtctggagagtgggtctggggtcctggctgctaaccagggccgagatcctcaaaagtctggtggagagacatcctctgcattcctcgtgtacagacaagggtgttctgaccacctgtctctccgcaggacaagggtgtcccccacctgaagacggcaagctgggtcctgagtgatgcccctcagctgagtgtccaaggctggcccgaggagcccccacggccccacctttccccatggagaaaggactcactttgccccaggactgccgggactttgtgcacagcctgaagatgagaagcaaatacgcccttttcttggtttttgtggtgatagtttttgtcttcatcgaaaaggaaaataaaatcatatcaaggtgagggttgcaagcccaagtcttcatcttcctttcaaggtggggtgggtggggacagggaggtaactgcagggctctctgtggacctgcaaatgcattccttcaacgagccatccccaggccccttctatgtcccaggcagtggctcctgcacacgtcctcatgactgcacaggggtgagacttgggctctggactcaaacagcctgggttggagcccccccatgttggccctctacagctgtgaaaggttagacaagatacttaacatttctgagtcttcggttcctcttttgtaaaacatggctaataatgggaccagcattgttgtaaagattaaatgagaaaatgtaaaagcatttagcccactgcctggcacatagttggtgtccagtatttgctggctgtgactattactgttaatttacctcctggccttgcattagcagcacatcccctatagaagtcttgatgtcactgagcccatggaaaggcaaggtcctagtatggatactctgatgggcaaggctgccaatgtgcagctgccaagttgtgtactgctcaactccaggggcatgtccctcaaataggctaatctgggaacgcccctttacccctttgaattggcagcatacagctatgtgcagtgggcctgttagatgtagaaagatttcttagcctgttctcctcccaggcacaagccctgcaagaaagcattagctaagatgggtgggtcagggattgggcaatatagtggacaccgtcaatccccccccttgggtcactgagcaaggaccgttctagcttgtgcctattgggttctactgcaagcccctacagctctgcacctgagagctttctctccactggcacactggcaagccggaagtactagggagtaactgtcccccccagatccccatcagactaagcctccgatgcccacacctgctcctagcagcacatccatcatgcacctctttcctcccctgcctcacttccccatccagtacttcctgtgatcatgtcccaaataaacttacttaaacacaaatccttgcctcaacgtctgcttttggggaaacccaactgagacaggttttggtgatctgcttggaggactgcttagggttgcccaggagacggggtccccagtcagccactgaccctgatcttctttgtcctcacagggtctcagacaagctgaagcagattccccaagctctagcagatgccaacagcaccgacccagccctgatcttagctgagaacgcatctctcttgtccctgagcgagctcgattcagccttctcccagcttcagagccgtctccgcaacctcagcttgcagctgggcgtggagccagccatggaggccgcaggggaggaagaggaagagcagagaaaggaggaggagccgcccagaccggccgtggcggggccccggcgccacgtgctgctcatggccaccacgcgcaccggctcctcgttcgtgggcgagttcttcaaccagcagggcaacatcttctacctcttcgagccgctgtggcacatcgagcgcacagtgtccttcgagccggggggcgccaacgccgcgggctcggccctggtgtaccgcgacgtgctcaagcagctcttcctgtgcgacctgtacgtgctggagcacttcatcacgccgctgcccgaggaccacctgactcagttcatgttccgccggggctccagccgctccctgtgcgaggaccccgtctgtacgcccttcgtcaagaaggtcttcgagaagtaccactgcaagaaccgccgctgcggccccctcaacgtgacgctggccgcagaggcctgccgccgcaaggagcacatggccctcaaggcggtgcgcatccggcagctggagttcctgcagccgctggccgaggacccccgcctggacctgcgcgtcatccagctggtgcgcgacccccgggccgtgctggcctcgcgcatggtggccttcgccggcaagtataagacctggaagaagtggctggacgacgagggccaggacggcctgagggaagaggaggtgcagcggctgcggggcaactgcgagagcatccgcctgtccgcggagctggggctgcggcagcccgcctggctgcggggccgctacatgctggtgcgctacgaggacgtggcacgcgggccgctgcagaaggcccgcgagatgtaccgcttcgccggcatccccctgaccccgcaggtggaagactggatccaaaagaacacgcaggcggcccacgacggcagcggcatctactccacgcagaagaactcctcggagcagttcgagaagtggcgcttcagcatgcccttcaagctggcccaggtggtgcaggccgcctgcggccctgccatgcgcctcttcggctacaaactggcgcgggacgccgccgccctcaccaaccgctcagtcagcctgctggaggagaggggcaccttctgggtcacgtaggggggccggggccccgtatgcccctcctcgtgaaaggcctgccccgtctttctgccgcagccctcgcagagggcgggtgcacagcgccatgagcgggcagcgcctcctgtagcagtagggcccccagccagcgctccagccaaagcggcggccccagggttaattgcggagaacaggacagtgcccggtccccttgagggccatcacacccagacccaacgggttgcagcctcctgagcaggcctaggcaggcccgggcctgttggcaagcttcgatctcacacacacagaaacatacattcgtgcctggagaccctgcaggccagagtccaaatatttaacaatcagaaggggcaaggctctgaccagtgacagtcagacctcctgctttatttggtgttaaccgtttcttgtctggatggtgaagtctggaatctgggtgggtccttggaggaggggctaggacagccgtgggtgtcaaaggtggcatttgaggctcgtttgaggtgacagtggctgtttaccaactagtacagagcgattcagcgttttcatgaatgggttggctgtgctggttactgatgaatatgggccccttatagagctgcaaaacacacacatgcgtatagacatacatacatgtacaccatacatagacaagcatcataaaggcacaagtgcacacacatctatgcagacaagcttcctcgctgcttatgcccacagggtttttctgtatgacacacctcagaggagcctgtgcttaacatttgtaggattatttcgagggcagggcaggggaaagaaacgcgttaaagggccatgacatgacacagttccctggccgggtttggactgaacagtggattcagaactgcagcgttcaaagcccctgcccgccttagattctcatggctacctcctctgacccatccacatccttgcggctggcaggcaggatgttttgaaatggtgcagccaaaggccccgtctagcttggctggctcccgaacatgtccatatttgaaggctgcctcaggcctggcaggcagaagcagctgtggtccctggaggcaaaaggcagctcacggggccttccatttccagccaggcctcatctggggtagggccaagaggaaagtacagagtgcccgtgggggagaagtcccaccaggatgccccccctcccctgagaagcccgccttctccctcgtggacaggagtcagccagttggttgctgtggttacagccagtgcctggaattcctccttagggccctgggaagagtattgcttaacgcaggatgtgctgggtgttttgtttcgggcttttatttatggcttggtgtctttcttgtttcatggctgtgtttttgcttttgtttctgtaggagcgcctcttccaagcagtggaggcctgagggcttgagggaggctggggaaaaccagcagggagcacttggctcctggcagagggagaggacaggaggaggagccttccccaggaggaacgaggagaggtggccacgtggcaggccacagtgccctatgggcttttctgtttgaaccccatgtgggatgaatctcaaagccaccagcgttcttgcctagtgtccagagcagcagagatttgcagccctcgcccctccctgagaagaagctggatttgaaaatccctcacaggccctaacatgtttcctgggtgggcaggggcctcatgacaagcgacaagtgtacccagagtagaaggccttccccactcccacctcaaacccaggagcagaactcagtatccagagcttacaaggagctgcaagggtttgccgagggctgcccagctctgcttctggtttcctggacaatttctctgtcagatacggcccattgtaaacccagagggctgcattttgggttgagtaatatggacaccatggaagtacaggatctgagtccaacattgccatgggggagggaagagtgtgtcctggcaggaagccaccattggagaaggtgaggccagtaaccatctcatgggattcgctataatcagcctatttgagctgctgggtctctgtcactgtggactccagtcattcaaggaggtctccactcttgggttttttttattttcttttcttttgctattttgcctgaacaccccaacactcttggttttagagtccaagagtaagttgtgcagagacatggttctaatttggagttcaaaggaacaccagctctgaaaacatgaccgtggggccaggatgtttctggcaggcccagaagtgctggccgttcttccccagcctccccactgctccctcctctgttccccatgtggaggtcggaggggctgggactggggagggggcagccacctccatccaaggctcttcctaggggccctgctaatgtggacagtagactttatccctccttcttactctgggccaagacctcccactccgccctctgaggatggtaccaagaatgggcctttgggacttctcaggacattgacaatgtgcacactgcaggttgacttaatttatttattttttgaaaagaagagacagaaaataccttattatctgcagggactcaaagctgtacccaaatcaagaaagacaaaataacaatagaaaccattcacacactccgttcatgcatggacaccagaagacgattcagaacacaagaggagaatgagctggagcgccagcaccacgatggccccaggacgttgtttaagatctgagatcccttggtttctctcttgttgatctgagatgctacatcagggcccttgctgctgtattacctctgcccgggtgtttgagacaggtcacaagcgcgtggatgtttcctggaagtgtattcccctggggctcagcgatgctctgggaacccttggggtttggggaaggacagtgtggtgtgactattggcttgaaacgttatggatatggttggagtcacccatgtggatatgattttcagcttggagctgggatggagaagatggaagcactggtggccgggcctctttttccagcgaggccagccctggcttctcctctgttccagcttgtctgccagaagccttcccctgcaaggtgcccacctgcccggagacagagggagcagctgaggcctctctccactggccgccagcctccctagcacaaggggaccattcagcaatgagtgtttactcatgttctttcttgttgatgagttctgcggcccagcatatagaaatggctcagaacgttccaggccttggtgagacacagcagcgtccaatgctcacaggctgtccccactctgcctgttcccatcttcccctcgggacctgtttataaattgaggaatggatgagggccctggagggtccttgggagtagttagtggagggcaggattctcaggtccccatagagagggaaagagaagaccagatgtgcatagaagccagtctctgtcacatacaccgcaggtggtcaccgagttattttccaaaagctgaggaacataaagcaaatttaggcttttgtccttctgcaatacatgcacttgaaaataaacagaaaagagatgtttaataacaagtttacttccggtctgctagcaccctcagcctgggagctactgccagaggctggcgtagtggggcagctgctgaccaaaccccacagaacagagggcaccaggcatcacacgacatctttccctcccatctctgccatctgtctgtctggcaatggaaggagcttcagcaggaggtccttcccagaaggttgattcttggcctgggtggtagaggagatatcctgaccctaaagtcttccagccccgggtcatcctctcctatactagggcctattgaccgtagaggccaggtgcggtggctcatacctgtaatcccagcagttggggaggccaaggtgggaggattgcttgagcccaagagttggagaccagcctgggcaacatggtgagaccaattgactgtagggcttgtcccttgctaagacaggagcagaagactggatggctgtgtcctcaaggcagtcccctcccatccccattcccaaagtcagaaagtgaagccagatctcaagggctgatacctgaggcaaggagagctaaggggagagaaattggggctgagtggaagcagatgcctgcacaagccaagtgtgtcttattgatctgtacaagctgatagaaggaccatctgctgaaatccagggctcctgagttggtgggtttgcttgtgaagcttctaggacaaggcgcagccagatggaagggagagggtccagggcttcctaaatgcagccgcatcacctgtcaactcgctgcagtttcagagacagtggaagctgctctttacctcaaaagcacaaagcagaattggcaacttcacttgtctcaagagctccaagatcctttggtctcgtgtcctttggcaccccgtaactggactggggacaaatttgttacgtgtttccaaggctacagacatggcgccatcctcacaggcctagctcatgtcatggatcaggtgctttgctggggggatacaatgacccatgtggtctgcgtcttctgccattggcttgaactgggcaccccctgaagtctccatctcagctgtatattctagtccaaattttcctggctcccctgctccctcccaggtcctgcacactgtctttttgccaacacctcagccctgtttgctatttcatgtctgcatggtacgagacaccccttcacggcatacactgccatggtatgtacatatgcatccacgtgtgtgtatgtgtagcatgtagctcattctgctcagcctctggcgccgttccacattgctcccagccccattgctgtcactgtcgtcccagatgtccttgccatggccacagacaatctgccgtctcctggaaacgctggggctgcccttcagagagctggcagccccagcagtcagggcctgctttgcagaatagaatgtgaacccaactcctgatggcctacttgacttatttaattaaagatgaaatcatgcaatgagcaaaacctgca

SEQ ID NO: 382 - DNA, 25131 bp, Homo sapiens
ttattcaagatcaattttatttgttgtaaaaacaaacaagcgttatgttccagacagatataagtgagtagacttatgccctggtgcctccttggctcttcacaggatgcaaaaacaaatcttgccagcaggaggtggcaggctgcagaggtggctggttgctctttgagccatcttggccttgcctggcatgcacaggtcccagcacagcaaaacattcagggagttagagtgttgcacaaaggattttaccaacctctcacattaagcagcattcaaggatttgctgaccaccacttatgcaaattttgtgttatgctatagcaatgaacttacttgttctatttctaaacaaaatattgggttcacacacaggcctggacaaagcttcccacttctgaactatttactgatcttcttattctcaaagaatgcaagatgaatgatgtgcaataccatggctatggcatgtgacttttctagacctggatggttagtgtcccaatatttaactgatttttgggggggtgaaaatatgccataagttcttccttctatcatccccatcactaccatacatgtaatggcataatcatgtcacagtgtgtcctcagaatcactattcctagctgagtatactaaggctttctatctaggtcagttcattgtgtctgtgtctcctctaaaccctccttcatcatgcctacctcgaagaattcagcaagtgatcattcacgcaagctaaaggattttagctttctctgccataaagattattgctaaaatacataccatacaacaaaccaacccacttccaacaaatcttactgacttctcacagaatacataatgacttttattgtgtctcttccttctgtgtttctctttcctaactgaactttgttctttatccatgccttcttccaatcctgacatattttaaaacctttagcatttctgcctataatatttgggttttcttcttttcctatctttatttgataagtcccgtcaaatattttccccataatcacaatgttttcttttcactttgctcaagaactgagttatgagctccaaatttggacaaactctacattggctaagttttagtcatttgcactgctaagaaagatgacaattcagcatgctgaagatgatatcctcccttataaaggggctaacacagagggcaatactgttcgtgcttctgagtcttgatcacaagaattgctttaggcaattacaatcatgtctcctctgacatatcatattagtcaagtgagacagagaaagaatatgtcctatgtcacacagctgggtggtgacagctgctttagcatcagcacactgcgttccctctgatttcttcattcatctctaagtagcagtaaagccggtcctgaatactgactttgacactcagctttctccacatccttcctgtcactgcctttgagactacttcagattcttcccttaacttctatttctccatttgtaaaattgggttgatgagggtatcttccttcggtagctgtgacaataaaaatgggatcatcatgcatcctccttagccccacgagtaagctcccagtaagtgaggctgtcatcattactggatatttaagattctttacctatttgaaaaaccctagtgacagagtctcagttgcttttctttttgcgtgaatgatcacttgctgaattcaccaagcaggcgctttaacatttaccttcctttattatgctggagcatttttaatgtaggaggcttctgtggcttctcactatgactgctttgtttgttcaaaacttatacaggttgagtatcctttatctgaaatgcttgggtcagaagtgtgttgggtttcaactgttttcagattttggaatatttgcttcaatgcaatgaggtatcttgggaatgggagccatgtctaaacacaaaattcacttatgcttcatacacacttagccacatacacataacctgaaggtaatcttatacaatattttaaataattttatgcatgaaacaaagttttgaatgtgttttgactgtgacccatcacatgaggtaagatgtgcggaattttccacttgtggcatcatgtcagcactcaaaacttttggattttggagaatttcagattttggattttcagagtaggtgtgttcaatctgtatatatgggtcagattcagttgtctcctttaatctttggctgaaggaagccctaaagactttggggcctcaatctcccatatgcagtgacattctcaaagccattgactcagcttctcacctgggtttccttccagtgagccacagatagaagtcatagatgatggcaggggcctgctggctgatggcattccagtactgggttctgaagttgctggtggtgaaatcagcatatggcctcgtcaaagctctctcaaatggaattggaatttcaaaggttgccaagacctggaaacctgggggaaaaaagagagtaagtgctagaggagaataggagaatataagcccatcatagtggaaggtatttataatgggtcacagcaataaagacgaaggatttgctgtgtagagtcaagaatcaatttctgagaacaacgtaaagatttttatgctaggcaagtggttatctgcaaaatgagacaatgtgaatgggttaagaattggaccctttatttgaaacatctactctaaaacaaattcttggggaaacatgtagtcaataaaagggggtactgttcagaaaaacataaatccacatttaattctaaggttatctagtctattctgaaagccccaagaaagaggctagaaactttatttccctggctggaccattactgtcagaaccatttagaaagtttcttaatattttatttgaatctttattaaaagtttaacttaaaaattctaaaggcaagattttcttgtgttagcttactttaaatatttctctgggaatatgtaagactcaactgtccactctggtatccagggttttatccatagtagtgtttttatattaatacttagattaagctgaactaagaactgtttacatacatttgtgaattcagcagttcttttgaaaagatactcatttgaattcaattttatttaaggtatgtaggtttttgcaaagcatatgcctaagctcattattcaattatgatgtcagttattatagtaatacgattattgccctacttaaaaaaattggcatttttttaaaatctaaaaatctatctgaaaaatataactcctcttcagagaagattctcaagaatcatctggtccatagggatttatactttaaaaagatggtggtaaataagaaagttatgtacaggttgatagcataagagattctgatctcaacactgatgttctgatctatatatccatatacttattcaacatttccacctggaggtgtaagagacattcacatttaacagctctaaaatgggcctcctgatacacccactgctaaccacccccctcccaatacatacacaaacttgctatttcaccagtcttctacctctaaccaaatgctaattcaatttgtttagtagttcagccaaaaactttggggttatccttgattcttctctttctttaacaacccacacacaattgaacaaaatctatcagctctgtttgaaaaatacccagaatcataattaccacctgctatctctctgatccaaaccactactgtagcctggaatgttgcaatactgtcctaagtggtctctgccactacccctgtaaccctagtcggacctccatgtagcagccagagggattcttgtaaaatgtaactcagagtgtattacaggaacgtccccattcagagcccttcagcggaatctcttctcatttagaggcaaagccatggtctgcaagggtttgcactctctgcatcctcactctctctgcccaccactctgacttcacctcttaccgctctccctctcggtgcttctgctgcagccacactggcctccttgctgtccttgaatatgattaaagaacttcagcacttgctatttcttcaacttggaatatttcatccacgtgtccctctgatttgccctctcacttctttcaggtctctactaagatgacaccttatcagagagactttctttggccatcacatattaaatagcagccttcccacaatactgtttacttctttaatctgttttatttttctgcaatcactcaaccatatctgatgtatatttctcctttctaagatttaagtatcataacaaaattttgtctgttttgtttgaacctatacagtaccttgaaaagtggctgaaggtaatcagtgcctaataaacattttttgactaaacgaatcaatagatatctcagcaacatacacttactttccttttcctaaatctgtatcaatccttcctttagtcatttcaaatatatttatttagcatttaacacttgccaggcactgtggtagatgctgaggtaaaaaaaaattacatatgatatattctttgtctttaaagaactggcagtctggtgggagatgtggacaattcatgattacaatattttgcctgagtattctgctagaggccagtacaatatgctctggaggaatacaaaagaagcatctagctctgtctgggtgccaggaaggggaggggtggggctaggtttggaaaggctttctaagaaagctgtccatatggtaatagcaagcatttactaaaatgttcactgttctaaccactgtactaagcactttgtctcactacgttctcccaagagctccctagaatagaataattattattctcactgacagataaaaaaattcatctacagggagaaactgagagactttttccaactgatacaataagagtggagtctactaaatggtgggacgcatatcagcatataacatctatgtgagcatggatttctgtttagtgatatatcctcagcaccaagaataatgtctatttaataaatacaggagtgagtgaatgagctatgatttgaatccaagtctattagatctcaaagcccaagacttttaaccattaagctaatgtctgtctgatgtgagggacaaggagaaactcatgcacatgtagaaaatgtaatttggcaattggaaactgcactctacatcctcataggtcaaagaagaaattcaaatgaaaaatgttgaaggattagagagtaatgataacataaacattatacaacaaaatgtgtgggatacagccaaagtggcacttgagggaaatatgaagccataaatgatgtattagacaagccaaatattcatgggctatatttctaagttaaagagaagaaaaacataatcaaagaaagcaggaggaaggggaaaaaagagataaggcaatacatctatgcaatagaaaagaaagcagcataataaagagtcaataggctgggcgcggtggctcatgcctataatcccagcacttttggaggccaaggtgggtggatcacctgaggtcgggagttcaagaccagcctgaccaacgtggagaaaccccatctctactaaaaatacaaaattagccaggtgtggtggcgcatgtctgtaatcccagctactctactcaggaggctgaggcaggagaactgcttcaacccaggaggccgaggtcgtggtgagccaagaaaatgccattgtactccagcctgggcaacaagagcgagactccatctcaaaaaaaaaaaaaaaaagaaagaaagaacaaagaaaaaagtcaataaagcctgaagaagttggttctttcaaaaaaagaaataaaataaaccctttggagactagctgagaagaaaagagaagacacacaaatattatgaattaaaaaagaagcataattacagatacagtttaggacaaaaatattaatataaaaaagaatgtaaatacattttagaacaaacaaaatcttagaaaaagagacaaatataatttactaaaactgattccaacagaaaatgaagcctgcaaaattctttaactattaaagacactgaagcaataaaaaatcttctcacaaaaaattataaatcaagataatttaaaggtgcttttcccaagttttcgaggaatacattactccactattacaaaagcactttcagataatagaaaaacaagggaactatatgattagcaaactgaattaaacaaaatataaaaaaagataacatggtatgaccaagttgggtttatcctaaaaatggcaggtgagtttaatatttgaagtcttccgcttaaaatgagcagcaagacaataatacctactattgccatttttattcaccattatagtagaagttcaacaagaaggctgggtgcagtggctcactcctgtaatcccagcactttgagaggcgaaggcaagcggatcatgagatcaggagatcgagaccatcctggctaacacggtgaaaccctgtctctactaaaaatacaaaatttagccaggcgtggtggtgggtgcctgtagtcccagctactcgggaggctgaggcaggagaatggcgtgaacccaggagacagagcttgcagtgagctgagatggtgctatcaacaagaaaaataaagacctaaagcttgaaaaaatggggataatactgctatttttgcagattatgattatgttaggaaattatgaggaaattttatacaattgctagcaataataagtttagcaagatagctgaatataaggtcaatatacaaaaatcaattgcatttgacatcatccacaaacaattagaaaatgtatttttacaaaagacatttaaattagttaaaaaaaaaaagcatcaattacctaggccctaggtataaatctgataaaagatgcttaagatctatatgcaggagattaaaaactcttcttaagggacactaaaggagacaattcaatggagagatagcccatgttcacccacccagctgtctatcactccttgtaatatcacctgagactatatatgctcaacctcctgttaacatggctactgctcctagtaggaagcatttttatccctctgaagagtccccaataggaaacacaaatgagtttaatttgaatgcaacatcaaattaatagtaatagcttccagaaatgctgtgttagaagggaatctagaacagagccttggcacagggataaccaatgtcgtatcagcccgcagtgtttgctataggtgtgagagaggtagaggaaacatgcaggccaggtatttttcattgtggaaaagcatttttcaattcaaacccacaatatataaatgagccacagtgtccagctgccctgcaatagaactttcagtgtggtaccatggcttaccattggaatatgaagagctagtggtacctatgtaacagggatagaaggggtgcgttagttagtaggtactaagaaattctacagaatagcaaaactccctacttttatcttctaccatcattagatgtttaagttgtactcaaattgatttccatggtttttgtacattgatcagattaaatcccttacattcagacaaattaatcatttgtatagtacagggtttctcaaagaccatttccacaagcatcaagaaacatctagatgcttattaaaaatatagttttctcagcatcacccaagaccttggtcacagggtccaaggaatctggctgttgtttttattctcccatagtgattcctattcacttttacaaatcactagtagagtagttaatgcacacccaagagaaacaagttgcataaattagtgatcactattacacactcaataaggaaggaataatatcacccgacttttctaaatctcattggtcattgatcacgtcgcattctcagtgacatatcaacaagggaaggggtgtgtataggacccactgccccagcagggaggagtatttcagtattttatcactgagattctttataactgccaacttttgctttatttcatcattgttttttaaaatctctatagccaatggaccccctactgcttacaatcatgtatgtgttcccaatgactcctttccttggtaaccacagtacattctagttaactaccacacatttacaatttctcattattttgtctctttgcttactttttgtcctcctccccatgtaggctctaatctccatgacacactgtctatttcttctctgtgtcagacactagtaattatgcagttacatggctaaagtacttacccattttgccccggttgcagggattgaggttaccagatgtacagtggtagactaacactgacttaggtctggaaaatgaaataaaaattaaataaatacaactgaatgaaaaactaatgaaagaaaaataagggaaaataatatttagacagagtggcttcaataattcatctgattaaagcaacctatgcaagaaggcttctgtatttttttctttctttgggttaataagcaaaatggaagaagactagcaaaagggtgtgtgcggaggtggggggatgtgtgtgtgtgaaagagatgttaaataggagtgacatattatgaagcacatatgtacgagttcacataaaaaaatttaattctgtttaccacatactaacacagccaaatgtatgaacaacctgtttttttttcctttgtaccaggaaacttccccacacatagtgattgaacacttttggcattaaccagagttcaattaaagaaaattctctcatttcatccacttctatctcctttgccctaaaaaagaaagctgaatgttaaactactgagtagaaagaaaagccttttggttatcaagaattgtatggttaagtgatttaaatgttttattactttgtgagtagccaagtactaaactgtattttgaaaacaactgaatgtatatatgatggcatattaggaactctataaaatactgaaacaaacaccctctcacatttggggtcttgtacaatgaaatgcctatatttggaaaatgtgcctaatacaataaccctccctctcatgacatctttgaaagcccacttgagcatccacacctgtgaactgcagcacacacaccatcctacagctagtgggagattgacggctgtatcacctggaattggaattaagtctcccacagccattggagtagcttttatggacagaagaaaccctttcccagcctgcacaggaaaaagaacataaaatgtgaaaccaggtcttaagtaacagctggggctaaagtatgtatcatcaaactgattatactagtgcaataagtgaaaacagctaacatcgatccactgcttaacaggttcccacactaagtctgacttcgtcagcctatcctagcttcccagccaagcgcatcttcagcattttcttgaactactcgtgttcctcacgttcctttagggaataaaattcctcatatttttgagatattaataaacttagttaattaccaaacaccaagaataaaccttcacatttaaaaaattaactcataagacacgttaagaattaaggttacacaaattccccattaatgtttgttttccatttccttaatgattttgttttctgctagggtttactaacctacaagcaatagtaagcactaaaagtttaagaaagttttatttgaacaaaaattaatttgtgaaattccacaattaatgacaaaaacttttttggcttagaaaaatggccttattatttactttttcttcagaatctcatttcacctcacagatcactgatgttatatagatacaagagtttggacttatttatgttaataatttgttgagtttatgaaattcattctttctgctttgcatgtttcccactttaatttgaaatgattagcactttcttatgttactcaattctcttttcttataactagctccccttcttttggacataagaaaccaatttagaacattttttaaaatgtaaataaatatacagctttgcatataatgaaaaccgctttgggatcacgttaaaataatgatgttctaagtcaccaaacttcaccccaactgaacttttttaggagaaagagttgaaggcaggtgggaagcagaaagaaaggggctgctagaaaaatccggaattcgaaggaaggtctttgtcactaccataattcattgtctcatatttctatttgaattcatgttgaacccagctctggtaggaatagagacagagtctgaagagcagtctgaatccctaataagatttaaactcatttagatcactgatttcccattcattgtacaaaagagtaaagtggggtttaggccctgaatgcctcagtgtgagctgtgaaccccacagctctgccggatcaatgtggacttcagggagatgggcactgagggctgctcacctagaggagccacgtttctccttgtaagacattattgaaaaggcgttgccggcacatgtctacctatgtaacaaacctgcacgttgtgcacatgtaccctagaacttaaaatagaataataaaaaagaaaaggccttgcctatattcactgatgtttgtatttgaaaaatttgccccaatattggtagttctttcttgtattcattaagaattattgatgtatacctgctttccatatacacacataaactcttctatgtgttttataataacgaatttaataatctttgaagatatttttactgcatcctcaattcactgcactaattcatgcaattataaactgaagaaaggaggaaataccccatcttgcgataaataaagcaaaatccttggcagaaccatgcccgcctgtccgcgccccgaccagccctcccgggcagccactcaccggtgtccgtcttcccagcttcgcgccatgtggccaagtgaatccatcctgccgtccatctccactttcaccagcccgtaccgcaagcgccgcctgcaggtgcgctgaccccgcgcccagcccgaggccaggggaacccacaactacctcaacagcgtgcgggactccattcggtccacagggctggatggcctggggccgaggccaccccgaagcccccggcgaccccgccgtctgcgtcctattacccgaacactgcacaccgctgccctacggcgccctggagctggacccactgccacatggcccgcgctgctcagctggtttttgttgttgttgttcttttgagatggagtctccttgggttgcccaggctagagtgcggtggcgcgatctcggctcactgcaagctccatctcctgggttcacgccattctcctgcctcagcctccggagtagctgggactacaggcgcccgccaccgcacccggctaattggtttttgtacttttagtagagatggggtttcacctgttagccaggatgttctccatctcctgacctcgtgatccgcccgcctcagccttccaaagtgctgggactacaggcgtccaccaccacgcccggctactttttttttttttgtatgtttagtagagacgcggtttcaccctgttagccaggatggtctccatctcctgaccccgtgatcggcccgccttggtctcccaaagtgctgggattacaggcgtgagccactgcgccctgcctgctcaaccgctttcaactggcgctgcccagccacctggtcaaagcccagcaccctgaagcagatggcggcagctgcggctgcgcacccaggttcaggtatgcatcgcgcgtcctctcaaacactagggcgccccgggcctgcagcttcatgcatgcgaggtcccgggtccctcccattccgcccccaacacctgcccctcagcccctacgacccgcacgcctccttcccgctgcccttccgtggccctggtttgggacacccagcccggccttcatgaggcgccccccgcccagctccgcccctccacgcccctgtctttagtctcttaggcggtggccgccgccgccacagccctgggcctggcacccccagtcgcccgcggcctccttgtggtggcaccggcgtccccgctggagctgctggaggccacgcccaagcgtggcagctgctcctggcctgggaactgcaacaccaggcatacctatgtggctacggccagacctacagcaagaattctcccctgcaggcacatctgcgcagcacacaagtgacaagcccgaccactgccactgggatggaagcagctggaagtgtgctcactcagacaagctaacgctccaccaccacaagcacaggggccaccggccatttcagggccattggtgccaccacgccttcttgcgctctgcccaccttgccctgcacaggaagcggcacatgcagcccagaggcctccccacctgcacgcggccccctcccaaactgtgactggtatttattgcacccagagaactcggcagggcggtgtggctccatagggtctacctcgacgacgaagacggcgccaccgccccagcccccatctgtgactgaagaccaggtgggaaaagaccactatccgccttgacgagttctgtttttcaaaatggtgcaataattaagtggcatcttccctcccacggggcataagacttgatgtcctttgagaaataagggccttaatttgtactgtctgcgacattttttataatattgtacataataactgggacagatattgttattactgtacatagagtggcagggctacttgcctcattttcctaagacttttgcttcttttatttttaatttttaaaaaagttttttttaaaaagaaaagaaaaatccttaattctcacttttcaaaatagaactcttaaatagtaattgatagcactttacctctgttttcctgataaaaaaaattctaaaagaataaaaacaatttcatcctgcccccatattataaccagaataattgaaataatatgcttcaattgatagtaaagtagcatttatgtttttggatcaatgaagctaagccagcactaagaattttcttactattcctccactacattacagttacttcctcatccctatacataccgcaataatgagtcagctacatccatttagattatcaacccaaccctaaaagaaagaaaatttccattggttacacatttcagaaaattgttgtatctttggaacatctgccgtctaatcttaataaatttcaaacaagggcactgagactccagccgatagaactatctaattcagtattattaagatcccaaagatcaatggcaaagcgttggctattttctgcagtttgtgcaagaattaaaatttggccaggattgttgtttgtagcaggagtcatgaatggttttgtggtgttttatgacaacttaagggctacaatggaccttgtccttatatcatgatctgctaagcaattcaccaaccatacttcacctcattcctgattttagcctccttaggagaacattgaaaacatgattggtaataatgtgtgttgacttgcttaaagatgttacaggaaagattatgcttaagagtagttagagggaaatgtctttttgagtttgtttcctaagccctaagccgtctctttaccttacagtataaaagtcgaaatgcatataatgggagaccagatatacgggaggagaagatgaagggactaatattcgttgagccttttagtagggatctaccttttactagagactgagcactcctcatacattgtctcattaaaccaactctccaaagtagtatctgtcctgttctaccgaaagaacaactcaaaaatgttgcattgccagtaagtggtggagctggaatgtatctgcccccaaagcttcacggacttgctttgaagaagatggtataattcaaagtactttcaaaaggacatagcagtatactgaggttaaaaaaaattagtattcccaaactgagatccttctgtgagctttgtaaccctggcagttagttgcaatactaccaatttggccatcaagaacattctgatatgtttaagctacagtgggaaagccaagatatgaaaacatcacccatgggaattttgagactagagtagttagaagctaatttaagatctccatccaactctaagatagggtaactgccagaagagccacatgatcccaaagtggaattttgccctagtataatgggttaatatttgattggctgcacttagctataaatcctgaggagaagaagaagaagaaagacatcagaaaataattgggctagaagaaccttagtttgaaggcaaaacacagaatccaggtaagtgggcttaccaggaaaagctggtgcgacgttgctccgcacaatggagggccttaggatggcaatggttaggttcctgctctcctgctgcaccaccatttctcccaaggccttgctataggtctaagtattgggacaatctccaatccgcttgggagtgatctcgtcaataatggcgttgtctatacataaaaggtagtcagaataaaaagaattctagcaacatgtgttagacaatagaccaaaaggaaaatgtgagacacagtcaaacaaaacttccaccttttagccttggttctggaattcagaacagtcacatgataccaagtttgagtgcatacctgtccaaagcatgcatgagctcttttgttttcactgctaagcccaatcttacagtcaaatcctatgccctcctatccagacaggtaggtaggtagacggatagaatcaatagcgatgccactttattactactactagtgtagggctattaatactactttagcgctactattactttgtcagtgctaattactactttatctgtagcagtattaatttgaggtaattacatacaacctctttacttcctttccaacaaggtcgtaagtacattcattgcacatatttttgagtcccaatcattctcccagtagtgtgctggaagctgtgttcagggagtttgaggctctcatccaaggtgtttcagtggcagccctgttcagtgttgtcctatagaaacccagtgcagtgatcctgaagagtttagctttacattttaaaattttcattcaatgcaaatcaaaccagagtgattacttttggcagactgacaatctgttttaccaaatctatgtaatgcattttgaaggtctgtttagagtctatgataacaaattgctaattatttccagagattttcaatgaattctgaagtctgtcaagtgtggtgattatagtactctgaaattgcttcaaaaccatgaatattgaatactcctacttacaagatgacatgtatcatcaataactgagttaccatagcatcagcctaaactttcttaaaaatatgtcagaaccagccgggcacagtggctcatgcctgtaatcccagcattttgtgaggccatggcaggcagatcacgaggtcaggagattgagaccatcctggccaacatggtgaaaccccgtctctactaaaaatacaaaaattagctgggcatggtggcgtgcgcctgtgatcccagctattcaggaggctgaggcaggagaatcacttaaaccagggagcaaaggttgcagtaagctgagatcttgccactgcactccagcctggtgacagagcaaaactccatctcaaaaaaaaaaaaaaaaaaagtcagaaccatttgataaccccaaaatctatctacaactctctgagagagcaaaaaaaattattgtcaattaaatatgcaacatgtattctagctgacagatctatgtggttaaattgttaatataacatagctttttaaaaattaagctgtcggaatatgctagggtgatttttctgatcaatgtggtccatttatttctattttatacaacagaacataactatactattttgattgtagaaaatcttcactgttaccaccttgctgacatgacacatttttgaacaactaagatgtgcatgaggttaagactcattcagaatcacaactctcaatattaatgcctcatttgatcctggggtagaacatgggcattgaccattatgtttccatttttcttcctttgcttctgagtgctgagtgtcttctggatactaaatgtcttttcatttaagttgaatagagaaagattgaggggttctagaattaaaaacttaaactacatagaaatatcaaggatattttaattatatggtcacctgggggctgggaaagagcataggatgattcatacatctctcaatcttaacaataatcctaccgttacctcatttcatttctgtgtcaacagtggattgactgacctaagaccatttcccctcaactgcaaaactatacagtttatgaaaaccaggtcttcagggaatagagcttaatttcaataagtctgtaaagaaaaaattcctagaaaacatcagagcccaaaaatgtactgggattgtatgtcagatggctagtaccagttgctgtcattaatgttggggcagccggaaaggataatacttggagggatgggggccttataaagcttagtgagtttccttgtattagaaaatgttgggttttgttgttgttgttcttgttgtttgttgttgttgttgttgctgttttgaaatgaagtcttactcttgtcgcccaggctggagtgcagtggcacaatcttggctcactgtaatctccactccccgggttcaagcaattctcctgcctcagcctcctgagtagctgggatttcaggtgcccaccacacctggctaatttttgtacttttagtagagacggggtttcaccatgttggccaggctagtctcgaacccctcacctcaggtaatctgcccgccttggcctcccaaagtgctgggattccaggcatgaaaaaattttggttttatagatttctaacaacacacatggaagaaattttaatattctatagatggcttacctctgctactcttagctgcacctgtattccactgttttatattctcgttccaattttacttgtgaaaatggcaataattatattcattctaaattctcaggttatgagggtaaacaaaaatattcacaactgcatttaagctgtttgataaaacaaaatgagccaataaacctaaggcactcctatttttagataaaacaatcggagagcatcatatatctgtgtacgtaatagttggttttaaaatgtcatttctggccatatgtggtagctcaagcctgtaatcccagcactttgagaggccaaggaaggaggatcgcttgagtccatgagtttgagaccaccctgggcaacataataagacccagtctctacaaaaaaaggtttaaaaattagctgggcatggtggtgtgcacctgtagtcccagctattcaggaggctgaggcaggaggattgcttgagcctgagagttgaaggctgcagtgagccataattgtgtcaccatactctagcctggatgacagagtgagaccctgtctcaaaatgaatgaatgagtaaaacaaataaaaataaattatcatttataatgcagccagacaggccatctgctagctcattcagccagttcctaggttcagacaggagattagtgtaaacatgcacatgcactgattgggcaaagcccttctcaggactttcactcaattcagggttgctgctgctgtttgttctcaatatgtttttaaacagtaaataagttaccatggataaaaaacactatataaaccaaaatacgtgtctgaaattaatccaaatgttcttcagtatactcaagaagatgttttgacccaggggtctcaaattctaaactcgaattgcttcagaagaagcataaagtcattgaaaatttcagaaagcaatatgtatgtctatgtatgtacatacatagacacatatacaatttcttccaaagattactatcaattttgctttcaaacttattgaatcaacatgatgatatcattaatggtttcattatttatgtatttatggaatgaaatactaagaagcatatgcatttcccatcccctgaccctccaattttatctcattcaacaagttggcaagcctagtggtttatgagtaaatctgttagagagtaagtagtggacacactgtcttatgataacgtttgctctctttctccagtctaaattatataattcacttgattgttgtagttatcaagttgtatttgttcatctgtctgtctgcccactagacagtgagtccaggagagcagggattatgatttttatctctgtgtctaatcacttttctgcccccaggagccagctaccttattcagtaaatggatgctcttccacatggtaatcttgattggccaatttctgtactatataaggttttgggaagcagagatggacaatgatgagacagagtggatgtactcaaaaaaagacaaggttgtagggagaatgcaggaaaggaaagaagggggtatctttgtacagcaggtagcaaaattggaagtcaaagtgtccagtggcagtggtgaaaagtgttgaccaacctcggtttgatgaaggtggcgtgaaagtcaacttaaacttttcactgggaagcaggatatttctgagcctaatgcttatggagaattgccctctgtatttccctccagactttcatgaggcacccagcttggcccaaacatgagccagatgctgaatagcctaccaatggcctgccaatgtgaaaattattcagtttggctaagaaacaatttactcatattctggtttgtatttgaagcctgctaatatcaaagtacacagaattttcatttttatgtcagctacttagatgtcattttgaagctgtgccatgatgaaattaaaaacacaggcctggcacaatggcttatgcctgtaatcccaacactttggccaaggtcaggaggtggagaacagcctggccaagatggcgaaatcccatctctactaaaaacataaaaattagccaggcacacttgcgggcacctggaatcccagctactcgggaggctgaggcaggacaatagctggaacccaggaggcagagcctgcagtgagctgagatcacgcattgcactgcagcctgggaaacaagagcaagactcaaatctcaaacaaacaaacaaaaagcacaagtgctagagtcagctttcaccattcccctagaacagatcatctttttcagtgttaacaatgtgttctatagcaggaagtcaagactactgtccaaggtctgacctcctttgatatctcctggagggctgtgatgagggccactgatgctggctgttggggtctccatttccctgcctctcacccctgcgccttcagggcacacgccacctttccttttttacatggcagactagctgtgtcttctggtggccacgtagcttcagaagtgtggtttttagtaggtacagatctactaggaactttcattcaattaaagcttctaggaactgaaaaacaacaggagacaaagagagcaggagaaagaggaagcatggggtattagaagataaatgatcctcttttcaaatgaagactgcttaatgaaaaatctccttaaggcacaatttcccaaacttgcctggtcatcagtgtgaattacacaaggcccctgggaaaaatccagactcctgggtgccattttagaaccactaaatacatctgcagaagtaagagtctggataatctgtattttcaacatggcctggaaattccaactgtcaggtaaattagggaatcactaatttaaaagaagtccactccatcaacttaagtcgttaagatttgaatatatcaggattagctctcaaaaacacattgcttcttggagtaaacatttcaacagaattgaattttaaaattattaaatcccctaatgctatccctcccccactcctctagccccccacccactgacaggttccggtatgtgatgttcccctccctgtgtccatttgttctcattgttcagctcccacttatgagtgaacatgcggtgtttggttttctgtttctgtgttcgttaactgagaatgatggcttccagcttcatctatgttcctgcaaaggacaggaactcatccttttttatggctgcagagtattccatggtatatatgtgccacattttctttatccagtctatcactgatggggatttgggttggtttcaagtctttgctattgggaacagtgccgcaataaacacatgtgtgcacgtgtctttatagtagaatgatttataatcctttgggtatatactcagtaatgggattgctgggtcaaatgtatttctggttctggatccttgaggaatcactacactgtcttccacaatggttgaactaatttacactcccaccagcaatgtaaaagcgttcctatttctccatatcataatgtagcaccaaatgtagataagcgcctaatgtagatgagaggttgatgggtgcagcaaactaccatgtcatgtgtatacctatgtaacaaacctgcatgttctccacatgtatcccagaacttaaaatataataaaaaaagattgaaaattttaaattttaatacaaaattaggacttagttatttgcaaaatacactgtattttcaatgtgaaaaacaaagggttatcgtatgtattatcaataaagttatatagttttccataaaaataacattaataatggaaaattctaaaagaaaaataattaaatttcttttaggacaatttaaaaatgtatctgtcaattttaacatgaaaattctcttacatttatacatcccacattctaataaggactaatttttatgagcagtaaagaaatgtgtgtatgcgtgtctgtatacttataggtatatatctgtttctgtgaaaatctctcttttagagtcagaaaatctgtttggtcccagttcttactaataatatatgatctcactaaagatacttaaattcaataaactcaataaactttactctcaatgaggtaagaatgagaacacaggtgccagccatgagctgcggttccactggcacaggcttcagagatcctacctttaacatcctcctttcattcatttgagcctgataagaaaggagtctcttgggagagaagcaagcatacaccttggggccagacagcccatggtcaaagttgaactccaccactgttcagctgtgtgactttgggcaagtgacttttcctctctgatcctcatgatcctttttggtaaaaacagcagaatgacaggtctatgaagattggaggaaagaaaaatgtgtgtcttagtttaagtttcctggaagtagatcctgaggcaaagattcaagtataaaaattttatctggagatgactccaggacagtaattctactgtcagttcttccttagagtactaattgcaggcaacaccagtagaggagtggggaactgagacaggaatggaatgtagcagttaaagggaccttcatcaagaaagtttccactgtgggcagccaggactcagccctgccgggtacctctgagagacagcatagaacatgtgcctcagagtcatcccacccagagcaagggagttggattatttatccaccaatacacaccagtcactcctcagggcttcgtccaaggacatgattcctccagaatgccctgcctgcactgcaagaatgagacctggagggtcaatggcaagagccctgacagcgcctccagcagtgagcaggaccacagcctggtgtggagagtttcagtccctcagtgaccccaacacacacacacacacacacacattctcacacacacacacacacacacacacaccatactccaacaccaacagagaacatacacacatacacatacatgcatagatgactgttacccacttacatcctggtgaatccatgggatagaagataaggtgggaatcagagggaaaagcaaaattaaggggagtgagggtcttgggaacaaaatgaaaatataggcagaaaatcaagggggaagagtgctctggacaccaaacgcctgctggctggcacctgctctacatacactgtcagtcattctccaagcaatctcgtggagtcgaaggaattcccctcaattacagatggtagaaatgtagttcagaaaagaaaactgattttactaactgattttactgcttctgggttctgctccttttcttgctaggcaatcatgacagaattgacaaaaacattttcccccttcaccacctggagcagagccaatgagaggggctggggaacaggccatgaggccctgcacccaccattcaatgtcttcaggattaggactcttgcatcacaggctggcagcactcccgatgtctgggtgttttgtgaggttgtacaggatctagtagaggccactggctctgctgtcatatcctaagaggcagccaggcagacttgggtctcttggctgcttcagcaccagaggatgaacagcgcccatacactgaggctttggggagaatgggaggagggaaaggaagggcagaatggagtgatgtagggtccatccatcatatccctggatggagagacccctgttcccacagtagtcccacaccgggaccaccaccagcactcatgaatatgccagcctccatttatatgtcctcgtctgacaactccttcccattttcatcctggaggcaagactctgaacacactagctctgaggacacctgtgtgtaacctgagacagtccctgaagacctttcatccaagcaggatccctcctttgccatctccagacctgccccacaagctccctccctggtctcctggctcttgttcactccttccaggcagccttctatagtcatctcgaaaacatagctgactgtcactcctttatccagcaccttccatggctccccagagccctccagatcaagttcaagtaccttgatcagacacttgatctcaagctccattctacctcctgaattaagatcctggagaagccaccttgctcagcacaagcgcatcaataaagtccgaagccttgaatgtggccttggccttgaggaagtcatcaacaccctggctagtgagggtgcggtgctgctgcaagatgatggtgtctgaagttgtgcaccaagtcacaggccctgcagaagcatcgcccctcaggaatgggtagtacaggaagtccaagcacaggcagatctactgacgccgttacactatgagggtactgagctccaagatgtcagcagtatgttcactggcattcctgcagggtgaggctagggagaggaagcagctccgtaacagatatgaaactctggaagcccttcccagccaaaatctctggaccacattacacccagaaatgggtgccctctcagcacacttctctctgcctccctctctgagctgcctcctggccccacatgccccagcctggaccagggcttggagcccagcaggtgttcagttcatggtgttgactgcttcctggcacaggagagcccttggtagctctgtgactcctcctgtggaacccctgcctctgcctcaggacctccctattcccatgggaagaccccaaggattgccccacctgcccagggatcctccaaccccataggccttacttgatgccttatccctcccagaacatgacatgtttctcacaaggtgacttacttccaaggccatctgtggatgtttgctggggacctcttgctgttctcctttatgatctgtagggcaggaccaagaggagaaaccagcccaacctcagaacaaacaaaggctcactgccacaaatggcaaccaccaaacagtcagcagtgcttctgggaggaaaggaggtttcattccgcacaaagctccttgtttggtttctttctgaatccggggaggggtaggtaccaagcccagcttacctgtggtgtctacattaccatctgtgcctaggatgtgcaaagggcccctactcccaccgcagggttgacgttccctccagctggagacctgggctcctgacaccgcctggcctgtttgtcctgctctggatgagcggggaaaggctgtagctggtatttccctaggtccttggtttctaccacctagacatccagcaggagtgaccatgtctagcaccacacctgaaaggggactcccttgtacagcagcccagacatctacagatggaagagtgctcagtgagacaggccacaggggtccccagggaggatcagggggtggaggattctggaggtttccagccttgggctctgtggttcctcaaagaggttaggtctacctagtaccaggcctcccctcccacgattcaaagactgaatgagtgtccagcatcaggaactctgttctggacctgttttttcatttaggtcaccaagggacaacccctaacccgagctagggatggtccaagctctggcatgagattttcctccagcaatgtgatgcttacagggacaggtagaaaagctggtgaccaggcctgctgtcctctggttaaggagtgtgccacccaccctctgagaggcaggtggtgccaggccacagcactgggtgcctgtacccctggctctgcagacaccggtcatggaggtccctccctccacattaccttcttgctgctcctagatttcttctagtcattaagcactttgagtcacttttctgtgcatccaattttacatttttgctctcagatgaaacaggataaagtatgctgagctgccaggattcctggaggggaccttggatgctgagtcttgggatccagggccctgatgggactgaatcagaaggagccagggaaagacaaagattggggctgagcccctatgacccaatggccattggtggcctggccttatggtcccaagacaccttgttctcaggccagaaacaccatgggctttggtcgggtcccagcctcccagtagtgtcctggcactagcaggagctgacccctgagccacaaccgc

SEQ ID NO: 383 - DNA, 55688 bp, Homo sapiens
atttccagtgtttcctcgttgtgtcttacattgtccagttcagaactgagcattttattctcagttgtcaacatgctaagctgtccactgtactgaaatactgtgcttcctcaatttgttttaaggtgtgcacttttatccaactctcctcaagtcagagtacaggtaagccctggctgcctccagccactctcagggagaccaaaagccttcatacaccccaagttggggtacaaaagaggggggccacgaaggctgatcattcaaaataaaacaaaattaaaaagtattaaggcgaagattcaaaaaattttgcattatgtaatttgcacaaaagcaatgctatcacctcccctgtgtgaactagggagaggactgggccattctccttagagagaagtggggtggcttttagcagggcaaggggcttcctgaaacaatgcgtctcacaatatttggaatgactattgaaaagaagaacaaggtacaatcaaagtccttggccacattgtagaactttggaggaagcttcctccaaccgactgctgtcaccttcaccattccggtttttaaatcctgagtcaagccaataaaaaacaaaacaaaaaatgaaacaagaaaacaaataaagccatgccaatctcatgttgttttctgagaagtttggttttgtcaagaaagggtgtaacgcaactaagtcagagtccacctacaagcatttgcggtggacaatggaggggcctgactcatcatactcctgcttgctgatccacatctgctggaaggtggacagcgaggccaggatggagccaccgacccacacggagtacttgcgcttgggaggagcaatgatcctgatcttcatcatgctaggcgccagggcagcgatctccttctgcattctgtgggccatgccagggtacatggtggtgccgccagacagcactgtgttggtgtacaggtctttgcggatgtccacatcagacttcatgatggagttgaaggtagtttcatggatgccacaggattccatgcccaggaagcaaggctggaagagcgcctcggggcagcggaaccgctcgttgccgatggtgatgacctggccatcgggcagctcgtagctcttctctagggaggagctggaggccaccgtggccatctcctgctcgaagtccagggcaacatagcacagcttctctttgatgtcacgcacgatttcccgctcggccatggtggtgaacctatagccatgctcggtgaggatcttcatgaggtagtcaggcagttcccgcccagccaggtctaggcgcagggtggcatgggggagggcattcccctcatagatgggcacagtgtgggtgaccccgtcaccagagtccatcacgatgccagtagtacggccagaggtgtacagggacagcacagcctggatggccacgtacatggctggggtgttgaaggtctcaaacatgatctgggtcatcttctcgcggttggccttagggttcagggtggcctcggtcagcaggacggggtgctcctcgggagccacacgcagctcgttgtagaaggtgtggtgccagatcttctccatgtcatcccagttggtgatgatgccgtgttccatggggtacttcagggtcaggatgcctcttttgctctgggcctccttgcccacataggactctttctgatgcatgccccccatcatgccctgctgcctggggcgccccacgatggaagggaagacagcccggggggcatcgtcgcccgcaaagccggccttgcacatgccagagccgttgtcaatgacgagcacagcggtatcatcatccatggtgagctcattcaattgtagagcctttaaaagattatcattcctttttttcacactttcaatatcctccaaatatttcttttctcttagctggctctgatgtttcattgtgtctagctccagtcttagcatggcaatttcttcccgcaacgtactattttcatgcaagatgtctttttctttcttacaactaagagaaagctaagtaaacaaagagaacttttagttagcactcaatagattgacatatcatgatttcttctgaaattcaaaaataacatgtatttgtataatgaaagaatccccatagtggatatttaactggaaaaaaattggacaaaacttcaaacctaataagagtgtaaattcctccagtgatttatttttcatcgtctttaaataaatatttaaacttttaggaatctgctcctaaattcctaaaagtttaaatatttatttaaagacgatgaaaaataaatcactagaggatttttaagaatcccagaattaaaaaaagccttttttctgagttacaaaaaacccagaggcataaaatataagattaataatttgactacatttttaagattaggtttacactctgatatctaacctatcaaccacaccatcctaagagccttagctatgcatatatttggacagaagcaatttctcaaagttctttaagtttcttttacttaagaacgttttaccgatattctacatttctaatatttctatactcagttataagaattacatttatttataactgtcaaataagcactgtacccttctacactgtacacatctgtatctaggcattgctcttctacatataatactgaactcatttaagatcgcgattcttaaaaggagaggtcaaaaaatatacacagatgcaggattttccccaggtctgctgatgctacttctagtgatcctccacaaaaccacacttacttctgtggtgtaaatatataaatacaaaagaaaccttttgtttcaaaatatgaatggtaaataagatacaacttatagagattttcttagaaatcatgagattatttgccattgcggtaacttttatttcctctttataatgtttgaaacagtagtaatggtgaaataggggaaatatactgaactatttctccagaaagaaaatacttatcaataaattattactaaatgtgtatcatggcatgtcattcttttcaaacctctttacattgaaatgagaaactacttggagcaaactgttcctctctgcaaaagtaaggataatggtatccacaatgtggcctctgacccagctatacatttcctactttcttatcagtaaaaataatcaattgacttctctattaacattttttaaaaaactaatgtccaaaaacgagaaaatctgttttcagtagcaaaacttatttctgatgtggaaagatcatcaattcttatgaaaaatatcaaatacttctcctttggattgaggccattgtgcaggtcactactcaactgttgcaggcaaatgaaggtgaattaagaacatggctttatcctatacgtacgtatatagatatatgacaaaggatatatagaatatatacacacatatatatgacttaaaaatcctttatatttccaaaatacagttctttaaaatatacacacatataaaaacatttgaaaataactaaagaaaatacctcagaattcattttttcaaccacttctatctgcttttcttcatgaatcagaatctcatcgtgtaatattccagtgttctgttcttcacaaaattgcttctgagtatcattttgttcgtcactagaagaaattttaattttcatgaaatactggagctgtccctaaaatgatgtacagggcaagatggcgccatcagatgtcattcacacaatgcatatctgcacattattccaagacaaggcaaaggggtctcacatctgttaaccaggtgtccccaaccatgctggcaccagggactgcttttgtggaagataatttttccaggaacctgaggtgggggatggttccaggatgattcaagtatattacattcattgtgcactttatttctattattattaatatataatgaaataattatatctcaccaaaatgtagaatcagtgggagccctgagcttgttttcctgcaactagatggtcccatttgggggtgacggaagatggtgacagatcagaaaggcattcgattctcataaggagtgaacaacctatatccccctgcatgagcaacttacaacagggttcaggtcacactcaggacaatctaatgccaccgctgatctgacaggaggaggagcttgggcggtaatgcgagcgacagagagtggctgtaaacagatggagcttcacttgctcacctgcctcgaacctcctgctgtgtggcccaggtcctaacaggccagggactgctaatggtctgtgtcctgtaacccatactctttatgtttattgtttggaaacactttctacttatattcttgattcctatgtattttataaacaacttagaaattccttttagaacaagacagggtctaatattatgtttttaacataggactttgaaataattttatctgtgtatgagagagagatgtgaaataaactcatcgttaagcactttccattttacttttatttcatgcatattaagaataaaactgggaagtcctaggcagagcaattgggcaagagaaataaagggcatccaaattggaaaagaggaagtcaaactatctcttcaccaatgatattatcccatacctagaaaaccctaaagactcctacaaaacactcctagatttgatacatgaattcagtaaagtctcagaggttacaaaataaatgaataccaatcagtagcaccactatacatcaactacaaccaagctgagagttcatatcaacaatccaatcccttttacagtggctgcaaaaaggtgtgaagtacctaggaatatacttaatgaaaaaagtgagtgatctatataaagataactggaaaacaccaccaaagaaaataacagatgacacaaacaaatgaaaatacatcctatgttcatggactgaaagaactgatatagtgaaaatgaccatagtgcccaaagcagtctacacattctatacaatacctaccaaagtaccaatgtcattcttcacagaattattttaaaatgctgacattcatgtagaaccacaaaagagcctgaacagcaacagacataccaagcaaaaggaacaaatatgttggcatcacattacctgacttcaaatgatactctaagaccacagtaacagaagcagcgtggtactcgtataaaaacagatacatagatcaatggaacagaacagacaactcagaaataaagccactacaaccaagtgatctctgagcaaggatacaaaaacatacactggagaaagtacaggttattcaataaatggtgctgggaaaaaaagatagccacatgtggaagaatgaaactggatctctatctctcaccatatacaaaaattaattcaagatggatgaaaggcctaaacctaagacctgaaaacattggcctaggcaaaggatttatgaggaagaccctaaaagcaaatccaacaaaaatgaaaataaataaataagacctaattaaactaaaaagcttcagcacagcaaaagaaataatcatcagagtaaaacaacaacttatacaatgggaaaattttgaaaattatgatgctaacaaaggactaatatctataacctacaagaaactcaaacaaatcaacaggaaaaacgcaaataattccattggaaagtggccaaattacatgaatagacatttctcaaaagaagatgtacaaacggtaaacaagcatataaaaacacgctaaatatctctaatcatcagggaaatgtacaataaaaccacagtgagatatcacctcactgcagccagaatggccactattagaaatcaaaaaacaacagatgttggtgtggatgcggtgaaaagacaacagtgatacactgctggtgggaatgcaacttcatacaaatctatggaaaacagtatggagatttctcaaagaactaaaagtagatcctaccattttatccagcattctcatttccagatatctacataaaataaaagaaatcatactctcaaaaggacacccgcatacatatgtttactgcagcacaattcacaatatgcaaagatatggaatcaaccagtgtccatcaactgatgcgtggaataaagaaaatggacgtatatacatatatatatatctcacatcacatacatgtatcatatatatgtatgtgtgtatatacactcacacatatacatatgtacatagctgagactgggtaattcacacacatacatacctgagactaggtaattcataaaggaaagaggattaattgattcacagttacgcatggctggggaggcctcaggaaacttaacaaccatggtagaaggggaaggggaagcaggcaccttcttcataaggcggcaggagagagagaagagagaagtgaagcgcaaagagccccttatgaaaccatcagctcttgtgaggactcactcactatcacaagaacagcatggaggaaaccgaccccatgagccaatcacctcccagctggtctttcctcaacacctgggaattacaatttgacatgagatttgcatagaaacacaaagccaaactattgcgggggggggggggggttatccttatttttaaaatatctaaatgtcattatttataattcaaaatagcaatttttattacttatgattttgtttgaaaataaaatgatctcgtaaattttcttcacttttaacctattcagtcaaaatatagaaaaagctagatttgccagcagaaaattgttaactttttaatgagataaaaatgtataacaatatcactattattgtacagagaaaaaagtgaacaagaaaaggaatttaaaaacacagaatatgactatcacatacatacatgaactgacaaagagactaaaatctcctactggagattatgttaggacttgagcaaaagcttctaaaaataccaaaaacaaaaacaaaacacttatttttaagaaataaattatacagagaacacttctggttaagatgatgtatcaaaaaaaaaaaatcttcgtgagagctattattaaccaagtcatcataaccaaaactttaaatccacaattctggaatattaaaaagtttctttttgaacatagttaatggaaggcaacttttgaacagaaaatttctggttaaagttgactcaaacttaggaaagaattgacctgtagccatggtaacaagaagccagccagagccagttcaaaatctagtcaatcgatcaatgaccgaccactggctgtgctcaccaaccaatatcagtgtgagcagcttgcttctgaaagacagccaagcagcaacagctgctccatcagaatagacagtgcctgaccagtatagtcttactatcggaagcaaaaaattccaactgtctttttatttcaaataccgaaggtccataatcccttggaaagaatttgtgagtccattacatttaccaccctaaaaaaactaaaatactagtggccggatgtggtggcttacacctgtaatccacccaggtgggtggactgcctgaggtcaggagttcaagaccagcctgacaaacaggatgaaaccccgtctctactaaaaatacaaaaattagccgggtgtcatggcacgcacctgtaatcccagctcctcagggggctgaggtaggagaatcgcttgaacccaggaggcagaggttgcagtgagccgaggtcacaccactgcactgcagcctgggtgacagagcgagactctgtctctaaataaataaaataccagtaaagtttgtaatttctctaactcattttaccataattgcaattatcatgattaccagtaaaagaatagtgaataaccacaatattgggcttttctccctaagtgaaaaaatattaatataaagaatgtagcttattataaaaagccgaaagaatttttaaaatacatataattaccaggcaaaattgttaaaatgaaccttgtcaaacattttttaagtgagaatcaatcaaacaatatacccgggataaactccattcattcatttaatacctatttattaggtagctacgtctgataggctaggcctctttctaggaagtgaggatatggtaatgaacaataaaaaccctattcatgagagtgagataaacacacaataacaacagacagatacggcaaaatacacagtacgttagaggagaaaaactaaagcaggaaaatgaaatctttatgtgtttgatgggaagggtggtgggaaagttgggatggccagaaaaatccctgctgagaaagaggatttttctttaatacaaagaaacttttatttgtacatcaaagactctaaaaaatgatgatgttaacagagttgatgtcaagacacaaacaggtttgaagttaaagatgataaatcactttgtttcattgaaccttccctcaattacgttaagagagcatccctggtatgttcccaattgaatctcaagcctgacgcgtcctgatgatacaatcctaattcctttctgttagtcctcattatctctcttttttttcattttcttcattttctctggattaggaatcgtgctggtacatggttcttcctcaggaagtggttattccttaatgggtttctttttaccctttttcttcttcttagaaaggggattttaagtaaagagctgaagtaatggaaacagtaagctagaagaatatctggggaaaaagcattccagacacagggaactgctaagtgcagaggtgtgcctggagtctttaagcactagggataggtcaggaatagcaacaagttcagtgtggctgaaacacagcaatagagataagaaacagaagtttcagcaggagaggtaacatgccagatggtttactgcctttcagttattaggaggaactctgccacatactcagagtgaaataggaggcaatcagaagggcaggggcagaggaatgacaacatttgacttatgttttaaatacatccactgagataagaattgatgaaaggggaagtttttaaaaaccaggactatcaattcccgtctatgacactcatctaaactgcagatgacggtggctcagatgtacaagatagactggcctctggatatattcttcagatagacctgacaagatttactgagagattagatgtgaagtgtcaggacagagagaaagatcagtcaagaagatcttgactgagagagaaagatcagacactgaggtttttggcagagcaactggaagagttgctgttaaccaaagtaggaaagactacatgaggtgtagatttcaggaaggacatcagtagcccaattttggatctgacaagtgtgtgatacccaacagctaatcaaatagagatgtcaagtaggtgggatgatatagagatctggaattaaggaaagagatctaagttggagacatacatttggaaatcactagcatatacacagtagaaaaagtcacgaggggccaggcacggtggctcacgcctgtaatcccaacatgtcatgaggccaaggcgggcagatcacctgatgtcaggagtttgagaccagcctggccaacatggggaaacctgtctctactaaaaatacaaaaattagccaggcgtggtgttgcacacctgtaatcccagctactcaggaggctgaggcaggagaagtgctggaactcatgaggcagaggttgcaatgagccaagatcatgccactgaactccagcctgggggacaaagtgagactctgtcttaaaaaaaaaaaaattatgagaaagaagattgaggactgagccatgagaaacaacaatgtccaaaaggagaaagatgaggagcagcaagcaaaacagaccatgataaacggactagaaaggcaggaggaaaagcctgagggagtgaggtcctgaaagccaagtgaagacgccattagggaggagatgccctccattggctcaaatattgctgacagattaaatgaggtgtaagaaaaatgcctagatttagtacagaaaaaaattagtgataatcttgaggaaaaatagttctggaggagtgctgaaattgaagacttaccggcattgagatcaagagtgaatggaaagaaaatttgagttcatgagtgtagacagttctttaaggacaatatacttaacgctcatgactgagaatgatgtaattttcatccacagtcatggaaaagtgatagacaagaaatagtagcttccaaattttacataccaggtggagttttcaaattttatgtaaccattatatattctaaaggttataaaaattatacacatatggcatttagaaatgtcagaccaaggttttaaaggccctttgaacatttctagattacataagctgattatcattttgttcacgcttatacataaagaccaagaaatactaaaactctcaaggagaatatttcttgcttgataaaaatcagccaattctaggacagttgacactcatcaaatatacgaagtaattgatcacagtaaaatactgagttctattaacaggaataaagtgggagaaatgcagaaaataatcttattttataaatgtagttttcaaaatcatatgaagtcactggaaaaatatggtgaggtaaatactgaaatatatccttttctcaaagggaggataatgtcacacatgcagggcacttttacaaataaaagtcactgcattagcagcaccttccttttagcacaagggtcagcaaataagcacctgtgggccaaatccagcccactgcccgtttttgtaagtcaagtatcttggaacacagccatgcttattcactttacagtccatagtgtcagttagctgggtgtgatgttgcacacccgtggtctcagctagtagagactgaggtcagaggatcactagagcccagaaagtcgaggctgcagtcagccatgatcacacaactgcactccagcctgggaaacagagtgagaccctgtctcaagaaaatcaatatatgtagtccacaaagcctaaaatatttactaactagctctttgcagaaaaagctggccaactcctggtttagtagatcaaagattctttgatgtattttaataaaagttttaccaaatatactgaaatgtttatattaaatatagatccccatgtacaatcgcttggcaatattcagattgagggtccaatatttcagcactcaggcactgacaacaaaaatttagtaactagcaatcttgttgctaacaaggtacagtgtcaatgtagcatgtagcttccatttgcaacacagcagatattacaagaaatttaacaagaactcttaagatgtgtcatcaaactaaacgctttaaatacattttaattgtgaaataatcagtataccctacatctaacctcattttttaaaaatggttgcataatacattattttggggatatggaaattgagctatttcctattgataaggaattagactagctccaaattttttacataatactataataaatgtccttatacataagtatacatataacatatctatacaaatatcctttacatgtattatatatgcttactgttatatatgtgtgtgtgaatatgctactcaattaatgttcaaaatgtatttaccaacagtatatgaaatgtctttttcaatgaaaccatttcccctgcagcaacacggatggagctggaggccattatcctaagaaaactcatgcaggaacagaaaatcaaatgccacatattcttactcattagtgggaactaaacatgagaactcatggacacaaagaggagaataacatacactggggcctacttgagggaggagcatggcaggagggagacgaccaaaaaactacctttcgagtattttgtttactatgtggctggtgaaataatctgtaccccaagcctccatgatacagtttacctatataataaacctgcacacgtaccccgaagctaaaataaaagttcactgaaaagagaagaaaatgtcttttccctcacatttgccaatactggttatttttcaaataaattaatgactggaaaaaaaacggtaactgattgtttgctgattttcatttttctgattaacaggcaaggctcaatatcctaataaaagtataaaatttgttcatcatgaatattagctcaaattaggattagtttggcagcacaaagttacctcctgttcaatgttgccataggcttacctgtgatactcttcattctcagtgtcaggaaattgctggctttcaggtgttctgctcttccttggaggaattaatccatcatcaccattgccagcagtggcaccattagtcaggttttctgggaatccgacatgagtacttctgtgcttcttcatttcttcgatagccataaaattttctagctggaaaatacagagaataagaaattatctactttaggcacattatctattgataatcagactaaaaccaagaaagataaaataattggtctaaagctcctaaagtggcattacctagcattttatggcaccattcgggattattccataataatgaaagaatagctctagggtttgcacctcttcaaaattcaatgtacagaattctgagttaactatttaatttttcactgatgatttatgctacttacatgataggatcatgtatgcctacatttactacactttgttaaacaacataatgtaaaaatctaattcaacacaaacgtttgaatataaaggtatacctctctatcaccatccttatttatttctggttcttgagatcttttctgcagatgtaaaaacagaaggttaatttgcttgttgtatttctgtgacatttcctcttttggagtgcatgtttttaaaataattttattctgaagtaatcaagtatggacaataaaaattagaaagtaattaaaattaaactgttaaaataaataataattaaaattaagaattaactttttaatctatgtttagctactgccacatcactggcttctaacatgtgaaaaataattcaccttagacaaagggagaagaaaaacatgaaccagcaaacttaactttctcactatttgtttggactaaatttaatttgttatgtgttaaatctaccaaaaatgaatcagcagatgatttgtagtgttccaaaatcttcctcacttgaaaagagtttacctcatgaaaccctaactagtgagcacctacagtgcactgaagtgcttttttaaaagattcctaactggattgtaggcaccctttaaactattaggagccgaaatcaacaccaaacagaaagaaatgcaaattctcacattttaattgaaattatatactgtcatatgatagtgttatgtatccagattatctgcgtaagtccagttctaatatattctaatgtgtactaatgacagcagataaaattttttaatctctactgattttctgcaactgaaataaattagaatgttattgtgtttgtgcactaacaccaaaggtcccattctgcaagatatggttcttgtaataggcagttgggttgcttttatgacctggttccctccctgaacagaaacactgaggtcaacgagagaccacaaggcaggatatgtccttaaccttggtatcagtgactgacaatataaaactgtggattttcaatcacaggccatgattactctttaaccatgaatccagctcagggaatcagtgttacattgttcataattcctattgcttaataatatgattcaatcattgatgttactttctttatcatgttagggtgttgtaaaaataaaagaacaaacaaagttctgaaatttgtttttgcctctattccaaaaggagagattagctataagctaatcaagaaggcagataagaatattttaaaataagagtattttaaattttatagtgggttatgttgaagttaaatatcaaatattaaattagaatctattgattcttctgttaataaggttgctgattttattacaataaattttaagaatctattaaaatttttttttttttttttttcacatggagtctcgctctgtcacccaggctggagtgtagtggtggatgtcggctcactgcaagctccctctcctgggttcatgccattctcctgcctcagcctcccgagtagctgggactacaggcacccaccaccacgcccagctaagtttttgtatttttactagagacggggtttcaccatgttagccaggatggtctcgatctccagacctcgtgatccacctgcctcagcctctcaaagtgctgggattacaggcgtgagccaccttgcctggccaaaagattcttaaaaaaacaatctactgattctcaaagcctagtctgaaaggtaatttcatttggactatctaatattattaaggcaaaaaaaacacaacattaaacaaaagtttaaatttaaaagtttccatgcctctggctggccattttcactgcctttaagcctttgtgactcttcctctgatgtcagctttaagtcttgttctgttgaaaaatccatacattcagttaaaatcaaccacttaaaacagttaaaaactattgccttttaaaaacagatttgagacatttcattttatttcataaattgagtgtttcatcttttgtgaaattgtcatttaagaaataattctcaaaaacttcaaaaacccacttggggagatagcagatgtcaccagattgaagacaaacaaacatgtcaaaaattccctcacaaattcatccacccaacatccatgaacaaaaccaccagaaacacagctttaaaatacagtagaaacatataaggtgacacagtgtactgttctccacttcctaatagtaccttataaatgatttccaaaatcactgctgacacctttattagtgtacaacatcttcctaatatctaaaatgtttctctccactattctgacaaatttattttctttttttcttttttctttttttttttttatgagctagagtcttcctctgtcaccaggctggaatgcagtggtgtgatcagctcactgcaacctccgcgaccctggttcaagtgattctcctgcttcagtctcctgagtaactgtgattacaggcaagcaccaccacacccagctgatttttgtatttttagtagagatggggtttcaccattggacaggatggtctcgatctcctgacctcgtgattccctctgaaagtgctgggattacaggtgtgagccaccacacctggccttattttcatcttttgaaacaatgctatatgaagtcttccttgattctgcatgtctttccccaaataaacaggtacctccttccttgaggctgccttagtactttactgatttttctactgcatcttgaccacctaaactgtacattattcctccacgtctgtcccctctgctccaagactgcaggggagagtcttgcacatcatctttgtaaaaacagtctttgttttactcagaaatattttattgagtcctgctaaatacatgctaggcattagggtttaaaaagaattaaaataaagcatgtcagagatggcttttctagaacacatgcccaagcagagacttaaatattgagactagccagattaaaaggtgtagagggcaggaaagggtgacggcatgccacgcagcagcaagagcgggagcgactcctgaaagagtgaaagtatttgcctacaatagaaggatgagtgagtagggcactgccagcagttcagtaatgccagagacagggcacacagggaaaagggctaaagatggagagtggggcagaagtcagattatgaaagcattatgtgtaattttaagatgcttgaacattaatgttcaaaagtggtcccgggtcctatctgcatttagatatagatcatttcaatgccaaaaccaatattcctagtgaacaattattcattaagacaaggtgacagatagctcatgtggacacagctgagatgatacaatgtagcaaattctaaacaattctcatgaacacttggaaagtcagttctataataaagtcatacaaattataataaatcagtaaatatttggtttcggaagatgctttgtaaagttataatgcatatgaatacaattaacagtcgtgaattcagagctgtgaaaataaatcaaagaaaccacattgtgtttgagtcagcaatctttagatttctatccagtcttcccatccagtccataaattctaagtataatcctggtactcactctcaagtttacgttaaatactatcccattacaaaaaaacactctttctcttacttcttttcattatgtcctgctaaaaagattctgattggctgcaggcggcaagagggaaaaacaaaaagcacattttgcagaaaatgattatttagaagtcagaactatgacatgaagccaagcagggcactctaggaccgaatttgctgtgctgccttcatacgctccttgctctttcttttctggcagctgtgactcacacaggtcatggagagtatcattccctaagaggaacaactccgatattcatctttatctattaagttcatctgtcccaattctgtgttctgtggatgctgactttctgtcacggacgatgatgcacatggacatttattactgactttcagattcttggatctttgacaagtcttattacttagagtcaaactagtaggatgcgagttataaatgctgattatccaattacctactcaaaataccctacacgaatattccattaaacatgcatcgaaaaacattagtcattcctgctgacctgctgctctttgctctcctgtattcaccagaaaatttcctactccttcctcatgtccaggttaaatactagtgtgcaatctggaaacctgtacatcatctgagatttctctctgtcccccaagcctttctcattcaattatcactaaatcatattgactatacctctcttctgcctctgttttatattcccactgccactgggaacacaaacatttacaaaatgacttctatttaaaagaaaactgccaactattaatgttatttcttacaggaaaaaaaattaagcaaaacaagtgaaaaaggcataacgaaggccaacatagtaaaatgagtaactgagatttctaacgttatttattttaccatggacgggtgaaaaccttgtaatacattgatgctactccaaggatgtgtgacatggaaactatagctgactactgcaaaagcttcctttgtctcctggtttctttgcatgattatctcccatcaatcccaggaaactataggccacaggccaaatccaatctgcattatggttttgtaaataaagttttataggagctcagtcatgcctgtttgcttacatataatcatggtggctttcacactacaacagcagacaacagcacggttaagtagatatgacagagaccacatagtccaaaatatttcccacctggtcctttaaagaaaaagcttgctaacccattttacaccataaccagaatgccttaatactcaaatttaatcttgtggctcccctgctcaaatttctccaatgagccccctccagcacacattgttggctccctatcaatagccattcctcattctttctggcagaaaaaacataagtctattgggatatttaatatcccaatccccctcctcagcctcagaaagaaatgtttattctaagctaatcagatatttaccttcccagtgcctggtttgggaatgagcatgtggtatgacccagccaatgaaatgttacaggaagccccttgcatgcttctaagttttctccctgtttaaaagacacatgtgaagaaaagcagccctttcgatgttgtgttgtgagaacaagatgtttggagctgctgcagattagccaaccacaaaaggagacgtgaataaaacactgtcaacagcacagctgaaagagggacaagtgggatccctaggatatcaatgaacaaaaaaacaactctggttcctagtgttttaggcactgctcatctagtatttgcagtccaaagcattctacctggtaaatttcccatggcccacaggaaaagacctactcatttctatagtattaaaaagtctatcgtaaacttgccttagctaagtattcacctcactcccaacctctggtatctcacacttttggtactagcaaaagtgaactgctcagaaaccctgccatgttcactcaagcatcttgtcttctgcacttgctgctcttcctcccaaacgggcaatctcattagatgttccttctggcaaacacactatctcactccatgttccttctgccaaatgtcattcctctgcttctttccctgaaaaattcttctcactctgcatgcttacattaaatcctgcctcctttctttctaaagctttcactcctcatcacatatgtctggcacacaatcaatatcacatataataaatcataattataagattccagtgggcatctagcacacagtaagcactgaataaagcagcaaaataataaaaatgacaatgataataataacaagctcctgtctgtttttgtgttctgtagccttagaaaaactgcttagtatctaaaagacatttgacagttatttgttaagtggacaagtgaaaacataaataaaaatgttttctttgtaaattctgttgaaaaaccacagaaatgaaatagaaacacttctgttgtgagcaccttaaagattaaaactacatctattccatctttgtctcctgcaacttataaaacctaacttacagaagctctttgataaataggtagctaaattaaaggtgtcctcatacagtttggattgtaccatgtattaggtgtccacatccaggtagcatactagcatttttgttactgtgaaacatttttatatttttattataatctgctgacccttgcattgggaaaattgtacattatgacaatcttttggcaaatggtagcagagcaccttcttctaacaaaattactgttatcatgacaattaaccagccggtggaagaacacatcttgttccaacaaagtaaatgcatctctttcaacttcaaaataggaggaatgaagtcagtaacagtgagaccttgttggcacaagcatatgtaacatgacctgtgcttcactgttcttttgtgaacaaaaattccttacttttactttttaaatctatggtaggacctcccagagcagggctccacaactccccggccacagactggtaccagtccacggtctgtgaggaaccacgccacacaggagtaggtgcgcagcaggcaagccagggaagcttcatctgtatttacagccactccttatggttcatattacagcctctactctgtctccagtcagatcagtgatagcattagatactcataggagcatgaaccctgttgtgaactgcccatctgagggatctaggttgtgtgcttcgtatgagaatctaatgcctgatgatctgtcactgtctcactttgcccccagaagggaccatctagttgcagaaaaatcagctcagagcttccactgattctacattatggtaagttgtataattattttattatatattacaatgtaataataatataaagtagcacaataagtgtaatgtgactgaacaatcctgaaaccatccccaccttcccccagcccatggaaagattgtcttccacaaaaccggtccctggtgccaaaaagattgtggacaactgacctaaagtaattcactatcacaagtcttacctgggttgctgttttcagaagagtattttggcatctgcttttctttgtagtcagaaagtaattcacaaattctatgtataaaaatataacaaataaaattactgttttaaaatactgatctggaaacttaccaaatgtaaaattcttagagtatttcaaacaatatcagaatatcagaacttaacagtattatcccatccacttatgcgtacgttctacaaacttctcatgaagcttctaattaaagaagaaaaaaaagtaagatgaaatactcataaatcgagggcactttgacccagtaaattaacttgcattagcctgacataatagaaagtgtcccaactctaaataagtcctagctccataatgaacagctatttgctcttgaacaagctgcttctcttaggctcaatgtcttctacaaagtgaggactatgctgccttattttactaggttgttataatgatttaacacgataacatttttttaaatgctcaaagaaatagtaaaacaatggaataatttgttcctaaactttatgactgaaattatcttggaatcccaaataaaacccagtgcgaattttgttcataggttctaatatgcaaatgttgtagttttcaggaaatgttattaagtcctaattttgcttcttagttgtcctactctttatggcttctaattcagggcatctcaactatgtcatagtttgtaactaaattttttcataaatatctcattaaagtagataatgtgattgtccactattacggagttgatcaatcacgccaagggcagaaaaaccaatggatgtcaagacctgacttggaccaatgatccttctctacagactcaaactctcagccagatgtttgttacgatgatgctttatatacatgttcatctccagctgacatgggagacgaaaaccctacttttatttttttttaggttccacgaagaagttgtaagttgccattctctaatttttaacatacatactaacaatatatttggtacacaacaccccacacgttatttggctctggtgtcatctcacagaccaccttacatgactatttttattgcgcaaatcacaatttcaatgtttttgtggcacccattctgctttgattcacaccatttccttaaagctactcagcaaacagtcaaatgaccttccagtgactgcgcaaaatatagaatgcttcaaaaatttgtgtggccgccttatgcaagggccagctccttgggaggctgaggcaggagaaatgcatgaacccacgttgcaatgaactgagatcgcgccactgcactccagcctgggcgatacagcgagactccatctcaaaaaaataaaataaaataaaataaaatagtaaagtttgcaattcctctgactcagtttaccataatgacaattatgattactattaaagaataaatagtgaataaccacaatattgggcttttctccctaaataaaaaaattaatataaagaatgtagcttattacaaagagccaaaacgattttaaaaatgcagacaattaccaggcaaaactgttaggaaagaaccatgtcaaacttttttttttttttttttttgagatggagtcttgctctgtcacccaggctggagtgcagtggcacgatcttggctcactgcaagctccgcctcccgggttcatgccattctcctgcctcagcctccatagcagctgggactacaggcgcatgctgccacacccggttaatttttttgtatttttagtagagacggggtttcactggtctccacctcctgacctcatgatccacctgcctcggcctcccaaagtgctttgattacaggtgtcagccaccatgcccgacccatgtcaaacattttcaaagtgagaatcaatcaaacaatatacacaggataaactccattcacttatttaataagtatttattaggtagctacatccaatatgctaagcctttttctaagcagtgaagatatggtagtgaaaaataaaaaccctattcatgacagtgagaaaaacacacaataacaacagacagataaggcaaaatatacggtatgttagaggagaaaaactaaagcaggaaaatgaaatgtttatgtgtttgatggggagggtggtgggaaagttgagatggccagaagagtccctgctgagaaagggttttttttttctaatacaaaaaaccttttatttgtatatcaaagactctaagaaatgatgacataaggttaacagcgttgatgtcaagatacaaataggtttgaagttagagatgataaatcactttgtttcattgaaccttgccttgattaccttagagagcattccttgtatgctgccaattgcatcttaagcatgatgcgtctgggtagtacacggttcttcctcagaaagtggatgttccttaatgtgtttctttttaccctttgtcttcttcttcttagaaaggcggttttaaataaagaactgaaggaatggaaagagttaagctaggaggatatctgggggaaaagcatcccagacacagggaactgccaagcacagaggtgtgtctggagtctttaagcactaggggtagatacgggatggcaagaattcagtgtggctgaagcagagcaagggagataatcaggaggaactttgacccatactcagagtgaaaaggaggcaatcagaagtgctggggaagaggaatgacacaatttgacttatgttttaaatacatccactgagttaagaattgatgaaaagggaagtttttaaaagccaggacgatcaattcccagtctatgacactcatgactgcagatgacagtggctcagatgtacaagatatgactggcttctggtcatattcttcaggtagacctgacaagatttactgaaagattagatatgaggtgtcagagggacagatgagtcaagaatgacaatgacatttttggcagagcaattggaagagttgcccttaaccaaagtaggaaagactacatgaggtgtagatttcaggaaggacatcagtagcccaattttggatctgacaagtgtgtgatacccaataactaaccaaatagagacgtcaagtaggcaggctgatataaaaaatctggaattaaggagagagatctgagctggagacatacatttggaaatcactagcatatacacaatagaaaaagtcatgaggggccgggtgcagtggctcacacctgtaatcccaacactttgtgaggccaaggcagacagatcacctgaggtcaggagtttgagaccaggctggccaacatggggaaatgctgtctctactaaaaatacaaaaattagccaggcatggtggcacacacctgtaatgccagctactcaggaggctgaggcaggagaatcacttaaacccaagaggcagaagttgtagtgagctgagatcacaccactgaactccagcctgggggacagagtcaaactccgtctcaaaaaaagaaaaagaaaaagtcaggagaaagaagattgaggactgagccctgggaaacaacaatgtccaaaaggagaaagatgaggaggagcaagcaaaacagaccatgatgaatggactagaaatgcaggaggaaaagcttgagggagtgaggacctgaaagccaagtgaagacgccgttagggaggagacgccctccactggctcaaatattgctgacagattaaataaaatgaggtgtaagaaaaatgcataatttacagaaaaaaattgtgataatcttgaggaaaaacaatgttggaggactgctgaaattgaagacgccggtgtgagattaagagtgaatgaaaagaaaatttgagttcgtgagtgtggacagttcttttaaggacatcatgcttaggagtcatgactgagaatgttgtaattttcttccacagtcatggaaaagtaatagacaaatagtttcaagttttatataacaggtgtagttttcaaattttatataacaattatatattttaaaggttataaaaattatacacatgtggcattaaaaatgccagactgaggtgttaaattcttaaaactatagaactaaaagtcgccttgaacatttctagattacacataagctgattatcattttattcatgcttatacataaagaccaagaaatactaaaagtttcaaggagagtatttcttgcttgataaaatcagccaattctaggaaaactgatactcatcaaatatacaaaataattgatcacagcaaaatactgggttctattaacaggaataaagtgggagaaatgcagaaaataatcttattttataaatgaaatttttaaaattatatgaagtcactgtggaaaaatatggtgaggtgaatactgaaatatatccttttctcaaaggaaggataatttcacacacgcagggcacttttacaaataggagtcacttcacttgcagcaccttccttttagcacaagggtcagcaaattagcaccttgggccaaatccagcccactgcctgtttttgtaagtcaagtattttggaacacagccatgcttattcactttacagtccacagtgtcaattagctgggtgtgatgttgcacacctgtggtcccaactagtagagaggctgaggtgggaagatcactagagctcagaaagtcaagacttcagtgagccatgatcacacaactgcactccagcctgggaaacagagtgagaccctgtctcaaaaataaattaatttatatagtccacaaagcctaaaatatttactaactggctctttgcagaaaaagctggccaactcctggtttagcagatgaaagatcctttgatatattttaataaaagttttacccaatatactgaaacgtttatattaaatacagatccccatgtacaatcccttggcaatattcagattgagggtccaatatttcagcactcaggcactgacaataaaaatttaatgactagcaatcttgttgctaacaaggtacagcatcaatatagcatgtagcttccatttgcaacacaggaaatattacaagaattttaacaagaactcttaagatgtcatcactgatgctttaaatacactttaattgtgaaataatcagtatactctagatctaacctcacttgtaaaaaatggttgcatactacattaatttctgggtatgaaaattgagctatttcctattggtaatgatttacttttgataatgataatttcctattgataaggatccatctttttgatataataatgctgtaataaatgtccttatacataagtatatatgtaacaaatctacacaaatatcctttacatatattatatatccttattgttatacatgtgtttgtgaatatgctactaaattaatgttcaaaatgtatttaccagcagtgtatgaaatgtcttttacaatgaaaccatttcttttgcagcaacacagatggagctggaggccattatcctaagcaaactaatgcaggaacagaagatcaaatgccacatattcttactcattactgggaactaaataatgagaactcatggacacaaagaggagaataacaggcaccaagggtctacttgaaggtggagcgtcgcgggagggagacgaccaaaaaactaacttttggtgttttgcttattatgtggctgatgaaataatctgcagtccaaatctccatgatacactttacctatataataaccctgcacatgtacccctgaaactaaaagaaaagttcactaaaaagaaaagaaaatgccttttccctcacatttgccaatactggttatttttcaaataaattaatgcctggaaaaatggtaactcattgttcgctgattttcatttttctgattaacgggcaaggctgaatatcctagtaaaactataaaatttgttcatcatgaatattagcccaaattagggttagtttgacagcacatagttatcttctattcaatgttgccataggcttacctgtgatactcttcactttcgttgtcaggaaattgctgattttcaggtgttctgctcttcctttgaggaattaatccattatcaccattgccagcagtgacaccattagtcaggttttctagtaatcccacattattactttcatgcttcttcatttcttcttcaaccttgagtgggatattaaggatagttatcactttattgaataaaaagaacctttttaattgattctatcaattgactcagtttgtcattattttagtcattaaaaatatttcacacttaaatttgatcatatatatagaaatattaccatataactttaagatgtaattatcatctcattaatatatcacagaaatttttgtaaagtttgcttcatttctgtttcaatgaatgaaacagaattttccaaaattcaaaaagggccctccttcattttgtgcttttattctcaatcactcttcagaatcttatgtatgtatttaccccatttgattcatgggaacacacaaataaaaagacaaagatgcaaaatgtgtcctcttccgtctttaccacctagattttacattaaacagtcagatttagaggatgacacactgtgcggcttcaggaatagaaaggaagtttgcccttttctgcgctaagatattcttctaccccactgcctttgagcattcttttttcatttggttgctgggatatcaaaaacatgatggtgctcactgaaaatgggagccaaagtttgccacaacacaagaagcagagtgaaactgctgacgtgcaagcatggaattccagaaaatgagatgctccccaaatttcacattgaatagccatacaattttctagctggaagatacacagaataaaaagctatcttctttagccacattatctattgataatcagactaaaaccaagaaagataaaatgattggtccaaagctcctaaagtggcattacctagcattttatagcaccattcaggattgttccataataatcaaagaatatctctaggctttgtatctcttgaaaactcaatgtacagaattctttctgagttaaatattaactttttcactgatgatttatgctacttacatgataggatcatgtatgcctacacttactacattttgttaaacaacataatgtaaaaatctaattcaacagaaacatttgaatatgaaggtatacctctctatcaccatccttatttatttctggttcttgagacattttctgcagaggcaaaaacagaaggttaatttgcttgttgtgtttctgtgatgtgtcctcttttggagcgcatgttttaaaaaaattttattcttaactaatcaagtatggacaatgaaaaattagaaaataattaaaattaaaatttaactgttaaataaataataattaaaattaagaattaactttttaatctatgtttagctactgccacattactggcttctgactaacatgtgaaaaataattcaccttagcccaatgaagaaaaaaaacgtgaaccagcaaacttaatttggtcaccatttgtttggactaaacttaatttgttatgtgttaaatctaccaaaaatgaatcagcagatgatttgtagtgttgcaaaaccttcctcacttgaaaagagtttacctcatgaaaccctaactagtgagcccctacagtgcactgaagtgcttttctaaaagattcctaactggattgtaggcaccatttaaattattaggagccgaaatcaacaccaaacagaaagagatgcaaattctcaaattttaattgagattatatactgtcatatgatagtgttatgtatccagattatctgcttaagtccagttctaatatattctaatgtgtactaattacagtggataaagattttttaacaatatgtactaattttctgcaactgaaataaattagaatgttattgtgtttgtgcactaacaccaaaggttccattctgcaagatatgattcttgtaataggcagctgtgttgcttttatgacctggttccctccctgaacagaaacgctgaggtcaacgagagaccataaggcagaatatatttttaagcttggtatcaatgactgacaatataaaactgcagattttcaatcactggccatgattactccttaaccatgaatccagctcagggaccatcagagttacattgttcataattctattgcttaataacataatccaataattgatgtaccttcttcatcatgttcgggtgttgtaaaaataaaagaacaaagttctgcaatttgtttttgcctctattccaaaaggaaagattagctataagctaatcaaaaaggcagatgagagtattttaaataaaaatattataagagtattttaaattttatagtggttatgttttttaagttaaatatcaaatgttaaattagaatccattcttctgttaatgagattactgaatttattaaaataaattttaacaatctattaaaaaattctttaaaaaatctattgattctcaaaacctagtctgaaaggtaatttcatttggactatctaatattattaaagcaaagaaaacaacattaaatcaaaaatttaaatttaaaattttccatgcctctggctggctattttcactgcctttgaacctttgtgactcttcctctgatgtcagctttaagtcttgttctgttgagaaatccatatattcagttaaaatgaaccacttagaacagttaaaaactattgcctttataaaaatagatttaagacaacattttatttcataaattgagtgtttagtttttcatgaaatagttatttaggaaataattctcccaaacttcaacaaaccacttggggagacacctgatgtcattcactcacaaattcatccacccaacataaatgaacaaaaccaccagaaacacaactttaaaatacagtagaagcatctaaggtaacacagtatgttgttctccacttcctaatagtgaagcagtaaatgtaaagaaaaggaaatttagttttaaagagaaacaagttttcccgcacttagctagtctgactctaaggatagtaacaagcagggcccaggaaaggtcgtggtgaccctgcctgagaagccagagcccacaggtatgggctccagacatcccagagcaaggttaagaaaacaaaatcctttactgtctccccttcccctcagcattcactcagagctgtttttacaaatgcatactattcgcaagttcctgttgaccttcaatgcagctgcaaggtcataagctttgctgaggttgcaaaactgtcactatatgattaactgcctttgttctgcttctgtaagcttgcctacataagccaagccctgtctttgttcagggctcagctttcggatgcaaatctgctgagctgttgcgaacctaaatgaaatcctcctgtttcacccacttggtctctcctgcctcctgctttctgcaacaatagtaccttacaaatgatttcaaaaattactactgacacctttattagtgtacaatgtcttcccaatatctaaaatgttttcctccactattctgacacatttattttcatttttctttctttctttttttttttttttttgagccagggtcttgctctgtcaccaggctggagtgcagtggcgcaatctcagctcactgcaacctctgacactccctggttcaagcgattctcctgtctcagtctccggagaagctgggattacaggcatgtaccatcatgcccagctaattttcgtgtttttagtagagacggggtttcaccattggccatgatggtcctgatcttttgaccttgtgatctgcctgctccagcctcccaaaatgctgggattagaggtgtgagccaccacacttgtccttatatttatcttttaaaacaatgctatgagaacgtcttccttgattctgcatgtctttccccagataaacaggtacctccttccttgaggctgccttagtacttcactgatttttctactgcatctttaccacctgaactgtacattattcctccacatgtctgtcccgtctgctccaagactgcagaggacagtcttgagcatcatcttactcacattttactcagaaatttcttattgagtcctgctaaatacatgttaggcattagggtttaaaaagaattaaaataaagcatgtcagggatggcttttctagaaaacatgcccaagcagagacttaaatattgagactagccagattaaaaggggtagagggcaggaaagggtgacggcatgccacgcagcagcaagagcgggagcgaggcctgaaagagtgaaagtatttgcctacaataggaggatgagtgagtagggcattgccagcagctcagtaatgccagagaaagggcacacagggaaaaggcctaaagatggagagtggggcagaagtcagattatgaaagccttatgtgtaattttaagatgcctggacattaatgttcaagagtggtccctgatcctatctgcatttagatatagatcactttaaatgccaaaaccaatattcctactgaacaattattcattaagacaaggtgacagatagctcatgtggacagagctgagatgatactatgtagcaatttctcaataattctcatgaacacttggaaagtcaattctataagaagtcagagaaattataataaatcacttaatacttggtttgggaaggtgctttctaaagttatagtgcctatgaatttaactaataattgtgaattcagagctgtgacaataaagcaaagaaaccacattgtgtttgagtcagcaatctttagatttctatccagtcttcctacccagtccgtaaattctaactataatcctggtactcactctcaagtttatgttaaatactagcctatacaaaaaacactctttctcttttttcattttgttatttatatattgctttgtttaaaggaagaacacaaaaatgccctgctaaagggattctgtttggttgcaggctgcaagcggggaaaaaatcaaagtgtatttcacagaaaatgattttttagaagtcagaactatgacatgaagtcaagcagggcactctaggactgaatttgctgtgctgccttcatacgctccttgctcgctcttttctggcagctgtgactcacacaggtcatggagagtatcattccctaaaaggaacaactccgatattcatctttatccattaagttcatctgtcccattctatgtctgtggatgctaacttttgatcattgatggtgatacacatggacatttatcatcaactttcagattcttggatctttgacaagtcttattagtgagagtcaaactagtaggatgcgagttataaatgctggttatccaattacctattcaaaatatcctacatgaattttccattaaacgtgcatagaaaaacattagtcattcctgctgacctgctgctctttgctcttctgtattcaccagaaaatttcctccttcgtcctcacatccaggttaaatactactgtacaacctggaaacctggaaattatctgacatttctctctgtcccccaagcctttctcattcaattatcactaaatcatattgacgatacctctcttctgcctctgctttatattcccactgccactgggaacacaaacatttacaaaatggcttttatttaaaaaaaagcctgccaactattaatgttatttcttacataaaaaaaattaagcaaaacaaatgaaaaaagcataacaccaaaaaaacaaaggccaacatattaaaacaagtagttgagattcctaactttatgtatttcactaaggacgggtgaaaaccttgtaatacattgatgctactccaaggatgtatgacaaggaaactatagctgactactgcgaaaacttcctttgtctcctggtttctttacatggtaaagaaccttccatcaatcccagcaaactataggccacaggccaaatccaatctgccttatggctttgtaaataaagttttataggagctcagtcatgcctgtttgcttacatataatcatggtggctttcacactacaacagcagacaacagcagggttaagtagatatgacagagaccacatagtctaaaatattgcccacctggccatttacagaaaaagcttgctaacccgttttacaccataaccagaatgccttaatactcaaatttaatcttgtgactcccctgctcaaatttctccaatgagcccctgcagcacacattgttggctccctatcaatagccattccttattctttcttgaagaagaaatccaagtctattgggatatttattatcccaatccccctcctcagcctcagaaacagaaatgtttattctaagctaatcaggtatttaccttcccagtgcctggtttgggaatgagcatgtggtgtgacccagccagtgaaatgttacaggaagccctttgcatgcttctaagttttctccctgtttaaaagacacatgtgaagaaaagcagcccttgcgatgttgtgttgtgagaacaagatgtttggagctgctgcggattagccaaccatgaaaggagacgtgaataaaacactgtcaacagcacagctgaaagagggaaaagtgggatcctaggatatcaatgaacaaccaaaacaactctggttcctactgttttagccactgttcatctagtatttgcagtccaaagcattctacccagtaaatttcccatggcacacaggataagacctactcatttctatagtattaaaaagtctatcataaacttgccttagctaagtattcacctcattcccaacctctcgtatcacacacttttggtactagcaaaagtgaactgctcagaaaccctgccatgttcactcaagcatcttgtcttttgcacttgctgctcttcctcccaaacaggcaatctcattagatgttccttctggcaaacacacgacctcgctgcatgttccttctgccaaacattcttcttctgcttctttacctagaaaaattcttctctctctgcatgcttaccttaaatcatacctactttttcccaaaactttcattcctcatcacatatgtctggcacataatcaatatataataaatcataattataagcttccagtgggcatctagcacacagtaagcactgaataaagtagtaaaataatgaaaatgacaatgataacaaaaagctcctgtctgtatttttaattgtttgtggtctatagcattagaaaaatggttactatctaaaagacatttgatagttatatgttaagtggacaagtgaaaacataaatagaaatgttttctttgtaaattctgttgaaaaagcacagaaatgaaatggagacagctctattatgagcaccttaaagatcaaaactacatctattccatctttgtctcctgcaacttataaaacctaacttacaaaagctctttgataaatagatgactaaattaaaggtgtcctcacacagtttggacaatataatgtattaggtgtccacaaccaggtagcatactagcatttttgttagcgtgaaacgtttttctgcttttattataatctgctgagcctagagttgggcaatttgtatatttattatgacaatcttttggcaaatggtagcagagcatcttgttctaacaaaattactgttatgatgacaattaaccagcaggtagaagaacacatcttgttccaacaaagtaaatatatctctttccaacttcaaatgaggaggaatgaagtcagtaatagtgagaacttattgggacaagcatatgtaacatgacttgtgcttcagtgttcttttgtgatcaaaaattccttacttttacttttttatctatggtaggaccacgcagagcaggggtcctcaactcccaggccacagactcataccagtccatggactattatgaaccacaccacacaggaggaggtgagcagcaggcaagccagggaagcttcatctgtatttacagccactccttatggctcatattacagcctctactctgcctccagtcagatcagtgatagcattagatactcattggagcatgaaccctgttgtgaactgcccatctgagggatctaggttgtgtgcttcgtatgagaatctaatgcctgatgatctgtcactgtctcactttgcccccagatgagaccatccagttgcagaaaaataagttcagagcttccacggattctacattatggtaagttgtataattatttcattatatattacaatgtgataataatataaagtagcacaataaatgtaacatgattgaataatcctgaaaccatccccaccctcccccagcccatggaaaaattgtcttccacaaaaccggtccctggtgtcaaaaagattggggacaactgactaaagtaattcactatcacaagtcttacctggattgctgttttcagaagagatttttagcatctgtttttctttgtagtcagaaagtaactggcaaattctatgtataaaaatgtaataaaccaaattactattttaatactgatataaaaaaacttaccaaatgtagaattattaagagtatttcaaacaatatcagaataacagaacttaatagtattatcccacccacttgtgagtacattctacaaacttctctttaagcttctaattaaagaagaaaaaaatgtaaggtgaaatagtcataaatcgagggcactgtgacccagtaaattagctagcattagcatgacataatagaaagtgtcccaactctgcataagtcctagctccataatgaacagctatttgttcttggacaacttgcttctcttaggctcaatgtcttcttcaacaaagtgaggactttgctgccttatttcactaggttgttataaagatttaacgagataacattttttaaatgctcagagaaatagtaaagcaatggaataatctgttcctaaactttatgactaaaattatcttggaatcccaaataaaacccaatgcgtattttgttcataggttctaatatgcaaatgttgtagttttcagaaaatgttattaagtcctaattttgcttcttagttgtcctactctttatggcttataattcagggcatctcaactatgtcatagtttataactaaatttattcataaatatctcattaaagtagataatgtgattgtccactattacggagttgatcaatcacaccaagggcagaaaaaccaatggatgttaagacctgacttggaccaacgatccttctctaccgactcaaactctcagccagtagatgtctgttaggataatgctttatattgatgttcaattccagctgacatgggagaccaaaagtctacttttattttttttttagtttccacggagaagtagcaagctgacattctgtaattttcgacatacatactaacaatatattttgcacggaacatgttattcagctcaaagtcatctcatagaccatcttacatgactatttttgcagcacaaatcacaatttcaatatttgggtggcacccattttgctttgattcacactatttcctcagagctagtcagcaaaaatagtcaaatgaccttccagtgactgcacaaaatatggaatgcttcaaagatctgtcctgcctccttatgcagaagccacgctaactttccccgtattgttccaattttaggatatgtgccgccgaagcaagcacaaagccctacttttacatatgattagtgatgcgtcatggacaaggcttggctctgtgaagtccaactaacctacttgagattctgagaattctcttcaatggcttcctgtgagctagagtttgaaaatatcttaaaatcttgagctagagatggaagtagctccgataattttcattatcatgtaaatcagatcactcaaggggccaaccacagctgggagccactgctcagggcaaggttcatacgggactttctactgcccaaggttctatacaggatataaaggtgcctcacagtacagatctggtagcaaagaggaaacagacactgacctccttctgccacattatttgaacccctctcaccctttagaacaagcccacctaacatctgccagagaaaagaccaacaacagcctcaaaggatctcttaccatgaaggtctcagctaattcctggctaagatgtgggttccacattaggttctgaatatgcggggaagggtcaatttggtcactttgtgtgcggataaagtcaggatgcccagcggccagagcagggggctggtgctctgggaacaatggctgagcatataagcataggtatgggaattaaaaaacatcaaagtcactgtatgaatcgccatgaagacttgagggatctgaatctactgattcatcttaaggcagcaggaccagtttgagtggccacaaagcagcaacagaatcaacggaaacaacagaatgattgcaatgtcttttttcctcctccttctgacttgataaaagggactgtcttccttggatttagtgaactccttcggttcttgaaaaattcaaggagtatgtaggacatagtccccagaagacagtacaagactttccgctaaactggacatttcaagacccaaataactaatcagaaaaattaaagatgtgacactattttttatccctgcataggtgttacacttggatcaaatgaacaatgctgggatctctaaggataaagatcttaaaagtcctgagataaagaatcccgcacccattggtacttctaacttgtcttgctttttgtctgatttctggctgatgcaggggactaaaactcactgccacgcgaaaactacctgaaccaaactatgacatctcacctgatatgtgagatgcaactgttataattattttaaacctcaattcagcattaactagccttttaatgtaaacacttacacatgatgatgactagaaacagcatactctctggccgtctgtccagatagatcttgagaagatacatcaatattttgctcaagtagaaggctgactatacttgctgatccacaacatacagcaagtatgagagcagttctaaaatgacagagataggaactgtaataaagttatttttaaagctaatttgatatactttaccaatgtaacatcttgcctgtctgtgcagaatcaaacatttacatgcactaaaagacataagcaacctgagtgctcaagtgttcatctttgtaaaatgccaccaaggttaaaaggaagggaccaaaaaaaaccctcttatctcagtggggtattgcatagcagaagctactaatttaaagtcctttgatgggcaagaaacaatgttagggccacttatctgaggtggacaaagatttaagtgaagattttgtcacagcttccctagactgacatgctgtaatagaaaatcagctagggggtaagagaaataagagctctctgcatgctcaaagcagtaataataatggtaagaatagtagtcataggagtttcagttaatggtgccaataaccatgtgctaggcactgaattaaatgccacatatatctttcttacttatgcacagccaactttgaaggatatattctcctacttttcatatatgacaacatatttggtggtaaataacgtccccaaggtcacacacctagcaagtaagaaagttactaattaaacccagtcttgtgtgaatccaaagcctagctcttttctctttatcacccacgtacggcttgtcttcattaaaggaaaagtgtatccacttaaaactatcttcactccctctctccataccaattaaaaataaaaacatcaaaatacactggaaaaacaaaaggaaaaaagctgttgaacccacagtatgtgggaacagcaattaattgttatgtagggataagctaacactaatattcttcaaagaaagcaacttaaagcaaagtcattaaaaagacaaaaggattttcaacccctatttatgtttaatacagcatatttaatggaaaagcatgtaagacacaggttaaaaactattagaaagggttaagaagttcaatactgagtcataaagtaaactaaaagttaaagttcaaacttcataaaattaatatgaaatcctttaagctaacataagatcatgtaaccaaaaatgtcacataacaaataacatcagtcaatataataagagaagatgaatcctactaaaactgttctttatgttgcccagcccaagtaattgtttttctacctaactgatttgtgttgatactgatcactacatcccagtaagtatacattaatcttattaatttaatatttatgacttgagtgactgctgtccatctacaacacacagattaaaagaaagaactataccttccatatctatccagtgcatttaaattcgcttttttcttaattaaaaatttcacgacttgctgtttttgctcatgtacaccaagtaacagtggtgtgaggccatgctgtaaaacaatataaagcaaaaacctatgtaattcaaaaaagtacatattcctcaaccgaagtggaaactttatataagatcttatggacttacacgcatagaagtaaataaaatgtagtcacttccttctcactcttctgtgctttcccacacgctgctccttcccttggaaacaccccttctctgcctcaccacagtaactctaatcatctcaaaaactcactttaaacatttactgcttccaaggctctttgcttctaaaccagcatttggcttggtgttattggatgataatatttttcccatctaaacaaaaagcttcttgagggcaggggctgtatcttttgtctctatatcctcaaccctaagacaaattgtgtataaagcaagaatctgcatgtaaaatatttctttagtttcatgttttaccaaaagttcaacctccaacatgcaacaaaaattgctattaaaactcatactgcccatttgaaaaaattttccaacatttatttatttaaaatctatttgtatttaattttcccagattgttaactaaaccatcagttcataggactactgaaactaaattaacagaattcctatctgtattcttaataactccatggtttttagtgtttaaaactgccatgctgattatgccaaagctctacatacttaagagacacactggatagtccataatacagcgtcaattgacaaaaaatggtttagaatttgctactattctaattgagaaaactctgctcttaacgacttactgacctaagtacttgaatgactgaacaaagagacacaaaatcctgagagggccatcctctacttattgaaagactactcacagcaaatttctaaagaccttctgaacggcagtgaataactgatggtaggaaggaaaaggtattattctgtaagctgatacatactaccaataatattcattttaatgtctcaaccacagagataaaagtcagactaggtcaggaatggtggctcacacctgtaatcctagcatttggggaggctgaggtgggtgaatcgcttgagcccaggagttcaagaccagcctgagaaacatggcaaaaacctcatctctactgaaaaaaaaaaaaaaaaaactgaggttggaggaccatctgagcttggagaggtcgaggctgcagtgagctgtgatcacaccactgcattccagcctgggaaacagagtgagaccccatctcaaaaaaaaaaaaaagtcagattaatgttattggaaagatttaaagaaatcagcacatatccaaccccaactcttctagagataccttaagtttctgagacataagaatttacatattacatttatgtattgagtggttcttaagcaggagtgtatccagattttgagaaaattgttgttgttgtcgttgttgttgttgttgttgttagagacagggtctcattatgttgaccaggctagactcgaactcctgagctcaagcaatcctcccacctcagcctccctagcagctgggactacagccatgcaccaccatgcctggcttcaaggaaacattttcaaatatacatatccaggctttattagacttactgtatcaaaatattcagaaaaagcctagacttgttatttaaacattttcctcaggttactaggatgcacaattctagctgaaagctagtgcaacagacaattacttcagtctcatttctcacccacatgaccaattccctttctcatttgaagatttggccaaaaagagtaaggagtaggagagagacccatttgctgaaaacaccacatgattttccccggtaagagaagaacagggtctagtcaactcaaaatccaacttgatcttgttacttgtttatcttccaccttcccatccagacactctagatttgaaagcagagctgagactctcattggccatttctaccagaataggatactaagtcagttaattacttgatattccctctgctcaagggtttcctcttacattaccacctattcactgccaatctggttcctcagaggcctcctaaaattgatctctaggtagtttacaacccactaactccctctcccaaactgaaaactgtcattctctaaaattgaagagaaccttgtctcaccatgcaaaggaaacaaatcagtcaacaacaacaacaacacacacacacacaacctcttcatggtcttttccctccattatctaatttccaaattggccttgatatttctgattgctctcttttttgctttccacttctggctcatgagcaatcagaaatatcttaagccttgccagtgagaggcgcatcacctcgtatctattactgttttttaggaacttgccaaaggagcaggatctctattcactgaaacatgtttaacttttcttggagttttcatgtaaaacctatttcagggcaaattttgccattttacattcaatagggaaaaaacatcctaggagggaaaaattgaaaaatagtaagtattatcttttacaaattcagtgttttcaaaaaaagtatttaccacaagtgcattaaaaaaaaaaactgtaccctctaatgcttctttgaaagtaacaatatttaaaatgaagtcttagataattaggtcatttcaaaatatttccattcaggttatgcttgagcttccaaatatggaagactggcccttacacaggtcaatgttaaaatgaatgcatttcagtattttgaagataaaattggtagatctataccttgttttttgattcgatatcagcaccatataagagcagtgctttggccattaatttatcttcattatagatagcgtagtgcagagtggtatttccatactcatctggaatatttggatcagtgccatgttccagcaacattaacgcacattcatcttcctggcattgtacggcctgtcagtattagaccaaaaacaaattacaaatcttaggaattcaaaataacattccacagctttcaccaactagttatatttaaaggagaaaactcatttttatgccatgtattgaaatcaaacccacctcatgctgatatagttggctactgcatacctttatcagagctgtcctctttttgttgtcaaggacattaagttgacatcgtctgtccagcaggagttttactacttctgaattcccattggcagaggccagatgtagagcagtcctatgagagtgagaagactttttaggaaattgtagtgcactagctacagccatagcaatgattcatgtaactgcaaacactgaatagcctgctattactctgccttcaaaacaaacatttaactttcccatgaaaaaagcacactatttattatctctcattgctcgctgtattaatgaaagggcagcctatatgaatataaagagcatagcccttggatgacattcaacgtgggctggaatcctacttgaagctctgtcacttcctggctgttgcttagccttttggggtctcagtttcctcatcaataaaataggaatgaaaatagtagctttctcacaggaaaccactctaatgcttaaatgagactctgcacaaaagatatagaatagttcctaacacaaataacagctcaataattgttagatattttaatttttactaataccactaaagacaacatttgaattgagatgatacaattatacctacactttcaggtgtgttttaaatattacagctaacattgtattttagtgattctgagatgatcattgtctccatgttgtctccactgaaataccacttacaattcatgatttactataattggcggcatttaaataattctcttattgaggcataaaataatggggcatcacacaatccctggtgtcttacatgaagtagaatatgttataacaggtccggggcggttccagtcagatgaccagcatttagataaattttggttcttaaaagaactatggaataagaaagctgaggtgaaaacaaaaacaaatttctaaaataaaccaattcttactttggttttcaataaactttaagccaaagaaaacctggaattcaaatgaatagcatgggctcatttttgtcaatacttagatttatacaatgtatgtacatcagatatttccaatcattcatattaggatttaagactgttataaattttctccttttaaaacggatttatgaaacgatttgtggagcttttttcaactgttacattcaggggtacacgtgccagatgtgcaggtttgttacacaggtaaacacgtgcaccaagggggttggttgtacagattatttcattactcaggtgttaagcccagtacccattcattctatttcctgcttccttccctcctcccacccttcaccctgtaataggccccagtgtgtgttgcttccctctaggtatctgtgtgttctcaccatttagctcccacctataagtaagaacatgcaatatttggttttctcttcctttgttagtttgctaaggataatggctttcaacaccatccatgtccctgcaaaggacatgctctcgttccttcttttatggctgcatagtattccatgctgtttatgtaccacattttagttcttaaaacaactaaaacagtctttctccaagacttataaattttcaaaagggcagttaagggttgtcttttactattttctaccttcagaaatgcttctgtttgaaaggagggaggaaaagcttcaattgagattaagtcctaatgcaccaattttaaatctctcatcttgctcaagcccagcagataaacatgaagttttcaaaggtggaaggatcctgagagatagtagaatatgcctgccacataataggtgtctggcttatgtctgatgactaaatggattgaaagaatggatgaacacagcttgggagttcaatattttcaaagaaaactcctgtcgagtaatgcaatacatttgcaatagtaataatcacttacatttgctattttaattttcataaacatataactcaactaaaatgattaattcatactttttacatgttaatctatatctaatgaaaagataattatgtaataaaatgtatatacaataaaatctacaggaacaggtaaacacaatccctctacttctgaagagggtaaaagttcacggaagatagccaaccacagatagaaaaataaataatagaatgtgacaaattatttgcatctatgcaagaagcatattccttctcttcccaaggattattgcattactaatgaactttaactaaaacttcagatgttcattgcagaaatcacagataagagaaagggaaaaacttcacttacaaatccccagaaacaagtttgattatattttctacatgttttcagctaacacgagcagattctgttcgtgtatatgtgtaaccgattttttttctcacttgttatagcaaagtacatctttgcatgtcgacatatctctgtatctactgacaacctcaatagttacatattagtccatcctatggatgcactgaaatttgtccatgaaatctttatatgggttcttctaaatacactgctattttaatcaatactaagaaaaacagacctctatttggtaaagatatttcagtataatggaattgatgagtaaaaagcataacattttaaaaatgtggttcttaccactaaagtgtttgtttgaaaagctgtagcaatttaaactttaaatgactacgtaagtaccactgttcttcatcctcacaaactttgtggataaaaaacagtatttcattccttttttttttcttttttttttttgagatggagtctcactctatcacccaggctggaatgtagtggcgcgatctcggctcactgcaacctccacctccctggttcaagcaattctcttgcttcagccttctaagtagctgggattacaggtgcgtgccaccatgcccagctaattttttgtatttttagtagagatgggatttcaccacactggccaggctggtctcaaactcctgacttcatgatccacctgcctcagcctcctaaagtgctggggtaacaggcgtaagccactgtacccggcctttcattcctcttctaacttaaatagaaaacagtatttcattcctcttctaacttacattccttcttctaccaggaacgctatcttttcctatgtgcataggtcactggtagatatgcaaaaaaagtactttgcccaattttaaaatgagcttattttattatgtctgcaaatatggccaggcacagtggctcacgcctgtaaccccagcacttggggaggccaaggtgggtggatcacgagggcaggagttcaagacctgcctggccaagatggtgaaaccccatctctactaaaaatacaaagcaattagccaggcgtggtggcaggcgcctgtaatcccagctactcagtaggctgaagcagagaattgcttgaacctaggaggcagaggttgcagtgagccgagatcgcactactgcactccagccggggcagcagagtcagactccatccaaaaaaaagtatatatataaatatatatctgcatatataaataggcatttgtatgtttctcttctggtatgtttctctttttgtatatttaaattttttaatctatactcttatttttgtgacataaaaatctagctagttttctccaaacatgaattatgaacaatccatctttttcaaataataaaaaacaccaccattatcaagcgctaaattcttaacatatatttgggtatttctaaatttcctattctgttgtattcattgatgtcttttcagctgttagtaaacaatttgtggaaataaataacatgcacattttgatatctggaaaagcagcctttttccattctgttacaaaaaattaatttatcacaataataaaagacagcatgtgtaatttaaaaacgctaaaactttgctatttttatttggcttaggtaaaagtgataaatagaaaaagctcccatcttttttttttttttttgaaacggagtctcgctctgttgcccaggctggagtgcagtggcactatctcggctcactgcaagctccacctcccgggttcacgccattctcctgcctcagcctcctgagtagccgggactacaggcgtctaccaccgcacccggctaattttttttatattttttagtagagacagggtttcaccgtgttagccaggatggtctcaatctcctgacctcatgatccgcccgcctcccaaagtgctgggattacaggcgtgagccaccgcgcccagccaaaaagctcacatcttaagaaaattcaatcttcctgttcaagcacaggaaccatcttcccatttcagtttccttctaaggttcctcagtaaagaacatatttacatactgtacattgatataaaatccatactggattttatttgaagaatatttagccctgaagttgatgtgttatggggcttcgttcttagttctcaatatacacttttctataatgtatagaacattgttttaaaatctgtagattaaaaataatctgctgcattgacttaattaattttgcaagttaaatcactttaaaacagtctattagtgttctatgagggaaattatgattggaaatcagctaaagttttgtttttgtgttgctgttcataaagggccctgtaccctgacctctctgaggtttccacatccagggtggtgtgaggcctgcggaggcgagaaagccaggtccccctcctcccccgccaggagggtatgtccccatcatccccccacgtcccacctcctcccagcccaggcctggttacctcttttgcttgtcctgcttgttcacgtcagtgtccctgagcatgacgatgagatcctttctggggactttaccccaccaggcagctctgtggagcttgtccagatcttctccacggacgtggtacctgggctccatgaaggcactgtcatcgtagtctccccaagcgcccaccttgctcttgctgctccccctgcagcaggggaagcagtggcagcaccacttgcccatcttgttcctgagtgtcttcatagcagagtcgtcgtggtctccagaagcgcccacgttgctcttgccactccccctgcagcaggggaagcagtggcggcaccacttgcccatcttgctcctgagtgtcttcatagcagagtcgtcgtggtctccagaagtgcccacgttgctcttgccgctctccctgcagcaggggaagcaacggcagcaccacttgcccatcttgctcctgagaccaaatggcttcttcacagaagaggcagccggcatggaatcaacctcaaccaccatctgcttttaacagccaggagaagccagtagtagccaacagatcgcgtctaccaaccagtttcaccaactagcaggtaactccgggtttccaatctgtttgaagagaaaagtcaatcccagccaaaacctgccaaccccagcaggggattccagcccagcccaccccacccagggaaaacccacacccacccgaggaaagcccacgccccccctgggcgaccccacgcccaccccagaaagggccaacccccgcccccaagaaaacacccagcccacccaagggaatgccaaacccagcagagaaaaggtcaagcccagcaaaggaacacgagagagaaaacgtcaatccaagcaggaaacgtcaatccaagctaccaacgccaagccaagccaagaacgcaaagccaagccaagccgctacaggccagccaagccgttaaagcgcgtgcagcatgcgcgtgcaagccattacaggccagccaagccgttacgcgcgtgcggcgtgcgcgtgcaagccgttacaggccggccaaaccgttatgcgcgtgcggcgtgcgcgtgcaagccgttacaagccagccaagctgctgccgggcgtgtgcgcgcggcgtgcgcgtgcgcgtgcggcgtgcttatctcaggtggcgtcagggcacgtggcacagacactggccgatgcatgcaacgcgcctgcttaagtcttggcgccacgaatgtcactgacagccttgagttccggcaaacttcgtgggagtcagctgagctttcaagccactgagaagcctctggtgaaaaaaaaaaagcctcttaaaggaggactggggctaagcgtctggaacttgaggatgctgacagcctcctttgaaaaaagcccccaggacactcctggcggtgctgttgtgcatggcagcagctgcagctgggagctcgggctgacggagctggctgcaaatggcctcaaaatcgcggagcacaagacgcccaccgagcccagggcctgcctgaggtgccttcaacacctgctcctctttgctccgcacccagaacacgaggccatcagcaagggggcatttggggccacaggattgcagccagctcctgccccggtgcagtgtatacagtgtatactgcacaggtgttgggtgcaccaaaatctcctgaatcacctctaaagaacttactcatataatcaaacaccaccttttccccaaaaccctaggaaataaaatgaagaactttttgtttatgcataccacatattttttaacttttttcacaggttcattgagatacaatttatatattatttaattcactcatttaaagtataaaattcagttttttaagtgtattaactagttaaacaatcaccatgattttagaacatttttatgctccttaaaagaaactttgcacccattagcaatctttccctattttccccattcttcctttaaacctctcccagccctaggcaatcatccatctattacctaagaatttgcctattctggaaggatttgcctattctggacatttcatgtaagtggaatcataataatatagttacgtgtgacttactactttcatttatcatgttttcaatgttcatcctttttggagcatgtattaatatgtttttctttttcattgccaagtaatattttattttatggacagaccacattttattaatccactccaaaattcatggacatttctgttgtttcctactttttgttgctataaatacttttatgtgtaaggcatttgttttaatttatttttggtgtatacataggagtgaatttactgagtcatgtggtaattctgtatttaacctttgaagaacggcttcatttttctgcatgtggcttgccaattataccagcagcatatgttgaatagggtgtcctttcccattttcttgtttgctttgtcaaagattaggtagtctgatgcctccaggtttgttctttttgctaaagattgctttcgtttttcagcatcttttgtggttccattcagattttaggactaatttttctatttctgtgaagaatgacattggaatttgacagcggttgcatttaatctgtagaatgctttgagtagcattgaaattttgacaatattaattttttcaattgatataggactttttctatttgtcactttcaatttctttcatcaatgtgctataattttcagtatacaaatcgttcacatccttcattaaaattactccttgctctttgatttacttatatatttgttttgttgctattataaatggaattaccttatttttcagataacagtttgtcattggtgtatagaagccaatgttaattttgtaactctcaactttattgaatatagtgtttatcagctgtaatgggttttttgtggagtctaaaacacagacaatctcaccccttcccttcctatttagatgcctttcctttctttgccttgtataattactctggcaagtcagttacatataacgttctcagcatttgtaatttgacatcaaatccatctgttgtaatacactgattgttacttttcaactcgaaaacatggacatttatcactactctccctttctcttggtctagttgttatttaaaaaaaaacctatcaatgcaaaccaggatatttttctacaaaacaatttcaaacacactaaaaggttttaatctaacaatttttaaactttctttgtcaatgactttgaactgtggtctctcggaacaaatccaacacctttagtagaaaaattatgttaattcctacattatcattgggtctagccaagagttgaccaaaggtgatattaacagatatgcttatttattaccttgttctcaaagttctagcataagtcttgaaaaatctagtaaaaatttgtaaagactataattgcacaaactccctctctcatgagtcacacagttaatccagaatactatttctaagttattggaaagccaacaagtaaatatgatgtagtgtataaaaataatcctaatttcattgtatattctgtaagtgacatatgcaattgatactatttactaaatatctcataattatatttatttacatagaaaaaaggaataaaaaacatatctattatctaacatttaaatgattaaaaatacttgagatagcattgctacataaatgctatgtaaatgctgaagaaagtaaaaatgtcattccctacatttgctaaatatattgtgacacattataagcatttttaaaatatatcactaatggttgggtcaagtcagcaaaaatgattctaagtatttaattgtggaaaaatttagtacaggggatagtattcatgtgatggaaggattttaaatggaacccagagattagcagcagcagtaagttttaattgcataccaggtgcagagtctaggatacaagacagaactgcagataaaatctgactccttccagcatagctaggagacatggctaactccacctgtccggagaccttacctagaaatctaacggctccaaaccaggtaaacaaaactattttccaaagtcaaagcatcaatttatgacattaaagcacttctaaaacttaacctctgacttaagttagaccaaatggataaattttgaagatatttttattttaccactgactttaacaccatctttatttcccaaagattactgaagtcacatgaaataaaaggcattagagcttctatttttcttacaaaatatttaagagctttcattttcttttaagccgagccattatatatacatcacatacacaacacttctagacaagaaaagatctagcagttgttcagtttttctttcccactttatgaatcataacacaacttccacagactatctacaacatgattaaatttatctgacctgtcctgtatttccctcttttgtaattagtcattctactttaggacaacaatttgccatataagatcctctctcatataacatttctttccttcataacatttcttacaataaatacatcttcatatccacaattttctttagatctctctcccctactaatttctgatgcccatccaaaccaaaaaggtcagacaacgcaaggcaaaacagagcagagccttagatttttgagagggacctgtctgcttaaagttcttggggttccatgaggaaaacagaggtttctcctaaaatggggtttgtggaaccttctgtttttccttaaggagtcccaggttgtcagaaattaccttagatcctctcatgtgggcatcaagagtggcaacaagagagactggggtaataattcagacaactgagcagaaaaagaaaaacttactactgtccccactgtaatgatggataaactgaggcaccatgcagttcaaaaattcatgttcacataattaggatccacagctcactctcttaaataattttgccacctctatgcccagtcactgatgcacctgtatggtagctcatggcccccttggaacttagaacctgggtttcattcctgctctacggctatataattcaacaattttcctttgaatttgttggactctaaccctgtatatctcaaattttattagtattactgaatcttaaagggagctgtgacgtctttagtctttagaaatattaaacctataaacaaggactatatgaggttaaacagtattcaaatttctatatgctttaaaacatggacacaatgtattgagaaacacacctacaaaactgcaccccatcaactctggacaaaaatttagatattatctcttcaatataacctatctagtggtatttatacatattcttccatgtatcaacggtatattacatgctcataaccttaaaaataacaagtgttcaaattataggccttacacatttctacgggcttgaaaaatgatacaatatagattgtctttaaagcagtcaagaaaatgcataaacttctagaggaatcagtaaaataaagataaaaagttcacacctaaagtagtaatactaggaataaaagagggctcgacactgcaggttcttagatacaaaagttaataaagccttgtttttggttgtgaatctttgccttaaaatacacacagctgaccgaggtgggtggatcacctgaggtcaggtgttctaggccagcctggccaacagggtgaaaccccatctctactaaaaatacaaaaagtagccgggcgtggtggcaggcacctataatcccagctactcagggggccaaggcaggagaactgctttcacccaggaggcaggggttgcagtgagccaagatcgggccatcgtactacagcctgggggacaagagcgagacttcatctcaaaaaaaaaaaaaattacacacaattctcccgacttcctttttctcttgcaaagaggtggtgatgaaccaggtttgctcaggcagatgacaatactcttgaaaatggtggcagagagccaggcgtggtggctcacacctccaatcccagcactttgggaagctgagacaggtggatcacttgaagtcgggagttcaagaccagcctgaccaacatagagaaaacccatctctattaaaaacacaaagttagctgggcatggtggcacatgcctgcaatcccagttactcaggaggctgaggcaggagacttgcttgaacccaggaagcggaggttgcagtgagccgagatcgccccattgcactccagcctgggcaacaagagcaaaactccatctcaaaaaaaaaaaaaaaaaaaaagaaagaaaacaaaggaaatggtggcagagaaaatgaaggcaatacagttcacttaataatctcataaattagaacttaccccgtgactcctgcatagctccaaatatgtgagagagatgaaatggctgtttgccaccaatatttttatgtgatgcttcattttttgattctctgaataactacttacaacgcattagcccatttatgccagaggctgcaattttttgaatttttgcacgagtgaaaaatcaaaccttctaatgaccttgagcagtaggatgtaattaactccctcatgcttaccattccaataatggaacactaggcataagtggtttaacacaatcgtgaaagcatagctattcaagtaactaattatacaactgatttttttcctcatccctaaaacatagtaaaggaccagttattttaaaaatacaacacagtgacaattttggcttgttgtttgttaaggccattgcttggcataaagaaaacaaaaagaggaggagaaacaagaatagaaacatgaaatagaagcagcagcaaaagaaaatgaagaggaacaagaagatgagaagaatacacagactagaataagcaaaaagaacaggtgcaggaattagaaggcctattatgacaccttttatcccctccccaattcacaaaatttgaaaaagtccaagaccatcacaacaaaaaagaaggaaaaaatggccgggagtggtggctcacgcctataatcctagcactttgggaggccaaggtgggtggatcatgaggtcaggtgatctagaccatcctggctaacactgtgaaaccccatctctactaaaaatacaaaaataaaattggctgggcgtggtggcaggcgcctgtagtcccagctactagggaggctgaggcaggaggatggtgtgaacccaggaagcagagcttgcagtgagccgagatcacaccacggcactccagcctgggcaaaagagcgagactctgtctcaaaaaaaaaaaaaaaaaaaaaaaaaaagccacacacacacacacacagtcaccccctaaattttgttaagaatgagacaatgctgccactcatgcctggctcagaaggaggccaccctccagagattgcaagagaagggggaggactcctttccctaagtgcacctccaccactgccaccgaggcccatggtacagcaccagcaggttcgtccccaccccaggtcggactgggccctgcagtgctcctactcccccttcccagtccccagactttctgccactaccaccactagcaccaatgccaatacaattgctgtcgccatcaatgcagcagcccaccctacaaggttcctaccaccttgcccccgcgggcaccctcctaccactcctgtcgagctgcagtctccgtggctgccatcagtcacacgaggcgagctgcagagtcacgccacatgcaggctccagcgtaccacaggtgattccttctcctcctcctccagcctggcttggagcagctagacgggcaaagccagaaaagcctagaatgggatgcagggagtggtaacgttagagcctcaccttgtcatgctggccactgggtggcagggaccagcttcagctaaggcactcagacccacccaccgaagtccagcctctctttctggcaaaaggtggccaggaactggggcgggtgtgagtgcctatgctgaaaccacccccatccaggtgcaactggccagaaattgctgggcccaccagggctgcactccttggggagcaggagtaggagaaactcagacccagccagccctccccactcaactgctggttcccattcctgacacctccacccacagtgccctgttcccacagtcccccgcgatgcccactaatccccacccggtagtcccaggtggtctccccaacacagagcatggggtgtgggcgggaggtgcaggccggagaaccgcagtgggtgtgggggccctgccctgctcaagattgcaccaggaggaactctggagtctggaaaagagaagagtcacccgaaggagcaaggagaccatggctgttgctgtccccaccacctctgcagccgaccaacaccactggcagtatagcccccatagcaaccctaacctgacccctgccgccggcagtgtagcccccggacagcacacccaccacaccctgtgccagttgcaggcagtgtaaccccaataccccccccaaccaccccctccacaggcagtgtagcacccgatagtgcccacaacctgacccagccacaggtgttgctgcacaagacaatgcctcaaaatcgccgcccccaccccaccacaggtagcgcagctcctgatagcgcaccctgagtaagggcagtgcagcacccgacaacactcctaaaccaccccccgctgccagcattgtagctccaaataaccaccaaaaccactccctgccccgggcagtgcagcagaaaatagtgcccctaacccctcccccgccaccggcagtacacgttagtgcacacaacctgcctcccccccatcacccccgccaccacgggcagtgtagccccggacagccagccaaaaccgcccccctccaccgccagcaatgcaacctcggagagtgcccccaaccagccccctgacacaggcagtgcagcctcgggtagtgagccccaataggacacccaacccctgcccccacaggcgggcagtacatccccggataactcacctacaccaggacatttctaccactctggccgagctgcagtgtcccacgtcaccaccaaacacagcaaggcgagccccaggggctcaggctccagcctccagcatgccgctcccttctactcgtcttcctgcctggcaggagaagctcccgc

SEQ ID NO: 384 - DNA, 9791 bp, Homo sapiens
ggaagtcaggctcttccacgttcccgtattttcctgtggagctgctcagtgcccggcttagaggaccaggaatgggtaatcaccagccgtacgctggaggctggagccgctacaccgtggctcgcctcgctgcgactggtggtaaccgcgaccgagacggcagtgcggcggaagcggtaagaggaggaaaagagttttgggatagatggagggggtaaagagggtggttagtgccaaagggaaaagaggatagtgagcaggagagcgcgttgcaaaaaggcggtggggaaaagatagtgggaaaaaaagtttttgggtagatggagggagaaaaacggggtggggagcgggagggagggaaggttttgcagaaagatggtgggtaaaatgtttatgggtagatggaggaggaaaagagggtggcaagggaggaggaaagagagggtggtgggggggagaaacagcgttgagcagtagggagagaaggttttgtgaaaagacagtggggagaaaaggttttgggtagatagagggggaaaagagggtaacaggtgggggaagggaaaagggtagccagcgggaggaagacaaggttttgcaaaaagatagtgggcaggaaagaaagacggtggagaaagaaaagacagtgggtaaaaagtgtttgggtagatggtggggggaaagagggtaacgaggaggaggaaagagggtgacgagagggagcagggaaagagagttgggaaaaaaatgggaaaatagtttggggtagatggaaggcaaaaaagagagtggcaagcaggatagggcaaagaagaggacgagtgggaaggggggaagactgtgaaaagacagtagggaatattctggggggtggatggagggggaaaaggggaggtgagcaggagtggggagaaggctttgcgaaaagactatggtgaaatgtttttgggtagagaagggaaagagggtggcaaggaggagcgggggaaaagacgatgaggaaaacagttttcgggtagatgaagggcgaaaaagtggtgagcagcaggagtgaggagaagggtttgggaaaagacgggagaaaatgtttttgcttagatgaaggagcaaaagagggtgatgagagtgggatgggggaaaagaaggtggccagggagaaagggaaaagacggtgggaaaaacagtggggaaagtgggtaagtggatggggaaaagggtggtgagtgagagagcagagaaggctttgcgaaatgacggtggggaaaaatggtggggaaaaagttttggggtagatggaggaagaaaacaggtggcgagggggaggaggccaaaggcggtcgggaaaagaaggtgggaaaataatggtgggagacaaagatttggggtagatttttttttaatcagattatttgtatttttgcttttgagtagttatttatatattttgtgtattagccccttggctgatgcatagtttgcaaatactttcttccattctctgggttgtttcttcgttctactgatttcttcctgtgctttgcagaagcttttaagttttatgtaattacatctttgcttttgttgcttgtgcttttgacaagtttaatgtaattacatctttgcttttgttgcttgtgcttttgatgtctatttgaaaattccttgtcctaaccagtttcatgaaggatttatcctatgttttcttctctagtagttttatagtttcaggtcctacatttaaatctttattttgagtagatttttgtatatggtaagataacggcctagatgtattcctgtacatgtgggtgttgagttatcctagcagtttattgaagagattgtccttcccgaatgtgtgttcttggtgcctttgttaaaaatgagtacgccataaatgggtgaatttatttctgatttctctattctgtttcacttgtctatgtctgtcattccttcgtttctgtttctcccccgcccctttttttgatagtattatgctgttttggtattaccatgcttactacagatttgtagtatgttttgaagtcaggtgtgatgcctccagcttttctttttattccagattcttttgtctatctgaggtattttgcgtttccatgtgaattttaggattttttttttctatttctatgaagaatgtcttttgtaatttaacatggattgcattgactctctagatcacattgggtgatatagacattttaacaatattcttctagtgcatggacatgggatatctttccatttacttgtgtctgctttaatagctttcatctgtgttttagagtttccattgtgggatcttttgtctttttggttaagtttatccctagatataatttttttggtaatgaaatagctttcttgatttctttcttaggtatttcactattggtgcatgggcgtgctactgatttttatatgttgatattgtatcttgcaacttgactaaattatttctagtaggtgattttgtggaatctttagggttctctctttctctgtgtatatatatgatcatgtcacctgcaaacaaacagtttgacttccttttttccaatttggatgccttttattgcattctcttgtctaattgccccacttaggacttccagtactatgatgaataaaagtggcgtaaaagtagccacacttgttccaggccttagaggaagagtttaaacatttccccattgattatgatgttagctgtgggtttgtcatatatggcctttattgcgctgagatatgttccttctgtactcatgttgtccagtttttgtcatgaaggaatgttgatttttatttttttcagcatctactgaaatgattatatggtttttgttcttgattcgctgaatgtgatgtcgcacatttatttgtgttttattgaatcatcctcatattcctgggatgaatcccacttgatcatggcagatcatctttttattgtgttgtcaagtgcaattttcaagtattttgctgaaaatttttttgcatctgtgttcatcagggatatttaaaatgcctgtggttttctttttgtgttgtttcctggtctggtttttgtaccatgtaccagggtcatgctgtcctcatagaacaagtttcgaagacttcctttctcttcattttttggggaatattttgagtaaaattcgtattaactctttaaaaaacgtttggtagaattcagcaataaagccatgattcttgtgtttttgtttgatggaagactttttattactgctttaattacattactcattatggatcttgttccggttttttgtttatcattctatcttgggaatttgttatgtgtccagaaatttatcacttctcctagattttccaacttgtttttatataggtgtttttagtaatctcttacaatccttcatatttctgtgttatccattgtaatgtctcctttttcatctatcattttgttttgtttttcttttccttagtctagttaaagcttgtcagttttgatttttttctaaaaaatccagctctttgttccattgactttttgtattttttgtttctatttttaaaatttcttctctaatctttatgatattttttgtgctaattttagtattttatttttctcgtttttctcattacttcaggtgtactgtcaggttggctatttgagatctttctattttctctgatgtaggcatttatagctatgcccttttcctcttacaactgcttttgctgcatcccacaggatttgttatgttgtgtttcttttttcaataaatttttaattttctttttattttttcatttatttattggttgttcatgagcatgtattttaatttccatgtatttgtacagtttttcctcctgttattgatttctagtactattccactgtggtcagaaaagatactcgatatgatttcagttttgttttgttttgttttttttgagacggagtctcgctctgtcgcctaggctggagtgcagtggcgcgatcttggctcacgcaagctccacctcccgggttcacggcattctactgcctcagcctccccagcagctaggactacaggcgcacgccgccacgcccagctaatttttgtatttttagtagagatggggtttcactgtgttagccaggatggtctctgtctcctgaccttgtgatccgcccccctcggcctcccaaagtcctgggattacaggcatgagccaccgtgcccggccatgatttcagtttttaaaaatgtgttgtgacttgttttttggcctaatgcatagtcttttgtggataataatccatattctattcagtggaatgtgcattatgcagttgcggagtggaaagctgtgcaaatgttaggtctattcggtatagagtacagtttaactgatgatgttttgttgtctggatgatctgtccattgacgatagtggggtgttgattatagcgaagcattgaggcattctgttattgtattgcagtctatcctttaaggtctgttaatatttgcttctgtgtttagttgcttgagtgctggttgcatatacacttataattgttatgctgctgtttactttttctcattatataattatcttcatttttttctttttttgactgaaagtctatataatctaagtagagctactcctgctttttttgtttccacaggtgtgcgatattatttatcatgtcttcactttcagtctatgtatgtctataggtgaactgagtttcttgtaggcagtatataattgggtcttgtcttttaattcattcagccactctgtcttaattggagaatttaattcatttatattcaaggttattattaacaggtaaaaacatactactgccattttttacttgttttctggttgttttgctattctctcttttttcttttgttctttctctcttccttcctctttctcttctctctgatctctctctttctttcttttctttcctccttcccttccttcctgtctttatttgtagtgagataattttttctggtagtgtgtttcaattgcttgcttttcatttttagggtgtctattattgatttttgttttctggttaccatgaggctaaacaacataattatatcaagttattttaaactgaagaaaacttaactttgatttgtcccagctactccggagactcaggtgggaggattgcttgaccctgggaggctgaggttacagtgagttgagatcgcgccactgcgaatataaataaataaataaacaaacaatagcttataatgaattctgattgtaaattttgagatgatgattgataaggtataaagaagaaagtgaaaatcattcataatctcattactcaactactcctaatgttttggtacatatgcttcctaattcataactcactctctctctctctctctctctctctctctctgtctctctctgtctctctctctcacacacacactcacacacacgtacacataaaatagatacattttatacacagatacaattttattgtaacattttaagaaaaacagctttgtaattttttatttaaaaatattggcctggcgcggtggctcatgcctgtaatcatagcattatgggaggctgaggcgggcagatcatgaggtcaggagatcgagaccatcctggctaacatggtgaaaccccgtctctactaaaaatacaaaaaagaaatgagccgggcgtggtggcgggcgcctgtagtcccagctacttgggaggctgaggtaggagaatggcgtgaacccgggaggtggagcttgcagtgagctgagatggcaccactggactccagcctgggcgacagagtgagactccatctcaaaaaaaaaaaagaaaactcaagaatgacatggcagtggtgagtgggatcctgggcatccctgggggaattggggctcccccaagagctcctgggagcaccactgggaggggccttcaaggttagggtggctgggtaggggctgggcctgacctgagaccctgcccaccaggcctcttccaggccaggtttgctgtgctgggtgggaacatgggagaagtcactctctgtctgtggcccccatcggtgcctctgccacctggcccagagggggcagggactctggggaggacaaagctgtgggggtagggaatatacccaggatcagccaacattgtctgcacaagggtggaggctgagagagaggcctcgggaatctggctgtgagtgaggacgggcctggggtgggaaagccccctacatggggaacccttgggttccgggctgctgaccatgcccatcctgctccagcccactgccccactgcccccggtgccactgaccaaacagcagtacctatgccagctgctcctggatgccatcctggccaacatccgctcaccctcttcaaccattccctgtaccgcatattcatgccaaccatgattgccatccacagcccacccatcacatacatccagctgggctgggcttcgcagagggtggctgcctggccctgggccatgtgtgcccagtgtggtcaccatggtgcctccccaaggccccagtggtatgcacccagaagcacaggcttgaggacgatgagcagcagagcatccccagtgtgctccagggcctggtggccaggttggagcccaagtgcatgataaacctggacccttctcactgcagcaacaacggcaccgtccgcctgatctgcaagctgggcgagtgtccaggagggccaggctggcgcaagagagcaacccccaactgcagccccaggcctctgctgtccaagctggagggcacagtgcccagaccccatcctatgttcacgtgccagcaggttgtctgctctgtcttctgggcccaggacagactggccattgcctctgcccccacccccggagcccacgcaccctcacctccccaacacagatgcggctctgcttgcctggggccctagggaggtggcacgcaggacctctgggcacccattgatgcaggtcactctggcttcaggtttggaaatccgagagtgagagagacatccaggctttgccgcaagcctcaccagaacctccctgggtgtgaagagtcctgttcgggagcagggctgtgaggcggggcaggccagggcttgtctgggtcacaggtacagccttgtgtgttgcaaacgacaaggacctcccaagtgtgccaccatgtgcccacccactaccctacccagagtccactgtggatggaccggcagtggctatacagtgggcagacccagagggagctgtctgggggcccagggcaggcaggggtcattctggaacaccaggcttccagtgctgcagggacagcctctgtgcactccagcccctcccagctcaggcccctccctcccctcttctgactccccctgcacgggcaggcgcaggttttccagtggtcacctgagagagaggggtctctgctcttcttctgtgtccctttgccccttcatcttgtgtcaggtcagttgtccagggtggctgtgttcagtggctgaggggtgagaaagcctacggctcaaggacagaccctgcttttcccagaggccaccagggagctcagcggggctgacaggtcctaccagtagcttgggcacacaaggccccatctgggcgatgtggctccagagggtcatgttgacaggagtcagtgtccctgagcccagagctggcacacagcagatccagggctgggtccccaaggttgtcagaggcaaagccctgggctccaaaccccattcagattcagttcttcactgacaatgaggctctgggaggagagcccgatggccaggcaggcagcgtgcagggctcctcctggtgcttcagccagtcctggggctgccacttcccagagcactgccgggtgtgcaggccgtgggtgcagcaccagctgcctcaggctcatgcccattgttctgttgcaggcaccaaccccttcctcaggtcggtgcaccactgcgtgacctccaggcagccacagcctggaaaagcactcggttaccaccttgctcaacacctgtgcccggaacatccacaaggcctgcctcggctgcttagccaggactgcagggatggcccgcagcctcatcggggccaaggacgcatgcctcctgtcagacacttctaggtgttggcgtccatggagagcctggagttaggttagctttcctccttttctctcctgccttggggatctgccaaatgaaatcccgcacttgtacagactgagatgggcgtggtggagcgggctgctcgccgtggcctgtccagggtccaggtccatctcagcggcatgagggtgcgctcagggtgttgttagagcatcttgtgtgtgctcaacacacccctgctcctttctataggagaacacagaggacataggaaacccttcaaacacacatcggattctctgctcacagttttgggttcaggctgtgctgctttgggcaggtggggcaccccccagagaagcccctaagtccagggcacaggctgcctatcggagggagggctggcccatggctgctgccagctccccaccaccagctgggcctcagccctcacggcattcctgctgagcactgtggggcccccagggagcaggggcacgggggatcctgctgccggcacccctgtgtcactcgtgtgagggccgtgtccccattgtgaaggatgaagagccaggccctctggacccgcgtcctcagaacactacgcactgccacccagagagtgcgggcctggcggtgggtggggccatgcagtgagtgcctccctatgttgcccactgccctgggcaccggccagcagccctttggtgacaagagtcgccccttttaatgcataccaccccatcatctgtgattgttataatcttgttattcctgtgtttgtcaggactcgtcactgtgtcccccactccatgaaactgggcctgctgtcctgttaggatgctgtaagcccccgggcctgggctgtcctttctgacgcactgtcccattccttggcctggttcatccccagcttcctggcaaagttctgctccctgaagcaggaagaggctgagattaatgccaacgaagtgggccgtgggcctgggaagactgtgtggctggctgagggtgggcactaagctggccaccccacccccgacatggacatggctgtgctgtggcggaaggggtggtgcgggcatggccacggcactcgagacagccctccgaggaggagggcgagcctggctggaccccctgtctgcggtgctgtgtcagggcagcagaggacagcctcttgcccccaggagtgtgcagtgtgggcaagagacagagtgatcatgtgtttggaacgcagctccagcccagccaggggaccagaaaagccctcccgcttccagggaggatgtgcatggctctgccaatgcctgtctcccagggccgctggcaggtcccaggatgcgcaagactgggctgcccaggcaggtccctgcagacagcggggcctgggctagaggccaagggctgggactgggaagggacgcgacgcctgatagccagtgaggagccaggcacacaacttggaaataaacaagctttattttcagtttcaacaggtaaggcgatacctgcttcatcgtgtgcttttatgtaaatgccaaatagcaaaataacagctagaaaataaacagtttgtcagtttggaga

SEQ ID NO: 385 - DNA, 5852 bp, Homo sapiens
caacttggaaataaacaagctttattttcagtttcaacaggtaaggcgatacctgcttcatcgtgtgcttttatgtaaatgccaaatagcaaaataacagctagaaaataaacagtttgtcagtttggagatcaagtactttatctatcttgagtgttatctatcttggaatttagccaggcctaaaagtagcggaagtgtcaggaaatgctatagagagccaatctccagctgcaggttggtgggcctggcactgaccagatgcgggtagctcaaagcaccgagcgatgcaggcgccgtttctgcattgcctgcagcctcttctgcctctcggcaaagttgttcttcggggtctgcttcagtgcgggcaggatggcacgctccgccacaggtgggctcagaagcaggctgggggcgggtagagggactgtcaccgtgagcatcctcgcgagtggagtgtgtggggagtgcggcctgcatggccctcacgggggcacagagaggcctcagcgagctccgcttctgcgctgccacgctcccttccccactccctccctggggcccaggctgcagggctgccccactgtccccatgcctgtgggacttaccatttcttggagaggctcttggtggagaccttggggaaatgcgtggcttcttggtccctgggtgaaggaagagtcagcagtgagctgtggataggcccccagggatggggcaggggtgcaccaggcactcacctgggaaagctagcttcctccgggactgcctggggcctctggctcccttccaggagggacttgaggtgctgcagctgaaaggcaggggcaggggcgtggtggggcctgtggcggtgccagactgcccagggccacccccaccacccagggcctcacctcttgggtctgcaggaggttggtattccacagctcgcggatgagcacttcgcactgcctaagtgtggtgggctttcgcaggggaaggggcaggatcattggggggtgtgccgccgcccccatctgcctgccctggtgctggctgttccccatacaggcagctcctgcgttagaggcctctgctttctcctttctgaaacagtcattgcagcagccagaggtgacctgcccaggtgcgtctaaccacccacccagcatacctccccaggcagcgcccaggccaatgtggggaagagggcctggttcccctctcccactgagcagggtgctctgggcaccaggtgggggtctctgggactggggcctgtccctttctcccctctgaaggtgccctaagggtcagatgggcttcagtgggtgaccagctagctgccaggctgctcttgatcgtgaccccacacccagtggggcatcttgctccaggcctggtctcgggatgtgcagatgcaggagcctgtcctgctggttgcgctgctgaaagtgtgcgctctgtagcatctcagggcagtcccgcaaactcagggatcaccagaacctgttcctactctgacctgctggcctagtgccctccaaaggcaggctgtggccaggggcagcaagccttctcttggtcagaatattactttacttttctctgaggaagtggtttaggggccgctactggcccccctcgtgggctcaggtcagcacaggtactctgcaggacccccaggggaagggaggaagacagcgcccaccgatgggtagagcgtggccgtcatctgctatcatgagccctggagacaggcccctggagctaggggcagagcagttggctgactgcagggcgtgagcctagtaaatgtagtcatggggcccttagggtgcaggcaagacttacctggcctgcccttgcaccccaggaacacccaagccttacctggcctgcccttgtaccccaggaaccttgtccagcttgctgttgtgaagtaggggctcctcttccaggtccgccttctgggggacgtcagcttttgaatcttgcttgttgaaggagccgggctggggcctggccttgccttgagagttggctgcaagtcagaccctacaaggccggtcactgcaggcaccaacagtcaccgcccaagttttccaggaacagctgtgtgtacccaagaagcccctgtccctgcctcagtttcctcctctgtaaagggaagcctgccttggagggttctggggggaatcaatgtggttctgagggtgaagcccatgggtggtgcctgtgaacactctagaacaatcaacatagtggaagctggccccatcttgggtaaaatgaaactgcatgagaggcttgggacccagcctgcatgggtttcctcggcaaggacaaggcccgtccagcacctgggcccatcacaggaatggtgagggttagggctgggctgaggaaaatgcccggcctcacagagtggggaaaagaggctctctgctcccagttcactctgcagaaggtgccatgagcccagggctccgtgggcagtgccatccctcctgtgtcctgcctgcttgtggcggggacacggccaagcagggctgctgctgggcagccagggtacgtcctccctaggcggccacccggggaggcccctcctgcctgcttgctgccccaccctggggtgcctgctgtgaggccttactgccctgtgactggtccctggtcctgcccacccccccttaatcccctcccggtggcttcagcttgcagggctcttttcagctgcaccttcatccccaaatcctggagcttggcccagcagagggtacctggtcagcacccctagaggccacccaggctggggtccccgtggggcactcacccctgtgagcacatggacgccagcctgctcacctgaattagagatggacttgacagactggaagcttgacgtggagaggctgtctgcaggagagcgcacagtgtcggcgctaccgcccgcaagacgcccatgcttgcctcctggcctgtgtgtccgtgaggagccctccttcagcctggcagggctgggtcctcccggctctacccacactccgttgatgcagacccagcgagcgcccaagggagcagaggccctggaaaggtggtttcctgaggggccatctggaaagcaggagggcttgggacacatggaacagcaggtcccgagggagagcatggcctcttcccgtgtcctgtcagcgtccccagcactgcagggctggggctgccgacttgggccacactttgcccagaacagctcactggagttgccacagcggctagggaagggccctccctcaaccccattctccatgtctctctgggaagggagagccctaggcactgccccagctacgatgttcccaggctggctccatccaccagtcagatgtcctcctgatgtcagccccagccccaaagataacgggaagtgagctcgagaccacaacccagaatcctgggctgggtgggggccgctgtcaggatggggaagtgccttggacaagtggcaaggaaacaggactctgcttcctccctttgtccccatggttgctgcccagatggcaggaagggatccctggatggagtgtgtccagagcccctgggcccccagcatgtcaggactcagagccatagggctggagatcctgggcctggccacagcagcaatctgaggcaaagatctagcagggcaggggctgtcccaggggttccttcccatttcagctctacttggaggagggaggtctggggagcaccctgtgcccacctccccactgcaatgacctcaggccctgggcttcctgagagcagcacgtgctgtgcttggctgcgtaacatcatccagccacggctagaggtagcggcatctgtccaggtcccccagaacctgtccccactgggttggcatacaggggccagtgcagccaggtgggcaaggacagtctggaggggctcccctgggtggcaagagcatcccatcaggaactgaagggcccagttctcacctttcttctgtgatgtctgattcattatgagcttgtaacggagatctgaaagcaagcacacgctctcctcagcacttgtgaaaccacagccattctgagagaagaagcctggcctgtcctctcctggctgctgagcccgaaagtcctgcccccccactggctgattgggccctgccccatggatcccgctctccaccatgcctttgtcgtgggtgtcaggccaggagtggcccctgcctgttccctaggcagagcccacctggcatatcagcctcatccatctgagatgactggagggcgtccacactgccaggcagaacctgggctttaggggtacagaggtgaactctggaatccctggctatggcggtgtcatgatcccgtgggcatcagggactggggggaggctcaagaagatatgaggaacggggcgtcctgaggctcaagaagacatggggaagcggggtcctgacaaaacagacgcctggtgatgggatactcggcactcaggtaaggcagcagcagggaacggggcgggagaggaggccgcgggcactggtgcccttgctggagccctcctgaagcaagagcgaggagcggagccacatcccacatcctggcgggccctcctcctgctcggggcaggaggggtgggggaggagggagggagaaaggggggcgtgggggtgaggagcagctaagggtgcagttgggaaggccccgccggaggacagcatgggcacaggcgaagcggggacggggtggggggcgggggaatgcctgctcctgatccgatgtgtttagctggaagaaattcactgagctgcgcactcgcacttgggcacgtttccctgcataaagtttttgtttgtttgtttttgttttttttgagacggagtctcgctctgtcaccgaggctggagtgcagtggcaagatctcggctcactgcaagctccgcctcccgggttcacgccattctcctgcctcagcctcccgagtagctgggactacagacgcccaccaccacacccagctaactttttgtatttttagtagagacggggtttcaccgtgttagccaggatggtctcgatctcctgacctcgcgatccgcccgtctcggtctcccaaagtgctggaattacaggcgtgagccgccgcgcccgggcccctctataaagtttttaacagaggtgtgtctgaccctgcttggagaggagaggactggcggagtcagcatctgaaatgctgctgccctaggagacaggcagacaggttcggcactgcccgggggccacgcgggtctccctctgggaggaggggacagctcagcgtggcagggcgggcttaccgtcctgtgttccccctgagcccaggcgtgtgctggagttgatggctgtgtttctgtgctgcgggagcggcagtgttgagtgtgcctggggaggcagggccggcctagggccccgcgccggctcacccttgttttcccgcttcagatgctcgatctcctcatggagcttggccagcatctccgagtgctgctgctgcaggaactgtaggctcttctccaggtccaggttccgtttctgcgggtcgctctgcctgagctgcgggctctgcggcctcaaggactggacgcccacagaggggcgctggcgccggcgccgagagcccggggtcggcgagctggggggccgcgtcccagccgccacccccgcaccgctcatatcgccatcgccaggtactctcccgctgccactgcaccccggctcagtggccaggccgccctagcctggcgccccgtcaccatggaaaccgggcgacggagggcgccaggcgtttggcgggggcggggcctgtcgctg

SEQ ID NO: 386 - DNA, 5852 bp, Homo sapiens; identical to SEQ ID NO: 385

SEQ ID NO: 387 - DNA, 30366 bp, Homo sapiens
ccaggtgccagaagactcagaagcaaggacatgtttattcagatccatggtcgttacaagcttcatttttggtcacaggccctaaaatgccattatgctcagtttacatcaaaatacaaagcccaacatttacaatttcaaaaacattaaagcaaacccccaaaaccccacaccgaaaacaaaggcttggtttggaaatcaccactgagatgctgttctccctcgcatgtcgcctgtggggtgaatgaaggtgaagaccccgtgctggtttctgtcagagaatctgtagttgtatattttgaatacttaagtaccactgaacggttgccatgtctttgagcacttgatgttactgaagtgacaatgcttctgaccatctttggctgcagagcagaaactggcagaatccgaccccatcgacccagcagtgtccccaacgcctgaggaccagcacccatctgtgacaaggcacaggggtccgcgatgttggccactgctttgggtgatgtgctcaatggcttggggtctgcggtgaagcccctgggctctgggagggtcttaggctcctgaaacatggaattctacggcccagtcttggaacagctgggagaacatgaagaacgcccctcacagtgaagaatcaggacagccactctctggttttctcacaactctagaaactttgattctttcctggagtggagacttaagccactgtcctggtcccacacagagagaggaagcgccacaacccactctgccaacctcaaggccagccagtggggaggccaggcccaggtggctgttggcaggctggctcccaagcttggtgcagcagagtagccaaatgggcagtggaaaaaaggccccgagagctggcttggccgtgagtccttggcggagggagggaaaggccgccgctgagctctgcgctgtcacagagcgtagctgttgagccctggcagctactcctttgctggggcccacctgccttcctttcttggttgcgtttcctccagatgcctctgcggctgcaggaaccccgctccagaagcccgaggatgaccgtgttccctcctggaggggcttcccaggtcctctcagcccaagggtggggctgtgtggcaaatccctccagcctgctctgaaggcagctgacaccttcagggctggtgcagcttcccccgctcggtcagcagtgtcatggcagaggcgtagaggacatagcccagggtgagcagcagcgtgcatgggaggggcccgacgcagaacagagaggccacgaagaaggccagcagcagcgagaccagcgtccggtaactgcccaggaagcgcaggctgagcctggggccgcgggtgtggccggccacctgcctccgccccacagggctcagcaggtgcctgctggccagcccaggttctgtgaggtggtagcgacagaagctgccgaggaagtcatcccgggaacacagagccgccatctgtcctgcaaactgaagcacagacagaggcacggggatgtggggtggtggcaccacaggcctcaggacagcagtaccccaccctcacaggccaccccaggactgcaccccaggcaggagcatctagaaccctctctgaagacgccaggccagccctcctgcccactcactctgtggttgatggcagacgacagcctaaagagtgtgcggaccaagctggcgatctcatagctccggatgggctgcagctccgggtccccctggtactcaatttcaaaccttcgcagcccattgatgatctagaaagccaggccatggggatgggtcagaaaacacagccccacacacaactcagaggagcctgatggcctctgctcacaagggaggagggagctggggacgggtcagggcccagcctgtgcgcctctgagacacgggcctctcacctggtaccgccccaggggcgtaaggatgagtccgtcctcacccacgatgcagtcggggagttgcttttttccattctcatcctgggtggtgcccaaggcgagtgtgaactgcctgagctgcgcttcgctgagctgccagagagaaatgccactgccctcagcatcaagatgaagagaggggaccagtcttcaccccaccagcctacaacagtggcaacaaggggacccagctatgacgctcggggtgtgggcctgcctcccacaacactgggtccatatgtgtggggcctgggactggtaggtggctgaccacaggctgggtggagtggatccttcagggaaggggaccctgatggcggtggggcaggccccatagctcgtacccggaatatctggcgcaggtactccagggccttctccaggtattcatctgtcttccggacactgtcttgccccatctcgtccaggtcgttggctgtgtaggagccattggtgtccatggagctaaagcccagccatgagaggaaggagtggccagccgggctctccgcacactggtcggagatggacttggctgtgtgtttggcctgtgtgatgagctgagcgaggcgcaggacctgcaagggaggcgcgggcaggtcaccagcaggacaggcctgtgctgccacccaggcagccccaagagcaatgcacagccagactgctgagcgtcaggaggagtggcttctgccagaagacttttaaagactaaaggatgatcttctacatttgaaatttcccaagaaacactgccttcgttatcaggaaaaaattagactttactaaaacgggggaaggagatatggcgtcaaatctatacccagcctccctccttcctgctggatcacagcacttcccgggttctgctcagccccatggctccaggggccctgaggacaggcaccgccgaaccactcaccagggtgcgggcctcgggcccaaacatcggggtgtacttgcagtcctggccctccaggctgtagacgtggctcttcaccttgaaggaggcatcagtgaccgctggtggccagggtgacaggaagctcccagtgaatgtgggggccgtgaagagtcggtgctggcggtgggggatgaccagctctggctccaggaatagctgctcacctagaaggcaggagacgaacctggcacccacttcccggaggcagagtacccgactgctgcccttaggattctggggtgtctctgaggtgtctggggagccatgacccaggggtgtcctcctgaggccctgcctggcagcatctcccacacagtaggtggctgacatggggagggcggatgggggagctgctggctcacagagcccctagcagtgtctgcaggaggtaaacaacaggaggatcgacagaaaccaacgcccaacccagccaggatgaatgcaaggcagagaccaggctcacctcctgaagcggccaacacgagttgccagggagaaacagcggggtcacggggccgcagcttggaccgtgccggcccgctctgtgggcacacctgcgatcccccacccagtgcctggtggctgcagggcaggcaggatccagccggtttcagacctcaccacacagacgtgtcccaggagtctccacagcaccctttgccggggcccactctgggcgtgtgggtccctcttaaagaccagccacccccagctaagggcctggccctggtctggctgggttgacgtataccgggctggcccaggctgaggacttacctttctgaatcatctcagccaggttgggctgggcaaagactttggccactcggaacaccatgagcgcgtgcttggggctgaccaggtctgtgcggagcgcgcggttcagaaagcccacaaacaacttggtgtacatcagcaggttctcctggacaaagggtgccctggggaccgaggtggcaggttggggccagccttccaactggaagcatgcccctaatgcccggtccgtgcccctaatgcccttgctcacccttgggctttcagactctccttagccaaggtgacaagctgtcacagatgacagctcagggggccacgggcaggcagggaggacaggacagaggcaggtaagacccaggccctctgaggatgccacatccttagcaaggctgaggcccctttccaagtggatggaggccaccatggcagaggccagcccagagcctgagggggctcagggaggatcccccagagggtccaaaggggaatgccttgggcaaggaggggagggatcagtggccatgccaggtgccacggaagcctgggggtccgctgtgaggatcaagcaggggatgaggggaagacagcctccctcatcccctgcttgatcaccgctgctctgttctgtgctgatgaaggtcaagggatagtttgggggtggctaaacactcatctgggacagaagggagaggggacagggcaggatgggtcacccacagcttccataagaaaccaattctagggcctggcaaagttgagcctaggaaaaggctggtctgtgttccgctcggcaggggctgggagaggacttcaggaggccacgggggccagggccaggctgaccccagcacaggccgctggcttggcctccacccactggaacaatatccacctgggggagccagtggcatgtctgtgagaggagctgaggctcaccatttctccgacacacaccggggctgggagtcgctgcccggagcctgcttgtcaggcgcgtaccgccacggctgcaggtagctcagccacatctccaggacctgtgggggaggtgtgtgctaagggctccgtggctgggggccaaatactcggtggcctggagcccagataccaggcggcagctgggtgggactgactcttctcacttcctccagagggcgcaggagagacatgcacagccctgtgaggtttggctcttgctggccctccagaagccagggtgggcttttcccagcccagggggcagagtactccctggtcaggtaagggtaggaacctgccctgcaccagacaggtgggacagggcagggctttcctgagggctggctttggaaactcaaacagaaagaacaatgtggccctccaagaccccctccttgccaaggcctctgtgataacacttgctctcctcctttatctgccccaaaggacctcccacctcaaggcacacagaggacacaggcacacgtgtgacggggccaacactcacagctctgaacgatgcgtccaggggccagtggccaaagcaatgctgcaagaagaggtagagtttctgctggacgaacctcgggacagcagccctgcaggggatggggagggtcacctgctgcttgcccagtaaggaggccctgctcacagatgaccccagggctcccatcagtgagggttggctccgccgggggagagcactgggcacctccgggaggttcagccccattcttcagaggaagaaatcaaggttcagagaggttagggaacatcccaaggacacacagcacgcaggcggccgagtcagcacaactcctgcacacacctcaccctccgtcccatacaaacagcccactctgctggccctggtgggcctggcagtcagggccaccccaactcttctgacagggttgaagaatatgagatgcaagagatggcagcacaatggggcctctctggccagtctggagagagaggctctgggagccaactgggcggggtgagaggacacctgcctaggcctggagaggcctcacgtgctctgtgaacagaaagggactcccctcaccctgccctccatgccctggggagaggtcgctgtgggcgacaccttaggaggggaaagtgggggagacggcagtggtgggaagccgcaagggccacccaccgtttgaactcctccagggggctggtggcgtgggagtgggcggagggtgaggcctgctctggcttcaggctgttggcaaaggcgtgcaggtgcttcagcagcaggcgcaccaccaacacatgctcctcagtaggcgtgaacgactcctgggtggagaaggaggggtgagggcctgggaaggagcgtggcacccatagcactccgcctccaggtctgaccacatcccgccctgagccagttgctctgctgcccccacgggaggcatgagccaggccaggagtggggccaccccatggggcaccactgtgcctggcacccagatgtgccttgcactgcttggtctgaactgtgaccagcttgtggtatggaagtgcttggcccagcgcccacacagccctggggaggcctcactaagacagacacatctgcagagggcctcccagccctgcttctgcacggctgcaaatccgcagcgggtggcacaggctgtgcccttgggcgctggtgcctgtcttgatccccagggcaggagaaagccagcatcacccacaagctctggatccagggtctcccacctgcctcccaagtgtgtgcagaaagcacatggaacccaggtgtggtgcctcagacctgtaattccagcactttgggaggccaaggtggaaagatcgctaagaagaagttcgagattagcctagacaacatagggacaccctgtctctacaaaaaatttttaaaagttagctgggtgtggtggtgcacacctatagtcctaatgactcaggaggctagggtgggaggatcacttcagcccaggagtttgaggctgcagtgagctaggatcgtgccactgcactccagcgtgggtgagagtaagacctggttcaaaaataagaaccccatggcttcactttcctccccaattcctcccacctgctcctcatcctggacacagccagatgagaactcggcccagtagaagccccgggcgtcacttcctctgttgcccagggacctgtggtcaggaaaaccccaagacaaaagcacagtcaagcatattaggccaaactttttttttttttcttgagacaacgtctccctctgtcgcccaggctggagcacagtggcgcaatctcggctcactgcaacctccgcctccaggttcaagcaattctcctgactcagcctcctgagtagctgggacgacaagtgtgtgccaccatgcccagctaatttttatttttcatagagatggggtttcaccatgttggcctgacctcaggtctcccaaagagagggaatacaggcgtgagccactgtgtccagcctaggccaaacttttgatttgtaacatacaagcaggatcctggagatctagccggagaggaaagcctttttggtggccatgggcttcctctggttgtttagcattgggagggcaggtgggcgcatcgagagtagacgagggcagggaagtaggggtgctgagggcaggaccctgagtctgagtggacatgctcgcctctccacacttgtcccctagccctttgggccgtaacacatctgtgctgctgaggctggtgcagggcccagcctccaggtatatcctggtatgctgtagaccccgcacgggccactgcccatatcgctacccactcaagtctccccgtcaggaaactgtccccacaggtccaagtgacacaccccagagataagtggctgagtctgaagatggagctatggggtgggaggcattttcttttttttgagacagggtctcactctgtcacccgcgctgtagtgtcgtggtctcggctcactgcagcctctgcctccagggcttaagggatcctcccatctcagcctcccgggtagctgggaacacaggcgcacacaccaccacaccaggctaatttttgtatttgtagagacaggggtttcgccatgttgcccaggctggtctcaaactcctgagctcaggcaatccgcctgcctcaacctcccaaagtgctgggattacaagcatgagccatcgtggctggctatttttctctatctgtattgttaagtctttgggcaatgaatttgcattgttttggaagaaagggccaggtgcggtggctcacgcctataatcccaacactttgggaggccaaggcaggcagatcacttgaggtcaggagtttgagaccagcctggccaatatggtgaaactacatctctactaaaaatacaaaaattagccgggtgggtggcacatgcctgtaatcccagctactcaagaggctgaggcagaagaatcacttcaatctgggaggtggagattgcagtgagccgagaccatgtcaatgcattccagcctgggcaacggagtgagactccatctcaaaaaaaaaaaaaaaaagacagaaggagaaaagtatgagacataatacctgtacctatactgcccaactagaagggcaccagtggggtgggaagttagaccagggtctttctcctcctccagtctcagcccaggccctccctccaatcctggcctgggatcctgagccgtaacatccttcctgcagctaaggggaggggaagacctccacatgtgaactggaaaactgctttcccctgctggtgcacttgacccacctcacctggtccttccgaagggtctggagggcccactgtccgcccctgccgccggcagtcacatggaaccctctcaggctattttcccataggtttgctgagccaaacttctccctcagctctgcacccctcctgggccatgttcccacatggagtccctggccacagtcacctgcttgcttcttaaggatgtgtccccaaagccgcacatttcccactgggctgagactcacagcacctcagctcaccccacctgggtctcgctggtcaccctcccaccatggggtttgccagatgctttctggaccactgtcctccctccctggcgcaagccctcaggtccctcctctcctctgcagtggctcctgcggaatgaggtgcccctgtgtgctgtggccaccatcccagcccaccagcgctaaggagccaacacattttctcatcttatgctcaaattcctgttcaatcatgtgtgctctttcccaggtgaatgggacagatcactggctgtgagcacagcccgtctcccccggctctcacagattcctctgtcatccctgaagtcccctacaggtctgaactctgcttcactgacctcaaatccatccacacacttgtcatttctgcctaggcagctgcaacctctatgaggtcaccacccactctaatctgcctctggaggtgtgtatgagcggccagggctccccaggtgaaggccgggtcctggctgggctgtcaaggactgacagcttctgtgggctatagggtcaagccccaggtccttcccaccccctgcctcacacgcaagctctgggtcacagcacctccaggctgggtgacagttctgaacaaggcagaacccacaccacccgtaagtcccaggcctctgcgtcttcagctccttcctaagcgccagaccctgcagagtgcagtgaacccagccactgctgaggcctgaggactccagctcttcaaaccagggccaagcacgaggcctccaacactggagagcttgtgacacctccactggcctggagcctggacagccagggccacatgcccacatgcctcgttctgccacaaagccaccacccccacccccaaccaaactagtctacaaagccaggggccaagccaggctggaggctgacccctgcctccccccgacacaggggcttcgttctgcttggaactagcctctgagtcaccagcggccggccccggcggccccttgctttgccaggcatggacatgcactctgggcaggaggaagggaacgaatgagccagtacttggtaggcgtggagggcctggaggctgggttgggcggggctgtagagggcgctggagacactgagtcggtagtgcagaacctccagctgagataagaaacagagagatgccggaagaggccgaagagcagaggacaagagaatggggtggggaaggggagagataggaccagacacgggagggggaagcggagagagaaagaaagcaatgagaacgagcccaggagtgaggagaaaaaaacaaaaacaaagcacggtcagtgacaatccaaacaattgcagtcccagcagccgcgggccagcgcagcacccccctccacaaccaggccagggctgtggccacactctcctcgctttgaaggcccgggcagaggggcctccaggtcacctgggtggcccctcagtattgctggggcctaaaggcctctctagctccttggaagggcccaactcactgcccttcaagacgggacccactctccccagtgactgaggtcacactatgtgtggcaaatgcaaaccagagccctccaagagcccagggccctcactgggacatgctgccagccaccaagacctcaagatcctgaggctcagaaaagaaaccagcggagcatgttccaggaggagcactctgcccagaaaacacatgtggaattgactggatttccctgggttgtcttaagaaatttaccaaattggtataagacatgattgattcctatgtgtctaaaactcaaatcaatgtcccctccatgactggctctctgagaactgagggcgaggacaggtccccaagggtagcacagagacgaggagcacaggctcaggccaccaggccctgccctccaccctcatagtctggacgtcagctaaggtggtgtgcacatcagctctgactcctggaggcagcctctcctaccgcaccagaaactcccaccctccagatacagtgggttcccaagggcgggagcccctgaggatctggccacagccacacacacccagaggcagcaggaacctgaggctgagctggctcctagccaggaccctccgacctgctgccctgcagcaccacggcctgccgaagcaccccttcagcccagtgcagccacagccggcctggtgcacatcctgccccgccagcagcatgcctcctgcccaagcagcacacccactgggctccacacaggagaaatcagaacacacgccagtcgccatgacacgcagagcagggagtgaaggagcagggcagggaggtgttgccctccacagccttcctctgtgccagacctggggctcagggaggaatcagacacatagttccccagtgtggctctgcccttgcttgcaggaacacagtggcctacagcgccatggccatccttactgcccacagggccactggggagcaagcatgcatcctggactcaagcagggtgaggaggatgaccccaggagcctcacttcctgcatctgaaaataagggctagtggggacgggcagggatttctgcatggcagtacgtgtagcacaggcctggacaagcggcaagaagccttgggagacacagacctccacagctgcctttctctgactcccacccaccaagttttcttgcgttttgtgttttgcctgaactggaagaggcgaagagtggagcatctctgggtacttggtccggccactgcaaggtattctgagcagggtccacccaccccaaggtctggccaagaggaagcaaatgtggggaagaagggaactgcacctcctgccctccacagggacagccccctgcccttcctctggcccgtgaggacacagaatcctcacaggtgacagcctcaaagagcctttctggctgactcttgaaagtaggtgtgcttccactccctcagaaggcagaaggagcaacaggaacacaatgcggtgcagtggcctctgcccctgccaggccacgccacgccacgccacatgcacgagtgctgagtgtcccagagccccacgggaggagcaggctcagggaataaccaggcccccaggcaccggccaggaacatgcagcaagtctgctctggaagcaggaagggcactgcaggctctttgtgactcaagaggcccaagatggggtcctcagcttttccccattctccgcccatgtgattctgagggtgaggatttgggggaccctatgctctgagagagcctccacatggcaaagcatggggccatggaactggctgcagactgtggcagaagcagacccacagctctttgccagaaccagaggaaaagtgacaggatgctcttctgaagtttaactccatcacccacattctggaggaagccctcaataattctgtcagtgacaaagccaaagtttcccaagcatactgatgcacagacgccatgggcaccagactacgtggctgatgccacttcaggcaagggcacggatgggcatgagtcaagctgctccatggagatgactgactggagatctaaggttcacctagctgctttctcactctgaccggtccaggggtggtgctagctccaggaacggcaacagcaggaatgacccagggcctccgccacctccatgcatctgaaagcagcgtgctgcccagagagagagagcagggacaggcgaggcggagggagaggaggcaagccaggctgcatgcaggggggcaccaggtgccactcgccacgagaagggctgcttgctcatgctctggagaaggtgggggagtagggtgagcaggcaaaggaggctccaggccaccccttcatgggaaagcacaaaggcactgctgatggtcgaggagacagacaagaaagtgactccctgaggcatcgcagctcccccactcccagagcaagagcaccacaacctcatctgttcctgctgccagggagggggctcaggaagctgcacagggagggccccggagaggccagacttccaggcctcaagtttctacacatcagggtgcaatgccccctgcccgccaccggaaactagagaacgatgcccacttcttatttggcttctgagtgacaggtgggtggtgggtttctgcttcccaccatccagcctgtgaaaactcactcagaggcaggataagaagcagcaggctgagcagggtcagaagcaggaggtgggaagaaaaactgaaaacataccttggcatgaggggactgcattttttgatacatctccaaggaatagtgatgaagccacatttcaacaaaaacctgcaaaaaagcattagctagtcaaaccattcttgacaatggtgtcagaccatccagtggggaaaggacagtgtctccaacaagcagagctgggaacacagaatacccatgtgcagaacagtgaagctgggcccttccttcacaccatcaccaaaaaataactcaaaatgggtaagcgacctgaggataagcactaaaaccatacactcttagaagaaaacatgggagaaaacttcataacactagatttggcaatgattaattagatatgatgcccaaagcacaggcaacaaaaggaaaaaaaatagacaactagacttcatcaaaatcaacactcttgagcatgaaaaaatactatagatagagtaaaaaggcaaccaacaggcatggtggctcaaccctgtcatcccagcactttgggaggccgaggtgggtgggattacctgaggccaggagttccagaccagcctggccaacataatgaaaatctgtctctacaaaaaatacaaaaattagctgggtgtggtgaggcatcacacctataatcccagcgacttgggagtctgaggtgggaggattgcttgtgcccaggagtttgagactgcagtgagccaagactgcaccactgcactctagcctggcaacaaagacagactctgatttaaaaaaaaaaaaaaaaaaaaaaaaaaaaagggctgggcacagtggctcacacctgtaatcccaacactttgggaggccaaggcaggtggatcacctgaggtcaggagttcgagaccagcctgacccaacatggagaaacagtgtctctactaaaaatacaaaattagccgggcgtggtggcgcatgcctgtaattccagctcagctactcaggaggctgaggcaggagaatcgcttgaacccaacaggcagaggttgtggtaagccaaaatcgtgccactccactccaacctgggcaacaagaacaaaactcggtctcaaaaaaaaaacaaaaaaaaaacccagcaactcaagtgtctactgagagatgaatgaataaacacaatgtggtacatccacacaatggaacactattcagccctaaaaagcaaggaaattctgacacatgctgtaacatggattaatctttagtccattatgctaagtgaagcatgctactcacacacaaataagtactatgtgctacgcatactctgggtatgagatctaggagtcaactccatagaaacagagagcagaatagtggttgccaggtgctgggtggggaattgtttaatggtttgatttccttgtttttcattagaagagatggggtctcactatgctggccaggctggtcttgaactcccggccttgagcaatcctttcctgctgggcctcccaacgcactaagattagaggtgtgaggcccctgcgcccgggctggttcagtttcagttttgcaagatgaaaagcattctggagattgcatgcacaacaacatgactgtattcaacactactgactgtacacttggaaatagttaagacaataagtttcatgttatatatatcttataattaaatttttttcttagttaaaaaaacaaaaagggccgggcacggtggctcacgcctgtaatcccaacactttgggaggccaaagcaaatggatcacttgatgtcaggagttcgagacatggtgaaaccccatctctactaaaaatgcaaaaattagctgagcatggcagtgggcacctgtaatcctagctactcggggggctgaggcgggagaatcacctgaacctgagaggtgaaggttgcacagagccaagattgagccactgcactccagcctggacaacagagggagactccatctcaaaaaaaaaaaaaaaaaaaaaaaaaatgctttggcccagggaacagcagaaccttccagttcttccctataagcgctgtgtcatgatcttctgccctcttcatggccagcacagcctacggtccacacagccaagagccatctgggcatcatggtcccctctgtgaacaggggcaacggttcttaccattccaccctgcgaggatgctgtgaaatggtatggaggcttcaaaaagtgcagcaccccaaatactaggagttacatataagatgggagatagaatcctatcttatctacatgccaggctgtaaagcaaggctgtggctaccaagtcagccccaggatccagcgtcagaagcagcacctgctgaatctctctgtgtgcctagaagacacagccaggacctgggagttggccagcactcaggaagtgagccagcccataccatcctgacaggctggagcccctctgggcagacaaggaaatctgtcacctactacttggatcccctgaatcaatggaaggcctgtggaggctgcacagacccctcaccattcagtgtcatggaaaccaaaagactctgcaacaattatatcaccacaggcaaaacgaaacaacttccatggacaggggatcctgggatgaaaaacgccatcaatgacattcaagttaaaagggtgggcagatttactttcatgttttctaaatgtcacagcaggaaaatatcaacaatttagaatcagccccgggctgaggggccgcctctgggactctgccccacatagtggaaggtggcaacagtttcttttctttttctttttttttttttgagatggagtctagttctgtcacccaggctggagtgcaatggcacgatctcagcttactgcagcctccacctcctgggttcaagcgattctcccgcctcagcctcccgagtagctgggattacaggcgcctgccaccacgcccaactaatttttgtgtttttagtagagacgtggtttcaccatgctggccaggttggtcccaaactcctgacctcaggtcatctgcccacctaggcctcgcaaagtgctggggattataggcacgagccaccatgcccagctggctgaacagtttcttttgaccagctcaactctcacctggagcagagtttctgacctccagatctcgtgggaggcggggtctgcattcacagacgtctgatgagagatgtgtcgctttaggaggctagtgtggtggaggccataggaagcaaagggtatggctggtgtcctgagggagacacagaaacaggcccgagttacaggctcccgctgtaactcgctcccgctgtaacaggggcaatctggatatcaaaatcaacgagagcagggacagattacaacttgttcaatagcacaatgcacacctccccccagccccctgatccacactgatatacctgaataaataaatagcaaagagagaagtcttccttaccacagagtgaccattgacccacaaatcaatgaaggagggatgaagttagagaaccaccatttagtaaccgccctattaatagctgatttggtcaagaatcaacagtgaggttgggcatgggggttcacacctgtgagcatgggggctcacaccagcaccttgggagaccaaggcaggaggatttcttgaggccaggcatttgagatcagcctgggcaacaaaatgagaacctatctccacaaaaacattgaaacataaaacagctgggcctggtggcatgtgcctgtagtcctagctacttagaaggctgaggagggagaatggcctgggcccacgagttgaggctatagtgacaaatgatcgtaccaacttcactccaccctggggtgacagagcaagaccctgtttctaaaaaattaagaaattcccagcctgggcaacatggcaaaaccctgtctccacaaaaaaatacaaaaattagccaggtgtggtgatgcctccctgtagtcccagatacttggggggttgagacaggaggatcacttgagcccaggaggttgaggttgctgtgagcagagatcgtaccactgcactccagcctggggtaagagaacaagaccctgtctgcaaataaaatcaatttgaaaaaataggagaatcaaaagtggatgttaatactactgataattacatagtctccatacatcttcccggtaaattctcgttatcaatttttttttgagacaggatcgtaccctatcgcctaggctggagtgcaatgatgcaatcacagctcactgcaacctcaacctcctagacttaggcctcccaagtagctgggaccaacaccaccacgcctggctgatgtttttctttttagtagaaacaaggtcatgctatgttgcccaggcactattaatttttttttttttttttttggttgagatacggtctcactctgtagcccaggctggagtacaggggcatgatcttggctcactgctacctccgcctcctgggtgcaagcaatcctcccacctcagcctctcaagtagctgggattacaggcgcacaccaccacacctggttatttttaaatttttggtagagatgggattttgctatgttgcctgagctggtctcacactcctgagctccagtgatccgcccacctcagcctctcaaagtcctggaattacaggcatgagccaccatgcccagcctcattactatttaacctgggcacaaagtaattattttacaatggaaaaacctgaccggcacctttttaacccagtgataaaagggcacctggcaaggaccaggtgtcccactacggtgctcctcccaacaaagcccatgctgggcctagtcaccagcaaataccacacagcctaaggggcggccgcatgctctggaggggtcaaggtcaggaaagacagaaaggcaagggaccattcctgactgaaggggactagaaatatcactatatacagtgggtgagcctgtgaaacatcactgcacacagtgtgaggcctggtggcaatactaacttcctggtgtggttacaggcactgtgactatataggataatgcattcgcttctaggaaatacactgaaatattaagaggtcaagggatgccatatcctgtagcttactcatattggcttagagaaaaaaaaacacatacaatagaggtggaaaccaacacatgcagcaaagtattaacagtttggaaatctgggtgaagatctatgaaagtttcttttttttttttttccctgagacaggatcttgttctgttaccccaggctaaagtgcagtggcacgctcacagctcattgctcctgggcacaagtgatcctcccacctcagcctcctgagtagctgggaccatagttgcacatcaccatacttggctaattttttttttgtagaaatgaggtctcccgacgttgcccacactggtctcgaattcctggcctcaagtgatcctcccgccttggcctcccaaagtgttgggattacaggcgtgagccactgtgctcagcctgcaagttatttttattatgcgtggaaacttatctgtaaatctgaagttatttcaaaataaaaagttaggtgtggtgacttgcaactgtaattccagctacttgggaagctgaggcgggaagattgctgaggccaggagttcaagaccagcctgggcaacacagcgaggcatccccatatctccgcaaaaaaaaaaaaaaaagttaaattagctggctgtagtgatgcatgcctatagtcactgatgtgacaggctggcttgagtgatgattgtgccaccaagtgatgattatgacactgcactccagcctgtgtgacagagtaagaccgtctttaaaaatacataatggctaggccaggagcggcggctcacacctgtaatcccagcactttagggggtcgaggcaggcagatcacttgtggtaaggagttcaagatcagtctgctcaacatggtgaaaccctgtctctactaaagatacaaaaattagctgggtgtggtgacaggcacctgtagtcccagctacttgggactgagccaggagaatcacttgaagcagagacagcgccactgcactccagcctgggcaacagagtaagaccctgtcaaaaaaaaaaaaaaaagcacacaatggaccagtgtagtggttcatgcctgtaatctctgaactttgggaggctaaggcaggaggatcgctcgagcccaggagttctagagcagcctgggcaacatagcaagacccatcttacaaaaaaataaaataaaagctaggtgtgggggtgcatgcttatagtactagctacttgggaggttgaagtgggaggatcacttgagctcaggaggtcaatgttgcagtgagttgtgatcacaacactgcactccaggctgagcaacccagccaggccctgtctcaaaaaaaaaaaaatgctgggtgcagtagctcacacctgtaatcccagcactttgtctgaggccaaggtggacggattgcctgaggtcaggagtttgaggccagcctggccaacatggtgaaaccccgttactactaaaaatacaaaaattagtcgggcatgctgacctgtgcctgtaatcccagctacttgcgaggctgaggtgggagaatcacttgaacccaggagatggaggttgcagtgagccaagatcatgccactgcaccactccagcatgggcgacagagtgagactccatctccaaacacaaaataaaataaaataaaataaaataaataaataaacccaaaccatatatatataatttcttttcttttttttttttgtgtgtgtgtacagtggtgcaatctcagctcaccacaacctccgcctcccgggttcaagcaattctcccgcctcaacctcctgagtagctgggattacaggtgtgcaccaccatgcccagctaatttttgtatttttagtagacaaggtttcaccatgttggctaggctggtctcgaattcctgacctcaggcgatccctccaccttggcctcccaaagtgctgggattacaggcatcagtcaccactcccagcctacgtatataatttctaatagaaaaaattaaaacaacccaaaaagttaaaacaagcaaaaaaaccaggcatcaaaaactgcttggcagctgaattctgcatctaagagggtgtgaatctgcctcacctccgagtcctccacaggatcagcaacatttcagggtcactgatcactgccgctacctgggcagcgtctcctccttgccactccctttctcccctccaccctctggggaatctgtccacacgtgaattgtaggtaaaggcctggcctgccttacacatgccagcagatctggggtgggccagcatctgcaggaaggggcctgcatgcagcttcctggggaaggcgatgggccagtgagattaaagagggtcagaggtgcacaggcagctgctgctggggcaagagggtctcctgggaagtcggcctgcgttagtgcccactgaggacccaggacagccaggcatgagagcccctggttcacactcccaacctgtgcaggcacgcatcaggctcagcctgtttggactgacaaaacaggctctttggcccagggcctccccttcaagatctgctcctggggcccatagagattcctattttttttgctcataggacaacctttccaccctgctcactgactcagacaccgcctgtggggacggctgctccatgcacaacacagcccattcccatgcaggccgtggaggcctccagggacctgatagcttcagtgatggccaaagacactgaacactaaggacagattgcccgccataccccaccctccagtctgtgctaagacagctggggatggggaatgaggcataagaaaaattggggaaccgtggacaaagggtggcaacattgtccccgtgggcgatgcaagtgaccaggccactcccttatggaagggccaggtcttaacaaagggcagccttacctgggaggtggtgaggggctggtcccccctgggctggaggagagtggtgggggcacactgccttcggtgggcaggaaccatgacaggtacctgtccaccaggatgaaataggcacagtctgaagtacggacgtggagggacacaggaagtggctggaaaaccaagctagttgttagcatgggctctggacactgccaggccaccaagcaccaacaagtgcagggaagccctgggccgtggccccacctctcccagcaaaaggcatcccttccttaccttctgagtgatgaggctcaaggcaaagaagaatatgtaatactcgaacggatctgagagcagcgtcaggggcaaacatgcagggttgatgagccaccccccgctcagtgtcaagtgctgggccacccacagcctccctacctcagggccaccaaaggatactcagggccaagttcagaccaaggcccccagtaggggtgaactggaccttgttgtggtacagaggactgtcagggaggatgcactcctggatggacgccttcacaggaccctgcagagagaggcagtgaggcttgtgggcaggtgctggtgcgtagtgcccgatacgcagtaccccacatgcacagcagcactttgggaaggctgctggggaagagacccacacacagaacccacctgtggggacagtgccctgcctctgagcagtgcctgaacaagagtctttgcttagaacttctcctaccatcatctcataaagagctgcagacagcaagggtagcagtcatgcaatacccatttcctttgcctctcacacccctggaacgaatcgctcctcaatttgccctcagaggactggaggagattgcccatcaccacagggctgtgcaaggcccactgccccgagcaccactctcgccactgtggtttacttacaggcaagtaggagacaggaaagtcgaacttatagtcttcagcttgaagcttataaaccaacttcatcattgggccactgaacacgaaattgaacaaacaaacaaaaacagggcaaatgaactgcgaattatcttgctttgattgtttcttaatcttgagaaattcagagagtgctttaaaggtggaatcaccatgaggaatcacccagcctctctccggtgaccaacctacctacccagggtcgagaaattccatcacgatgctgtactccacaggattcacgcgcccctgtaagcagcggaggttccagccaacgaggacaccatctaggctgccaaaaatgctttctaccagccatgggaagatggtgtgcagctcctgaaacaatgtgtggtgaagccgcgtgcaggaccagcacccactcctgccccggctctagtcctgcaccacctgctgcccagctccctctgaggaagccactccctggctaagacctatgggatcagccctgcacccaaaggaagcctggtgccatggtgccaacgacaagagcagctttacgttcttccagtggggtacatggcataccaagcagtgttgctttagacttgggccagttaagtaagtcagcctccgatcaaaatacattttttgtgtgtgatagaagattaaattaagaaaaataaataaatttaaaaaaaaacaaacaatgaaaataaaaaaatataaaataaaaaaataaacaaaatacatatttattgagacaaggtctcactctgttgccctggctggagtgcagtggcgcaattatggctcactgcagcctcgacttcctgggctcgagcaatccccccacctcagcttcctgagtaaatgggactataggcacacaccactacactcagctaatttttaaatttcttgtagagataggttctcagtatgttgcctaggctggttttgagctcctgggcttaagtgatcctcccacctcggcctcccaaagtgttgagattacaggcatgagccaccacaaaaaaaagattctttaaacagtgatggaaacttctgacttgaaggatgctctatcagaaaggaaagcaacatcctttccagagtgaagcccctgaaacctaactgacctattgccatttggtattaactccttgtctaggccagcttcctgggcttgacaattccaggtgtgatttaaatacatatttttagtatttacatcagggtttctcaatcttggtgctgttgacattttgggctagatacttctttgtcgcagggagctgtcctgtgctttgcagaatgtttccagcaaccctggcctctacttcttagaagctagtagcacacactccccatctacctccagatgtgacaaccaaaaatgtctctgacattgccaagtgtccctgaggaacagagcatctgtggctgagaacccctgatctacaagttcacatgtttaaatgtgtccgtaaacataatggtcatggtaatggccaggcctctgtgccaggcagtgctcggggttggggcggggagggaaattaggaattataataaagttcttcaacgaatgtataagacatgctccaaagagagacgttagcagagctatacctttgctggaaagtcctcaatgactttaaccaagtcttggcactgctgtgcaaagggcttatttatagagtcagctttcaggctagcctagaagacagaacaaagcgaaaaagtcacgaggacattcactctgcagcttttagtggcactctggcttgagtcaaacagaaatccaagcaataggttatgagtcagacccataacctctggcctggttccccagcccctcatgtgtgtcagtggcccaaagagtactactaggagaggccgtagttctatgctctctggaccaggaactatcagccttgtttcccagtaccccctcagagtgctgcacatgatcagaacaggattgacttccaccaatccataagtaggggttggtcccagagtcagccccacagccagaagaggatcttgactgtgtaagggcacccctcacaaaccacagagtataactgagtttgtacgcatcaactggaaatttccagcctgatggaccaccgtgattacaccattgtgatcatcagtaagaacgcccaacaacatcacggctatggcagaagctctcttaaatgagctgtcctttattcggtagacactgaaccactaaaccaatgatcttaaaacacagggcagacaaaaattatagatggcttcagccaagtagacactaatcatgaaggcaatggagaggccagaaaagactcaggacaaggactaatgaaatctacctagtcgtgggatgtgaggaaagcaccctgactacaaggagaaaaagggcatctgtgcgaatggattaagatcaggagaaacggctagaatttcaacctagagagctttgccaaaggatatctaaggccttgtctacctccaaacaagggtggatttcacagtgattgagacagagatggagacctgagctatctggccatgggccagacctgttgactctagtggggtgcactgaggaagaatgtccttccacataaatgtttacaaaaacacctcctaagaactaaaattaggaactttcatcaccaatacttgcctcatatctaacttctcacttctcagtatcatttttttttcctttttgagtctttactatgttgcccaggctggtctcaaactcttgggctcaagtaatcctcctgcctcagtctcctcagtagctggaactccaggcatgagccactgcacccagttctcagcatcatgtttaatacttaaagtgcaacctagcaggcccccgcacaacagtgtctccatttttcactgatgacagttatgactgattattagaatacttcatatctatttaagaatttacaagtcatgaacattctgatatacatccttctcacttgctcttcctcctcctcacacccttgggaagtagagaaaatagaatttgaatgaacttgtgtgagaaaacccagagcccagaagttgagtaaccccaaggtcctgtagtaataaggaggcacagtcaagttaaggagtctgccattgtttccatcacatgcccctaaaaaacaaccactacagagttcttcaagtcaatgggaagaacactcaagtcccacatctacagaactatggccacactgacactcatgcaagcagttgatatttaccagtagaaagctgggctgctgcaggtgagggaacgccatagcagcctccagtggagagttgaaaatggccttcttagcaaaccactgtggaaaaacaaagacaaaatctcaacatctgtaacacagcagaatctttttatattatttttttagagacagggtcttgttctgttgcccaggctggcatgcagcagcacgatcatagctcactgcaacctcaaactcctgggttcaagcaatcctcccacgtcagtctcctgagtacaggcacgtgccactatgcctggctaattttcttcttttttgagacagggtctcgctatgttgcccaggctagtttgtcaggctgtgatgcccaggatcctggcctccactgatcctcctgccttggcctcctaagtgttggggttacaggtgtgagccactgcacctggccctaacaaaatattacatagtttcacaatgcccaggagaatatcacacattacattaccaattcgcaacacacattacattgccaattctcatgtcttacttattgattagagacaggctcttgcttgctcactcaggctgcagtacagtggtgcgatcatagctcattgcaacctcaaactcctgagctcaagtgatcctcctgcgtcagcctcccaactagcgggaactacaggcaaacatcaacaagcccagctaatttttgtactttttgtaaagatgggggtttcatcatgttgcttagactgctcttgaactcccagactcaagcgaactatccgcctcagcctcccaaagtgctgggattacaggtgtgagccaacacgcctggccagcaattcccatcttttatagaaatgctgttctcagccgggcatggtggctcccacctgtaatcctagtactttgggaggctgaggcaggaggatcacctgaggtcaggagttcaagaccagcctggctaacatggtgaaaacccgtctctaccaaaatacaaaaattagccgggcatgatggtgggtgcctataatcccagctactcaggaggctgagacccgagaatcacttgaacccaggagaggtggttgcagtgagctgagtcacaccactgcactccagcctagaaggctgagcaagactccatctcaaaaaaaaaaaaaagaaaaaaagaaatactgttctcctgcagcccatagtggccagcttcagagccaagtttgtagtactgaatcctcggtaatgcttgtacagcatttgttatataccaggactcgctctaaatgctctctatatatctcctcatttaatcctcagtggtaggcagaattctaaagatagcagcccaagattcccgacccctgtttgttcaatcaaatactcatctaggtactgctatgacggcattttgcacatccaattagagtcctaagttagtggaccttaagttacagagtagtccccagctgacagccagcaaggaaacaaagaccttagttctacaactccaaggaactggattctgccagcaacctaaataaacctggaagcagcttcttccctagagtctccagataagagcaaagctaccaacaccttgattttaatcttgtaatgcctggacttctgcatacataactatgagataataaatggatgccggtttaagctgctaagtttgtcatacaagaatagaaaaaccaacctcacaacaacccgatgggtacagatgtactatgactgcaggtcagtacagatgatgaaggagaggcagaaatgggataattcacttacccccacccagctagtaagtggcagaaccaagattccaatacaaacaccacctcacaaaactgagacaggggcaaatcccctccatattacctgtgcactatgcaatgaacggaggggaagagcaagctctgccaagggagcctttgaataagccatgagaaaactaggatcaaaggccgggcaccatggctcacacctgtaatcccagcactttgggaggccgcggtgggcagatcacttgaggccaggagtttgagaccagtctggccaacgtggcaaaaccccatctctactaaaaatataaaaattagctgggtgtggtggcgggcacctgtagtcccagcaactcgggaggctgaggcatgagaaatgcttgagcccaggaggcggaggttgcagtgagccaagatcacaccattgcactctagccggggtgatagagggaaactctcaaaaaatggaaaaaaaaaaagaaaaaaaaagaaagaaaactaagatcagctttccagaatcctacctctcagctcacccaggtcagaaatgaaaaatgctcagacctagacttcacagacaggaagtctgccaagtcccactggtgggctagttacagttttcatggcccagctctgcccactgcacaagtaaaggcactggggtgacacctggcagtctgtggaggaagagaggctgggtgtaaagaggccatgtaggcagctgtagagtgagaggagacaggaatctctgcctctcggcaataggaacatctcccaagttttttcaattctttttttttttttttttttgagacagagtctcgctctgttgcccaggctagagtcctgtggcgctatcttggctcactgcaagctccgcttgggttcacgccattctcctgcctcagcctcccgagtagctgggaccacaggcactggccaccacacccggctaatttttttgtatttttagtagagacggggtttcactgtattagccaggatggtctcgatctcctgacctcgtgatccgcctgcctcggcctcccaaagtgatgggcttacaggcatgacccaccgcgcccagcctcttttttctttttttgactgagtctcactccatcatctcactgcaacctccacctccaaagttcaaacggttctcgtgcctcagcctcccgagtagctgggattacaggggcctgccaccacaggctgcctaatttttctatttttagtagaggcgggtttccctatgctggccaggctggtctcaaattcctggcctcaagtgatccgctgcctcagcctcccaaagtgccgactttttcaattcttttttgagatggagtctcgctccgttgccaagctggagtccaatggcatgatctcggctcactgcaacttccgactccctggttcaagcaattctcctgcctcagcctcccgagtagctggaattacaggcacatgccaccacatccagttaatttttgtatttttagtagagatggggtttcactatgttggccagactggtctcaaactcctgacctcgtgatcagccctcctcggcctcccaaagtgcagagattacagacgtgagtcaccatgcccggccgctttttcttttttctcctttttttttttttgagatggtctcgctctgtcgcccagagtggagtgcagtggcgcgatctgggctcactgcaagctccgcctcccgggttcacgccattctcctgcctcagcctccctagtagctgggattacaggcgcccgccaccacgcccggctaattgttttttgtatttttagtagacagggtttcacgtgttagccaggatggtctcgatctcctgacctcgtgatccgcccgcctcagcctcccaaagtgctaggattacaagcgtgagccactgcgcccggccagctttctctttttcttttttcagacggagtctcgctctgggctctgtcgcacaggctggagtgcagtggcgcgatctcagctcactgcaacctccgcctcgcgggtgcaagcaattctcttactcagcctcccaagtggctgggattacaggcgcccgctaccacgcccggctaatttttgtattttttactagagacgaggtttcaccatcttggccaggctggtcttgaactcctgacctcgtgatccacccgcctgggcctcccaaagtgctgggattacaggcgtgagtcaccgctcccggcctcaattcttaacctagctatcaactgcagtgttaaagaaaaacgcctcagtcctaaggcacttggtcaagaaaacgctgcactactacaaaatgatcaaagcagcattaaactgtggactgttcggtaagtgcggagctctagagacgatgaaggggagagcatctctgctcagaagaagctttcatgggcagcgactgaaagaatgaggcccagaggaatttctaggaaatttccaagaaaggaaattcaaacccgagaattcccaagaggtgtctcccacacccctgttatctgactctgccatggccaccctcccccgtcacaggtctctgcgtgccatgcacctagagtccacttcatggcgactctccaacacctattttctccaggagctgcttcggaccccgtttgttttttgttttgttttgtttttctgacagcgacagcccttgggcaacgctaatcattccaagcaaattctgtcatgccaagacctcccttaacagcacgcgcccacttgttcccaactctcctgccaattgggcttcgggagcctccaaaaccaaggctcggagatgtggagcacacaggggaagggtcgagctgggacccacacccggctcttacacccacaccgcctgttgagcccaaggctcaacttcaacacaaagctctccttccctcaattccttcaacgaaggttaaccttcagcgaacacctaccggaccgggacagagtgtacgagccgcgcgggaaggtggcacaaaggcatggcccagaggggtggcagaagactcaaccggggccctccactccccagcctgccctgcctgggcagagccggctggccggcccgagtcctggggctcgcggaggaacggagatggcctccgcaggggctcggggaagcccccagggcgccggaccgtctcaggcgcgcatcccgcgccactcacctgtgggatccatagcgtcgctcgcctcagagatggaagccgccattccgccacggcgccgaaagtcgtcatcaagctgcgcgcagagccacgccccgcggccgggcgggaaaagcgcttccacctctttgggccgttacctcaaaaggcgcgtgcgcaaagcgaaggccggccgggcggggaagagaaatggcgaggcaggagtgcgggggagggagtggtccttag

SEQ ID NO: 388 - DNA, 30366 bp, Homo sapiens; identical to SEQ ID NO: 387

SEQ ID NO: 389 - DNA, 30366 bp, Homo sapiens; identical to SEQ ID NO: 387

SEQ ID NO: 390 - DNA, 30366 bp, Homo sapiens; identical to SEQ ID NO: 387

SEQ ID NO: 391 - DNA, 30366 bp, Homo sapiens; identical to SEQ ID NO: 387

SEQ ID NO: 392 - DNA, 31359 bp, Homo sapiens
ccaggtgccagaagactcagaagcaaggacatgtttattcagatccatggtcgttacaagcttcatttttggtcacaggccctaaaatgccattatgctcagtttacatcaaaatacaaagcccaacatttacaatttcaaaaacattaaagcaaacccccaaaaccccacaccgaaaacaaaggcttggtttggaaatcaccactgagatgctgttctccctcgcatgtcgcctgtggggtgaatgaaggtgaagaccccgtgctggtttctgtcagagaatctgtagttgtatattttgaatacttaagtaccactgaacggttgccatgtctttgagcacttgatgttactgaagtgacaatgcttctgaccatctttggctgcagagcagaaactggcagaatccgaccccatcgacccagcagtgtccccaacgcctgaggaccagcacccatctgtgacaaggcacaggggtccgcgatgttggccactgctttgggtgatgtgctcaatggcttggggtctgcggtgaagcccctgggctctgggagggtcttaggctcctgaaacatggaattctacggcccagtcttggaacagctgggagaacatgaagaacgcccctcacagtgaagaatcaggacagccactctctggttttctcacaactctagaaactttgattctttcctggagtggagacttaagccactgtcctggtcccacacagagagaggaagcgccacaacccactctgccaacctcaaggccagccagtggggaggccaggcccaggtggctgttggcaggctggctcccaagcttggtgcagcagagtagccaaatgggcagtggaaaaaaggccccgagagctggcttggccgtgagtccttggcggagggagggaaaggccgccgctgagctctgcgctgtcacagagcgtagctgttgagccctggcagctactcctttgctggggcccacctgccttcctttcttggttgcgtttcctccagatgcctctgcggctgcaggaaccccgctccagaagcccgaggatgaccgtgttccctcctggaggggcttcccaggtcctctcagcccaagggtggggctgtgtggcaaatccctccagcctgctctgaaggcagctgacaccttcagggctggtgcagcttcccccgctcggtcagcagtgtcatggcagaggcgtagaggacatagcccagggtgagcagcagcgtgcatgggaggggcccgacgcagaacagagaggccacgaagaaggccagcagcagcgagaccagcgtccggtaactgcccaggaagcgcaggctgagcctggggccgcgggtgtggccggccacctgcctccgccccacagggctcagcaggtgcctgctggccagcccaggttctgtgaggtggtagcgacagaagctgccgaggaagtcatcccgggaacacagagccgccatctgtcctgcaaactgaagcacagacagaggcacggggatgtggggtggtggcaccacaggcctcaggacagcagtaccccaccctcacaggccaccccaggactgcaccccaggcaggagcatctagaaccctctctgaagacgccaggccagccctcctgcccactcactctgtggttgatggcagacgacagcctaaagagtgtgcggaccaagctggcgatctcatagctccggatgggctgcagctccgggtccccctggtactcaatttcaaaccttcgcagcccattgatgatctagaaagccaggccatggggatgggtcagaaaacacagccccacacacaactcagaggagcctgatggcctctgctcacaagggaggagggagctggggacgggtcagggcccagcctgtgcgcctctgagacacgggcctctcacctggtaccgccccaggggcgtaaggatgagtccgtcctcacccacgatgcagtcggggagttgcttttttccattctcatcctgggtggtgcccaaggcgagtgtgaactgcctgagctgcgcttcgctgagctgccagagagaaatgccactgccctcagcatcaagatgaagagaggggaccagtcttcaccccaccagcctacaacagtggcaacaaggggacccagctatgacgctcggggtgtgggcctgcctcccacaacactgggtccatatgtgtggggcctgggactggtaggtggctgaccacaggctgggtggagtggatccttcagggaaggggaccctgatggcggtggggcaggccccatagctcgtacccggaatatctggcgcaggtactccagggccttctccaggtattcatctgtcttccggacactgtcttgccccatctcgtccaggtcgttggctgtgtaggagccattggtgtccatggagctaaagcccagccatgagaggaaggagtggccagccgggctctccgcacactggtcggagatggacttggctgtgtgtttggcctgtgtgatgagctgagcgaggcgcaggacctgcaagggaggcgcgggcaggtcaccagcaggacaggcctgtgctgccacccaggcagccccaagagcaatgcacagccagactgctgagcgtcaggaggagtggcttctgccagaagacttttaaagactaaaggatgatcttctacatttgaaatttcccaagaaacactgccttcgttatcaggaaaaaattagactttactaaaacgggggaaggagatatggcgtcaaatctatacccagcctccctccttcctgctggatcacagcacttcccgggttctgctcagccccatggctccaggggccctgaggacaggcaccgccgaaccactcaccagggtgcgggcctcgggcccaaacatcggggtgtacttgcagtcctggccctccaggctgtagacgtggctcttcaccttgaaggaggcatcagtgaccgctggtggccagggtgacaggaagctcccagtgaatgtgggggccgtgaagagtcggtgctggcggtgggggatgaccagctctggctccaggaatagctgctcacctagaaggcaggagacgaacctggcacccacttcccggaggcagagtacccgactgctgcccttaggattctggggtgtctctgaggtgtctggggagccatgacccaggggtgtcctcctgaggccctgcctggcagcatctcccacacagtaggtggctgacatggggagggcggatgggggagctgctggctcacagagcccctagcagtgtctgcaggaggtaaacaacaggaggatcgacagaaaccaacgcccaacccagccaggatgaatgcaaggcagagaccaggctcacctcctgaagcggccaacacgagttgccagggagaaacagcggggtcacggggccgcagcttggaccgtgccggcccgctctgtgggcacacctgcgatcccccacccagtgcctggtggctgcagggcaggcaggatccagccggtttcagacctcaccacacagacgtgtcccaggagtctccacagcaccctttgccggggcccactctgggcgtgtgggtccctcttaaagaccagccacccccagctaagggcctggccctggtctggctgggttgacgtataccgggctggcccaggctgaggacttacctttctgaatcatctcagccaggttgggctgggcaaagactttggccactcggaacaccatgagcgcgtgcttggggctgaccaggtctgtgcggagcgcgcggttcagaaagcccacaaacaacttggtgtacatcagcaggttctcctggacaaagggtgccctggggaccgaggtggcaggttggggccagccttccaactggaagcatgcccctaatgcccggtccgtgcccctaatgcccttgctcacccttgggctttcagactctccttagccaaggtgacaagctgtcacagatgacagctcagggggccacgggcaggcagggaggacaggacagaggcaggtaagacccaggccctctgaggatgccacatccttagcaaggctgaggcccctttccaagtggatggaggccaccatggcagaggccagcccagagcctgagggggctcagggaggatcccccagagggtccaaaggggaatgccttgggcaaggaggggagggatcagtggccatgccaggtgccacggaagcctgggggtccgctgtgaggatcaagcaggggatgaggggaagacagcctccctcatcccctgcttgatcaccgctgctctgttctgtgctgatgaaggtcaagggatagtttgggggtggctaaacactcatctgggacagaagggagaggggacagggcaggatgggtcacccacagcttccataagaaaccaattctagggcctggcaaagttgagcctaggaaaaggctggtctgtgttccgctcggcaggggctgggagaggacttcaggaggccacgggggccagggccaggctgaccccagcacaggccgctggcttggcctccacccactggaacaatatccacctgggggagccagtggcatgtctgtgagaggagctgaggctcaccatttctccgacacacaccggggctgggagtcgctgcccggagcctgcttgtcaggcgcgtaccgccacggctgcaggtagctcagccacatctccaggacctgtgggggaggtgtgtgctaagggctccgtggctgggggccaaatactcggtggcctggagcccagataccaggcggcagctgggtgggactgactcttctcacttcctccagagggcgcaggagagacatgcacagccctgtgaggtttggctcttgctggccctccagaagccagggtgggcttttcccagcccagggggcagagtactccctggtcaggtaagggtaggaacctgccctgcaccagacaggtgggacagggcagggctttcctgagggctggctttggaaactcaaacagaaagaacaatgtggccctccaagaccccctccttgccaaggcctctgtgataacacttgctctcctcctttatctgccccaaaggacctcccacctcaaggcacacagaggacacaggcacacgtgtgacggggccaacactcacagctctgaacgatgcgtccaggggccagtggccaaagcaatgctgcaagaagaggtagagtttctgctggacgaacctcgggacagcagccctgcaggggatggggagggtcacctgctgcttgcccagtaaggaggccctgctcacagatgaccccagggctcccatcagtgagggttggctccgccgggggagagcactgggcacctccgggaggttcagccccattcttcagaggaagaaatcaaggttcagagaggttagggaacatcccaaggacacacagcacgcaggcggccgagtcagcacaactcctgcacacacctcaccctccgtcccatacaaacagcccactctgctggccctggtgggcctggcagtcagggccaccccaactcttctgacagggttgaagaatatgagatgcaagagatggcagcacaatggggcctctctggccagtctggagagagaggctctgggagccaactgggcggggtgagaggacacctgcctaggcctggagaggcctcacgtgctctgtgaacagaaagggactcccctcaccctgccctccatgccctggggagaggtcgctgtgggcgacaccttaggaggggaaagtgggggagacggcagtggtgggaagccgcaagggccacccaccgtttgaactcctccagggggctggtggcgtgggagtgggcggagggtgaggcctgctctggcttcaggctgttggcaaaggcgtgcaggtgcttcagcagcaggcgcaccaccaacacatgctcctcagtaggcgtgaacgactcctgggtggagaaggaggggtgagggcctgggaaggagcgtggcacccatagcactccgcctccaggtctgaccacatcccgccctgagccagttgctctgctgcccccacgggaggcatgagccaggccaggagtggggccaccccatggggcaccactgtgcctggcacccagatgtgccttgcactgcttggtctgaactgtgaccagcttgtggtatggaagtgcttggcccagcgcccacacagccctggggaggcctcactaagacagacacatctgcagagggcctcccagccctgcttctgcacggctgcaaatccgcagcgggtggcacaggctgtgcccttgggcgctggtgcctgtcttgatccccagggcaggagaaagccagcatcacccacaagctctggatccagggtctcccacctgcctcccaagtgtgtgcagaaagcacatggaacccaggtgtggtgcctcagacctgtaattccagcactttgggaggccaaggtggaaagatcgctaagaagaagttcgagattagcctagacaacatagggacaccctgtctctacaaaaaatttttaaaagttagctgggtgtggtggtgcacacctatagtcctaatgactcaggaggctagggtgggaggatcacttcagcccaggagtttgaggctgcagtgagctaggatcgtgccactgcactccagcgtgggtgagagtaagacctggttcaaaaataagaaccccatggcttcactttcctccccaattcctcccacctgctcctcatcctggacacagccagatgagaactcggcccagtagaagccccgggcgtcacttcctctgttgcccagggacctgtggtcaggaaaaccccaagacaaaagcacagtcaagcatattaggccaaactttttttttttttcttgagacaacgtctccctctgtcgcccaggctggagcacagtggcgcaatctcggctcactgcaacctccgcctccaggttcaagcaattctcctgactcagcctcctgagtagctgggacgacaagtgtgtgccaccatgcccagctaatttttatttttcatagagatggggtttcaccatgttggcctgacctcaggtctcccaaagagagggaatacaggcgtgagccactgtgtccagcctaggccaaacttttgatttgtaacatacaagcaggatcctggagatctagccggagaggaaagcctttttggtggccatgggcttcctctggttgtttagcattgggagggcaggtgggcgcatcgagagtagacgagggcagggaagtaggggtgctgagggcaggaccctgagtctgagtggacatgctcgcctctccacacttgtcccctagccctttgggccgtaacacatctgtgctgctgaggctggtgcagggcccagcctccaggtatatcctggtatgctgtagaccccgcacgggccactgcccatatcgctacccactcaagtctccccgtcaggaaactgtccccacaggtccaagtgacacaccccagagataagtggctgagtctgaagatggagctatggggtgggaggcattttcttttttttgagacagggtctcactctgtcacccgcgctgtagtgtcgtggtctcggctcactgcagcctctgcctccagggcttaagggatcctcccatctcagcctcccgggtagctgggaacacaggcgcacacaccaccacaccaggctaatttttgtatttgtagagacaggggtttcgccatgttgcccaggctggtctcaaactcctgagctcaggcaatccgcctgcctcaacctcccaaagtgctgggattacaagcatgagccatcgtggctggctatttttctctatctgtattgttaagtctttgggcaatgaatttgcattgttttggaagaaagggccaggtgcggtggctcacgcctataatcccaacactttgggaggccaaggcaggcagatcacttgaggtcaggagtttgagaccagcctggccaatatggtgaaactacatctctactaaaaatacaaaaattagccgggtgggtggcacatgcctgtaatcccagctactcaagaggctgaggcagaagaatcacttcaatctgggaggtggagattgcagtgagccgagaccatgtcaatgcattccagcctgggcaacggagtgagactccatctcaaaaaaaaaaaaaaaaagacagaaggagaaaagtatgagacataatacctgtacctatactgcccaactagaagggcaccagtggggtgggaagttagaccagggtctttctcctcctccagtctcagcccaggccctccctccaatcctggcctgggatcctgagccgtaacatccttcctgcagctaaggggaggggaagacctccacatgtgaactggaaaactgctttcccctgctggtgcacttgacccacctcacctggtccttccgaagggtctggagggcccactgtccgcccctgccgccggcagtcacatggaaccctctcaggctattttcccataggtttgctgagccaaacttctccctcagctctgcacccctcctgggccatgttcccacatggagtccctggccacagtcacctgcttgcttcttaaggatgtgtccccaaagccgcacatttcccactgggctgagactcacagcacctcagctcaccccacctgggtctcgctggtcaccctcccaccatggggtttgccagatgctttctggaccactgtcctccctccctggcgcaagccctcaggtccctcctctcctctgcagtggctcctgcggaatgaggtgcccctgtgtgctgtggccaccatcccagcccaccagcgctaaggagccaacacattttctcatcttatgctcaaattcctgttcaatcatgtgtgctctttcccaggtgaatgggacagatcactggctgtgagcacagcccgtctcccccggctctcacagattcctctgtcatccctgaagtcccctacaggtctgaactctgcttcactgacctcaaatccatccacacacttgtcatttctgcctaggcagctgcaacctctatgaggtcaccacccactctaatctgcctctggaggtgtgtatgagcggccagggctccccaggtgaaggccgggtcctggctgggctgtcaaggactgacagcttctgtgggctatagggtcaagccccaggtccttcccaccccctgcctcacacgcaagctctgggtcacagcacctccaggctgggtgacagttctgaacaaggcagaacccacaccacccgtaagtcccaggcctctgcgtcttcagctccttcctaagcgccagaccctgcagagtgcagtgaacccagccactgctgaggcctgaggactccagctcttcaaaccagggccaagcacgaggcctccaacactggagagcttgtgacacctccactggcctggagcctggacagccagggccacatgcccacatgcctcgttctgccacaaagccaccacccccacccccaaccaaactagtctacaaagccaggggccaagccaggctggaggctgacccctgcctccccccgacacaggggcttcgttctgcttggaactagcctctgagtcaccagcggccggccccggcggccccttgctttgccaggcatggacatgcactctgggcaggaggaagggaacgaatgagccagtacttggtaggcgtggagggcctggaggctgggttgggcggggctgtagagggcgctggagacactgagtcggtagtgcagaacctccagctgagataagaaacagagagatgccggaagaggccgaagagcagaggacaagagaatggggtggggaaggggagagataggaccagacacgggagggggaagcggagagagaaagaaagcaatgagaacgagcccaggagtgaggagaaaaaaacaaaaacaaagcacggtcagtgacaatccaaacaattgcagtcccagcagccgcgggccagcgcagcacccccctccacaaccaggccagggctgtggccacactctcctcgctttgaaggcccgggcagaggggcctccaggtcacctgggtggcccctcagtattgctggggcctaaaggcctctctagctccttggaagggcccaactcactgcccttcaagacgggacccactctccccagtgactgaggtcacactatgtgtggcaaatgcaaaccagagccctccaagagcccagggccctcactgggacatgctgccagccaccaagacctcaagatcctgaggctcagaaaagaaaccagcggagcatgttccaggaggagcactctgcccagaaaacacatgtggaattgactggatttccctgggttgtcttaagaaatttaccaaattggtataagacatgattgattcctatgtgtctaaaactcaaatcaatgtcccctccatgactggctctctgagaactgagggcgaggacaggtccccaagggtagcacagagacgaggagcacaggctcaggccaccaggccctgccctccaccctcatagtctggacgtcagctaaggtggtgtgcacatcagctctgactcctggaggcagcctctcctaccgcaccagaaactcccaccctccagatacagtgggttcccaagggcgggagcccctgaggatctggccacagccacacacacccagaggcagcaggaacctgaggctgagctggctcctagccaggaccctccgacctgctgccctgcagcaccacggcctgccgaagcaccccttcagcccagtgcagccacagccggcctggtgcacatcctgccccgccagcagcatgcctcctgcccaagcagcacacccactgggctccacacaggagaaatcagaacacacgccagtcgccatgacacgcagagcagggagtgaaggagcagggcagggaggtgttgccctccacagccttcctctgtgccagacctggggctcagggaggaatcagacacatagttccccagtgtggctctgcccttgcttgcaggaacacagtggcctacagcgccatggccatccttactgcccacagggccactggggagcaagcatgcatcctggactcaagcagggtgaggaggatgaccccaggagcctcacttcctgcatctgaaaataagggctagtggggacgggcagggatttctgcatggcagtacgtgtagcacaggcctggacaagcggcaagaagccttgggagacacagacctccacagctgcctttctctgactcccacccaccaagttttcttgcgttttgtgttttgcctgaactggaagaggcgaagagtggagcatctctgggtacttggtccggccactgcaaggtattctgagcagggtccacccaccccaaggtctggccaagaggaagcaaatgtggggaagaagggaactgcacctcctgccctccacagggacagccccctgcccttcctctggcccgtgaggacacagaatcctcacaggtgacagcctcaaagagcctttctggctgactcttgaaagtaggtgtgcttccactccctcagaaggcagaaggagcaacaggaacacaatgcggtgcagtggcctctgcccctgccaggccacgccacgccacgccacatgcacgagtgctgagtgtcccagagccccacgggaggagcaggctcagggaataaccaggcccccaggcaccggccaggaacatgcagcaagtctgctctggaagcaggaagggcactgcaggctctttgtgactcaagaggcccaagatggggtcctcagcttttccccattctccgcccatgtgattctgagggtgaggatttgggggaccctatgctctgagagagcctccacatggcaaagcatggggccatggaactggctgcagactgtggcagaagcagacccacagctctttgccagaaccagaggaaaagtgacaggatgctcttctgaagtttaactccatcacccacattctggaggaagccctcaataattctgtcagtgacaaagccaaagtttcccaagcatactgatgcacagacgccatgggcaccagactacgtggctgatgccacttcaggcaagggcacggatgggcatgagtcaagctgctccatggagatgactgactggagatctaaggttcacctagctgctttctcactctgaccggtccaggggtggtgctagctccaggaacggcaacagcaggaatgacccagggcctccgccacctccatgcatctgaaagcagcgtgctgcccagagagagagagcagggacaggcgaggcggagggagaggaggcaagccaggctgcatgcaggggggcaccaggtgccactcgccacgagaagggctgcttgctcatgctctggagaaggtgggggagtagggtgagcaggcaaaggaggctccaggccaccccttcatgggaaagcacaaaggcactgctgatggtcgaggagacagacaagaaagtgactccctgaggcatcgcagctcccccactcccagagcaagagcaccacaacctcatctgttcctgctgccagggagggggctcaggaagctgcacagggagggccccggagaggccagacttccaggcctcaagtttctacacatcagggtgcaatgccccctgcccgccaccggaaactagagaacgatgcccacttcttatttggcttctgagtgacaggtgggtggtgggtttctgcttcccaccatccagcctgtgaaaactcactcagaggcaggataagaagcagcaggctgagcagggtcagaagcaggaggtgggaagaaaaactgaaaacataccttggcatgaggggactgcattttttgatacatctccaaggaatagtgatgaagccacatttcaacaaaaacctgcaaaaaagcattagctagtcaaaccattcttgacaatggtgtcagaccatccagtggggaaaggacagtgtctccaacaagcagagctgggaacacagaatacccatgtgcagaacagtgaagctgggcccttccttcacaccatcaccaaaaaataactcaaaatgggtaagcgacctgaggataagcactaaaaccatacactcttagaagaaaacatgggagaaaacttcataacactagatttggcaatgattaattagatatgatgcccaaagcacaggcaacaaaaggaaaaaaaatagacaactagacttcatcaaaatcaacactcttgagcatgaaaaaatactatagatagagtaaaaaggcaaccaacaggcatggtggctcaaccctgtcatcccagcactttgggaggccgaggtgggtgggattacctgaggccaggagttccagaccagcctggccaacataatgaaaatctgtctctacaaaaaatacaaaaattagctgggtgtggtgaggcatcacacctataatcccagcgacttgggagtctgaggtgggaggattgcttgtgcccaggagtttgagactgcagtgagccaagactgcaccactgcactctagcctggcaacaaagacagactctgatttaaaaaaaaaaaaaaaaaaaaaaaaaaaaagggctgggcacagtggctcacacctgtaatcccaacactttgggaggccaaggcaggtggatcacctgaggtcaggagttcgagaccagcctgacccaacatggagaaacagtgtctctactaaaaatacaaaattagccgggcgtggtggcgcatgcctgtaattccagctcagctactcaggaggctgaggcaggagaatcgcttgaacccaacaggcagaggttgtggtaagccaaaatcgtgccactccactccaacctgggcaacaagaacaaaactcggtctcaaaaaaaaaacaaaaaaaaaacccagcaactcaagtgtctactgagagatgaatgaataaacacaatgtggtacatccacacaatggaacactattcagccctaaaaagcaaggaaattctgacacatgctgtaacatggattaatctttagtccattatgctaagtgaagcatgctactcacacacaaataagtactatgtgctacgcatactctgggtatgagatctaggagtcaactccatagaaacagagagcagaatagtggttgccaggtgctgggtggggaattgtttaatggtttgatttccttgtttttcattagaagagatggggtctcactatgctggccaggctggtcttgaactcccggccttgagcaatcctttcctgctgggcctcccaacgcactaagattagaggtgtgaggcccctgcgcccgggctggttcagtttcagttttgcaagatgaaaagcattctggagattgcatgcacaacaacatgactgtattcaacactactgactgtacacttggaaatagttaagacaataagtttcatgttatatatatcttataattaaatttttttcttagttaaaaaaacaaaaagggccgggcacggtggctcacgcctgtaatcccaacactttgggaggccaaagcaaatggatcacttgatgtcaggagttcgagacatggtgaaaccccatctctactaaaaatgcaaaaattagctgagcatggcagtgggcacctgtaatcctagctactcggggggctgaggcgggagaatcacctgaacctgagaggtgaaggttgcacagagccaagattgagccactgcactccagcctggacaacagagggagactccatctcaaaaaaaaaaaaaaaaaaaaaaaaaatgctttggcccagggaacagcagaaccttccagttcttccctataagcgctgtgtcatgatcttctgccctcttcatggccagcacagcctacggtccacacagccaagagccatctgggcatcatggtcccctctgtgaacaggggcaacggttcttaccattccaccctgcgaggatgctgtgaaatggtatggaggcttcaaaaagtgcagcaccccaaatactaggagttacatataagatgggagatagaatcctatcttatctacatgccaggctgtaaagcaaggctgtggctaccaagtcagccccaggatccagcgtcagaagcagcacctgctgaatctctctgtgtgcctagaagacacagccaggacctgggagttggccagcactcaggaagtgagccagcccataccatcctgacaggctggagcccctctgggcagacaaggaaatctgtcacctactacttggatcccctgaatcaatggaaggcctgtggaggctgcacagacccctcaccattcagtgtcatggaaaccaaaagactctgcaacaattatatcaccacaggcaaaacgaaacaacttccatggacaggggatcctgggatgaaaaacgccatcaatgacattcaagttaaaagggtgggcagatttactttcatgttttctaaatgtcacagcaggaaaatatcaacaatttagaatcagccccgggctgaggggccgcctctgggactctgccccacatagtggaaggtggcaacagtttcttttctttttctttttttttttttgagatggagtctagttctgtcacccaggctggagtgcaatggcacgatctcagcttactgcagcctccacctcctgggttcaagcgattctcccgcctcagcctcccgagtagctgggattacaggcgcctgccaccacgcccaactaatttttgtgtttttagtagagacgtggtttcaccatgctggccaggttggtcccaaactcctgacctcaggtcatctgcccacctaggcctcgcaaagtgctggggattataggcacgagccaccatgcccagctggctgaacagtttcttttgaccagctcaactctcacctggagcagagtttctgacctccagatctcgtgggaggcggggtctgcattcacagacgtctgatgagagatgtgtcgctttaggaggctagtgtggtggaggccataggaagcaaagggtatggctggtgtcctgagggagacacagaaacaggcccgagttacaggctcccgctgtaactcgctcccgctgtaacaggggcaatctggatatcaaaatcaacgagagcagggacagattacaacttgttcaatagcacaatgcacacctccccccagccccctgatccacactgatatacctgaataaataaatagcaaagagagaagtcttccttaccacagagtgaccattgacccacaaatcaatgaaggagggatgaagttagagaaccaccatttagtaaccgccctattaatagctgatttggtcaagaatcaacagtgaggttgggcatgggggttcacacctgtgagcatgggggctcacaccagcaccttgggagaccaaggcaggaggatttcttgaggccaggcatttgagatcagcctgggcaacaaaatgagaacctatctccacaaaaacattgaaacataaaacagctgggcctggtggcatgtgcctgtagtcctagctacttagaaggctgaggagggagaatggcctgggcccacgagttgaggctatagtgacaaatgatcgtaccaacttcactccaccctggggtgacagagcaagaccctgtttctaaaaaattaagaaattcccagcctgggcaacatggcaaaaccctgtctccacaaaaaaatacaaaaattagccaggtgtggtgatgcctccctgtagtcccagatacttggggggttgagacaggaggatcacttgagcccaggaggttgaggttgctgtgagcagagatcgtaccactgcactccagcctggggtaagagaacaagaccctgtctgcaaataaaatcaatttgaaaaaataggagaatcaaaagtggatgttaatactactgataattacatagtctccatacatcttcccggtaaattctcgttatcaatttttttttgagacaggatcgtaccctatcgcctaggctggagtgcaatgatgcaatcacagctcactgcaacctcaacctcctagacttaggcctcccaagtagctgggaccaacaccaccacgcctggctgatgtttttctttttagtagaaacaaggtcatgctatgttgcccaggcactattaatttttttttttttttttttggttgagatacggtctcactctgtagcccaggctggagtacaggggcatgatcttggctcactgctacctccgcctcctgggtgcaagcaatcctcccacctcagcctctcaagtagctgggattacaggcgcacaccaccacacctggttatttttaaatttttggtagagatgggattttgctatgttgcctgagctggtctcacactcctgagctccagtgatccgcccacctcagcctctcaaagtcctggaattacaggcatgagccaccatgcccagcctcattactatttaacctgggcacaaagtaattattttacaatggaaaaacctgaccggcacctttttaacccagtgataaaagggcacctggcaaggaccaggtgtcccactacggtgctcctcccaacaaagcccatgctgggcctagtcaccagcaaataccacacagcctaaggggcggccgcatgctctggaggggtcaaggtcaggaaagacagaaaggcaagggaccattcctgactgaaggggactagaaatatcactatatacagtgggtgagcctgtgaaacatcactgcacacagtgtgaggcctggtggcaatactaacttcctggtgtggttacaggcactgtgactatataggataatgcattcgcttctaggaaatacactgaaatattaagaggtcaagggatgccatatcctgtagcttactcatattggcttagagaaaaaaaaacacatacaatagaggtggaaaccaacacatgcagcaaagtattaacagtttggaaatctgggtgaagatctatgaaagtttcttttttttttttttccctgagacaggatcttgttctgttaccccaggctaaagtgcagtggcacgctcacagctcattgctcctgggcacaagtgatcctcccacctcagcctcctgagtagctgggaccatagttgcacatcaccatacttggctaattttttttttgtagaaatgaggtctcccgacgttgcccacactggtctcgaattcctggcctcaagtgatcctcccgccttggcctcccaaagtgttgggattacaggcgtgagccactgtgctcagcctgcaagttatttttattatgcgtggaaacttatctgtaaatctgaagttatttcaaaataaaaagttaggtgtggtgacttgcaactgtaattccagctacttgggaagctgaggcgggaagattgctgaggccaggagttcaagaccagcctgggcaacacagcgaggcatccccatatctccgcaaaaaaaaaaaaaaaagttaaattagctggctgtagtgatgcatgcctatagtcactgatgtgacaggctggcttgagtgatgattgtgccaccaagtgatgattatgacactgcactccagcctgtgtgacagagtaagaccgtctttaaaaatacataatggctaggccaggagcggcggctcacacctgtaatcccagcactttagggggtcgaggcaggcagatcacttgtggtaaggagttcaagatcagtctgctcaacatggtgaaaccctgtctctactaaagatacaaaaattagctgggtgtggtgacaggcacctgtagtcccagctacttgggactgagccaggagaatcacttgaagcagagacagcgccactgcactccagcctgggcaacagagtaagaccctgtcaaaaaaaaaaaaaaaagcacacaatggaccagtgtagtggttcatgcctgtaatctctgaactttgggaggctaaggcaggaggatcgctcgagcccaggagttctagagcagcctgggcaacatagcaagacccatcttacaaaaaaataaaataaaagctaggtgtgggggtgcatgcttatagtactagctacttgggaggttgaagtgggaggatcacttgagctcaggaggtcaatgttgcagtgagttgtgatcacaacactgcactccaggctgagcaacccagccaggccctgtctcaaaaaaaaaaaaatgctgggtgcagtagctcacacctgtaatcccagcactttgtctgaggccaaggtggacggattgcctgaggtcaggagtttgaggccagcctggccaacatggtgaaaccccgttactactaaaaatacaaaaattagtcgggcatgctgacctgtgcctgtaatcccagctacttgcgaggctgaggtgggagaatcacttgaacccaggagatggaggttgcagtgagccaagatcatgccactgcaccactccagcatgggcgacagagtgagactccatctccaaacacaaaataaaataaaataaaataaaataaataaataaacccaaaccatatatatataatttcttttcttttttttttttgtgtgtgtgtacagtggtgcaatctcagctcaccacaacctccgcctcccgggttcaagcaattctcccgcctcaacctcctgagtagctgggattacaggtgtgcaccaccatgcccagctaatttttgtatttttagtagacaaggtttcaccatgttggctaggctggtctcgaattcctgacctcaggcgatccctccaccttggcctcccaaagtgctgggattacaggcatcagtcaccactcccagcctacgtatataatttctaatagaaaaaattaaaacaacccaaaaagttaaaacaagcaaaaaaaccaggcatcaaaaactgcttggcagctgaattctgcatctaagagggtgtgaatctgcctcacctccgagtcctccacaggatcagcaacatttcagggtcactgatcactgccgctacctgggcagcgtctcctccttgccactccctttctcccctccaccctctggggaatctgtccacacgtgaattgtaggtaaaggcctggcctgccttacacatgccagcagatctggggtgggccagcatctgcaggaaggggcctgcatgcagcttcctggggaaggcgatgggccagtgagattaaagagggtcagaggtgcacaggcagctgctgctggggcaagagggtctcctgggaagtcggcctgcgttagtgcccactgaggacccaggacagccaggcatgagagcccctggttcacactcccaacctgtgcaggcacgcatcaggctcagcctgtttggactgacaaaacaggctctttggcccagggcctccccttcaagatctgctcctggggcccatagagattcctattttttttgctcataggacaacctttccaccctgctcactgactcagacaccgcctgtggggacggctgctccatgcacaacacagcccattcccatgcaggccgtggaggcctccagggacctgatagcttcagtgatggccaaagacactgaacactaaggacagattgcccgccataccccaccctccagtctgtgctaagacagctggggatggggaatgaggcataagaaaaattggggaaccgtggacaaagggtggcaacattgtccccgtgggcgatgcaagtgaccaggccactcccttatggaagggccaggtcttaacaaagggcagccttacctgggaggtggtgaggggctggtcccccctgggctggaggagagtggtgggggcacactgccttcggtgggcaggaaccatgacaggtacctgtccaccaggatgaaataggcacagtctgaagtacggacgtggagggacacaggaagtggctggaaaaccaagctagttgttagcatgggctctggacactgccaggccaccaagcaccaacaagtgcagggaagccctgggccgtggccccacctctcccagcaaaaggcatcccttccttaccttctgagtgatgaggctcaaggcaaagaagaatatgtaatactcgaacggatctgagagcagcgtcaggggcaaacatgcagggttgatgagccaccccccgctcagtgtcaagtgctgggccacccacagcctccctacctcagggccaccaaaggatactcagggccaagttcagaccaaggcccccagtaggggtgaactggaccttgttgtggtacagaggactgtcagggaggatgcactcctggatggacgccttcacaggaccctgcagagagaggcagtgaggcttgtgggcaggtgctggtgcgtagtgcccgatacgcagtaccccacatgcacagcagcactttgggaaggctgctggggaagagacccacacacagaacccacctgtggggacagtgccctgcctctgagcagtgcctgaacaagagtctttgcttagaacttctcctaccatcatctcataaagagctgcagacagcaagggtagcagtcatgcaatacccatttcctttgcctctcacacccctggaacgaatcgctcctcaatttgccctcagaggactggaggagattgcccatcaccacagggctgtgcaaggcccactgccccgagcaccactctcgccactgtggtttacttacaggcaagtaggagacaggaaagtcgaacttatagtcttcagcttgaagcttataaaccaacttcatcattgggccactgaacacgaaattgaacaaacaaacaaaaacagggcaaatgaactgcgaattatcttgctttgattgtttcttaatcttgagaaattcagagagtgctttaaaggtggaatcaccatgaggaatcacccagcctctctccggtgaccaacctacctacccagggtcgagaaattccatcacgatgctgtactccacaggattcacgcgcccctgtaagcagcggaggttccagccaacgaggacaccatctaggctgccaaaaatgctttctaccagccatgggaagatggtgtgcagctcctgaaacaatgtgtggtgaagccgcgtgcaggaccagcacccactcctgccccggctctagtcctgcaccacctgctgcccagctccctctgaggaagccactccctggctaagacctatgggatcagccctgcacccaaaggaagcctggtgccatggtgccaacgacaagagcagctttacgttcttccagtggggtacatggcataccaagcagtgttgctttagacttgggccagttaagtaagtcagcctccgatcaaaatacattttttgtgtgtgatagaagattaaattaagaaaaataaataaatttaaaaaaaaacaaacaatgaaaataaaaaaatataaaataaaaaaataaacaaaatacatatttattgagacaaggtctcactctgttgccctggctggagtgcagtggcgcaattatggctcactgcagcctcgacttcctgggctcgagcaatccccccacctcagcttcctgagtaaatgggactataggcacacaccactacactcagctaatttttaaatttcttgtagagataggttctcagtatgttgcctaggctggttttgagctcctgggcttaagtgatcctcccacctcggcctcccaaagtgttgagattacaggcatgagccaccacaaaaaaaagattctttaaacagtgatggaaacttctgacttgaaggatgctctatcagaaaggaaagcaacatcctttccagagtgaagcccctgaaacctaactgacctattgccatttggtattaactccttgtctaggccagcttcctgggcttgacaattccaggtgtgatttaaatacatatttttagtatttacatcagggtttctcaatcttggtgctgttgacattttgggctagatacttctttgtcgcagggagctgtcctgtgctttgcagaatgtttccagcaaccctggcctctacttcttagaagctagtagcacacactccccatctacctccagatgtgacaaccaaaaatgtctctgacattgccaagtgtccctgaggaacagagcatctgtggctgagaacccctgatctacaagttcacatgtttaaatgtgtccgtaaacataatggtcatggtaatggccaggcctctgtgccaggcagtgctcggggttggggcggggagggaaattaggaattataataaagttcttcaacgaatgtataagacatgctccaaagagagacgttagcagagctatacctttgctggaaagtcctcaatgactttaaccaagtcttggcactgctgtgcaaagggcttatttatagagtcagctttcaggctagcctagaagacagaacaaagcgaaaaagtcacgaggacattcactctgcagcttttagtggcactctggcttgagtcaaacagaaatccaagcaataggttatgagtcagacccataacctctggcctggttccccagcccctcatgtgtgtcagtggcccaaagagtactactaggagaggccgtagttctatgctctctggaccaggaactatcagccttgtttcccagtaccccctcagagtgctgcacatgatcagaacaggattgacttccaccaatccataagtaggggttggtcccagagtcagccccacagccagaagaggatcttgactgtgtaagggcacccctcacaaaccacagagtataactgagtttgtacgcatcaactggaaatttccagcctgatggaccaccgtgattacaccattgtgatcatcagtaagaacgcccaacaacatcacggctatggcagaagctctcttaaatgagctgtcctttattcggtagacactgaaccactaaaccaatgatcttaaaacacagggcagacaaaaattatagatggcttcagccaagtagacactaatcatgaaggcaatggagaggccagaaaagactcaggacaaggactaatgaaatctacctagtcgtgggatgtgaggaaagcaccctgactacaaggagaaaaagggcatctgtgcgaatggattaagatcaggagaaacggctagaatttcaacctagagagctttgccaaaggatatctaaggccttgtctacctccaaacaagggtggatttcacagtgattgagacagagatggagacctgagctatctggccatgggccagacctgttgactctagtggggtgcactgaggaagaatgtccttccacataaatgtttacaaaaacacctcctaagaactaaaattaggaactttcatcaccaatacttgcctcatatctaacttctcacttctcagtatcatttttttttcctttttgagtctttactatgttgcccaggctggtctcaaactcttgggctcaagtaatcctcctgcctcagtctcctcagtagctggaactccaggcatgagccactgcacccagttctcagcatcatgtttaatacttaaagtgcaacctagcaggcccccgcacaacagtgtctccatttttcactgatgacagttatgactgattattagaatacttcatatctatttaagaatttacaagtcatgaacattctgatatacatccttctcacttgctcttcctcctcctcacacccttgggaagtagagaaaatagaatttgaatgaacttgtgtgagaaaacccagagcccagaagttgagtaaccccaaggtcctgtagtaataaggaggcacagtcaagttaaggagtctgccattgtttccatcacatgcccctaaaaaacaaccactacagagttcttcaagtcaatgggaagaacactcaagtcccacatctacagaactatggccacactgacactcatgcaagcagttgatatttaccagtagaaagctgggctgctgcaggtgagggaacgccatagcagcctccagtggagagttgaaaatggccttcttagcaaaccactgtggaaaaacaaagacaaaatctcaacatctgtaacacagcagaatctttttatattatttttttagagacagggtcttgttctgttgcccaggctggcatgcagcagcacgatcatagctcactgcaacctcaaactcctgggttcaagcaatcctcccacgtcagtctcctgagtacaggcacgtgccactatgcctggctaattttcttcttttttgagacagggtctcgctatgttgcccaggctagtttgtcaggctgtgatgcccaggatcctggcctccactgatcctcctgccttggcctcctaagtgttggggttacaggtgtgagccactgcacctggccctaacaaaatattacatagtttcacaatgcccaggagaatatcacacattacattaccaattcgcaacacacattacattgccaattctcatgtcttacttattgattagagacaggctcttgcttgctcactcaggctgcagtacagtggtgcgatcatagctcattgcaacctcaaactcctgagctcaagtgatcctcctgcgtcagcctcccaactagcgggaactacaggcaaacatcaacaagcccagctaatttttgtactttttgtaaagatgggggtttcatcatgttgcttagactgctcttgaactcccagactcaagcgaactatccgcctcagcctcccaaagtgctgggattacaggtgtgagccaacacgcctggccagcaattcccatcttttatagaaatgctgttctcagccgggcatggtggctcccacctgtaatcctagtactttgggaggctgaggcaggaggatcacctgaggtcaggagttcaagaccagcctggctaacatggtgaaaacccgtctctaccaaaatacaaaaattagccgggcatgatggtgggtgcctataatcccagctactcaggaggctgagacccgagaatcacttgaacccaggagaggtggttgcagtgagctgagtcacaccactgcactccagcctagaaggctgagcaagactccatctcaaaaaaaaaaaaaagaaaaaaagaaatactgttctcctgcagcccatagtggccagcttcagagccaagtttgtagtactgaatcctcggtaatgcttgtacagcatttgttatataccaggactcgctctaaatgctctctatatatctcctcatttaatcctcagtggtaggcagaattctaaagatagcagcccaagattcccgacccctgtttgttcaatcaaatactcatctaggtactgctatgacggcattttgcacatccaattagagtcctaagttagtggaccttaagttacagagtagtccccagctgacagccagcaaggaaacaaagaccttagttctacaactccaaggaactggattctgccagcaacctaaataaacctggaagcagcttcttccctagagtctccagataagagcaaagctaccaacaccttgattttaatcttgtaatgcctggacttctgcatacataactatgagataataaatggatgccggtttaagctgctaagtttgtcatacaagaatagaaaaaccaacctcacaacaacccgatgggtacagatgtactatgactgcaggtcagtacagatgatgaaggagaggcagaaatgggataattcacttacccccacccagctagtaagtggcagaaccaagattccaatacaaacaccacctcacaaaactgagacaggggcaaatcccctccatattacctgtgcactatgcaatgaacggaggggaagagcaagctctgccaagggagcctttgaataagccatgagaaaactaggatcaaaggccgggcaccatggctcacacctgtaatcccagcactttgggaggccgcggtgggcagatcacttgaggccaggagtttgagaccagtctggccaacgtggcaaaaccccatctctactaaaaatataaaaattagctgggtgtggtggcgggcacctgtagtcccagcaactcgggaggctgaggcatgagaaatgcttgagcccaggaggcggaggttgcagtgagccaagatcacaccattgcactctagccggggtgatagagggaaactctcaaaaaatggaaaaaaaaaaagaaaaaaaaagaaagaaaactaagatcagctttccagaatcctacctctcagctcacccaggtcagaaatgaaaaatgctcagacctagacttcacagacaggaagtctgccaagtcccactggtgggctagttacagttttcatggcccagctctgcccactgcacaagtaaaggcactggggtgacacctggcagtctgtggaggaagagaggctgggtgtaaagaggccatgtaggcagctgtagagtgagaggagacaggaatctctgcctctcggcaataggaacatctcccaagttttttcaattctttttttttttttttttttgagacagagtctcgctctgttgcccaggctagagtcctgtggcgctatcttggctcactgcaagctccgcttgggttcacgccattctcctgcctcagcctcccgagtagctgggaccacaggcactggccaccacacccggctaatttttttgtatttttagtagagacggggtttcactgtattagccaggatggtctcgatctcctgacctcgtgatccgcctgcctcggcctcccaaagtgatgggcttacaggcatgacccaccgcgcccagcctcttttttctttttttgactgagtctcactccatcatctcactgcaacctccacctccaaagttcaaacggttctcgtgcctcagcctcccgagtagctgggattacaggggcctgccaccacaggctgcctaatttttctatttttagtagaggcgggtttccctatgctggccaggctggtctcaaattcctggcctcaagtgatccgctgcctcagcctcccaaagtgccgactttttcaattcttttttgagatggagtctcgctccgttgccaagctggagtccaatggcatgatctcggctcactgcaacttccgactccctggttcaagcaattctcctgcctcagcctcccgagtagctggaattacaggcacatgccaccacatccagttaatttttgtatttttagtagagatggggtttcactatgttggccagactggtctcaaactcctgacctcgtgatcagccctcctcggcctcccaaagtgcagagattacagacgtgagtcaccatgcccggccgctttttcttttttctcctttttttttttttgagatggtctcgctctgtcgcccagagtggagtgcagtggcgcgatctgggctcactgcaagctccgcctcccgggttcacgccattctcctgcctcagcctccctagtagctgggattacaggcgcccgccaccacgcccggctaattgttttttgtatttttagtagacagggtttcacgtgttagccaggatggtctcgatctcctgacctcgtgatccgcccgcctcagcctcccaaagtgctaggattacaagcgtgagccactgcgcccggccagctttctctttttcttttttcagacggagtctcgctctgggctctgtcgcacaggctggagtgcagtggcgcgatctcagctcactgcaacctccgcctcgcgggtgcaagcaattctcttactcagcctcccaagtggctgggattacaggcgcccgctaccacgcccggctaatttttgtattttttactagagacgaggtttcaccatcttggccaggctggtcttgaactcctgacctcgtgatccacccgcctgggcctcccaaagtgctgggattacaggcgtgagtcaccgctcccggcctcaattcttaacctagctatcaactgcagtgttaaagaaaaacgcctcagtcctaaggcacttggtcaagaaaacgctgcactactacaaaatgatcaaagcagcattaaactgtggactgttcggtaagtgcggagctctagagacgatgaaggggagagcatctctgctcagaagaagctttcatgggcagcgactgaaagaatgaggcccagaggaatttctaggaaatttccaagaaaggaaattcaaacccgagaattcccaagaggtgtctcccacacccctgttatctgactctgccatggccaccctcccccgtcacaggtctctgcgtgccatgcacctagagtccacttcatggcgactctccaacacctattttctccaggagctgcttcggaccccgtttgttttttgttttgttttgtttttctgacagcgacagcccttgggcaacgctaatcattccaagcaaattctgtcatgccaagacctcccttaacagcacgcgcccacttgttcccaactctcctgccaattgggcttcgggagcctccaaaaccaaggctcggagatgtggagcacacaggggaagggtcgagctgggacccacacccggctcttacacccacaccgcctgttgagcccaaggctcaacttcaacacaaagctctccttccctcaattccttcaacgaaggttaaccttcagcgaacacctaccggaccgggacagagtgtacgagccgcgcgggaaggtggcacaaaggcatggcccagaggggtggcagaagactcaaccggggccctccactccccagcctgccctgcctgggcagagccggctggccggcccgagtcctggggctcgcggaggaacggagatggcctccgcaggggctcggggaagcccccagggcgccggaccgtctcaggcgcgcatcccgcgccactcacctgtgggatccatagcgtcgctcgcctcagagatggaagccgccattccgccacggcgccgaaagtcgtcatcaagctgcgcgcagagccacgccccgcggccgggcgggaaaagcgcttccacctctttgggccgttacctcaaaaggcgcgtgcgcaaagcgaaggccggccgggcggggaagagaaatggcgaggcaggagtgcgggggagggagtggtccttagctgaatgcgcctgcgttgtggcggcctccggcgccccaaggtactttctccccagcaaggaatccgcgtgcgcgtaagcagtattgttgattagtgccccccccttccccccgcccgccccgaaaagcgacccctagtggtgcaccggtgcggaccagaaaattgcacgctttcttgaaagaggcatttaccgagcgcccaatgtatgcctggcactgggctgggtgctgccacctaagcgagcacgaccaatgcagtctatcagggaggcccagatcgccaagcagcggacccctgcggtccgccatgccactcccggctcctagagcgccgctcagcacaccgtgagcgcccaataactgttgggcttcaatgacgccgcggaggcggccccgtccccgcgctcccgcccctcccgccagggcagcccgggaggccagacgttgacgctgcagggagagggtggtgggcgcagccgctagggggcgcggcggggcggagcgcacctttccgcgggccgcggggatggcggcgcagggcgtagggcctgggccggggtcggcggcgcccccggggctggaggcggcccggcagaagctggcgctgcggcggaagaaggtgctgagcaccgaggagatggagctgtacgagctggcgcaggcggcgggcggcgctatcgaccccgacgtgttcaagtgagcggggcgggtgggggccgcatgctagccagacaccccccgacctctgctttccgggtacgcccggcccgctggtcgggaggagcccccgcccccgtccttgtcgggtcttcagggaggtggccgcgccgggcggagagggctcaccggccccgcgtctgtccccgccaggatcctggtggacctgctgaagctgaacgtggcccccctcgccgtcttccagatgctcaagtccatgtgtgccgggcagaggctagcgagcgagccccaggaccctgcggccgtgtctctgccc

SEQ ID NO: 393 - DNA, 209321 bp, Homo sapiens
ttagttctaaaatttttactatatttatttatttaacagctttactgagatataatttatgtactataaagttggttgacacatttaaaaattgtaataaaacataaaacttaacattttaaccactttaaaacatacaattcagtggcagtaattgcatttatgatgttgtataaccatgaccactatctagttccagaactttctcctcaccccaaatggaagccccatacatatggctgacacattttaaaagattaattttattttgtcccccaaatctggggggacaaaagtaacaaagaaaaatgagctcacaattaaataagcaaaaccttctgtaaaggtaaaaaaatttgccgggcacagtggctcacacctgtaatcccagtgctttgggaagctgaagtgggtggatcacttgaggtcaggagtttgagaccagcctggccaacatggtgaaaccctatctctacgaaaaatacaaaacatagccaggcgtggtggtgtatgcctgtaatccagctacttgggaggctgaggcaggagaatagcttgaacctgggagttagaggctgcagtgagccgagatcacaccactgcactccagcctgggtgacagagcgagactccatctcaaaaaaaaaaaaaaaaaaaattggaaagaaataacattatttctaacaacaatatatcaatcttttcacattcttatatagaatcagagaatctaatgaaatacattctattatggataaaccaaaatctcaagtacttgttttacaaaaaattaagtcttcaaaactcttttgaagtccactgggtgcagaacatcccccactgtgcctgaaaaccaaggaactagaactggagacagctgttgggaggacagcagcgataacagataggtgccctgtagcgatggcctccaacggctacctacacccagccctgggattcggaggatgcagaaggaacatctgggctcagctatttcatgctgtcggccatacacttccaagtgggaggtgatggcagtttggtcagctgtttgccaacccaggagttgggtaaaggttggtaagagatgttattagttttagcaccatttccttccaatagtctcattttaatacaatacaggttagtagtgaccagaaaatattgctactgaattgaaggatgactatacaaggacttatatcagattatttgttgcttttagtttctagtgtcccataaagtatagaaatggaaattgctgacaagagagtacctttggtaggcacagttccttttctccccccactggagaggacgctacaaccttgctatagagtgtcctgtgactgcccagtgatgtagattatgctcctaccccaggaggggcagcttgagaacagaaaagcaacagctggaagacatttatattacctctgtattcagctcattggactagcatctttcatggtgtgagactttctcatttactcatttgtccatttattcatttgttttaaaaaatgaggccaggcatggtgactcatgcctgtaatcccagcacttttggagcccaagctgggataattgctggagcccaggagtttaagaccagctgggcaacatagggaaccttgtcttttcaaaaaataaaattagctgggtgtggcggtatatgcctgtagttccagctatttgggtgcctgaggtgggagaatcacttgagcccaggagtttgaggctacggtgagttgtgattgtaccactgtactccaacctggtgacagagtgagatcgtctcataaagatataaaaaattaaaaataaaataaaaattaaaaaatgagtgccttcaggcagtgttccaagcattggtgaacacaatggtggggctaatgcagaaaagagtatcatttttgcacacatttctctgggtttgacactctctggagctaatatggactgttccacattagtaagacattagtgggattgagaaagggctgcaggtgtcaaactgcatcctctttgccagaccccagaacctcaaaacaagcagtaaaacagagaataagaggactgtgggtgtgccctcctctgctttaccaaggcccagtatcccagacactggccacttgctttttcatatcctttcctgaggtttcttctcactgctagtaaatagcagtgcaagtcttaatatattatgaaataaagctacaatcacaatgactaactccatgcaatataggaaaagcctcgctgaacagatgccacagagccaagcatctcccacccagccctcttagtgtctaccatgaacatcctcacagagcaactccaccgcctattacggggaggcctctagcttcagccctaggggcaaaagtaaggcagggctcagcagcgttccagaaatcaggggtgctcaggtagagaagcaaagtggccttcccagggataggactactgaggtcaaaaggaaaggcaggaaaagccacagaagaattggaagtggcaggaagtctagacagagtgagcaatggctggggggaaataaattacgataaaaacacatttctttattttaaaagccacagtcatggtgcaggcattttgctgttgacctgaacaacaaaatgggccttatgctctgtgatgagataagtgagtaaggggtgaaccaagaggggtggttcacttggagtgcctgaacatgatccttcaccgacagggagaagccttggccaacagaaccattaatcactgtctgctcccttcatttgcgtaagaaatgtgattcactccaataaaactggctattggcagaggggaatcgaacgtctgacttgtgagtctaaaagagccagctgttccagcctccaggattcagtgagaacttcctatttcaagttaagttcccagctgtcccaaggcttaggaaagggggataaacccagccacccccacctctagacacatgctccagccaacagcaggagtgttgcagattttatcagcttcttaaatgcattaggggttgaaattagacacctcggtgtggtttaagagcaagagaagggccaagtgaacccaggttgggataacaaatgagacaagagtcgtgagaaaaggcctgaggtccaacttccaattgaaaggttttctagcctccctgaaatcctacatccaagggccccacaccccagtggccttgggatcacagcgggggtcctgtgcagggaagtacacggggactgagtgtttatggtagaactgtaggcgggacaggagctttgtgacgatgtgaggatattctctggacaggtcatgtctttcttcagggtcccgatcaatatcaaagagccagagggtcttggttggtgggtctgatgagggtatctcagaaacattgtattgagacggtggagggaaccagtaaccacagcctagcaaagaaaacaaaacagtttactgagggagaagcacagaggcaggttctaatttcagggaaggagtctgaggccaaggctgcactgggttgtgggtgtggaaacataaaaagatgcggccctagatgctgtctctagatgcttctcagacttgacttctggtgctttaactagacatgtctcactgcttcacaagcaaggacacccagaaacgtgtgtgcatgtgtgtatgtccttgtcacaaggactagggcataggggtgctcctggcatttagtgggcatgagctagtgatgctaaagtcttgcaatacatgggacaatcccagtcaaaaaagacttgtcatattgcaaacgccaaaaatgttctcattgtaaacattgattaattacatcacagccttaaccatcatcccacatattttaaaagtattgaaaagatatcactcttagagaatataatcagaggagcaacctccttccccagctataccactggttgagggtgtagctctcagagactctctttgttagctaaatgtgctgtgcttgatagccacatatatttaaaatccgtattttccatgaagcataagagtgacatttcttcctttcacccctgctacagttaattctctctgtctttctctctctctctctttttttttttttttttttttttttggttaggacgagtaggttaaaccatttcttcctatctcctcattcagcagccccagagatatgttttgcaaaaggcatttgttacttcggtaagcttctccttgatgatccactgggaaagcttacttgcaccatgacaatgatggaagctgtgtaattgggaacaggcggagtcttagaattgggaaaagaaaaccctgaataaatagttgtctttctaggacatatatcaggagggatcatgaaagattagaaagacaaattaagatttcaggtatctgagcaaagtgaggtaagtggtagggcttaggggccttgaggaggagccacagaggaagaggtgggaaacggttagaacaagagtgataatgtcctctctttccagagaaatggccgtgggaatcaaatcccaggagggcagatagactggagatactgccctgaggacacagccctgctttgtctaccacgggaagggaagtttgctaagctaaggactctacctgggtagcccgtgaggagtttccaatttccatgtctaattgcagcatggacagatgtgttaaaggctgaatattctggaagagaagagtcatcctttgctggagccatgctgttcctgggacctgggaagaaatagtttgaaagaattagatcactgttattggaacgtgttgttataaatcagcattttatacccttgcagaacagtagcttttattcaacactggagtgcaaatgtgtatcttgccacagaaatgaatcttttattaaatccaaacagaaagctatagttacatgaaatgtcagtcataaaccaccgcaaatataaaggaaatcccaaagagattacaacactaattcatccttaaaatcgctatgttctgccaatgtacagctagccatatgcagaacagtgttctgttacagcagagtgacttttttttggtttttgtttttggctgttaaacatttaaacacactttctgtgtatacttatacctatgtaaatagtataagaaattataaaatgtacattttcatgcagtcatttcaagctatgagagttcatgcatgccatgatagagtacaaagacttattttttaacaactcttaaggaatctaaaagtgagcagtgctcagttaactattcagacaggataactatgggggtaagaacaaatttggtatacaaatttttggctggtatcatggattatattaatttatcatttttgagatcttaattgatcatcaggttggttttttgcttttgtggggagcaattactaatctctaccacctcttaagtttgaaaccaattaagaggtagaagatagacagatggaacaaaaaatactgcttttgttactgacaaaattgactggagagaatacagcttcagatctgtagcagagagatcttgtttgtaactgacccttgacttagaaagatttaatcctcaccattgatcttgctgaacacccagtgggctcccttagagcacacagccaagagcagaccagagtgcttacatatatccaggtgacaggctggctggaaattggacagcaaaaagggtctcggttgaacatgctcagttcctccttttgaataactccttcctttgcctgattatgaaaggagtgaacaaggcaagagttctactcttgtggaagaccctggtgggtccacaagggccctcacctcactcctacttatgcctatggttgaggcctagctgaataacatatagtctgttttaagcccacatttatctgttagcttttcaaatatggtcacagcaatcatcttgggatcacttcgaaaggttgctgaaccaccagcctaataattaattgtcataatatgtgatatgtctgtaaaagtatagactccattggagtggttaacccatctgtctgccttccttcgataatagactttgagagagcccttatcctcacccaagcaggacttctgtgctcctggggttttcatgcagggtgtgtcggtggtggaaaaggcgggacatgccattcttttgacagtcttttggaaatgaccttgtagagacaagctggagacagatccggcaaacactggtgctttcagaacttcagtctcaacaatcacacagcagcaaatctttagcaccaaagaggaaaatatttttgacttcttgtttctctgcttgcggatattttggctccaatacaaatggatacttctagtacttgaggtgcatgagcatgtctatcacaggaaatggttgctaacatacagactgtggtaaaactgtgaaccctcatggtttactcctcacaagtttgtatgaaggccacattttgataccaaagaatgttaaataaaacaagcatgttttgtgaacacaaacaaaaaaaggaaatttaactatctcatctatacttatatttatacacatttttttcttaagacaaacaggaacataaaatacctaaacaataaataagcctaagactaaactatgaaagatactattatcttgactttattgttttcattttgagaaattaaacaaagggaaaattacaaagaataatatgactaacaccctatgagccatcacccaaaatgaacagatgttaacattttaccatgtttgcctttttttaaaaaaaataaaagaaactggacaataaaaatgaagttgaagtctcctttgttcttatcctcaaaccctgtcctttcatttactcctctagaggctgctgctattgtgacttcagtgcatccttcagccattttaaaatgcagaatacatatgtgccaagggataatatatagcactgttttatgctttaaaaatgtatgtgtgtactgttggtgggagtgtaaattagtaaaggtattatggaagacagtatggaggttcctcaaaaaattaaaaatagaactaccatacagtgcagtaatcccaccactaggtatttatccaaacgaaaggaaatcggtatactaaagggttacctgcacctccatgtttattgcaacactatttataatagtcaagatatggaatcaacctaagtgtccatcaatagatgaatggataaagaaaatgtgatatatagacacaatggaatactattcatccacaaaaaagagtttgttggtaaagccatctaggcctagagttttctttgtgggaaggtttgaaattattgatttaatttcctgagcaggtataggaccatttagatcttctatttctccctttgtcagttttgataacttgtattttattaggaatttgtgtagtacatgtgaacttttgttttgtattatcttttaaatgtttgtagcatctgtagtaatattgcctgtttattcctgatattggcaattcatgcttttcattttttcccaagatacgttttgctagtgtttaattgattttattagtctttttttttttttttttttagatggagtcttgctctgtcacccaggctggagtgcagtggtgcgatcttggctcactgcaacctctgcctctggagttcaagcaattctcctgcctcagcctcctgagtagctgggattacaggtgcatgccaccatgcccagctaattttttgtatttttagtagagacagagtttcaccatgttggccaggctggtctggaactcctgacctcatgatccgcccgccttggcctcccaaagtgctgggattacaggcgtgagtcaccgcacctggcctgattttattggtcttttcaaacaacaaacttttggccttgtagatcctatctgtagtatgtttgttttctatttcattaacttcttttatctttattatttccctccttttattttctttgggcttaatttgttattttttttataaccttttgaataacagatattcaacattttcatttctaatacggactatgaattatccaagcaccaatgtaaaaaacatgtagtctgaagttgttgggctcaatgctctgtatatcatttaggtcaagtttgttaactatggtgttcaaatcttttatatctttatggacatttttgtttgtttgcttgttctatcagttactgagagaggtatgttaaaaatctcttctatgactggataattattttgaaaactccctctttaattctaatagtgctttcctcctttaaatctactttatctgatgtatagatagctcagtttttagctgtcattgttgctgctgttagtacctgcataatatattttttccatccatctgtcaacatgtgtgagactcttatgcaatagaaagaagtataaaacagggtatgataggcaggataatggttcctcaaaatgtcaacatcctaatctcccagaacctatgaatacatcaccttccatgccataagggactctgcaggtatgattataggtaagacctgtaagatgtgaggattatctcagatttatctggatgggcccgatctaatgacatgagttcataaatgcaaggagtacttcttgattatggtcagagggagatgtggctgcagaagaagggtcagagaggtggcaacttttccttctaatcaatagggagacataagaggaatttaaatatattttttaaagagtatatcatatagttcacatatgatcaaattcacccatttttagtgtaaaattctatggtttttagtatgatatattcacaaagttgtataaccatcactgtaacatattttagaacatttttatcaccccagaaagaaaccctgcaccattggcagttaatccccatttactcccacaccctccagccctaggcaacccttaacccactttgtgctctggatttacctattctggacattttatataaataggatcagacaatatgtggcctttcgtgtctggcttctttcacttggcataatgttctcaaggttcattcattttgtagcacgtatcagtacttcattctttttaaataatgaataatattcctttcattcctgtatattgccaaaaatataccacattttctttattcatcaattaatggacacttctttgtttatactttttggcgactacgagtaatgtaccattaacattcatgtacaatttcagtgtggatgtacatcttcacctctcttgggtatatatctagaagcagaattgctgagttatatggtaagtctatgtttaacctttcgagtaactgcagagcattaaaaaatggctgaaatgtgttctgtattacattctcaattttattctttttagagacaggatctcactccatcacccaggctggagtgcgatcttagctttagctcactgcatccttaaactcctaggctcaagcgatcctctcaccttagcctccagaatagcggggactacaggcacatgccatcatgcccagctgattttttatagagatgggggtcttgcaatgttacccaggcttgtcttctggcctcaagcaatcctctcactccagccttccaaagtgctgggattacaggcatgagccaccatacccacccaatttcatccttttgtatatagatatctcagttgtctccagaaccatttgtctgagagagtatttttttcctctttaattgtcttggtatccttgtcaaaacccaattgaccataagcatgagggtttatttctggactctcgatgccattccattgatctatagttattaaaaaatcgataaccatctatctatctatctatctatctatctatctatctatctatctatatagatacaggtttcactatgttggccaggctggtctctagctcctggcctcaagcgatccagcctcccaaagtgctgggattacaggtgtgagccacacacatagctgatctatgtctattcttatgccagtaccacactaccaggacttgtcaagcttagtagtaaccttagaaatcagcaagcctgagtcctcccacttttattttttcccaagattgctttggccgcactgggtgttttcactattaacttgacagtgtattggataaactgtcaggacccaagacaggaggcagaggtttcttagaatgttaacaaacttttaaaatttcgttgacagagttggactagatgccaatttaagaaatatttgttgattaacaactgtatgtggtaatacagcactgtgttctggaattccatgacatgaagtgatgagcaaagagacatctaagagaagttcccaaggtgaaagccaagatatttggtgacaaaagaatataaaagataaataaaatccaaggttttgagtttggtgattgagagaatactgttgatattggcagaatagagatgttcagacgggaaatagtggggagtaaaggattctggaatgagacatactgattttaggaattaacttgagctcaaggtagacggctccacaacatattggagctataggactggcctctgtctgacagactgaggcacacactaagcaccacccgcaatgcagtgattgcttaaccctagaagtggattcgctgcctagggagggaagcaagaaagcagacgcccagaaacagagcactgagggccaaaggaaaacagcaaacggagtagagaggaaaataatatgaggaagtgaaccagttaaacaggacattacagaagccaagagagcagagggtttcagatggcgaatcagaagagccaaatattccatctattagcttgatgaatgagcagaagctagggagttaagagagaagtataaacaaacaaatttttctcgtttccttctgagctgaaagccacctctgagataataaagctttctggccagacagaaatattcagctataagatggattagccgtgtgtattgattttggatgggaaaaaggagatcagcagaaaattttaggactgatgaaatatgttacataatacgtagtaaacttacagcactccttatctgagcaacccctagaaattgggagttgtttgttaccagaatgaggtggcctggtggtggtttcagtggagaactgtgttctccagacccaaagtaggttctggaagtaactcagaagttgtcttgaaataggatggtgagttagtgggtcggggtccaggttcaccatctccatttcaacagagttcaactccttaaggaagaatctataatatctgctaaatatgttgtacttctctacatttttttaatttatttttttattttttgagataaggtcttacactgttgctcaggctaaaatacagtggtgagatcacagcttactagcttactgcagccttgaacttcttggctcaaatgatcctcctacctcagcctcctgagtggttaggaccacaggcatgtgctaccatacctagctaattttaaaaaaattagaaaaaaaatttttaaagaggccactatgatttttgtaattgtttccctacgttacctggctggtctgaaactcctggcctcaagccatcctcccaccttggcttcccaaagtgctgaggtattataagtgtgagccaccacacctggcctacatttttgtttgaagaaagggtctatggctaatatatatagtttgaaatacactaattagtgattccaatgggttcaccaaaaagggaagggactgaggggagggctggagatacttctgatcttcatgaaaggcaatcctactctcttgactgcacaaggcatcctcttgaccttggaaagtattgtataatacagtctatgattgtacttttaggaaacacagtatttttcataacaatgcaatttatatgtttgttgtatatatgttggaaaacacagaaaaacatgaaaaggaaaataaaaatgacctgttaatttattagttgctgttaacattttcgtatatagcctttgagacttttaactacataatgtttaaacaaaataaatatgtgagctgacctgcaaataagaagaggaaagtccatggaagacaggaagttttcatgctcagagagaagagcatgggtagagatcagcaagaaattagtagagaatctaataatccatccaaagtatgaaagcaaccaagaaccagtttggcttctgaagagggaaatgatgtacaaaagcaatatcccagaaagacagttcttaacgatgcatgtacagcagactggagtgatatggtattgagtctacaaagtcatcacaaaggccaccatcatatcctggagggcaggctgcagctgacaaaagggtgaaaaagagtgaattcaagaaggactcaatttgtactataaagcatttggggtggaagccatagagagaactaataataataaaatagtaatagcagctaatatttagcaaacataatacagatgaggcattgttttaagcacttggtgtctaatttaatcctcgtgaaagtcccatggatgaataaactgaggcacagaaaggttaaaggcacatagcaccatttgggtcaatatgaggaatatgtttccaccagacagagcttccccaagacagaaagaatgagtttccttgggaggatgattttctggcattagaggtgtgcaagcaagggcttggcagggtggtgagggaagcgtggcacaaacagcgctgtagggtgaacgggagggtctagaggcatttcctctccgaaatgctgctcaagtacaatgagctggacatgattggagaatggggcttaggaagacctactgttgtgaccctgaaggaaagcagtgctagggatggtaatgaggatggaggaaagggctgtatcattgaagtggcatcctaccagcccttctccaggaggccatagtacacagtagcatagaacatgcacttttggagccagactgcttgggtttgaatctcagctccatcactcactggctgtgtgatcttggtgttagctggcctccctaggcctcagtttcagtattgttgtgaggtctaaatgcaacgatacattaaaaatgtctagtactaagtacagcatatagaaagtgcgcagttattaccacccgtgcaatctcaggcaactttttaaacttcccatgcctcagattactatctataaaattaacataacagtagcaagtgagataagacatatatagtgcttagtagaatatctgttatattgttaagacaattgccaacattaaagataataatatctaatacttaaatactacatgcttataaacataaaacactgctttaagtgttctatgtataactcatttaatccttgctctatgaaacagatattaacatctgtcaataactatcactgaatggtagctattatcatcagtataatatagtttcattttcttttacaacctcttctacccaagaccttacaaagaggaggaaaggaggcaaaaatcactattatatcagaaaaacaaaataaaaccaaacaaaaaaacaaccaaagtcacttctctggtgtggatttagaaagggtctatatttgttcccccatttatgttccagaatttaaagagggttggggtaaaaaggatttatgtgtagaagctgtaatttaccacttttagtctgtagccccttttctgtccggtttgtttggcctgccattcatttctactgagttctatttgttttttatcatttcacaatttatgaagatcagcaaaatttcattcttcgccaataacccatctgactttccctgccagtgtgatgccaccttcacttaatgatgtatgcatatttacttacagtaaaacttactcacttgggctaagtgagaaaaacaccccagctgtcccagaaatttggttcttgaggagttttctaaactggaaattctgtcgagtatgtttttaatgtacaggcaagatttaggtttaattagcaactatcttcaacttttgtacttaaaagttcctaaaagtagcttgtttatttattatgtaaatcaaatgtgtctcttaaagcttatttacgctaaagttcagtttatactaaacatctgattggctgaccacttctttatggctcactctaacaaaagttcaaaggatctcaaactgaaagtgaggttcaagtcattaaggtccttcatgtgccagctagtcagagacccagagcccgtgagtccccctcccagatcagcgcacccaggccgcatctgagcgactgcgctggtgcacatgtggctcaaatctccagtctgctcatggttttgaatgtcccaacaactgcaggctttggccaaggccaccctctcatctcgctgtgtggtaagggcttacatatccagacgtgcatgtatgcactgttgtctagatttttgtttttaaaaataatcgtggacctaaaaatagtttcttcctaaaattaattccctaaaatacactgactagaagccccacactctgaactgatgctttagtgaacctctttgcttaatttttgaagatgaaaaaagcccctaacagctgggaagtggggctgtgcacagctgttttggatggcgcagtggtatgccgtatgccaggcgtgtccaatcttctggcttccttgagccacactggaagaagaagaattgtcttgggccacacataaaatacactaacactaatgacagctgatgagctaaaaaaaaaaagaaattgcaagaaaactcataatgttttaagaaagcttatgaattttcagaaagtttacaggcatggtggctcacgcctgtaatcccagcactttgggaggctgaggcgggcagatcacttgaggccaggagttcgagaccagccgggccactgtggtaaaaccccatctctactaaaaatacaaaaattagccaggtgtgacggtgcatgcctgtaatcccagctactcaggaggctgaggcatgagaagcacttgaacccaggaggtggaggttgcagcgagccgagatcgcatcactgtactccagcctggacgacagagtgagaatctgtcgcaaaaaaaaaaaaaaaaagttacgcattcaaggccatcctgggccacgtgcagcccgtgggccatgggtttgaataagcttgccctatgccatcactctagttctgaaaagtaactcagagaaatcaatcactggcatttcaatagcctttagaacaagctctttttcttatcttataaagtcatttaaccactctgagttcctgtttccttgtatgcaaaaatgagaaccaaaatactacctaaatagaatgagtgtgaagaggaaataagattctacacgtagtgagcattctgtgcaccataagtgcacggattctgggtacaggtctcttgaatttccacggtggtcgccataagcccaggcaaataggtaaaaccaactgaccaactgaaagaaatcatttcaatatatgttgaacctatggcctctgactgacagctgtcaagtcaaggtgtgaccaactgctcaaccctcttatgactgtgagatctgaaccagctgcaaagggaacgaggtattgttagaaaattatgtggggaatatgtggtaacattttccccacataacctgtagtggtatgccacactacaggtctggccagaattgtaaaaacagagtgcaatagaacagagattcccaattctggttctgccttggggtcactggagcctacagtccctttcatacctgtctttggttcccttagtctagcccagctgagccctggcctaacataggctgcctgaaattaccatcttcagcagcatctgttgcacttatgatggtctttgcacagctattgccctaggacagtcccacacaggacttcctgcctcaccaggtagcccatgtcatggatggtcagctggagcaatttgaaagatctcaaatgtgcctcctatagtatccatcctattattttcatgctgcctgcagtgggcacctaggagacattcaactcccactccttagaagacaacgctctttttcccacctccacacttaccttacacatagtggggacagggaggagcaggaagtttctactctaattggcatttttatttaaaatagattttatagctaaatcaaatgtttatgagcatggatgtacgcagttggtcagtgaatttcagaatggaagaaacaaaaagatgtcttcccaactgctcgggaatcagagtctggaaagcaagagtaaggagacagcagagagctgagaagtgtcttgatcctgtggccatggtccccccaaactaaattgatttacttcgtcaacaaatacttcttgaactagtcctagttgctgggcacacagccaggtggaggaaggcaaggagacaagcagtgatgatcaattttgatgggtgttgtggctagggatgggggctctaggaaggcaaggtggggaccttgattagtctagggaaaggagaagatctccctgaagaagtgatgtctcagatgaaactggaaggctgaattggcattagaaagatttcaatttttattattttttttttgaggcgatgaggcaagtatgcgtgtgctgggggcagcatgggaggaaagtggaaaaggagaatagtgatctgggcagaggcacaaagcaacgtagtacattctgtagagcccgtacatttaggccccagaaattctcaagttatatggtttctgctgcaaccttaacttgagcataaacatttctttaggcatttccaaatatctaaccacactgctggaatcaatctcatcctgtaggagtctgcttctcaggcttactataagctgggtataggtgctgtagtggattctaaatttgcttgctattgattttatgaactgatttctcattcctgggcttgcggctctgttaaaaaacaaaacaaaacccaccagggttcttggctcaaaagggcaattctaattcatatatcattttggaaaaaaaaacacacagaatgaattcaatagtcttcaagtgcacaaacatgaaataaaataaaaacatccagtgtttattgaggccagtgaactaacactgagtagtaagaggggagggtgtgtcctagtgtagaagcaagagtaaatgtgacctgtcctgaaataggagcctaaagaatctaacacaaggcaaagaagacaggaccgataagggaggcaaaaagaaaacagaaaacaaagaagagaggtggggttggggagaaaggcaaagggagaggtgataggaaggaggaggagggagaggaggaagaatgttttatcaggcaggatattcggggagtatttacaagccaattttttctttttaccctgtctgtctcactgcttgtccaacttttccaaaattaggtgaggccactggggtgagagggatagagtgaagctcagagtaactaaggctcaagcatcatttaacgcctgactgtcataggcacttactaaacatgtgctgttctgttttccagttgtccaggctgcctcttcacttttaccagagctaattaatagcagtattagcagcaagattgagatccctggctttggagccagactaaatgggccagctctcctacttcataactctgtaaccatgggcattttacttagcctctgttttctagctgataaaatcagtaagtgcctcagagatttttttgggagaattaaatgagatagtacattgaaagcccataatagggtccctggcagagagtaagctctcaataaatgttagctattattgttatcatcatcatatagtagttattgaaattacacagttaaggcagtggttttcaaacttttaaggacaaaatcttcctcccaaacaaactctatgcagctgcccagcagaggtggccaatgtccaccttggttcatctttgggagtctccagaggtccctccagctccatggaccctagggggatgctggtggcctagggcactctgctggatgcccccatgtgggtgcaggtacatgtggggagtgagggggcctgggagccacaccagctttggggaggagggggctggcttgtgggtctagattatagacctttcacaggcactgtgcctttcacaggcactgccacccctcggggcctgtgcagctctgccagcgtgtaccaaagaagagtaaaatagggaggcctgaccaccattaaatacttccctcatttctgaacttgaacctggttgctgcaagttttctgttagaccctcactacttacttagaatcctgtctgtccttggagaaattcttacaacacgaaacaggagtgttgggaaaaatatgccagacatgaagctaatcagaaaaaggtgaggaggaatattgcagatgttatttattacctacaggggacaaattaaaatgctcataatttttatatatgcactccacatgacgtatttcaaatgaatcttaagtttatgattttcagtttacaaagtcaatttctctgacacctactcactcagttcatatctgatattttaaaagtcctagtgaaaaaagagctttgatgtggcttactcagcctagacagagttcaaatgttaatcattattgcattgtgcatagtaagtattcagagaatgtgctggtgttacagggaacttcaacaattggttaaggtctgacatcagccagcagtgttgattgagcagtgtaaaccaaaaatgacagaaaacaaccattcaatgaatcctcaactcatgaccgttgtagtaaattaagccacctatacctgaaataggttgacaagagctcttctcatgctttggtttaaatttgagtcttgaaaaaataacttatttcatattattcatttacttactaaacaaatacctatgttgttgatcactatatgtgttagacactaaatcttcagaatgaataagctggagttcagcaggtaataataaaataattttgtttaaccaccataaattctaaaatagtggaataaacatttgttgcctgaataaataaaacgcacaaagtgctaggagattccaaaagacataccaattccccaggaggatccaggaagagccctatggataggccaatgcaataggtaaagaaagagtgacaaatatgatcaaggcagaaggagggtctctctttttgaaattttcttctttctaaggtgtccttccccttttcagtctctaagtgagacaatgcgtgcaaagcacttactgcagtgcctggcatagagaaaatgctccatctgggttcatctttgggagtctcatttctacctgccattcttttttttttgacggagtctcactctgtcaccaggctggagtgcggtggcacaatcttggctcactgcaacctctgcctcctgggttcaagtgattctcctgcctcagcctcccgagtagctgggactacaggcacacgccaccatgcccagctaatttttgtatttttagtagagacggggtttcaccatgttggccaggatggtctcgatctcttttttttttttttttgagacagagtctcgctctgtcgcccaggctggagtgcagtggcgggatctcggctcactgcaagctccgcctcccgggttcacgccattctcctgcctcagcctcccaagtagctgggactacaggcgcccgccactatgcctggctaattttttgtattttttagtagagacggggtttcaccgttttagccgggatggtctcgatctcctgacctcgtgatccgcccgcctcggcctcccaaagtgctgggattacaggcgtgagccaccgcgcccggcaggtctcgatctcttgaccttgtgatccgcctgccttggtctccgaaagtgccgggattacaggcacgagccactgcgcccggcctctacctgccattcttttcagcctcatttgcttattcttttttcactgttcatctcttcaatgttttcgttcctctagtttccatgcccaacatttcgctgggtattctagactccagaatcttatctctaacccagactgttgttttgtgtatccaaccatagtgcctctagcccaggtgaacctgcacagtaacaaagcccagccttctcacttccttctcacatcattccttcgatggtgctccactcctgtatttcacatagggatattgacatccatctgctggccttggccatcaaaacaggttcaacctcttcagcttgtctctccctgtatccaccatggacaatagcttacctactctctctggctccatcacctttctgctgcccccgtgagccatcctgctttttggggtaagggtaggaatcacagagatcctgtatattcagctgcccctaagatagctttatgggtaacccctctctaatgtccgatgtgcactgccaagtcctggactctcaaactgggtgccttgtctccacttcttctggctgtatttaaggtggaaaaaatatatggactgagaaaagaacagggaggaggatggaattctggaaagaaacaccatttgaaaggcaaagcataggggaaggggcctctaaaaggctgagaaggaggagttagactagaagaaggcctcagaagccaggggaaatactccatggagaaaatggttaatgtcaaagagagggaaagtatgagaaagcaggaaaggagataactggatttggcaacaggatgttatagatgatgtggagacagaaaatgcactgagcttttaacatataatggccataataaacatgaacttgcggatctgatgagctggtaacaacaaagataagattggaagaaaagcaagtatttttttctaatcatcctccaattaaagtgacaacagacagccatctccagttctggcaccagcagatgctaatcgaatacagaactagggccaccattgaattcacatttttggtctgtctctgtctaaatacacgtttttttaagtaattggtagagtctgtcaacaaatggttataaataggcattgtgtgtaaaaaaaaaaaaaaaaagggaaactaaacccaaaatattcctcttcagcctgtgattatgatgatgagcatggcccaggctgagtctctggcaagggatgaaaggagaaagacccccccgccccctacatggcatttagtgcaatcccaaccacaaagcctcaccatccaaaacgccttgctgaaggctgagctcaccctgtgttgtacggttcatattccggtgtgcaggaaagacgtgtctaggctctgagcacagttttggataaggatgaaataatgttcatttaatacttaatttggaaaaagggccctgcccacggaatcagccttttaatggctgtcaggtgggcctgccccctccgggaagcttggtgatgccatccctcctgaccccaggagcccatactggggtagcagtggcaacaattacagtgcagaaaactgaagctggctggtgttcttccaagggcagccctccacaacattgctgtccatggcccaaacccaggcatgttacacaaaccctgtagtcactgacatgagggccactaggtgatgcttgccaaaggtaaaaaagcaaacatttgagacaactctttccagcctcctctagttcttgacagcagcccccgaaagtaaggacgttttatattttgagaagttatcagggtttcacatgaactgggattcagaacacaatttctctttccaatgaaaactggaaacacatctgagacagtaagcaaagacggtttcttagctctgcaattgacttagaatgaaatatgaaggaggtgccacccagctcttcagagcagctttgaaaaggtccagcttcagagggcacccgcctcaagtgctcaagaatctgtagatgcagatttgaatttggcagcttggttatgaagctcaacagacagacattctgagattgctgaagcctcagtcctctctcaacccatgttaactttcacatccataatcccagcatgcttcctgagaaatgccaaccgttagacactttagccacattcatgaagtgactcacttgaggggcaggatctgaagctgtgctggctagccgagtctggagagagactccctccctaacagtcagtttgtctcttttccttcccctgatgctggtgctcacctactcacatgaaggatgatgtgtatggcaaaatcctacttctgaacccgcatacggaaaaccaattaagacggggagaaaaatgaaacagaactgtatttcccatctgactcaaacaagaatgtttagaatcaggcagatttagaaatagaatgcaggagcctgctatcatagtagaggctcattttactagaggatggtaccctacaaaggtgtaggtgagcagaaccccacagagtcaaggcagattttgaagctttggctggttgatctgatgccctctcctggctctcatagggtttggcagatgaaaaatctggatagaagggaaaattggaaagacagagccccagggcaacacccctacaccttgcgaccaacctctttcttggggaaagaaggattgtgaatgaaaaagtgggaatatttgtaagcaaacaatctgtgacaaacccagagttggctttctgaatgagcaagagaagcaaagtagcggccagtcgcggtggctcacgtctgtaatcccggcactttgggaggccgaggcaggcaaatcacttgaggtcaggagttcaagactagcctggccaacatggtaaaaccccatttctactaaaaatacaaaaattagctgggcgtggtggtgtgcacctgtagtcccagctactcaggaggctgaggtgagaagattgcttgaacccaggaggcagaggttgcagtaaaccaagatcacaccactgcactccagcccgggtgacagagcaagactccatctcaattaaaaaaaaaaaaaaaagcagcagcagcagcagcaaagtaggaagctgtgcacagaggctggaggagcactcacagactcccctctccaccatgcattttacccagacctccgtttggggctggaattcccagaaaaagcactcccccttaactgaccaagactttgcattttacagggggttatacattaaaataacaataataacaaatcaacaagaattttttgagcatctgccatgtttaagaaactgtataaggtgtcacaggaattacagaaaaacattaaattaattaataattttttggagggtgtgcaaggtactgttttagataccaggaaaagtatctctacttaagaagcttagaatgaattgggagaataaatgtcaataaaaggcaatacatgataaatgccaaaggagtggtaagacacaagttaatttaagcattaattactttgaagagtaagcactacagaactccagagatggaaagtctatttctggttggttggaggggagacttcccagagaaggtgagacttaggggatgaaggcttgcactaaaacatcagtaggattcagagaggaggatgagcaggaacaggacatcccaggcagagtgtggaagagtacaaggtgagaattcaccaagtttgtttggactctggatagttgagcaccctggctggcttgaggaggacaaagtaagaattgttaggaaaagatgggttgcgttagtacctccaacatatagaagttagaactttattcagtaggtacttggaagcaagtaaaatttttttttagcagggatgaaaggcctgttttagaaagacacatctccatgttcattatactctgattactaattaagtttctaggatgacctgatagtacaaaaaagttgctctatacaacagccaggaataactctgtcactggaaggggatagtctacattgtaaatacgtaccttagcattctgtatcagagcagaaagaaaccaattgaagagcctagtcggggaagtactgaaccagtccagggttggattggtcaagtaagtctagacgatgaatagagcaggaaaaaggactgctaggtctggaatggcatcactggaagaacacgtgagagatgttgcttttggaggaagatgaattgcatgacattagcaattgaacgtgtaggtttagaagtgctgatggatttgccacaggtgcactctcactcacactcctcagcacgctaggaataaaactgaaactgcaacatggcccacagtgtctgcgtcatctgccctgtctccttcttgggatcacactctgaccacatttctcggcctcccttgcagttgggtgtgtgctggcggaatgtgagtgcggttgggagcaccacttccaggcaggcctgggcccagaaaaccctctcatgcacagccttccatgcagagaagcacgctggccttggcaggtcattaaaaatggcagagctgcaaaatgaaaggagctgtggtctccaagacactgctttgaacagggatatctaactgctcaggaatatctagtttgcacttctgcaaatgagaaataaatgtctatactgttcgaatgtcagttttggtttgttccagcagccagcgttatcttaactaatctgtcattctcccagtctcatctcaccccactgctctcactgtgtatgttccaaccacactggtttccttcagttctttgggcacacgaagctctgttcatccagtctagcccttccctgctgcaaaggtctttgtgttagctctttcctctacctggagcactttctacaactccttgcctgataactccttttccaggtctcagatcaaataacacttcctcagagcagatattttttgacctcccaaattaaatcagggcaacccctgttcatcttccataacacgtcttacaatttatcattatatattcatttaatatatttaatattatttaaattatatttgttaaattaaattaaatatatttaatacatgtctccctagaaaagtatatgatccaaaaaaagcagggatcatgactcttgttcaccagtgtactgttcattcagcacctagcaccgtgtgggtgtttgagaaatattatggaataaatgaatgaactggagtgctgcagtcacagttagatttgagaatgatcgcaatagggacagatagagagtggagagaacagagcagcaggctgagaaacagccccgggaaacacacactagggtacagcatctaccttccacccctaaacagaggccgtggaggagaataaagtttagagaagagaaactaattagagagataatgattacagaatgaagagcactcaagttcttgaggggccttagacatcatctaacctgttctcccctttgcatagatgaggaaatagaagtaaagttccctggcttagctaattggtgtccacgttggggtggccatactaaaaatgttagaattgttctgtttgcattgatacctgagagggaataggatcaaagtctttaaatttgtggccaggataaaactgtggtcctactgccagatttaaggggtgccttgtgaaggtctcataatggacttaaatgaaccaatgtctcctaagatctcaactccaggacattttctcctgcagggattaaagagaagggggactgtttgaaaacatgaggaagggacatctaggtcattatttggttgtgtttgctctccttcaagtgaaacacttatctgaatgcaataaagaggcttcttcagacagatgaagagcaggccctgtgggccatggagagagtcagtttcctccccagtgggactcgtctgctttcctggagagtgttttcacttccatgttgaagctggaactccagcctcccgacagacaattctccctaacgcactcccctctgcactagggacggccgcctcttgtattaatacaattaaattagcccgtcagttccctggtatcctttgaacacttgagagaaagtcggcagcttactggggcttttccaagagaaatatgtgctactaaaaagtgatttctacacacatccctccctcccttgatcacgaggtaattactgggctatgaaggccgctgaagctgggtcctggcaaagctaagtgtgtgctgctttccgactgccaaagggagcagacagagccctggccttggtccactggggcctgcaccactcttgcaagcttccatgagtgaggtcagtggcatccaagttcccacagaaacagtgctggtctcctcggctggagggcttgatcagccatctgcttccctgctcaggctgctttcctagtcgatccagcccagagcccttgcagagctacaaatgatgcaagtgctatgaagaccagaggtcttcccccatgggatatagtaatgtattcgtttcttcaacaaatatttactgagcatctaccctgcacctgtgctgggctaggaactggttttatcccatttgatggttatttattgaacacctactttgtactagacgttgtactccagtgctattccctgcaggcaaggagctggaggtctggtcaagggcctatttgttgtttcagtgcccttattctcccacccgagggcacctggcagagccagacagggcccctggcagtcctgctgagtgaaaggtataagcaggcacccaaatggctctaacagtcttcagccattaacgttctttcatttcaaggagctcacataagacacaggcacagtgagactcttgcaaaatgaaacaaatgccagggaagagaagtctctcaggatttgcaactgctcactgcagatgtaaccaaaatgtggaatgaaaaaaaaaaaaagatcccttcagactcagtttttgtggaaaaaaaaaagtgtttcacttcagctcagcatgatttttaaaaaatcaaaactgattcaattcccttttcctttccttgccaccccatccgaaccaccctatcactgaggttagaggacttacttggtcaatgtcatcacataagcctctcttaaggaaaaaaagtagagagtaagttagagaggatgggaaggttgagaactgcctactgtttatatgacagaagaaatggaaaccactgtacaattctaacttatcaagcagggtgaaaacaccactaggagcaaaagggagagagctcagagggatcaggagaaatcttttgacatggcagataattaagacactaaaactaacaaccaaaggcagaaaggcaagctgtaattacccaaatgctttcaaagcctggagaggagacaaaaatgggtggttcctattttaaccaatgtggatagcctggtagggactggcctttctgtccccagtatggttggctgcagtcattggcctctgacctcccagctcccggacagtggccattatacctgtgcacgctgagggaatgggcaaatgctgccccgtgctccatgcatcttccaggtccatggcaagtctcctgtaaaatcaaggccacttgagggcagggactacccattcaagctcctttcatattacacatagcactttgctcagaaagagtcacatgtatatttgccaaccagagaccattagcagggacacagcatccggcctccagggtttagtgatagcaacacgcaagatactgtttcttacaagtgggaagttcctcacagacttactcaaatgagtgcacactggagagtgaaacagagaccccgaccaaccaacgttgtcatgtcataaatcacatttcccaggggctgctgaaaacacccagccttttcctaataattgctgagtcgcataacaagcaaaaggcttaatcctacagtcccatcaagtttacctgtaggaggagttactttccacttatctgtatggagaatctgccatattagggacatatcagagcataagtcagccaacgaggcacacaggcagctataagacattatcagaacctaaactgttgtgattttataccaagtatgtgaaaatttaataagattagaaggaaaacaaaatgaggttgttaggaagaaagacgtctttctgtttctattcgttattgttacttctaattgtttttccttctatccaccctccaccactccaggaagaggctactggaggctctttcactgctttccacagaggtaggaaccatttctgagaaagcaaggctcactcttctcagcactgggtgtttctggtcctctctgaccttgactagaaaaacaagcaggaaagaggaggaatgataataaacatatggtcagcatgcctttgtcttctgataagaaaagtggctggatgagcaggaatgtccaatggaagcaaatttaaaatttttgattatcatcgactgagcagccgggtggctctgtgggttccggggcacagtcacacttagacacgatgcctgtggaactggtcgcggtgccgaaccccaggcaaggagcacttcaggggagcagttattcactgctgtggaaaaagcaacaccagggagaggcactgtgagcttgggctcccagagtccctgccttgttgctttctagctgtgcggccttgggggcaaattgcttaactttctaatattttacttttctgtaaaatgagactaatactaccacctaccttcattgggtttctgtgagcgttaaatgcactaatgcgctatgagtactgagcaatacaatagagagaaaatagggtggcctttattgttattattataaaatctgttctggattaccttcctctctaacaccctagtgtgtaagttaggaactaaagggatgacaataatcaaacaaaattaacccaaatgcagagaaaatacaaaacaataacaaagtcacagtgtcccctggcatgtgtaacaactgtatacctgaaggatgtcataggctgttaatatgtaaagatctttagagatcttcttctgcatgcaacatgcagtatcagataccatcagagaaataataatatctttcatatgaacaaccatcatttactgagatggcccccttcagaaacttacagggaacaaaatgtgattcctggactggcacttctcatctggatatattacaggattgatgctttcagcctcctgtatccatgcaactggattttaaagcatttgtaggtctgtgcagccacatcacactgttgcctcctattaagttccttgtcagtcactcctcctcaccctgcgctttgcaggtggcccacgcacagcactctacattgacctgatgacattctggcctattagatttgcctcattatgctccaccatcagcttctcctggattccaacttcatcgtctccatactcacgattactcataggccctctggcctctggaatgtgataaatatggttttggtagcttccttcaagtcacaccaccggaatgtgccatgtggacaggaagctagacaagacggttacctcaaatgggcagacatccccaagaactctacagttccatttaagactccaccagctggcatgctctcgccatgcttactcttccgctccctgtcacctccgattagctactctttctccactttcctgcaaccatatctgtggtctgcactggcagaaagctgggccatgaaggtgggaaatggctgaggacaatacagtgagtgcagagcattccgtgttggggtgtggtgatggaaggggtgttttgggaacacgagggtggtagaaataaggccaagaaaaaaatccactctgaaaaatgttaagctactggacttaagagcttctagtctccctccttaagagtgagacataatagaaacatttgagagagtcaataatccagggccaagcctgccctccacattttatgttcccagttggttggtggtccccaagctctatcagatagcacatcttcatcagttggcttccaggttgatttagtcatatgaaagtgtctttcttttaaaatgctcccattctggctcccttgggtacaggcacagtgaaaatggcacatttctcttctacaacctcaggaaagcatactcctcattggagggaggcaagtgattcacctcaacagagcctaagcccgggcaaggagcacttcaagggagcctggtttccagtaccatatgctgctccccaccccttcctgagccaatgggaggaaatgcacctaatttccaaagacttttaaacatatttggggaaccttaagggaaggccttttaagaaggtaccaaaagggtagatagaacaacaatttggaccctcttctctaactaggagatcctcagaggtaaccaggggtgaggaaaagggacaataaagcaaatccaagaaacgaggggatgagaacaaaatactgtttccccttaatctctcaaatacttaaaaaacataggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaacaccttgccatgaaaaatgtcaaacatgcacagaagtagactgagcatcataataaacaccatgtacccaacaatcatcaacttgtggccaattttctttatctttacctcccaccccctcctccccatattatttccaagcaaattccaaccatcatatttcatcggtaaatattttggcatatatccctaaaagacaaggatccttaaaaaaataaacccctcataatcatgatactattatattagtaggaatttaatgtgcaaagatgagcaatgtttcctagaacattcacaataattccctaatagcctcccatttctagttagtgttcaaatggtctgactccacatggtttttaagccacttttctgatgacgaggcctgcatgacctcctgggtggctgggaggatgctgttctagagcacgtagctggcacagggtagctcagcatgctctccgggcacatcctgtactgggtggagtgagattcagttcatgttgcacttacacctccccgcacacagaagcactcccactaaagcatttccctaatttccggagccacaggcagcttcagaagtccaaatacttttgaaggccacaagggacccatcttactctcagccttcaagacaggtcagcgctcctgcctccactggtgcccccaccctgtttgcagtgatgctggagggacacaggatggccccctgggctccctctgctcgggtcaacgatgtgtgactttttgctggacacggggtgtctagggcagcacacagcaagacgccaatatgtgttagctgtgccatgtgccctacttttgatttctcaactagtcagagctaagatgttaatgaaatctacaggctttcatctcagataacggatttgcaaaacagacatgtataaatgacaaactgtgtttcagccactgtgctgggagggatacagagatgaatggacagatgtccaggtccctgtcttggacagattcagcatctaacaaagaatgtgaataaataactctatcataatgggctagagctacaggtgcatagaacacgctgagcgggcaccgagggggttgcaatcagtatgcaatcctgccaggaaaggtggtggtcagagcggctgggaaggacttgccaaggaagcttacatttgaactggatctcaaagaacaagccagattttaccaggcacagaaaggcaggaaaggtcacttgggcaacgggaacagcatgaggaaaagcacggcagcacattggtggtgtaggtgtcttgtgacagagctttcggcacataacacagtgcctctcttctctgtctacaacaaaggccagccccgtggagagctaaaaagagtgaggaacaacaggcagacagatgatcctggagcacgttcagggaggagggcaggagccaggtctggctcagctccccaagtcagcggcacttcttgccttcagctgaagctgggagacccatcctacggtcaggctgagggccgccagagcctgcggccaggcctaacactaggcagagacgactctgcagctgtctgctcacactcactgccagtcacgcttcactccactttcctgctctgaaaatcacgtcctggcaacctgcccatcggacctggagccagccttgccctctccactgcgggcctgtaggcctggccttgaaccccagcctgctgacatgcttctcaagctacaggcccattgctttggccctctgattctggctgaccatgggccacagagaggaatagggggcagctgatgctggcagttgtagactgcacaagcaggacccatctctgggccctttccatcaagcctggtctggtggccagtgtggtgggcaccccactagaccccttgatccggtagtgagttccagaagaaaaggcacagctccaaagctcatctggagcaaactctgttctcctaatctccattcacttctcaaatttcccgacccccgcaagcttcactggcctcctagaacctccctaccaaaggaaaaggttaagtggtcatttctttaactctcatttctctttcggggacagagcctgctattcaggggcatcagggaagcaggggaaataaggatgggagtgattaagtgcatgtccaaaaccagctctctgatctcatgactttcttgtacccttggtacaagtgctccagagagaactgagttgtgaaatgacaggtaaaaacagcacagtgaaaacccttcttgctttgaacagaaaatgcagttggtgcctgtgagttatttgtttctcctttgctttggaaagagattgtctagagaatttggaaacctacatcccatttcagaaagcagaccagatttctgctgacagttagtttggcagggggtagagtttgtctgtttttgccatgagagctcgttttctgggggacacaccacacggttctaattctagatgccagcaaagctgcgcctttaaccatgaaacttgaattagcattgaatggcttttgagtttttatttaggatgcattttaagaaaatacaaggccctccagctgcaaacagtaagtgccaccaaggactatgtgagttaaacatctttaggatctgtagtcagccttcctgtgctttgggagtttcaggaactttcaaccacagagtactgtgttcagttgtgtcagaaaatgactggggttggatttctcctaagctctcaaaggctttgaatctttgacatagtgttgttaacatagttaaactgttttctacacagaaggcttactcaatacaacaaattagcaatacaagaaaagttaggtaaagtttctatagaaaattcagatcctacaatgttagattaatttaacaacatgaaaaaatgtccagagctgtaggtgtgatgaactgaaggctccccctgcttttggaggcagcaggagcgcagtacagaagcatgcgtttgacactcacaacccgctgccatcctatcatcatgttaggtttcatctttccaactggactgcagttgctgaggttagcctccgtatactatcctggtcttgcccccatttcctagtacagtgaaacaatggatgctctggaatgtttgttgattaaataattgagatcacacatggatacactagaaacttttttgcagggcagcattctttcggttagtgggattctgttctgggtagagaagctgcttccctcattctctccctaagaacctaaattccatcaagaggacacaatcacaccagcaagagaaactagtaggacaactgaaattcatcacaggaggccacaaaagagttaattcagctctgatatgaggattatgagacaagggtataaggattacacacaatggatttataaaagaatacaattttttttaaaggacaaaagtagtgactagggacgtttgtttcagatgaagaaataaccatgttaaccttttaaacatttgcatctgtgaattgtagcggctcaacataaagcagattgcctacatccactgcagccattctggcatgagaaagttctcttgcctaaagcaaaacagatgtgtgagaggaaaaagcaaagtctcttatgggtgtatcaacattcataattatatagttatctcaggaactatagatcgtgtgaagcaatgaatatggaatccttcccatattttttccctaaaaactcagtataaaaagcagaaacttaatattgaaaaaacactaattataaaggcagatgaaaaagttaacagtgtattcacatttcatccatacattttttttttctttttggccaactgaactaatcctgtaccagtgattaaatattcagaatttttggccaagtgctgcctaagagagatccacttgactgttcaagcaattagaaaaagtgccacatccttgcatgtgcctccaagcaggaaagagcacatcagggacatctgcatatgtgttcacatatgggattcacaggcaaatcaacttggaaatgggaaagtacacaaaggctaccccacttgagatgcaggtcagtatttacagagcagtgggcaggtgctcggctgtctgctaggtcctgggaaaggtacaggagaaacacaggcaagagcatgggcactgaacaggaaggaaaacaataccctggagggcacagccccctagcccaaaagaagagtatttacagtggggaggggaggacagagcatggacaaagtctcaacaagcaatcatccgaaaccaggctgggaaagttgtttaaggaaatttcaagtttgaatgatatgtaaaacgtgtatatgtaacagatgagaagtggctacacaacaatcaaatcaatttggtaaagataaatgctaatacgattaaaatgaccccaaatatttgtattatcacattattatagaaatgaagtcatatgaacattctgttcaaacacacacacacacacacacacacacacacacacacacatgatatcacaatttagcattaaatgcagcttagagggcttgaaattgtactggtacacatgagtttaataataattgatgggctgatgtggtggctcatgcctgtaatcccagcactttgggaggctgaggcaggtggattgcttgagctcaggagttcaagaccagcctgggtaacatggcgaaaccctgtctctacaaaatacaaaaattaaccgggcatggtggcatgtgcctatagtctcagttactcaggaggctgatatgggaggattgctggagcccaggtgatcgaggctgcagtgagccgtgctcacaccactacgctccagcctgggcaacacagtgagaccctgtctcaaaaaatttataataataattgatgataaaaaagtttacaaattatgtgtacagagatggaataagtaaatttcttccttccttcctttcttttttttttctcttgctctgtcacccaggctggagtgcagtggtgcaatctcggctcactgcaacctctgcctcccgggttcaagtgattctcctgcctcagcctcccaggtagctgggattacaggcatgtgccaccacaccggctaatttttgtatttttagtagagatggggtttctccatgttggccaggctagtcttgaactcctgacctcaggagatccacccacctcagcctcccaaagtgctgagtttacaggtgtgatccaccacgcccagccaatatattttcatgaacagtttttctacttatgcagttatacaaattaaacatgagatataatctctacctgaagtcatatagcatttacttatcacttttaaaaaatgcaaggccaggcacagtgactcacacctgtaatcccaacactttgtgaggctgaggtaggaggattacttgagtccaggaattcaagaccagcctgggcagcaaagtgagtccccatctctacaaaaaataaaaaattagttgggcatggtagcacatgcctgtggtcccagctattcaggaggctgaggtgggaggatcacttgagccagggagctcaaggctgcagtgagccgagaggatgcctttgtgctcatcctggaggacagagggagaccctgtctcacaaaacaaaaaaaaaagcagtgatttgtactccagataatagagtcatgcagtactataaaaatctcttctcattttgtatttattatgagtactggcaaaagagagggtcatcttcattttcttctgattttttaaacataaaatatttgctgaaattgttttctaatatacaaaattgtttgagtgaaagaaaaagaactataaaacacaagtaccaaacagtctccaataaaaacacttagataataatccatttggaaagaatgagctccaaatatggattttatgagtaaacaaaggttctgtattgcaaaagttaatagactgtcttcacatttaatttcatgaccacttcctctgtttgactcttctgtggcatagcttgagatgtctgcaagccctgctacttctgaaggaaaatatacagagcaaaaagacatgctgttaatcaaagactctggcatctgaatttaataatcagatgccatttggagtctatacagtttttcaatagtgtaacacacaaatcagtcagcacatacatttcaatagtgattaatctctttttacatgcacatctgcgatcccttatgaaatagtcttaaaagcaacctaataagaaaggagaaagaacctgtgggtcaaaaaggatcatcatgaagccaagagatgttgagtcagtctttccctaagtctctcaccacataaagctactgcgcctttatttacatatttttcccaactgaaatggtctctcctctcttttaaaggcccactcttttttttgaagtcttcagggaattccatgtaggaacattcttcctcttcccacctaatatgtcactggttcatcattttctctgttactcacttgcttctgtagcacccactgttgggtgttgttcgttatctttatgtatgtctacctcctgttccctaactcagttatacggtcttacaggacaaagaactatggattatatgctttccatgtctacagcaagcttcctcaaagtgtggtccttgaatcaccagaaattccttggatgtttgatcaaaatatagctgagagatcctgaagctgcatgaagggagggcctaggaagctgcattttcagcatgctgcccaggtgactttaattcacatcaaggattgaggacccctgtatacaaggactaagagagtgctatgaatagaatgggtaccaagaagtatttgttgaatatataagggcacacaaagtaaaaaaaaccccaaactaaaacaacaaaaccaaccaaacaaacaaaaaacaatgtgcaaagttaaaggcgttgggattatttagtcttgtgcctgtaagtttaatcacaacccaattatcgaaaagattattgaagttgactgtagtaaagcattattttaaagagattgcttattttctagtcgcatggttgctgaataaggcaaacgatctcccctaaactcctaattagaagatcataatggtcatctcctttccccttctccacccttccctgttgaccttccccaagaatcctttccttggctttccttcttgtctctattgctttttccctgcttttttctatgagactgactgcttttcactcatctcactgtggcttgcagcttcaagaacagaagagagcaggccacaaagacaaattagaacaagacacccctctctgtgccagaaagtgtgacttggcaaatggaggacaggctgtgcccctgtgcagttagcaacctgtgaaactgtatgtggcagcctgtcaaaaaaggtggaggaaagcatctgggcctacattttcctgaagatggcttttcaaaatttctgtttttagctgacttcactcttctctatatgctattaggtaataagaaaagttccaaacattattcactgggatgctcaaaagtaagctacatgtgccatattactgtaagacaagtataaagggcttgcattttatttccacaaggaatgaataaagggaaaggaatttacttttgggaaaaggtaacacaaagaactttggtctatgaaggacacaaatgaattctcatcttcaaagatattttgaaataatataagaaatgacccatctgtggtagtttatggttgatctaagtaagacagcctcctggggccccttctttcttggagaaggcacttttcctatgatgccaggttcctagttcccgcctcttctgccacttctgcaggagccacccgaggccttgaggggccctttcagaaccttgggtctgaagtcatttcttatgccctgggttatcatcttcagtagaaagttggtggtagctacaacagcagcgagcactcaggccagtctgtaaaacacacaaaatgactttcctgaagatatacagatttctcagggtacggttgtatcaggactgcatttctagtccaggagatttcttacaatctcactagactgtgaattcctaaagggcaaggactgtctccttcattattctagtgcctaacagggcctagaaaagaaggtgctcaacaaagactcttactgattaagggggcttgattagctctgtcagcaaattctgcctccaaaagtccttctctgtttggctcccggagaatatttcccttctgtgtgtcactccccagccccaccctcagtcacagatttctggtccctgaaccctggatttccaggtgtcattccaaggtcaggtggaaccaagggctccatggtcttcaccccctggtgttactcctgagattatgttatgtttggtgggaaaaggaattctgcagatgccattaaggttactaatcagagagcatctgcatgggcctaacctaatcacatgagccttttaaaagtagggaattttctccagcttgttacagaagcgagattcttgttacagttgagagattctaattgtgagagggattcaacaagaggaagcttctccattgctgactttaccatgaaagggtcaatgggacaagaacttgagaagctgagggtagtccttgcggagacaacagggacttcagtcctacaaccacagcaactgaattctgccaacaacctgagcaagcttggaagaaggttcttctgcaaagcctccaggtaagagcccaacctgactgacaccttgaattcagccctctgagaccctaagcagagaacccagttgagcctgcccagccttcagacctacagaactgtgaggtagtaaacaggtgttattttaagctgctaaatttgtggtaatttgctatacagcgataggaaataaatgcagcagccctctgggcccttctgtagcagtaccctccttgtcttccggacttcagttcaatcagttctctactgggagagataaagaatgatcattagtaggcacaaaataacaacagctatggtgaccactgttgtccttgttcactgaccaataatccaactgcttcactctctctggtttatgcttccctccccaaacccacacatccttcacagcttcctctctgttctttctctaggtgagctttggcaatttatggtaaaagcctctatccttgagctatatcctttatgttcccaggacccactcggcttcaacataagcaaatagaaatataaataaagataaaagtatgtgtagatcctgcagaatatctacagtcaggtctggggcaataaatgggtgcctttaagagtcagatctgatttgaacagaaataaatcaaattaagatctctgataggccgggcgcggtggctcacacctgtactcccagcactttgggaggccaagaggggtgaatcacctaaggtcaggagtccgagaccagcctgaccaatatggtgaaaccacctctctactaaaaatacaagaattagctgggtgtggtgccatatgcctgtactcccagctactcaggaggctgaggcaggagaatctcctgaacctgggaggcaagggttgcagcgagctgagagtacgccactgtactccagcctgggcaacagagtgacagcgagactctgcctcaaaaaacccaaaaaaacaaaacaaaaaatgtctctgatatacaactaagggctgggcacagtggcttacatctgtaatcccaacactttgggaggccaaggcaggtggatcacttgaggtcaggagttcaagaccagcctggccaacatggtaaatcctcgtctctactaaaaatacaaaaaaattagctgggcatggcagcacgtacctgtggtcccagctactcagctggctgaggtaggagaatgacttgaacccaggagacagaggttgcagtgaaccaagatcacaccactgcactccagcctgggtgacagagcaagactccgtccccctgtgccgccccccaaagaaagatctctgatatacaattaagatctctgtggatctctgatatacagctaagatctctgtagatctctgatacacaactaagatctctgtagatctctgatacacaactaagatctctgtagatctctgatacacaactaagatctctgtagatctctgatatacaactaaggctgcacaggcttgagcatctagggccgagacagctgcaatcttggatactcttagttatatctgagataaaagtcctgcatctgagatacatatctgagataaaaactcccatttgtaaggttcagggctttacccaaactacatggtgctcagcagaatggccatctagaatcttgcacggttcgcatttcatttcttctttcagaaaccccactttccttgggtttaaatggaaagaacccataaaataaagctctttttttttttttttttttttttttttttttgagacagagtctcgctctgtcgcccaggctggagtgcagtggcgtgatctcaatctcggctcactgcaagctccgcctcctgggtccatgccattctcctgcctcagcctcttgagtagctgggacttcaggcgcccgctaccagaagggacatgcttttcaagtgtcttgcttgatctcctatcataatgaatccttcctttctccttaagcaaccttgctcaatcctctttttaggactaacttgattctgttttgcattgcaagcagttgtttatagatgccccctcccacccttgccctggccctctctggctccttaggggcagaggccatgtcccattgatctttacacttccctggggcctgcacagtgagcagtgaatacccgttgaaggagtttaatttctgcatggagttagatttatagttgagatttcctttgctgttaggtttcaggtaggtgcttaagatcccttgatccagggagaaaagggccaggcggcagttgccactcagtctgcttctgaaatctccccacaggagtaaggaaggggctgctgggaggtgatggtcctaccatcatgaggaggttgaaagaaagggtaggggaaggaagctccgagggccaacctcacttcccatccctcagccagcagcaagcagggctgcttctcaaatttgatctgttctctgccttggcaaagaccaagtgcattccctgtatgtgaaacaatgcagttgctgtttcaaggcagacaaaaagactgtgggtgggaaaatatgaggaaagtctttttcgtgacttattttttttcaaaacgtatgttgtgagaaaaggtgtcatgaagataaaatatgcagtaaattctgaatcatgaaggaaaaacatttcccactgtcctctaaaatctactatatttagttatttattcaatcactcagcacacttcaaatgtgccctgactaggtgatgcttccctttgggagatttgtgtatgtgcttgtcttctagactggagggtctccagggctgggaccttccacagttcgtcttcatatccctaatgcctagcactgtgacagcaagagctcaggagatggcagagccacagagactgaagggggccacagaggtagagaggaaaaaggcagagccaaggggcctgggaggccaagtgctttaggacaagcactggcaaatggcacagaagggccaagtcagctcatgctgaaaaggagccaagggattcagaaaacccactggtcacctgcagggggctgctatggtttgttgctccaaaatccatatgttggaacccccaaggtgatggcattaagaggtggggccattgggaagtgattaggccctgggggctccaccctcatggataggattagtgcctttatccaagaacctgaggaagagagttcttcccttttccccttttgtcccttctgccacgtgaggactcaatgtttctctcctctggaagatgcagccacagggcaccatcttggaagcagaaaggagccctcaccagacaccaaatctgccggcacctcagtcttagacttcccagcctccagaactgtgagaaataaagttttattatttataaattacccagtctgtggtattttgttaaagcagtagcaatggatttagggatatttaggaaacaaggttgattgcagttgggtcaaaagtaaatggaagaaacattcactgatatctacaaataaacatgtttttaaaagtctctactaaaaatacagaaattagctgggtgtggtggtggacgcctatagtcccacctactcgggaggctgaggcaggagaatcgcttgaacccgggaggtagaggttgcagtgagtcgaaatcgcaccactgcactccagcctgggcaacagagcaagactccaactcaaaaaagaaaaaaaaatcatgtaaatatacactgctacatgactggctaaataaactacagaataccatgcagcagttaaaagaataaagtagacctttatcagggtttctcagcctcagcattattgacatttcaggtggaaaactctttgtcatagggctgttctgtgcattgtgggatgtttagtacatccctgacttctacctactagatgccaatagcattccccactcaggtcgtgaccaccaaaaatgcctgcaaaaattgccaaatctcccctggggggctcactagcccctggttgaaaaccactgatttatacttacggatctggaaagatctccaagacagatcattgacagaaaaaagtatgtggcaaaaaaaaaaccccacaacattttatatgatattatctatgtaaaaaaaaaaaagtattgtacacaccactgctccataaatccatattgtatacataagcacatctaaagtggtctataaagtcaaaactgttagcagtggtcacctctgtggagggggacagggaataagggtcatagtgaactttgttttgttttatttatttatttatctgagacggagttttgctcttgtcacccaggctagagtgcaatagcgtgatctcagctcactgcaacctctgcctcccgggttcaagctattctcctgcctcagcctcctgagtagctgggattacaggcatccaccagcacgcccagctaatttttttgtaattttagtagagacagagtttcaccatgtcagccaggttggtctcgaactcctgacctcagatgatccacccacctcagcctcccaaagtgctgggattacaggcgtgagccactgcactgggccaattttggttttatttgtatggctgtgtttaaacaaataatgaaaatggaaatgtatttggtgttaaaattagtaaatgaatggaaattgaagatatggagaaagcacatgcaaactacttctgacaaggtttagtggtgagagtgaggcagaattcaaggaaggaatttttagaatgtgggaaaattgagcactgctaaattcagtcaagttacaattttgtataaagcactatgaggaggcggtgcatatcttctagaatgcttctacttattagctcaagatttcaataacactttgccagcaatgactttcccactagaattaaatatgcatgaaataacagaattcctctttctgtttttctaccacatgtttctttaatttgtgtttctttggtgtgtgtacagctttctctaactaaactgctgatgccattatggaaactgtcactcttcagagttggaaagacccaagaataaaagctgactctgacttgtttggtctggcgtggctggggatactgcaggagtgtatttgtttttcattaatttgtttgtcatttttctccatgatctatggaacatttatttcccctgaagcaaaaagacctgaaatgtcaaaggttttttggtttctgttggggtaatgaattgttgagaaaaagagattttttcttatatgctattttattgtagaaagagacattttgtgaccttttgctgttttacagtgataatgaattttctgacagacttggaaactttgggcttctatgttaaaataataaagtttgaggaataacattgacctggacctttggagaattaatcaaatacagattttggaaaattgatgactttggtctttatcaagacactctagtttattactgtcatcaaggcagtacacagatttataccacataaaaacatccaacaattaactacagacccaagtccctgaacagagattttgacactcttggtggttgggaggtttaggcccaggagaccttcagcctgatcagtgttgctttgttgccttttttctttgttctttttcaaaaatttagttgcaaaagtaataggtacactgaattgaataaaaacgatactaaaaattatacataatctcaccctctaaagctaactgaccattataacaatttggtattctctttctaatcctgtttttttcttcgtttgtttgttttttgagacggagtcttgctctgtcacccaggctggagtgcagtggcgtgatctcggcttactgcaagctctgccttccgggttcacgccattctcctgcctcagcctcctgagtagctgggactacagatgtgtgccaccatgcccagctaatttttgtatttttagtagaggcagggtttcaccatgttggccaggatggtctcgatctcttgacctcatgatccgcccgcctcggcctcccaaagtgctgggattacaggcgtgagccaacacgcctggcctctaatcctgttttaatgtctatattatttttacacaactgagatactgaatacaaaattttattattttgtggtttttcctctcaaatattgcatataatgttttgtttctaatctcaaaacactttaaaggaaaactgtaggaacattaataaattctaccattgtccctatgaatgtgatgattagatccatttttcacatgctctgaaattgtaggtgtgtttttgcttttatttttgggaggtgagaaaacaggttcactgagtccaggaggcaggccaagctcacataatgatgacactgggcaagatgctctgtgtcccttggagacacagtaactgaccaatgggtgtcccagtgactactttggcctggtgtgtaataccaggccacagaaatctctcagccatttaagaggcatgagcatggggaattttcctcttttgcacaaagtagtggcactcctaatcacctagtttctctactaaaactctttctggggactttttggggtttgcctatacccatccatagtacttccgcaagatcagaggaagtacttgaaagaagtcagaacccatagcctaagtaggtttccccaagaatgttcataggagaagaaatctgctacctgattcttgatttccagggaccttcttctagggtggtagatactgagctccttgccattttttagaagcttgggttttctttctgaatgttcacataaggagaaaaccaggaacaaaaggaaaagagaccaagcttctgtgatgagctctaaaatcttcatgtcttgctggcttgaatatatcttaaactttttttcagcaaatgcatcatgttactttaggatcagaaaacattttggcatttggataatctgaaagataatgtaaattgctatacaactagcttaaatagaaatgtgggggaagagattataaatacttatgatataatttggatatctgtttcctccaaatctcatgttgaaatgtgatccccaatgttggagggggggcacagtggggagtgtttgggccataggggcagatctctcataaatggcttgatgccctccttgagtcttgttctgttcatgttttaaagagctgttctttaaaagagcctggcatctctcttgctgccactcttgccatgtgcatacctgctctccctttgccttctgtctgaggcctcatcataagctgagcagatgctggtgccatgcttgtacagcctgcagaatcatgagcgaaataaacctcttttaaattacccagtctcagacattcctttacagcaacgcaaaacagactaatacaatttataaaacagttctgaaattcaaggtcttacatctctgtctttaattagatatcttagaaaaaatatttagtcttaaatacttatacaaatattttaaattctaaagattgagcttcaaattgggtgaaagtcctctagactaggggctcaatattcaaattgtagtcagagacccagcagtattggcaccactcaggagtctgttagaaatgctgaatttgggccccaccccagcctgactgaatcaggtgattcgtgtgcacattcaggtatgaaaggcactgctttaagtgtagggtaatagaccagatgtgtggaatgccaatgttttcacctagtattcccaggtgagttcctaggatatacaggaaagttatcagacctgttcacagcctgctgttttcttcctcattaatagcctaatttctggtattatcttttcatcatgacttaactaatcatcagaatctgcccccaactgctgagagagacagtagctcataactatctgtgattttctgaagtaggaaaacaatgccaagattattgtcctcttggttttcagtcaggttaagataggcagaaaagaagatggctggtttaaaagcattttaacagctgcactggtaatatactgcattttgacagatgtggttagtaactctaaggagtgcatttttctctcacttgcttacttttgtttctagaagtaaaacagcctatgggtaataataagttttcagaagtattcaaaagtaggcctacggtcaggaatgtgtttggtttagcagttaggagaatttaaactcaaatccagttggtttttaattcagcttaatcaccaaaacctgataaagtgccaccaagttatctaaaagcaagcagatactgcacaatggaagagttgatgtcatccttggagctgccaaaccatcaacaatttggaaagcgattttaaagagaaaatgtaaaatatgaaaaatgtagttcttagcttttcttacatgctcttccaagtgtctgtgatttatgggcatctttttcctttcttttctaaattggttttcactgtcattattttcatttaaaaaatgtttattcatttcagctcaatgcagggtaaatgctgctgtttataatttgtggaaagactaagaaaaaaatcccatatacatttgaaaatatgattacaattagaaaaagggaaaggtttagattccttttcagtctctaacatttgttttttaaaacattagttgttaacaattagaaatcaagtactatattctaacttgtccaaaaaataacccagatccaatcttcaactttctttaaataaaatgtatttatgtcacaaataattcttatatctcagtcaaaagataagggaaggtagtacttaagctgactttctcattcctcttttattatttttttcttttttgagaaagaagctaaaagtcagctataagcactgaactatttttttcgaaggagtttttacaaaatgatgtaaaagaaaggatctgaaatgaatataaatagttcaaatacccatgacttcctctttaagtcattttaaatttatactaatgtcagtctcaagtaaacctcagtctcttaaacttgccatcaattaagccaaatctaagctttcttacgtctcactttacaaacaagcattagctattacaatcaagtacctctgacatctatccaatcttttccatagatcttttttaaaggttaaaaaagttaaccccatgtctttcctttttctttctttttttttttttgatggagtctcgctctgttgcccaggctggagtgcagtggcacgatcttggctcactgcaacctctgcctcctgagttcaagggattcttctgccttagcctcccaagcagctgggactacaggcgtgcaccaccatgcctgactactttttgtattttcagtagagatggggtttcaccattttggtcaggctggtcttaaacccctgaccttgtgatctgctcgcctcagcctcccaaagtgctgggattacaggcatgagccaccatgcctggccccttttttcattttttctttaagaaaagacatttattcaacaactacttattgtgctactgttctagatgtttgggtatagaaaagaacacaaaagactaaattgtctgccctcgtggaacttgtattttaatggagacaggaggatgataaataaatatttaaaaaataatatgtgctctaaagaaaggcaggtactgggggcagggggtagctacacagtgcctagaacacagtgcactgtcaacaatggttagtttcttttctttattgctctccatgtgatttctctcaactccttttacttaattgtgtatattctctggttcaaaactgcttctgtgaaggcatttaggaaagaaaacaaatagcacaggtgttacccctcatgtattaaaggaagaagctaaagctgactgcaagctcttttgctgtgaaaacagtatgatacccccaaaataagtgagagagatactaacagacttctacaaacattccaaatttgaaaataagggcaggtaacagggcagaatggaagcctccaagggggaacctatttggctgccatgggtcaggagcattaggaatcacctatgacaggaagtcccagagcatccctggcatatcagaaggaaagggcacctacagggggttcatcctaataggggcacagccagctgcatacctagaacagagtccagatagtgacaagagactgtaaacctggccccagatcaacggctccatcaaatagagcccacctagacatgattttctctttctaggatggcccactgtaccagtcacttctcatccataggctattagaccactaaactagttataaatatcttatataaactacttctcctgccttttttttgaaatagagtcttgctctgtcgcccaggctggagtgcagtggtgcactctcagctcactgcaacctctgcctccccggttcaagcaatcctcccaccttagcctccctagtaactgggactacaggtgtgtgccaccatgcccggctacttttttgtattttttagtaaagacggggttttgccatgttggccaggctggtcttgagctcctggcctcatgcaatccacccaccttggcatcccaaagtgctgggattacaagcatgagccactgtgcccagcccctcctgcctttatacttgagattattctaacactttgctgagatggattccaaggataatccagcaatatcatttttagtaaaaaccagcctacaaaggaaaatttatattttactcatatgactgaatcaggcccacccaggacttcctcttggttgaggcacttaaggatatgggacttggattacatctatcaagtcctttcaggcagtgcctaaaccagcctttgtttggataattgggagagaaatggctagactttgactagggctgtcattccaaagaattctgggacccacagtcctaacggcaaaacaagagtctctacaaataaacttccacaatttctgatttttttttttttttacttcactgagagtttccggtcaaacaggaagtgctgaaaccccagcatctatataaccacctgtggaattagcagatttttctttattttgggattaaaatagtgcagacacaaagggactttcctgtggacaacagcaatagctgttttaaaaattctacaaactaagaataggagggagttttcttacactgataaagagtataaaaaaaatctgcaatcgatatcatactgaacggtgaaatgttgaaagctctccctaaatagaaatagaaaaagcccaccaaaatattaacaatgcttatttctgggtagcagaataataggtttagggtgattttttttgtgtgtatttttaaaaattttgagcttttctgtatttttaaaaatttcttgcaccacccccccatctattatttgtacaaaaggagcttccctgctgcatacaggatgaaatcccatctccttagtgtgacatattgtccttgtttagctttcccatctcttctttcatgcctcccctttgtcccccaaataggctcacacaccttttgctcacagccttttctatttcctttgatggtcttttccacctaggaactctttgaggttcagtggaggtgaaagagggcctgagtgttttagccctccttcactctcatagcaactatcagactccatggaaatgatctgacaattaagtacaacttgtaacgtctctaccaccatagctttcaactgttatctgattttcttttaactttttgtatgttcttgttctctccaactaggttataagcgacttgttgtatttttcatgaagtctagggcaacacagcaggtatttgtggtagcagaataatggccccctaaagatatccacgtcccaatccccaggacctgtgaatatgttaggttacacggcaaaggggcattcaggctgcagatggaattaagattgctaatcagctgactttcaaatagggaggtgattctagattatttatccaggtgggcccaatgttatcacaagagtccagaaaagttgaagaaggaggcagaacaggtcagacaagatgagatgatggaagccaggttcaaagaatgtgctagaaaaggacccaaccttccattgctggctttgaagatggaggaaggaggccatgggccaaggaatgtaggcagcctctagaagcaggaaaaggcaaggaaatgggatgtcccctcagcctttggaagggactgcagccctgccaatcggtaccctggatttagtccagtgagacccatgtcagacttctgacctacagaactgaaaacattcaaaaaatacgaaaatagagtgatggttaagtattggttgttttaagccattgagtttatggtaatttgtttgatcagtgatagaaaactaatagtgttaaatattcttttccttcattcacattaaaatcaagaaagataaaactaaagttgttgaagtaatggacaaatttaaagatatcctttttgagaacacctttcctaatcactcccaaatgctgtcacttcttcatttgtccttactgcttatattatatcacttatcatttgttctactttattttataactgtgttaatatcctttcctgggcatatgttttcctctgattcaaaagaatctttagaagcaggggccatatactcattccctaggtattttctgccagaggtaacagacttcagtctataaatgcctgattactaacatcttacattatgggttactaaacaggccgtttagtctgttttcaacaacgtcccagaaatgttttcaaaagttttatttcagccttatacacaagcaccctaaaacccctaaaaattctgacaagatcaataaatatttacaaaatagatttactttgtaaattttaatttcattggatatgttccctaaaattttatgaggttttatgtttttacagaattttatggtagactctttcaagaaagatggatatatttatctttacagatggtaagactggggaactgaggtaggagaatgactggtccagactgggagaggaaaaaaggagtctggacaccaccaaatctttaccagacctggggaggctccagggtggaagacggaaggggcggagccactggacctgagagggactgtttggaagttagtctgcttttgtgttgaaattcaaaatcagcatagaacctttaatcaactataattaacaggctacacttggaagctatggctaaaatttctaggctgtaccagaattaaagaaaagtaagcaaataaataaatggtcagttggacatgagacagtttggcatcaaagtaaccctggggaaaaaaaaacaaacgctgatgtacaaatggagttatgggccactaaccacgtggtgctgtagagaagggatctggtgaggcagctggcccttcatcaaatggcctaactccagatgcagggccaggccaagtccttcaggtcagcttctgtgatctggctcagagaagccctagaaaatgttgcttaccctgatttctccaaacataaaattggggcagcgggatttgccatttctgcgtagcctaggccagtggtgagagttaattagtgtttttaaagtgctgtggatttggtttggtttgtgtattttctcgggatgaaagccaggatgccagcaccaagtgttaacagtgaaggtttcatgcgtgctccttgagatgtgctgtgtgaagtggggtggaggggatacgaggcttgtgggactgcctttggcatcaaaaaggccacatttccaaacagactttagtgctccccaaagcggagggggcagactagaagcctttgaaaattaaaaaggagaaagctatctgtgttttggctctgtgattgagggcatgtagcaacccacaccaaggaaaatttgacgagctgctaaagacaaatattggcaactagagacgacacaaaattctaactgctctgacctagtacaggcaggcacggaagcagcaactcccactctataagaacccagcagatttcagatattccatgcttaccggaaccctccttggaggtggttttcacaaataaagctttatggctttattcctgattaaggaagtcacatgtgctcataatttaaaattaaaactagagaaatacataaagtgaaaagtgcaactttcccaccctgccccaatcgtagcagccagaatgtaattgttgttcactgttgtttggacatatttacaggagatattgttataatcgttcccaacgtataggtgatgaaacagatggctggaagaacttacccacaagctcacaggaaataagtcagagctggtattgaataaaacccagggctttctggcacccccaaactctacctgttttactaggtgacactgcccaccccacacacagctccctcatccccccagcaccctccagtggagtgaatacaaggcactgacagggcttccatgactagctctacaagcagaagctaccaccatctgcagagtcagattacatgtgaatctagcaaggctaatgtgactactcgacccatttttccagcctcctttaaatgagtcatgtcccatcaacatgctattatataggtgagatgatcgtaactcatatctgggtgcccttctcccacaagacaagggtaggacacaaagcgatgagacctgcgaaatcagtaggacatgatgtacatgccgggtctgaacagccctgagttccagctctgatatttaacagcatgcatgacctggtgcctcagtttcttcacttggattataaagagtgaacaaactgccaaggggcccttagcctctggcattctatgcaatgctgagcaatctgtagcagggtgagccccatgcattccccctaactcttgattctgcttaatatctaatttcaggctgaaagaaagatgcctctgtgtcactacttctctaatagacccaaaaagaaataaaaatgccttgaaaatgatgtatgaaattactattgttctcattagactgattctaatcgaatcagctgatgataaattattcatttattagcgtgcattctttcaatatgtattaatctcttatacataagacaccgagagaactatacaatgaagccttgctctccttatagctccggatggggaaaacacgtgaatataaatactgcactatgaggcagcaagagctcaccgtcctgggaagctccagagaaactcaagggactcaagttcaaaagaatcagagagggcttcacggaggagtaggaatgtgcactgaactctacagaaggcgcagggcaacaagggagataaacaggactgaaggagggcattgcaatggtgctgaatggtgggcgttgtaggagggcttgctagtggacagctgggaaccaccaacagccttccagcagggtggggagaggctgtgtccatgccctcttccagactcttccagactgggttttagccagacctttaggtttggctttagcttaactgatctcgagtatttataacagtacctcatgcatcccaggccatcatcgtttatttatttactgaataaacaatcttggaaatggcaacataatactgggaaatggctctgaatgtcgctctgaggaggaaacagggagcagctccaagcattccaacctggacgactcttggatctcaagcatggatttggcaattgcaccacagaaaatgtgtgtgtgagagaggagagggtgggaagaaggctgttctttcaccctataatcaggagcagaaataacatctcattagaaactttaaagagaagagggcctttaaatgaaatagtaacaaagctgtatggaatcactttgaagagctggcctttggtggggtggaaaatgctaacatctgtcactgcccttcatctataatcaagcttctaccagcagaatgtgtgtgtctcctgtgtgtgcgtacgttttaaatatatacacctatgttacatgatcggatatgtgtgttccagccatcatagaatgccacgtctgacttccaaagtgagtcgtggtctcagatggggcaggatcattactgcagaacagccaagatcaagcccggcacctgcaggataggtgtatatgtttttcctcaggcaaaataatgcctttgaagcagttctccttgtggtctgagccatgcttgctggggccttgcaggagtgtggaatttggggctggagctctccttggaaccatgtagagctgaattcagacctgcaggacctcttgcctaccctgggattatggctgttccccaccactttagaggtttccaggctttcccactaatcagcttcaatggtgctattccccaggctctctcacgggtttcttacactgaccaccctgtgctgctggacgaagacagaagtattttaaagacatggaggaataaataattcttaggagttttctcagaagggaacaaaggaaaagagaagggtactatctgaacagagaccaaagcacttccaaggttacttcagaacaaagccttcaaaaatgaataaaaagtctcctcaaagcacacaggaaagcaattacatcccacactctgacacaggtcatgaagctgggaggcagtggagggaggaaggggataaaagcagagctagggttggggcactgagataaccagtgaatgatgaaacaaccagagggaacatcccagaaaacaggagcagaaccgaactcagaacagcaagaagaggcagagccccagactcagagggaagtcaggccgagccaggccagaggcaaaggctttataaatctctatttgtctattgaggaggtctgggaaaagggatgaagttgggcagggaaatcccacatcatcttttctggccgatcttttcaatgcagggagcgatgagggtgggcacttagaagctgaatgaacagtttcaaacatctgtatataatgtcaattacaacttaataagtgacttgtagcttctaagttatttttacttaggcacaaaaggtaggtttggggtttaaaaggagtataagtggccatctggaggtacttttaggctcaggaaaggctgtaagacaataaaacaatgactttgacaggttgatctgtttatcattcattagcagatatttactgatattaacccaacaacttactacgatgttaggttctgtgctacggagaccttactgtgcatatggcagtaaatgaaaaagatagagaccctattctcatgcagtttctcttcagttttggaaggagggaaagttacgttttatttattttttatatttttaaattgtggtaaaatacaaacaacataaaatttactatcctaaccacttttaattgtatggtccagtggcattaaatacattcacgttgttatgctgtcatcatcaccatccatctctacacccactcaacaatcatgccccattctcccctccccacaacctcaggcaaccaccattctattttctgtccctatgaatctgaccactttaggtacctcatgtaagtggagtcatatagtttttccttttgtgacttgcttagcataatgtctttaaggttcatccatgttgtagcatgtattagaatttctttcactgttagtgctggatactatttcatggtatatatatgtgtatatatatatatatatatatatatatatatatatatatgccacattttgtttattcatccattcactgatggacatttgggttgctactaccttttggctgttctgagtaatgctgagtaatgctgctacaaacatgagtgtacaaatacctgttcaagcccctgcttttaattcttttaggtatatactcagaagtgggattgctggatcctatgataattctatttttaatattttgagtaatcacacaatgttattgtccatagaggctacattattttactttcccattaacagtgaataagggttccaatttctctacatcctcaacaattcttattttcccctccctccctccctcccttccttcctttttccactctctctccttttctttctttcattttttaaattgtagtcatcctaatggtataatttacgtatgcatccttgagactttatgctttactgcagaatggtgaatctcctgatctatgagagatttggtgacccctggtgtgtgtgcatgtttctctatgaatgtgtacgtgtatcaatattttgtgccgatctttgagtatttttactgttagtatccaagccacaacctaccatgtgcatgtgaccatgaaaaaaatcctgactccaccagcaggatgggcctctgggcaccctataatttgactaggggaatggggtgtgtgttggcagggagcgggggaggtgtagctgctgaaatccaagaggccagcttctgggagcatgtggtgctaggcagagggcagaaatctcctgggaagtgcgtaatgcctattcgtatgattcacaatcagaggagacattggtcaacaaaccccaggatgacccactaagggaaagaggagatagaaaagcggatcgatacggtgatgtttcggaacggaaatcagaaaggtggccaggatatagtaataagaaactcataaaataattcaaattcctctagtgcatataatgtttctagcatttgcacttgtgtttatctatttatgatcatgcctttggcaacatcactgcttatcaatggacacactccttctagcaggcagaaaaaggagagaagcagagtaagcagctttgctcctttgaggtcccattcatatagagacccacagaacactgaagccagagggaccttggagatcatttaattccttctttactccacaggtgaggaaactgacgaagtggctttagggaaggtggaggtggaacgctaccttcttctcccgcagtaagcaccaacgatctgggaagagctggagtgagaaaccacagaaatgcttctgtgataacactgactccattgttaaccctcagtttacacccgagattggctacttctgatttaactccacaaaagcctctgtgctctatgaatatgatatccagacttggctgtcccctaagtacatgtttttttatagctggatttaatttttcctcataaatgaattgcatagaaaaggaaacgggcttgtatcatcatcctaaaaatgagcaggcacccaaagacagctcttcttgtttcttcttctgcctctcagtagagtgaagtgaatataaaaactgggcagaaaaggcccatgggattgccatgtgtgaggaggtgggtggcaccttgctacctgcaggcacagacagcagagaacgctgtgtgtgtgtgaagcaacagtgaatgtggttctacatccttgcaagagctgacaatgtccttcgttatctgcaggagtcagagcaggagtcccaagctggtggggaagccaacatgaaggcctgggtgggctccagagagggaaggaagagcagcagaaggccaaagaggatgcctaaatttgtggcggcagtactgggtcttataattctaccacataatacataggaaactgagtccaagagaagtaaatgtccttacagtctatggatggcaagattaggaaaattttctattctaatttccatgctcttaccaacttttactctggagaaaccttttgcctgtgctgttattttgctagggccctttaggtaagacaggagaaagcacagcaagttgcaccaagaaccctgcagcacacagtgctgtggtgatagtgtattcgtccgtccttgcattgttataaagaactacctgagactaggtataaataagagaggtttaattggttcagggttccacaggctgtacaggaatcatggctggggaggcctcaggaacttacaatcatgacagaaggtgaagaggaggcaggtatgtcctacatggctggagcaggaggaagagagcgaagggggaggtgccacacactttcaaacaaccagatctcatgagaactcactcactatcacaagaacagcaagggggaatccatgcctatgatccagtcacctcccgccgggcccctcctccagcatgggggattacaattcgacatgacacttgggtgggacacaaatcccaaccatatcacataggagtatagttctcaagctcctacttcaaatgccaaaccaaaatacagcttagtgagtgaggggtcttaaggtttttcatttgtaggtggaatttagcaggtgaagacatttacaaccattataatgtgggtggcatattccacatatcccctagacctaggttatactgggctttgcagtgcattaaattactcagaaagttttaaagccattcctgcctccccactattctcttccagccacccttagagactttgatatgactgaaatgtatctcttaggtgtactggggtagagaaaagtttaggagtcattgatgtagcctcacagtaactattcacagctctgtgatcagctcagctgatcaacttacttcctagcaccttctagaaggggtttttaggccaatagaaatataatgcaagtcacttatgtaagttaattaaaattaaattttctattagccacattaagaaaggaagaggagagaagtaaaacactaacaatatatttaattcaatatatccaaagtattatcctttcaacaaataataaatctataatattgtatgcatataatacataggtgtactaagtcttgaaaatcggatgtatatattctactcacagcacatctcaatccacagttagccatattttaagtacctgacagccacatgtggcctgtggctactatactggacagcacaaatctagactgttcttacagtccttagggctcaaaccttgcccttgcctctctcactgacatgcgtttactccaaaagaaatagaaatttctccacgatgtagccattctcgcctgtctcagggccctttcctgtccaggtcttaatgtgtccacttggtctttattgcatctcaactctccaattgtccactgagtcatcaagtaatcattactgagtgcctagcaagctcccagtatttgtgttaactgacaaggataaaaaaatacaggagatgctgacttccaggagctctcagcttggaaatgcaggcacaaacacgaacatgtgagggatgctatacggagacacatgcacacaggaaggagtgactgctccttctggggctctggaaagcattcacagagggagacatggggctgggtttttaagggatgagagagattatagacaggtagggaaaatgtgtttcaggcatagggaaaagcatattcatgacagtacgatgatctgcatggagatgacaagtgtctaggaagtgagaacatgacaaggagtgcctggagtgaggctggccgggcaagtggggcccgagtgcctggtgacacatttagaatgactgtggggtaattctctgagcaggaatctctgaatgagaatattttgtggtgagctataatgcagtttggaaaaaacaaagaagtaaggagagcctgaactaagtgggcagcagtatgtccagaaaggagcggatgggagcccccatgtgaataagggaatataagggcactgtttgcaagatgagcattatgatgaaagctgggcaaagggtctaattgctaaggctttctatgcccaaactcactatgctgagggcattagggccactcgcatggtatttatacaggcctattacagtccgttgtgatctggaagcactacatgcatgcctgccctgaaggaaatggtaaggctctttacaggttaatttaggcaggaggcagaatcaagcggaatcacttccaggactgctaggaaagtcacacttgtgacacccagcaggtgttgggcagtacctgaccagcccaatcagataatgtggttgctcacactacctggaacccaactgtggcttatctgactgtgagttttctggaaggtggctctggagctctcaggtaagaacagggcagcaacatgacatctacagtgagaaggagcctcagagatgccatgagttcttcttttgtaaatggggaaggctggggcagggagagttcaatggcttaaaggctagtaagcggcagagcaagaatagaattcacctttcttatttcataagctggtgttgctttcacagcacactgccctctgagatgagcgggagatatgtcccgaagaactgtttacctttatagcaactcaggaaaaaagagaaagctaggctagagacacactaggtaatcaaaccatcttggtgggccaattagatttaatctagtagcaatgcactggtactcacacggtgaagagtccacgaagttcgggtcaatattatgcagcagctcaattctgggggatgggcttccttcactggaaaacaatttttaagggaatgttaatttcctctctctaatgggcatgaattattttaatacttcccttccttgtacttataggaaataacaaacctgccagttaacaactctgtcatgaatttggaggtctccacaatcacggctggtgcatcttcaagcagtcatcgtttgtttacattgaccgaaccctttacataagaacttcagtgtcaagcatatgaagatattttaaaaaatgattctgggaccctttgaaataaatattgtggccttatttaaacatgaccattttttacaccagagaaatgagaactcaagtcacctcatatagacttcatactgaacacttacgagtaaatgaagaaactgcatctgccaaaatggtggcaccaatattacagatgcaacatgcctcttaaagagtaacctacatcagaaaaattaatgtcctccatgtccaaatttgcaacacggatcttagatttaatataaatacatgagaaatacctagatctctttaaggctttaaaaaatgtgtacacacaaatacaatcacaacctacatttgtgctgaaaagtgacttggagatcgcttagttcaaccccctcttcttacaaatgatgaaggtacatagtaagttattggtagaatattgggttgtgtgactctcaaagcagtgttcttaagaaattgggagcataaacatcaccagatgtatgtagggagcacaataggcacccaggtcattttgctagtgtagactcagccttacagaagtagctaaaaacaatttaaatcattgagggtgtactgaggactccctgataatctaatacagttcagctaagtactaaaggttgcaaagtactgttaacaccacaggattcatacataatataaataatcaataaggctcctgacgtaaccaagacatggtttcaggtgtcccagtgtccacacgccaaactcacagttagctgttgatagcagtggtttgggatttcaatgcccaatacaatttcaaaaaatctgggttgtgattcacaactttgtatttgccaagtaaggaaatataaaaacaaatcttaatgaattaatttaaaacaaaacaaaataacaaacttcaactaccatcaccattattttataaaataaacagcaaaaaaggtaggaaagacacgatctctgaataaataacagctccttaaattgagcatatttaactttggtattctatcagatgtcattgtccccctctactccataaatcacagtgatcagagacagtggaagagaaacattcaggggtgcccacggtcctgggacagcagcggcagcactgcaggggtgggggtggggcatatttcccaggacctttcttttctcattttctttcggagacacttaactgcctgaatatcctggagactatcaaccagtccaaaatgccaggaactacggtttgatcccagaagctctgaatggaagtagaaatgatatgtaaagaaaatggtaaatatgagaaaatctaaatagaatgatgatgatgtctaatttgtgggcttaaaaccaaacaagtatgccaggtacaatggctcacgcctataatcccagcactttgggaggctgagatgggaggatcccttgaggccagccaggagtttgagacaagcttaggcaacatactgagacctggtctgtactactactactactactactactactactactactaataataataataatttgagcatggtggtgcatgcctgtagtcccagcaacacaggaggctgaggcaagaggatcccttgagcccaggagttcaaggctgtagtgagctatgatcacaccactgcactccagcctagatgacaaagtgagactctgtcttaaaacaaacaaacaaataaaaccaagcaaacagagttaaaatcctggaaaataatagcaagcaaggaaaggaaatcaaatgaaagcattttaaagtatttatattgtttggaagtggggtaaagctactgattaaatttagatttagctaagtaaaacttttgtgttaaatttttagggcaactattaaaaataaaggctttttctggactataggttgaaaactcaaaaatttcagggccagtatattaatacataactacgcagctttaaaagtagagttcactgtaataccccaaaatattaggcacaattaaataaaaacattttcctaataactttagagagagtttatatacatactcttcattcatgtcatttttttcattattcagaagagtcacaggtattttaaaataagtaaatttaatacgatgagatgattttttgaaaccaagcgttgtgtataatcctagttgattgttaggaaaaatcttcataggcagaatcatcatgatgcaaataggagccaacccctccaactatcttaagtatgttgtcattctacttttaaaatgcactcatcagaatattttgataaggatgtggttagagatatgggccaagaaaacacaatatatgacaagtgattgaaacaatgaccaaacaccattagggacttcctgagggggaggtagagagggattgtggatttccgttaatagttaacactttattaacacagattcaagtaattataccctccaccaccacacacacacacacacacacatcaacttaagaaggcacagaaactgcatggttaatttcagtgcagacaagggtacagtgtactgatactgcaaccaagaaggtgggttcaagtcacctggagaagacaatctgggggcatgggacagaaacggagcttgtcggaaggaggggaaggggtgggtgatgagaagtctcaaagctaactctgcaagcctcataattttgcctaggagatatttcagagtcataattttgaaaagaccagtaaatggcagagacaatggtcattagagagacatggccgattgctggggaggagaatcctcagggctgaatgccatatataggaagagcatgccccagaccctgcgcagggcccactgtctactgaggagttaaaatttccccagaccgaagaagctggacatgggtacacagcttgggaagaaatgttcaccaccatattaataaactttctctttataaattcaaagaaagggaagttcagtaaatacccatatgttttcagcattaaagaccctcttaagaacccacaaattcttggccacttaaatttgagtagtctccaataatcacatgaaagatccctctcttggatttagaaggaaaatgcctggtgtgtggtgagttttctgtttttgtttttgtttttttccctttttttttttttagagaaaacgttttccattgttgtctcactgccatcccttcctcactcctctggaaatttttgatatcaataatctccactttcttatgcatgttcatctatccttctgttaaaaacaaaataagaaaattttattaaccatcttatttgccattaggtatcttgttttttgcagtactcattctcaaactttgctgtacattagaattacctgggaagcttttaaatcccagatgcacaggctgcatctcatacccgtaagatcactggcggtggaacccaagcattggtacttttggactctccagatgattccaatgtgcagccaagcatgggaaccgctgctcctaagcagtgcttcccaaaccttaatgtacatatgaatcatctggggagcttgttaaactgtggatcctgatgtacttgaactgaatggggcccaataatctgcatttctaacagtttcccaggtgacattgatgctgctggtctcagaaccacacttgaggtatcatggtttgaggaagcctcccggagtccttccacatgggatctcaactcttttggagtctcttaaattaaaatcttatttggattagggctgattcaaacataatgattctcaaccttggctgcacaatacaatcacctgaagaactcttaaaaaatactgatgcatgggttcaatcccaggagactgagttctgagtttcagcctgggcataaagatttataaaagcacccaaacttagctttattgaagtataattttaaaaccatacaatcacccatttaaactgcacagttaaatgtttttggtatattcacatggttgcacaatcatcaacagtctaattttagaacatttttatcctcccaaaagaaatactgtacccattagcagtcattcttcattttctacttcactcccctccccagccctagccgattgttaatctgtctctacagatttgcctattctggacatttcatataactggaaccacacaatacttggccttttgtggctggcttctttcacttagcataatgttttcaaggatcatcaatgtggtagcatgcatcaaatatttcattcctttatatggctaaataatatcccattgcttgaagatatcacattttctttatccatttacttggttagtattttgattgttttcaatatttggctattatgaataatcctactatgaacattcatgtacaattttttgtgtgggcattcgttttcatatctcttgggtctataactaggagtggaattgccaggtcatatggtaactctacaacattttgaggacttgccgaacaattttccaaagcagctacgccatttcacactctcaccaggaataagtgcttcaatttctccacatctttgacaacacttattaatgtgtctttttgaatgtagccattctagttggtgtaaagtgatatctcattgcgatttgatttgcattttcctaataattaatgatgagcatcttttcatgtatgtattggccatttatatatcctctttggagaaatgtctattcagatcatttgctcgtattttaatggggctacttgtctttttatgattgagttgcatgaattctttatatattctatttgcaagtcccttatctgatacatgatttgctaatattttctcctattctgtgggttgatttttcacttccttgagaatatcattttgagaataaaagtttgcattttgatgtagttcgacttatgtattttctcctgtgttgcttttatctaagaaactactgtctgacccaagatcacaaagctttactcctgagttttcttctaagagttttatagttttaattcttacatttaggtctatgatccattttaagttaatttttgtgtatgctgtgaggtagagatccaacttcattatcttctttttttattatgtttaattgacatataaatatacatatttatgggctagagtatatttcaatatatgtgtacaatgtgtaatgataagtcagtgtaattagcataaccatcacctcaaatatttatcatttctctgtgttgggaacattcaaaattcactcttgtaacttttcaaaaatatacaataaattgttgttaatgatagtcaccctatagtgctatagagcactagaccttattcctcctatttaattgtacttttatatccattaactaacctttggctattctcctctcccctacccttcccacccctcaggaaaaacactactctactctttgcttctatgagatcaacgttttttagcttccatgtatgagaacatgtggtatttatctttctgtgcctggcttatttcacttaacatagtgaccttcagtttcatccatgttactgtgaatgacaggatttcattttgttttatggctaaagagtattccattgtgtatatataccatattttcttcattcacccactgatggacccttaagttgattctatatcttgggtattgtgaatagtactgcaataaatatgggagtgcacatatctccttgatatactgatttcatttcctttgcatatatacccagtagcgggattgctggatcatatggtagttctatttttagttttttgaggagccttcatattgttttccacaatggctagactaatttgcattctcaccagtggtggataagagtacccctttctctacaacctcgccaggatctgttattttttaactttttgataatggccattctaaccgggttgagatcatatctcatcgtggttttaaatttgcattctctcatgattagtgatgttgagcatttttaaaaataaatctactagccatttgtatttcttattttgagaggtgtctattcagctcatttacccattttaaactggattatttggggggtttttctgttgaattgtttcagttccttatatattctggatattaatcctttgttgaatgaagagttagcaaatattttctcccattatgcaggctgtctatttgctctgttgattgtttcctttgctgtgcaggagattttagcttgatataatcccatttgtctatttttgcttttgttgcctgtgcctttgaggtcttctccataaaatctttgcccagaccaatgttctgaagcatttctcctatgttttctttcaggagtttcatagcttcaggtcttatatttaagtcattaacccattttgagttgatttttatatatggtgagagatacaggtttggtttcatttttatgcatgtggatatccaattttcccagcaccatttattgaaaagactgtctcttcctcaataaatgttcttggtgcctttgtcaaggatcagtaggctatacatacacgaatttatttctaggttctctattttgttccattggtatatgaatctgtattttacacaagtaacatgctgtattggttactatacctttatagtatcttttgaaacctggcagtgtgatgcctccaactttgttcttttcattcaggattgctttggctatagggtcttttgtgggtgcatgtaaattttaggattttttaatttctgttgagaatgttattggtatttagatagggattgcattgactctgtagattgcttttggtagtaagatcattttcacaatatttattcttcaaatctatgaatatgagatatcttttcattttttgtgtgttctcttctgctagcttgttgctggcatatagaaatgctactgatttctgtatgttgattctgtatcctgcaactttactgaatttgtttatcagttgtaagagttttttggtagagcttttagggttttctgtatatatgatgatatcatctgcaaatagggacaatttgacatcctcctttccattttggaggtcctttatttctttctattgcctgattgctctggctaggacttccattactctgttgaacaaaagtggtaaaagtgagcatcgttgtcttgtttcagatgttaggggaaaggctgtcaactttttcccattcagtgcgatgtttgctatgggcttatgatatatggcctttatcgtgttgagctgtggtccttctataactaattagttgagtgttttgattatgaagcgatgttgaattgtatcaaatcctttttatgtatctattgagatggtcatgtggtttttatacttcattctgttgatgtaatgtgtcatgtttatggatttgtatatgttgaaccattcttgcaactttgggataaatcccacttgataatggtgaatgatcttttaaatttatttttattttttgagatggggtctcattttgttgcccagactggagtacagtggcttgatcatggctcattgcagtctcaatctcccagactcaagcaatcctcccacctcagcctccctagtacctgggctataggagcatgccaccatgcctggctaatttttaaattttttgcagaaatgggatctccctctgctgcccaggctggtcttgaactcctaggttcaagtgatcctcctgccttggcctcccaaagccctgagattacaggcatgagacaccacacctggctgtgaacgatctttttaatgtgttgctggattcagtttgctagcattttgttgaggctttgtgtgtctatgttcattggggatactggcctaaagttttcttttcttgttgtatctctgtctagttttggtatcaacataatgctggtcttgtggaataagtttagaagaattccctcctcttcaattttctggaagagtttgagaagaatttttattagttctttaaatgttttgtagaattctgcaatgaggtcatcaggtcctgggcttctcttcaatgggagactttttattacaagattcaatctcattacttataattggtctattcaggttttctatttcttcttggttcaatcatggcacattgcatgtatacatgaatttatccatttccactagattttctaatttgttggcatatagttgttcataatagtctctcatgatcacttgtatttctatggtatcagttgcaatgtctccttttttgttggtgattttatttggaccatttacattcttgattcatctagctaattatttgtcagttttgttaatcgtttcaaaaaccaacttttaatttcatcgatcttttgtattattttttagcgtgaatttttttattttattattattattattttattattattatactttaagttttagggtacatgtgcacaatgtgcaggttagttacatatgtatacatgtgccatgctgttgtgctgcacccattaactcgtcatttagcattaggtatatctcctaatgctatcctcccccctccccccaccccacaacactccccagagtgtgatgttccccttcctgtgtccatgagttctcattgttcaattcccacctatgagtgagaacatgcggtgtttggttttttgtccttgcgatagtttactgagaatgatttccaatttcatccatgtccgtacaaaggacatgaactcatcattttttatggctgcatagtattccatggtgtatatgtgccacattttcttaatccagtctatcattgttggacgtttgggttggttccaagtctttgctattgtgaatagtgccgcaataaacatacgtgtgcatgtgtctttatagcagcatgatttatagtcctttgggtatataccccgtaatgggatggctgggtcaaatggtatttctagtctagttctagatccctgaggaatcatcacactgacttccacaatggttgaactagtttacagtcccaccaacagtgcaaaagtatttctatttctccacatcctctctagcacctgttgtttcctgactttttaatgattgccattctaactggtgtgagacggtatctcattgtggttttgatttgcatttctctgatggccagtaatgatgagcattttttcacgtgtcttttggctgcataaatgtcttcttttgagaagcgtctgttcatatcctttgcccacttgttgatggcgttgttttttctcgtaaatttgtttgagttcattgtagattctggatattagccctttgtcagatgagtagattgcaaaaattttctcccattctgaaggttgcctgttcactttgatggtagtttcttttgctgtgcagaagctctttagtttaattagatcccatttgtcagttttggtttttgttgccattgcttttggtgttttagacatgaagtccttgcccatgcctatgtcctgaatggtaatgcctaggttttcttctcgggtttttatggttttaggtctaacgtttaagtctttaatccatcttgaattaatttttgtataaggtgtaaggaagggatccagtttcagctttctacatatggctagccagttttcccagcaccatttattaaatggggaatcctttccccattgcttgtttttctcaggtttgtcaaagatcagatagttgtaggtaagcggcattatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcaatgtgggctcttttttggttccatatgaactttagttttttccaattctgtgaagaaagtcattggtagcttgatggggatggcattgaatctataaattaccttgggcagtatggccattttcacaatattgattcttcctgtccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgcatcctgagactttgctgaagttgcttatcagcttaaggagatttggggctgagacgatggggttttctagatatacaatcatgtcatctgcaaacagggacaatttgacttcctcttttcctaattgaatgccctttatttccttctcctgcctaattgccctggccagaacttccaacactatgttgaataggagtggtgagagagggcatccctgtcttgtgccagttttcaaagggaatgcttccagtttttgcccattcagtatattggctgtgggtttgtcatagatagctcttattattttgagatacgtcccatcaatacctaatttattgagagtttttagcatgaagtgttgttgagttttgtcaaaggccttttctgcatctattgagataatcatgtggtttttgtctttggttctggttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctgcctggctttggtatcaggatgatgctggactcataaaatgagttagggaggattctctctttttctattgattggaatagtttcagaaggaatggtaccagttcctccttgtacctctggtagaatttggttgtgaatccaactggtcttggactctttttggttggtaagctattgattattgtcacaatttcagagcctgttattggtctattcagagattcaacttcttcctggtttagtcttgggagggtgtacgtatccagtaatttatccgtttcttctagattttctagtttatttgcatagaggtgtttgtagtattctctgatggtagtttgtatttctgtggtatcagtggtgatatcccctttatcattttttattgcgtctatttgattcttctctcttttcttctttgttagtcttgctagcggtctatcaattttgttgatcttttcaaaaaaccagctcctggattcattaattttttgaagggttttttgtgcctctatctccttcagttctgctctgatcttagttatttcttgccttctgctagcttttgaatgtgtttgctcttgcttttctagttgttttaattgtgatgttagggtgtcaattttggatctttcctgctttctcttgtgggcattcagtgctataaatttcccactacacactgctttgaatgtgtcccagagattctggtatgttgtgtctttgttctcgctggtttcaaagaacatctttacttctgccttcatttcgttaagtacccagtagtcattcaggagtaggttgttcagtttccatgtagttgagcagttttgagtgagtttctgaatcctgagttctagtttgattgcactgtggtctgagagacagtttgttataatttctgttctattacatttgctgaggagtgctttacttccaactatgtggtcaattttggaataggtgtggtgtggtgctgaaaaaaatgtatattctgttgacttggggtggagaggtctgtagatgtctattaggtccgcttggtgcagagctgagttcaattcctgggtatctttgttaactttctgtctcattgatctgtttaatgttgatagtggggtgttaaagtctcctattattattgtgtgggagtctaagtctctttgtaggtcactcaggacttgctttatgcatctgggtgctcctgtattggttgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctttgtgtgtctctgcacatgagatgggtttcctgaatacagcacactaatgggtcttgactctttatccaatttgccagtctgtgtcttttaattggagcatttagcccatttacatttaaagttaatattgttatgtgtgaatttgatcttgtcattatgatattagctggttattttgctcgttagttgatgcagtttcttcctagcctcgatggtctttacaatttggcatgattttgcagcggctggtaccgattgttcctttccatgtttagtgcttcaggagctcttttaggacaggcctggtggtgacaaaatctctcagcatttgcttgtctgtatagtattttatttctccttcacttatgaagcttagtttggctggatatgaaattctgggttgaaaattcttttctttaagaatgttgaatattggcccccactctcctctggcttgtagagtttctgccaagagatctgctgttagtctgatgggcttccctttgtgggtaacccgacctttctctctggctgcccttaacattttttccttcatttcaactttgatgaatctgacaattatgtgtcttggagttgctcttctcgaggagtatctttgtggcattttctgtatttcctgaatctgaatgttggcctgccttgctagattggggaagttctcctggataatatcctgcagagtgttttccaacttgcttccattctccccgtcactttcaggtacaccaatcagacgtagatttggtcttttcacatagtcccatatttcttggaggctttgttcgtttctttttattcttttttctctaaacttcccttctcgcttcatttcattcatttcatcttccatcactgataccctttcttccagttgattgcatcagctcctgaggcttctgcattcttcatgtagttctcgagccttggctttcagctccatcagctcctttaagcacttctctgtattggttattctagttatacattcgtctaaatttttttcaaagtttttaacttctttgcctttggtttgaatttcctcctgtagctcagagtagtttgatagtctgaagccttcttttctcaactcgtcaaagtaattctccgtccagctttgttccgttgctggtgtggaactgcgttcctttggaagaggagaggcgctctgtttttagagtttccagtttttctgctctgttttttccccatctttgtggctttatctgcttttggtctttgatgatggtgatgtacagatgggtttttggtgtggatgtcctttctgtttgttagttttccttctaacagacaggaccctcagctgcaggtctgttggagtttgctagaggtccactccagaccctgtttgcctgggtatcagcagcggtggctgcagaacagcggattttcgtgaaccatgaatgctgctgtctgatcattcctctggaagttttgtctcagaggaatacccggccgtgtgaggtgtcagtctgcccctactggggggtgcctcccggttaggttgctcggggttcagggatcagggacccacttgaggaggcagtctgcccgttctcagatctccagctgcgtgctgggagaaccactgctctcttcaaagctgtcagacagggatatttaagtctgcagatgttactgatgtctttttgtttgtctgtgccctgcccccagaggtggagcctacagaggcaggcaggcctccttgagctgtggtgggctccaccaagtttgagcttcctggctgctttgtttacctaagcaagcctgggcaatggtgggtgcccctcccccagcctcgctgccgccttgcagtttgatctcagactgctgtgctagcaatcagcgaaactctgtgggcataggaccctctgagccaggtgcgggatataatctcctagtgtgccgttttttaagcccattggaaaagtgcagtattagggtgggagtgacccaattttccaggtgccgtctgtcacccctttctttgactaggaaagggaactccctgaccccttgcacttcccgagtgaggcaatgcctcgccctgcttaggcttgcgcatggtgcgctgcacccactgtcctgtgcccactgtcttgcactccctagtgagatgaatccggtacctcagagggaaatgcagaaatcacccgtcttctgtgtcgctcacgctgggagctgtagaccggagctgttcctattcagccatcttggctgccagatctccgtgaattttgtttatttctgctttcatcattatttctttccttctactaattttggatttggcttgttcttgcttttctagtttcttgagatacattgctacgttgctgattggaaatccttctactttttggatgtaggcatctattgctatacattttcctcttaacacttcttttgctgtataccataggtttttgatatgctgtatgtctattttcatttctttcaagacatttaacattttccttcttaatttctttattgacccattgaccattcaggaacgtgtttaacttccatttccatgtgtttgtaaaatttcaaaagttcctcttgttattgatttcattgtggtcaggaaagatatttgagatcattgcagtttggtggttttctgcagtaacaaggttttctcttgtttctctttctcctttgtgcatctgctctaccagcgagttttacacttgtgtgtgttttcatgagaatgattatcatcttttttcttccagatacaggactcccttgactgtttcttgtaaagccagtctagtggtgatgaattccctcagtttttacttgtctgggagactttctttctctctcatttctgaagggtagatttgctgggtatcgcatgcttagctgacaatttttttttcttttggtactttgaatacatcatccacttctctcctggcttgtcaggtttctgcagagaaatatgctgtaccctagaatggcagaacacagctgttatttgggccctggaagacaatgtgcagcacagcaatgactccactccccagagtcaagggtatctcagcagctcagacttcaggaggctagtacagccccaggaaggaaggacactagagctgtttggcctgcaggatggggtgtctcagctcagccactgctctgtttccctgggacacaggataccatgtcagcacagccctgggatttgcagctattcagctcagccagggtacaaattccccagagggtgatgtgtcatttcggcttgagtccaacaggtatgactgctctgggtggaccaggcaccatttccctaggatgcagcgtgctgctttgacttaggcattggaggggcatgatttctctgagcagtcaaagtactgttttcccaggaatcaggacactgcttcagctctggcctgaggaggaaagggtggtgggaggtggagcagctccacctctgcttggccccacaggggagcacaaaacagttgctcgacttggggatgtcaggccattgggctggggcagttcagcaatggcttagcctcagggataaaagagagccatgcatacttgcccccagagcaagacacatccagccatagttccaactccaagatggcatagcatggtagctatgtgggccacagggtgtggatcatagtattggctccttctctgggggaagcacggacatgtggacttcaggcagctccctcagctaggcttagtgtctgtgaggattgcaggggaccccagtgctcaggtctgtaggtatccacggtgttgatggggctgctgggatccttttgtttacctccttgcagtagggaaacgttcctcctagttcattcccagctgcttccaattggggttagggtaatggaggcctggcatttcttcccattctctatgtggccatcccaagtttctgtgctcaccagggtatctgttacttctcttgtgcaccactgtgctcctcctcagttatttttgttaaaatgaagttgtttattcattgttctggctatctttttgagggagaatagcactagggtcttctagtctaccatcttgctgatgtcatgcttcttcaacttcattcttctgcatgtgggtagccagttatcccagcactatttttttgaaaggactattttttccaatagtcttttcaatagttccaatggaactatcttggcacccttgtcaaaaatgcaatctgattttaacccacatctaagattaagaatcactgctctctggccttgttatagaggtcaccatatgtgattacatgttctaaattcttgattttgttcctatagagcaaaagatgggtatctagcttttaggacacttaggtaagaagtccatatataatgataatggcttccccttgaaaacaagtcctggtttcccagaaagtatcttaagaaatctgttgataactttctataatcaatatcttaatatatgccatatagggatattagtaccttgaacacaaagctttatcacaatgacacaatttcttccacaaaggtgtgtataccaaagtgggttggagaaaaagtgtatgttgtatgttcataacacagtttcagcaatatcaactcttgtgatcacttgtgatcttgcagaataaacagtggccctatcagaaccataaaatggttgtggggttgattattgctatactataatcatgtgttagcttctatcttctctatgtctctctctacacacacacacatatatgcatgtattcatttttaggtaatgctacaaatactatagtattccaggacatcatacagttccaaagtttcatttccatacaatcatcagaaaatgaactttcctcctgaccaatttctgaagacatcactctctcataagaagtatagcattgtctttgggagcaaagcctttcagggtgtgcatcccaactccagaaattactggctatataaacttgggtgttgtttttctcatcagcagaatctagataaaagtacctatcttacagagttgttatgagaattgcatgaggcaacaaaagcccttttattgtaaaatatagatccagattctgcagacatggaaataatataacctcaaagactataacctgggacacagacacaagaataatatgaagataaaatgaaacattaatattcctacctattcttcttgctggcaagtgctccctttatgaaacacactggggtagatgtaattttaatttctaagacattttatgatgttctctccaatatgagagtctctttttggaaaaatatcagtgtcaatatagtcaagtcacacagtctactcattatagactgtatattaaaaaatacatattgcaatctgttatctaggtattttccttattttttggttttggtagatgctatagtttagctgcatgagctatactgtctttatcagattgttgattttatttgtgaaataaaaatctctaaataatgactgacggtgttaatgataaacgggttttcaataatcacacaagttcatgaaatgtcctggttttacgtgaatcaaggtaatgggtgtttttattacagcaaatacttgggctccaggcttataggaacaaagcagagctctctaattagcttctttaaggtaggcacccatgggacagttcaaggattgccaccgtacaatgtttacccccatcccagcacatattattggctatggcagtaagtagacaaagacctatgtaaagaaaataacagaactatcttgtttgccatttgccacttagtgatgaagacctacctctaaaccggtgaagttggcaagttttacccatgcctataacaaccaaactagttattttggggtttcatttgttttggctaggctagtttggataacagtagcttgcactgatagaacattttttatgtgcaacacaccatttaaaatactttacacgtatcatttcattcaaccttcaacactgtgaggtagagacaagcttggcatggcatggttaagtgacttacacaatcatgtggttgagcaggtgacaggactgggtttggagctcaggcagactgacccccaaatcccatctctaaccttctatgctaaattctctgctcagtaagatgtacacatggcctcagtgtctccttgaatgtatggtgtttccattcatttggtttatttttaaggctccataaacaaatatctctattaactgcaaatgcttctattaataaaagttaaacatttttcttcaccctcttctcttgaaaacttataaagtagtatatcattgtctctgatgatattttcagtattctgtttgaatttaccccaaatttcacatttgctagagtatttttatttacaaaaacagggcaaggagacagccactgaccagtgaccagtttccaatatgctataaatattttctaaaagtctacagtttcagacactgagatcacagcactgtccatttataaatagtttccagtttttgattttcattttcctattagttgaagggtggggcaacaaaacatttcccataaataaatgaaatggtattacattccatacttcttttaccactaactgctgaccatctgtcataaaagacacaccctgaaaggcagtatcaaatttttagaaatagcaatgacaatactttctgagaagaaattttgaagaaaaaaaataaccccagttactaatgaaaacattgaccaacacatccacagggtaatgtccgacctgttaaccctttggaagcaccatcatccttgttatcatcttcactaccagctaccgagttcttacaatgttccaggcatggtgctaaatgtttcaaacacactctctcactaaatcctcacataggtgtctacaggataggttgttatttgttacatttgttacagacaaatgtaactattattacattttacacaaggaaatcaatgcttaaagattgcacaagtaattaatggaggagacaggatttaaaccagatctaatcaaaaagtaccgatttttaaccactatcccggtgaaactccttacaggacttatttcctttgttaagggtgtgtgtgtatggggggcaggtgatatttggtttgtgtaaatcccatgcttcctgaaaagccatttcaacatgcaaatattaccataaattaagagtataggcacggaaattagaaaatgttgatgaaattcagtgaggaaatatgtaagttgaattcactgggtctagagttatatatggaaagatatttttcatatagattgttattaagaaggtttattaagttttttaagtagtctagagaaaaaagtaatcaaaaatcactgaatcatacccttaatataatcttttcctattcattactaaaaaataattggtaggacttctgggttaattcaggataaacttcagggactaatatgcctttcttccaatttccattttaatatccacgaagaattacaaaaagatgaaaactggcaacagcgttggaaactaaagagaagaccatatgccaaagtcccaaggggattttcactaatgccaatgctgaagagacgaacaacacattcttggattctgccataagaatcaaaacatgatcccaaagaaagtagaagaagatggatttgctttgcctccatcgaatgatgggactcaggggctatgctaaacaaacaaaaaaaaaagagtgatgatcttccatgaactgtccttagagaggcaccattgtgcctcctctcaccccgaatgctggctgctttcctctctatgtccacccccacagcaagcagcagactaacatggaagagatcaggcatgagatgtagcttcctggaacatggaaccacctaacaaaacaatctgaaacaacctcagaacactccatactgtgagtgtaggatagaagcccttttatccaaaaggttgggaaattagggaatcaaataatatagcattccttaaacatttagtttgaacttaaaaacatagatacttccaactatgttgtcaattttggaataagtgcaacgtggtgctgagaagaatgtatattctgttgatttggggtgcagagttctgtagatgtctattaggtccgcttggtccagagctgagttcaagtcctggatatctttgttaactttctgtctcgttgatctgtctaatgttgacagtggggtgttaaagtctcccattattattgtgtgggagtctaagtctctttgtaggtctctaaggacttgctttatgaatctgggtgctcctgtattgggtgcatatatatttaggatagctagctcttcttgctgaattgaagtaaagcactcctcagcaaatgtaatagaacagaaattataacaaactgtctttcagaccacagtgcaattaaattagaactcaggattaagaaactcactcaaaactgcactactacatggaaactgaacaacctaatcctgaaggactactgcataaataatgaaatgaaggcagaaataaagatgttctttgaaaccaatgagagcaaagacacaacataccagaacctctgggacacatttaaagcactgtgtagagggaaatctatagcactaaatgcccacaagagaaagcaggaaagatctaaaacttgacaccctaacatcacaattaaaagaactaaagaagcaagagcaaacacattcaaaagctagcagaaggcaagaaataactaacagcagagcagaactgaaggagatggagacacaaaaacccttcaaaaaaatcaatgaatccaggagctggttttctgaaaagatcaacaaaattgatagaccactagcaagactaataaagaagaaaagagagaagaatcaaatagacacaataaaaaatgataaagggtatatcagcaccaatcccacagaaatacaaactaccgtcagagaatactacaaacacctctatgcaaataaactagaaaatctagaagaaatggataaattcctcgacacacacaccctcccaagactaaaccaggaagaagctgaatcctgaatagaccaataacaggctctgaaattgaggcaataaattaatagcctaccaaccaaaaacagtccaggaccagacggattcacagccgaattctaccagaggtacaaagaggagctggtaccattgcttctgaaactattccaatcaacagaaaaagagggaatcctccctaactcattttatgaggccagcatcatcctgataccaaagcctggcagagacacaacaaaaaaagagaattttagaccaatatccctgatgaacatcgatgcaaaaatcctcaataaaatactggcaaaccgaatccagcagcacatcaaaaagcttatccaccaagatcaagttggcttcatccctgggatgcatggctggttcaacatatgcaaatcaatgaacgtaatccatcatataaacagaaccaaacacaaaaactgtatgattatctcaatagatgcacaaaaggccttcgacaaaattcaacaatgcttcatgctaaaaactctcaggaaactaggtattgatgggacatatctaaaaacaataagagctatctatgacaaacccacagccaatatcatactgaatgggcaaaaactggaagcattccctttgaaaactggcacaagacagggatgccctctttcaccactcctattcaatataatgttggaaattctggtcagggcaatcaggcaagagaaagaaataaagggcattcaattaggaaaagaggaagtcaaattgtccctgtttgcacatgacatgattgtatatctagaaaaccccatcatctcagcccaaaatctccttaagctgataagcaacttcaacaaagtgtctcaagatacaaaatcaatgtgcaaaaatcacaagcattcctatacacaaataacagacaaacagagaaccaaatcacaactgaactcccattcacaattgcttcaaagagaataaaatacctaggaatccaacttacaagggatgtgaaggacctcttcaaggagaactacaaaccactgctcaacgaaataaaagaggacacaaacaaatgggagaacattccatgctcatggataggaagaatcaatatagtgaaaatggccatactgcccgaggtaatttatacattcagtgccatccccatcaagctaccaatgactttcttcacagaattggaaaaaactactttaaagttcagatggaagcaaaaaaagcccgcgttgccaagacaatcctaagccaaaagaacaaagctggaggcatcacgctacctgacttcaaactatactacaaggctacagtaaccaaaacagcatggtactggtaccaaaacagagatatagaccaatggaacagaacagagccctcagaaatacaaccttctgatctttgacaaacctgacaaaaacaagaaataaggaaagtattccctatttaatacatggtgctgggaaaactggctagccatatgtagaaagctgaaactggatcccttccttacaccttatacaaaaattaattcaagatggattaaagacttaaatgtttgacctaaaaccatagaaaccctagaagaaaaaaacctaggcattaccattcaggacataggcatgggcaaggacttcacgtctaaaacaccaaaagcaatggcaacaaaagccaaaatagacaaatgggatctaattaaactaaagagcttctgcacagcaaaaagaaactaccatcaaagtgaacaggcaacctacagaatgggagaaaatttttacaatttacccatgtaacaaagggctaatatccagaatctacaaagaacttaaacaaatttataggaaaaaatcaagtaaccccatcaaaaggtgggcaaaggatatgaacagacacttctcaaaagaagacatttatgcagccaacagacgcatgaaaaaaatgctcatcatcactggtcatcagagaaatgcaaatcaaaaccacaatgagatactatctcacattagttagaatggcgatcattaaaaagtcaggaaacaacaggtgctggagaggatgtggagaaatgggaaggcttttacattgctggtgggagtgtaaactagttcaaccattgtggaagacagtgtggcgattcctcaaggatctagaactagaaaaatcgtttgacccagtgatcccattactgggtatatacccaaaggattataaatcatgctactataaagacacatgcacacgtatgtttattgcagcactattcacaatagcgaagacttggaatcaactcacatgtccatcaatgatagactggattaagaaaacatggcacatatacaccatggaatactgtacagccataaaaaaggacgagttcatgtcctttgtagggacatggatgaagctgaaaaccatcactctgagcaaactatagcaaggacagaaaaccaaacactgcatgttctcactcataggtgggaattgaacaatgaggacacttggacacggggcggggaacatcacacactggggcctgttgtggggtggggggtgggggtagggatggcattaagagaaatacctattgtaaatgatgtgttaatgggtgcaggacaccaacatggcacatgtatacatatgtaacaaacctgcacattgtgcacatgtaccctagaacttaaagtataataataataaaaaaaaatagatagtcacttcatagtctttgcatgcagggctactgattgttgttcctatcatctttatttcataaaccatatctataatgttttatctatagtttctagtgctgtttttcttaaagtggaataagaacctaagaacatgtgaatttttagattttcatagaataatggtggccatctaaatttaaaatcccttcatacattctctttaaaaaccatattgataaagaaagaaagtaatatcaaccaaagcagaagcctatgacacaagcaggagacaaggcctatttaaaccctgggtgaagtgaggaaacaaccctctgagacctgaagagtcaggactggtacccacccaagggcagagtcaggctagaattatgcaaaagagggttagggggtacaagaggagtgtattagtccgttttcatgctgctgataaagacatccccaagactggacaatttacaaaagaaagaggattaattggactacagttacacatggctggcgaagcctcacaatcatggtggaaggcaaggaggagcaagtcccatcttacatggatggcagcaggcaaagagagaatgaggaagatgcaaaaggagaaacccctgacaaaaccatcagatctcatgagacttattcactaccacgagaacagtatggaggaaactgcccccatgattcaattatctgccaccgggtccctcccatgacacatgagaattatgggagtacagttccagatgagatctggtggggacacagagccaaaccatatcattccacccctggcccctcccaaatctcatgtcctcccatttcaaaaccaatcatgccttcccaacagtcccccaaagtcttaacttgtttcagcattaactcaaaagtccacattccaaagtctcatctgagacaaggcaagtcccttatgcctatgagcctgtaaaatcaaaagcaagctagttatttcctaaatacaagggggatacagacattgggtaaatccgaccattccaaatgggagaaattggccaaaacaaagtggctacagggcccatgcaagtccaaaatccagtggggcagtcaaatcttaaagctccagaaatgatctcaaactccatgtctcacatccaggtcacgctgatgcaagaggtgggttcccatggtcttgggcagctctgcccctgtggctttgcagggtacaacctccctcctggctgctttcatgggctggcattgagtgtctgtggcttttccaggtgcatggtgcaagctgtcgtgggtctatcattctggggtctggaggatagtggccctcttctcacagctccactaggactccgtataggggttctggccccacatttcccttccatcctgccctagcagaggttctccgtgagtatcccacccctgcagcaaactcttgcctgggcatccaggcatttccacacatcttctgaaatataggcagaggttcccaaaccccaattctcaacttctgtgcactggcaggctcaacaccacgtggaagctgccaaggcttggggcttacaccctctgaaaccatggcccaagctctacattggccccttttggccatggctggagtggctgggacacagggcaccaaatccctaggctgtacacagcacagggaccctaggcctggcccctgaaaccactttttgctcctaggcctccagtcctgttataggaggggctgccatgaagacctctgacacgccctggagacatttttcccattgtcttgagaatcaacatttggctcctgattacttatgcaaatttccacagcctgcttgaatttctactcagaaaatggaattttcttttctatcacattgtcaggctgcaaattattcaaacttttatgctctgcttcccttataaaactgaatgcctttaacagaacccaaataacctcttgaatgctttgctgcttagaaatttcctctgccagataccctaaatcatctctctcaaattcaaagttccacaaatctctagggcaggggcaaaatgtcaccaatctctttgttaaaacatagcaagagtcacctttgctccagttcccaacaagtgcctcatctccatccaagaccacctcagcctggatttcattgtccatattgctatcagcattttgggtaaagccattcaacaaatctctaggaggttccaaactttcccacattttcctgtcttcttctgagccctccaaactgttccaacctctgcctattacccagttccaaagtggcttccacattttcaggtatcttttcatcagtgccccactctactgggccaatttactgtattactctgttttcatgctgctgataaagacatacccaagactgggtaatttaccaaagaaagaggtttatttggacttacagtttcacttggctggggaggcctcacagtcatggtggaaggcaaggaggagccagtcacgttttacatgaatggcagcaggcaaaacgagagcttgcacagggaaatttccccttatattaccatcagatcttgtgagccctattcactatcatgagaacagcataggaaagacctgccccatgattcaattacctcccactgggtccctgccacaacacatgggaattcaagatgagatttgggtggggacacagccaaaccatatcaaggggaaaggactcaaataacgtctgataagataaactccagaaagagaaggtcacacccaagggacaaaatgttgatagaggtctcatacctgacagatcaaagcactggctagtggggagtcaaaagggagtccaaggaagtagcttggataaggaagtgtgcaggacgagagtggctgccttgggcagctgagatgctgagagaggagcagctgaagaacaagtgtcctttggaagatggatggtaaagggaaggaaggacatggccaaagatcagggttccattataataacacagtgtcagagaatcatgagaaggcagaccaaaaagaaaggggctgagccaagatggccgaatagggacagttccggtctacggctcccagcatgagcgacgcagaagacgggtgatttctgcatttccatctgaggtaccgggttcatctcaccagggagtgcaagacagtgggcgcaggccagtgggtgcgcacaccgtgcgcgagccaaagcagggcgaggcattgcctcacctgggaagcgcaaggggtcagggagttccctttccgagtcaaagaaaggggtgacagacgcacctggaaaatcgggtcactcccacccgaatattgcgcttttcagactggcttaaaaaacggcgtaccacgagactatatcccacacctggctcggagggtcctacacccacggaatctcgctgattgctagcacagcagtctgagatcaaactgcaaggcggcagcgaggctgggggagaggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagccttgaagagagcagtggttctcccagcacgcagctggagatctgagaacgggtagactgcctccacaagtgggtccctgacccctgacccccgagcagcctaactgggaggcaccccccagcaggggcacactgacacctcacacggcagggtattccaacagacctgcagctgagggtcctgtctgttagaaggaaaactcacaaacagaaaggacaccgaaaacccatctgtacatcaccatcatcaaagaccaaaagtagataaaaccacaaaggtggggaaaaaacagaacagaaaaactgggaactctaaaacgcagagcgcctctcctcctccaaaggaacgcagttcctcaccagcaatggaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcaagaagggacgtttagagaaaaaagaataaaaagaaatgagcaaagcctccaagaaatatgggactatgtgaaaagaccaaatctacgtctgattggtgtacctgaaagtgatgcggagaatggaaccaagttggcaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagtggatctcttggcagaaaccctacaagccagaggagagtgggggccaatattcaacattcttaaagaaaagaattttcaacccagaatttcatatccagccaaactaagcttcataagtgaaggagaaataaaatactttacagacaagcaaatgctgaccgattttgtcaccaccaggcctgccctaaaagagctcctgaaggaagcactaaacatggaaaggaacaaccggtaccagccgctgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaatgctacaattaaaagacacagactggcaagttggataaagagtcaagacccatcagtgtgctgtattcaggaaacccatctcacgtgcagagacacacataggctcaaaatgaaaggaaggaggaagatctaccaagcaaatggaaaacaaaaaaaggcaggggttgcaatcctagtctctgataaaacagactttaaaccaacaaagatcaaaagagacaaagaaggccattacatactggtaaagggatcaattcaacaagaagagctaactatcctaaatatatatgcacccaatacaggagcacccagattcataaagcaagtcctgagtgacctacaaagagacttagactcccacacattaataatgggagacttcaataccccactgtcaacattagacagatcaacgagacagaaagtcaacaaggatacccaggaattgaactcagctctgcaccaagcggacctaatagacatctacagaactctccaccccaagtcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaagtaaagatgttctttgaaaccagcgagaacaaagacacaacataccagaatctctgggacgcattcaaagcagtgtgtagagggaaatttatagcactaaatgcccacaagagaaagcaggaaagatccaaaattgacaccctaacatcacaattaaaacaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaacaaagaagaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggagctgaaattgtggcaataatcaatattttaccaaccaaaaagagtccaggaccagaaggattcacagccgaattctaccagaggtacaaggaggaactggtaccattctttctgaaactattccaatcaatagaaaaagagagaatcctccctaactcattttatgagtccagcatcatcctgataccaaagccaggcagagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctgcttcaatatacgcaaatcaataaatgtaatccagcatataaacagagccaaagacaaaaaccacatgattatctcaatagatgcagaaaaagcctttgacaaaattcaacaacacttcatgttaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggggaaggaaataaagggtattcaattaggaaaagaggaagtcaaattgtccctgtttgcagattacatgattgtttatctagaaaaccccattgtctcagccccaaatctccttaagctgataagcaacttcagcaaagtctcaggatacaaaatcaatatacaaaaatcacaagcattcctatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacaggttcaatgccaaccccatcaagctaccaatgactttcttcacagaattggaaaaaactactttcaagttcatatggaaccaaaaaagagccctcattgccaagtcaatcctaagccaaaagaacaaagctggaggcatcacactacctgacttcaaactatactacaaggcttcagtaaccaaaacagcatggtactggtaccaaaacagagatatagatcaatggaacagaacagagccctcagaaataacgccgcttacctacaactatctgatctttgacaaacctgagaaaaacaagctatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaggaaactaccatcagagtgaacaggcaacctacaaaatgggagaaaattttcgcaacctactcatctgacaaagggctaatatccagaatctacaatgaactcaaacaaattacaagaaaaaaacaaacaaccccatcaaaaagcgggcgaaggacatgaacagacacttctcaaaagaagacatttatgcagccaaaaaacacatgaaaaaatgctcaccatcactggccatcagagaaatgcaaatcaaaaccactatgagatatcatctcacaccagttagaacggtaatcattaaaaagtcaggaaacaacaggtgctggagaggatgtggagaaacaggaacacttttacactgttggtgggactgtaaactagttcaaccattgtggaagtcagtgtggcgattcctcagggatccagaactagaaataccatttgacccagccatcccattactgggcatatacccaaatgactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacaccctggggactgtggtggggagggggaggggggagggatagcattgggagatatacctaatgctagatgacgagttagtgggtgcagcgtaccagcatggcacatgtatacatatgtaactaacctgcacaatgtgcacatgtaccctaaaacttaaagtataattaaaaaaaaaaaaaaaaagaaaggggctacatttagcaaagaaactgcacttcactatagcaatacacagcgctcttgaagcacctgaagtaaatgaaagtgtccaaatcccactcctacggattgcctgctatcttagatccaggaaacgccaacatacataaacgtgaacaaaaccaaaaagaactcagcatctatgcaaagttaccatacgagttaaaaaaaatagaaaatgagaattcaaaaatttggcaaatgaaaacattctcctactatggaaaaacagtcataaggcagaagaaaaccattacaggatatttcaacatgaattaaatataatgaaatcatcaactgccaatattaaagaaacaacaaccatgattcagaaattgtaaaactcagacatcacactttttaaaggaagggaactgggaaaaaaaggacaaaatcttagaaatgacaaaacattatacatgacattctctatgtgaaagcgtgtagagaatagaaattaaaagagaaaggataattaattcaaaataaagaaaaaataaagaggcaaagaggatacgagagaaattgacagaaaccaaatttatgtaaagaagattcaataatacctataactaggagttcctgaagaagaaaaacaaaacagtagaatataatatttaaaactgtaatttttttttttttttgagacggagtctcgctctgtcgcccaggctggagtgcagtggcgggatctcggctcactgcaagctccgcctcccgggttcacgccattctcctgcctcagcctcccaaggagctgggactacaggcgcccgccactacgcccggctaattttttgtatttttagtagagacggggtttcaccgttttagccgggatggtctcgatctcctgaccttgtgatccgcccgcctcggcctcccaaagtgctgggattacaggcgtgagccaccgcacccggcctaaaactgtaatttttaaaaactctgaaataaaagaagatctgaatatacaaagtgaaataactcacttttatctgagaaaactgacacagtagggtcacctttgtgacacatctggaaaaattcttagattttaaatcataactataataatagtgataataaaaaatcttctgggtgcccagacaaaaaacacaaagtcacttgcaaaggaataaaatcaggctgatattagacttatcaacagtaacatagaaaacaagcaaagattagggtaacattttcaagaaactcaaagcaagaaagtgtgggacaagggttttattttaaccggttgagctggtgttcaattatcaaggttgtagaaaatgttttaataaacatgcaagaattcaaagaatcctgagaaatctattcaaggatgaattcctccaactaagagataattgtgaacactttagaagtggatgggtggtcagtattgaatatattattgaagatctaaaactaaaacaaaattgtggataaagagagaacagtattacatattacatgctctgatacagtaggaataacactacttaaatcacaaaactggaagagaatgaaaagttacataagttgcttgatttccttatgggtaataagtggaagctgaagatgtcatttaaatgtgacaaaccaaatagtggaacctaagtaagaaaaaagggactaaggaattatataaagatatttgtataatgataaacagtaggataaaatataaatttttctaaatattaaagaactactaaataaaaggtcaaagataaaaagtaaatgtaacaaaacaatgaaaaaactaagaatagaaataaaaatatttataaatatgtataaattcatctactaaaacattacagactggatcataaagaaaaacctaacactatacttaacaactacagaatacgcattcttttcaattacacctgatgtggacaacaagaaagaccatctactaggccaagtctcaaatttaaaacaattagcccaggagtgatggctcacacctgtaatcccagcgctttgggaggctgaggcaggaggattgcttgagcccaggagtttgagaccagctgaggcaacatagtgagaccctgcctctacaaaataaaaatttaaaaattagctggttatagcagtacatgcctgtagtgccagctacttgggaggctggggtggaaggattgcttgagcccaggaggcagaagttgcagtgagctatgattgcaccactgcactctagcttgggtgacaaattgagaccttgtctctgttaaaaaacaataataataattgaaataatacaaagcatttcaattatttgtggtcctcaaaaccacaactgaaataaactagaaatcaataatttaactagggaaaaacccaaaatttggaaacttaacaatgcacttctaaatacatggttcaaagaaaaaaatcaccatttgcaccattccccatagaatacattctttcaaatgaaagaactcaaacataaataattacattcaaacataaataatattaatattctaacattcaaacataaatacattcaacatattacattcaaacaaaaataatattaataatatacagaattcttgttaaatcctttctgctcaagatgctgtagacgttagtttattgtctactggtgagtattattatagcaaagtgaaccaggtaaaggcaaacaaaaacaagacaggattgcagttttggtatttgacaaggtggagtttatgccaacattgttggtaagtatcatgatcgaaagatgaaataaatacattctttcatttttaacaataattatttatattattattatttttttttttgagacagagtctcgctcttttacccaggctgaagtgcagcggcgcaatctcggctcactgcaacttccacctcatgggttcaagcgattctcctccctcagtctcccaagtagctgggactacaggtgtgtgccaccacacccagtcaacttttgtatttttggtagaggcagggtttcaccaggttggccagcctggtctcaaactcctgacctcaagtgatctacctgcctcaggctcccaaagtattgggattacaggcataagccactgcgcctgacctatattactatttatgtttgatggtaatagaaatatattctttcatatgaaaaatttggaagaactcaccatttatgtacctctactgaaaaattactttaaaatattaatcaactaatcaaaagattaatcaaacttaagaactaaggaaagttataaataaaaatgttggtaacattaaacataattaaatatatatatataaaatttcgcaacatgtgattacaaagtagaatgaagaagaaacttgctttggaagaagagttataagatttaaagtattcaattgcaaaaagctgggtctgtactgatagattgaatttaaaacacttgaaagtgagaaataggcaagaaaatactggtaaagaaagtaaaggcacaataaatttttctttggatacttctgcttccagccaaattagatttacttaaccctcttgcctaaaacaacccaaagaaaaatggacagaatatttaaaacagtattcaaaacactggatatcaggcaaagaacaatgattattccaagatgaaaaacaaagcaggtgagtttttaatcattgcccagtttactgccttgagagaatttctaagccctggtgcagggaagggcaactgaaatgtagtccaatgaattccttgagttgagcagacagagctgagtccagagaccaagggagcttgagctcttaggacagaggaccagagaagagaaagctgcacagaatgagaatcctggaaatctgcagaggatccccttagagcagaggtcccccaacaaagactgtggaccggtacccatctgtggcctattaggaactggacctcacagcaggaggtgagcggtgggctagcaagctttactgcctgagttctgccttctgtcagattagtggcagcactaaatcctcataggagtgcgaatcctactgtgaactgcgcatgcgagggatctacggtgtatgcttcttatgagaatctaactaatgccttatgatctgagtttcatcctgaaactatcccccgaccaaccctggtcggtggaaaaattgtctctcacaaaaccagtccctggtgccagagagtttggggaccattgtcttagaaaaagatgcctgtgagtgaactactcacaacacgggaaagaactacctgtaaggattaaggggaagactgctcagcattcacacagagttgggaacagtacccgttcccatcagccagccttgaaaaactcacaggctgctgtgagaaggtttgactagagaggatttgactcagcagtggagtataattagctgtagactgagcactgctctgcagttgcctaataaatcctaaaagcaatgctcaaaacgatcaaactgtttccaaataacttaactgcatctcagaacaaagccagaagctttatttttatttatttatttatttattttgaggcagggtctcagtctgttgctcaggttggagtgcagtggtgcaatctcggatcactgcaacctctgcctcccgggttcaagcgattctcctgcctcagcctccctagtagctgggatcacaggcgcccgccaccatgctcagctaatttttatatttttattagagacggggtttcaccatgttggccaggatagtcttgaactcttgacctcaggtgatccacccgccttggcctcccaaagtgctgggattacaggtgtgagccaccacaccctgcctagctagaagctttacaagaatacaaaaatatccagcactcaacagggtaaaatgtacaatgcttggcattgaatcaaagaccaaaagggatagaaatatgaccggtataatgaggagaataatcaatcacaaccaactgagaagtgatatagatgttggaattagcaggggacattaaaatatttattataactgtattctatatgttcaggaagttaagtagttacagggaggatattaaaaagacccaagtggagcttcaagaagtgaaagctacaatgtgtgagatgaaaaatacattgcatgaaattgatgaaagatcagacattgagaaaaaaatcaaaaaccttaaaggcttagaaatagaaactgcccaaaatgaaataaagagaaaacagaattttttttaaataaaaagagcattagtaaactgggggacaactttaagtgtccaagtgaaaagcatgaatatgtacattgttgccagattaatttacaggcttaatctcactcagtataatttttgagaagcttttcttttaatttaacaaaataattctagagttcaccaagaaaaattaaaaagtgagagttgtcaagaaaattttataaagacaatataatgaaggacaggccgataaccatttctaccagatatttaaatatactcgaaaaagacaatgattaatagtcagatgccagcatgagaacagataagtcagtgggctaaaacagggggccccaagacagagcacagtactcataagaacttaaaacctaaaatagtgccataagtcagtgaaaagagaaatattattcaataattagtctgagttctcttgttagtatgtggaatgaagtatcattttatgtgttttttttttttcttgaagtatccattttagatcagaggttaacatttagctcatggaccatcatgctttatttggcttcatggcatctgtaaaattgaggtgaaaagatttgtttttcctttaactttcttcttgaaatgatattgatagtgggggaaaagtctttataatgacatactaagtttttaagatattttaatattcagttgtcaccactgtcatgttatgacatcttaaagtgtttcccattgatgataaaaaagaaattcctatcattatgatcaggagattgctttttttttttcctgaaacaggatcttgctctgttgcccaggctggagtgcagtggcatgatcacaactcactgtagcctcaagctcctgggctcaagtgaacctcctgcctcagcctcctgagtagctgggactacaggtgtgtgccaacacacccagctaatttttgtattttttgtagagacagggtttcgctatgttgcccaggctggtctcgaactcctgggctcaagcaatcctccctcctcggcctcccatagtgctgggattataggcgtgagccaccacgcctagtctgcttatgttttacattgtttaattaaatataaaataattaaaaagaaacttgcaaggttttaatcctttggttttcctttttgtcaatcaaccttatgaaatgtcttcaaacaacctataggctgattattgagctgaaaagcagaaaaactacacagaattggaaagagcttagagaagtcatgtcccctagaaatggcaaacatagtctgtggcttgcaacaaagaaaaactgaagcagtcgaaggagctcctattgtaaataatgtcacccactccagaactactatttcttctaacattttaatattttgaagcagtcctaagagaaatttgtaactatacagctaataaaacttctgatgctctcagcacagacaactgtttttcatccgttactggcattcctatttcacgagcctcttcaaattttcaaaaactaccatcatctcgaaagtggtatttccatttctggaaaaaagtttcagacctctgggcacagatcgggtgtctctgacatttggctgtccatttgtttttgctgctttggaaaagacacaacagacgtcaatgtgactgggcgatttctgtatcagcaggcaggggtgccaaatgttctgccaccgattccgaacttgcctaatgctgtgagaagcaccaacttcattaggctcgaggctgaattattatttcaggaatttttctcaagcaatgggaacagaatgagagcggttttttgctttctaaatagaaatttgctgaatttccagaaaacaagtcttgaaatgtatgatcaaactttgggcagaaattttacttttaaataaaaaaaaaaaagaaagcccattatctcatgatttagcctacttggacaataattttggccatatcttttggttaaagccccgcagtcaccactatgtacggtactgaagaacgtgcccctgttccataagagattggccgctaggagaacgtgctaacaccgaagaaagatctgcaatttggagctaagagtgattagacttttcccaatttctctgcagtcagaagcaaacatgagccaaattcttaaaggttacttctgatcaacataatcttaaggttgaaatgtgcatttgtaatccaaaatttagctatatggacaaacatcaatgatgtgaactttgccaaagataataacctcagtaaatttgggactcaaaatgaattcaactatttttcgattcaatcccaccctcacctggcaaagtgtcctataaagctttgattccacatgctattatgtccttatgcaagccagggtttacaacatttttgccaccaaaacaaaacaaaagaaaaatcaaaaatgattggatatcaagcatgccacaaatgttgccatctcaaagtcactcaaagctttctcctactccaagccaaaccgctacagcctttatattgaaagttgatgataaactgaattaaagttcaagatttgctttgcttggaaatctttgttttatttttaccatgaagtgggcattaagttttgcattaaaataagcaaaaggggcataggcttgtaaagaatgttttagaaaagaatgtgtaatcaatttctaatatcacaaaataggtaatatctagatttttgtgcctatgtttaggtacttttttcctgtaagttcatagttttcatcggtcttaaagaggcctacaatcttaaaaaactgcaaaaaacattactcctctgatttagacactgacctcacataacacgcacaccatcttgcaacaatttaagaattatggctgagcacaatggctcacacctgtaattccagcgctttgggaggccaaggcaggtggatcacttgaggccaggagttcaagactggttggaccaacatggcaaaacccaggctctactaaaaatacaaaaattagctgggtatgttgatgcatacctgtaattccaactactcgggaagctgagacatgagaaccgcttgaacccaggaggcagagatcgcagtgagccaagatcatatcactgcactccagtctgggtgacagagcaagactctgtcttaaaaagaaaaaaaaagaaaaaagaaatacatggaagaaactcaaaccacaacacctagaagaaaatagatatttagcacatttgaagctgagaaaaatatttctgaacaaaaaagcaagagaaaaacatttcattgacaaataaacatgggaaagacatccatgtagaagacataaacaaaataaaaagacaaaaaaaaaggaaaaatatttgcaagaaatacaacaatccaaaaacctgacataaagaagcaaacaaatccacaaaaaacacctacttttcagtaaaataagtggaaaagcacatggaatgaatactttcaaagacaaaatacaaatggaatataaaaagttaaatattaatctccataataataaaaaatcaagttaatacaagactattttgtctataacattagcaaaggttttttaaaaagcttgataaggaaaagctatgaggaagatgagcactttctacacctgtacaagagtacattgatacagcctttttagaaagcagtttggtaatgtttatcaaatgcttttaaaatcatgtaggggccacccttggccctccgcaagttcactgaaaaatcagttcacaaaaggtgaattaacaggagaaaaggcatacaaatgtatttaatgtgtatacatgggagcctttagaatgaagacccaaagatatagaggaaatcgttcatttttatgtataggtttaacaaagtatggacagccatatagaaacatgattggataaaagggtatgctctaatgctaatagcctgagtggggaaacccagcaaggtctgtctctctggattcttctcggcctctctgggcatgcattccttccttctggatgtggggttggacccgctctggaatgggaatgttatgacctacagttaaaacaagttaggccagataacttttttatggccactttttacacaaatagggcagagggaaaattagaataatatttctaggttttatgattagccctggggagaaggggttctggtttctatgacctgccctggggaagaaggattctggtttccatggcttgcctcaggaaaaaatgagactgagagacaagagagcaggaggaggtcagagaaaaacttctgttgtagaggctgcttctggggcctccagtttggggtattgtttttcaagccccaacattggtcactttctttagctcaatgatttaatttcaaatcatttatatctaagggaaaaagtccaaaatgtagacaaacagttcatgtagaaagagctcatttcagagctaatgttttaaaaaactaaaaaagaaagtcaagggaatgggtaagtatatcaaggtatatccatgcgattgaatgtgcagtgactgaaatagtgtttgcagtaagtttcttggatgacacaatcaaaaaccaatggtctgttaaataaggaaaaaagatgtagtaaaaaaatgctgaaaagaaaaattctaaggaaatatgacaaaatgtttatagtagttgtttctaggtaagatttgagtgattttttttttttttttttttttttttgagacggagtcttactctgtcgccgaggctggagtgcagtggcaccgtgttggctcactgcaacctccatctcctgggttcaagcaattctcctgcctcagcctcctgagtagctggaattacaggtgcccaccaccacacccggctagtttttatatttttagtagagacggggtttcaccatgttggccaggctggtcttgaactcctgacctcaggtggtccacccacctcagtctcccaaagtgctgggattacaggcatgagccaccacgcccagccaattatttttattttttgtagtttgcaaattatctacaatgacatatagtactcacgcttggggaaattaaatttaaatttaacatatcaagtttagatcatggatagaggcagaaatgtttcaaagaaaaagaaaaaaaagtcatcgcatatgaatgagcacataatgagcacaaagcttcaaaatttctggtgagagaaaaggttttactgctttgcttctcagcttagctgttcagtggcattactttttctgtgacttggatgctgtagagtgttcttgaaatgacaaatcataaactgatcactgtctccaaactgacaaatcaacttttcaggcaagaataagagggaacaatttgaggctagtgaggattttaaaataatatgaaaataatatgactcataagaaccaaaataatgtttagaaatggtgaagaaatggctacccaatactataaatgttgctgcttgaaaagtgatctttaaaatttaataaattctcgaaggaaaacatggaactttgagttgcaaaataattgaaagaaggttataaagctaattaaatcagattttcccttgggtttgtaagagatgaggaccttccctagtctcacccttctgggtgaggcccattagagaggaacccatagactccacgttgtgagaggttgagcggcctggctgaacacttcttctatccattcctgaactcacaggactttaaactttaatgtttaaacttgaatagctatcaaacttcctttgtaaaaactaatcttaggctgctgaaccctactattttttaacattaattattaattacagaaaaattgataatataaaaagataagaaataatctatatattttgcaactggaaattggtcaaagtatggtatttccagagtgttgaatactatgattatgttcagcagggactataaacttaaatgcctacagagactaagtaggtaacctaaatgagtgcagtggatctgtattggaacttgggaacaatagagattgaagatttgaagggtggatacttcatctacagaaggcagcagctatttgattctagtcagttgttggccttctggaaatgtgggtgcagtgctgtcagaccttcctatttttaaaacacttttatttggaaataatttcaaatttacaaaaagttgcaaaaataagacataacaaaagaatacttatgcaccttacctatattcttttatttaattttgcagtccatttgaattctctctgtgcacatgtacatacatacacacacacacacacacacaatttttttctgaaccatttgagggtatgttaaatatatcatggctttttgctcctaaatactccattgtgtatttcctataactagagacctgaaacctgctattcttgagctgggatacctggagtgggatgaagagatggcctgaggaagtcctctccccctggccactaagggacagtcaatcagctgctaaccccaaacagagctgtaacaccaaacagaggttgaaaaccattgcactaggtcattccacccgtaaaaataatacctccaatatatgcatatttatttataaattagatttatgtacaagtctactaatatattatgtgtcttaaaaaacatatactttaaaaaggatgagatgaaattagatattaatacaaatacaagattgaaattttcttcctgtactccaagggaacatcttgcaacctctaaggcatgtgcctcccaaccttgggggctattgctctacactgtgggggttaaacaggaaaaagaccatcacgatttccaaatctgagtctgggtcctgttccctgatgtatcttcttcacatcagccagctctatctatcacaacatacttttttgccttcctggcacttatcacaactggcagtcatcttgctcatctgtgtgttcatttgtccaacatctttctcccccaactagaatacagcttcctgagaggcaggatcttgactgacttgttcattcctaatttctcagcatctagaagaaggtatggcacatagtaggtgcttgttagatacttgctaataaatggaaataaacatatccctagttcctattccagctttttccctgctgttttgtcctccattcttccagcagacaacaggactagttccctgaccccctgcaggaagctaacaataccctagcctacttctaagcaaaacgtcgcagcttcaaagaccttccatggagggcgatgggctgaggacaatcttgttcttcacgtaaaacacaggcccacaatctcaaatttataatttaaaaatatatatacttacaatgtctctaaaggcacttatttttcttaaaaatcatgtatttgtaagctgaactatcattttaacacaaaagctatcattcttgctcaatggagtcaggctgctcttggagtttctgtcctgggaggaaaaagggcagggtgtaggtacctgatggttttccacacgtcgaagccatccagaggctttgtgccattggtgtgtcccctggccagcttcacgagtgttggcagccagtcagagatgtggatgagctcccggttcttcacgcccttctgcttcagcaaggggcttgccacaaagcccacccctcggacgcctccttcccacaggctccattttcttcctcgaaggggccagttattaccccctgccaaagtctgccctccgttatctgaaacacagtaaggtcttggcatgaggatgatgttaactcttaaatacatttaagaacagagactgtatgtacattgttactaaatggtgcttaaataataaaaaaaaagaaaattccttgccttttcccaccctaaattcccttttcccattgacatagcctttcattattcagacataagtaaggcccagtgtgatacatatctacctttaaatcctccatggagagagccactggaaaacaaggcagtccctcgatgatatgcgctttggagatccctaagctaaacaatccactaaactttaaatacacctgtgtaactttgtatagcatgggagaatgagtccatggaagctgggaccctctccatgcatgaagagaaaactaagggaatttcacttagtgacttaatgctccttataggtggagacaaaaactgacctttttcttttcctcttggaaaaaaaattctacaatttaaactggaaaatgaattaacactctacactctggcaataatatctctttcttaagtgtgaaagctgagtatttctccagtggttgataaatgtctctgtaaacagaacattagatggaaaaatataattgtgaaaaaaatttttcccctcttgacaggatggtgaaataaagtttcattatgcacaataccagggaagagaaggtttctcttccaagacaacagaaggaatgggagatcttggcaaagacagggtagaagctactagagtaactgaagttaagtatcttcccagccaaatgagggctcagagttaagacattaaagtgggcagtagaaaagaaaaagtgccatttcttacatactggggttatagaatcatacaaactcccaaagtatccacagatttaggtgactttagagacacattttaaataacacatattttgcattaaactttaaaaaaaaaacccactattacccaaatgagccacatgagggcagtatgacagaccacctgctgtatagaatgttacatataaaaatttattaagaaatcagagatctatcaaagctacaagatgcatctgggaggaaagagaatgaacacttgttaagcactgactgcactaggagtgactctgattttgcattatctctcacagaatctggggttggcagacctggaatagaagcctgaggccagacactcactagctgtgtggccaggggtgatataccacctcagtttcctcgtcttcatgtggaaataacaatcactaattgatttagtccattttgtgttgctataacagaatactgagactaggtaatttataaagaaaacaggtttatttggctcacaattctgatgactgataagtccaagcgctaggcactggcatcagttgctggtgagggcttttgtgctgcatcataacatggcagagaagtggaaggagaggcaggtgcaggtaaagagggaccaaagagcaggaagagcctcactttataacaacccactctcatggcgactaatccattcccttgagattgagaactcgatcctgggagacagcattgatctattcatgaggaacccgcccccatgacccaaacacttcctactgggccccacctcccaagatgcagtggcaattagacttccacatgagctttggtggaaacaaaccacatccaaaccatagcactacttcatgtattatgatggaaatgaagtgacattgcttatgatcttttcttggcagggtacctgacacaacctaagtgctcaatacatggtagtaactgctgttgttcttaaaatttacaacaacccaaatagtttagtattataaccattttgtcacgttttttaaaaggaagtttgaaaaagccaaacagtgaatagatggcaatgctaggattccaacaaggtctgtgtgacaccccaggcctctgcccctagagcaccacactcctgctatccctagtatagagtgggctcacacatgtaggccacataaactttcacttcctgatgaaaaccacaagtacggtcaacctcagcaaagtgtacactcttcctatgagtgtacataggaagttatttcaaggtaatggtaattccttttagagaaggcttagctgctgttggggaagaaattcaaggctctactgccaaggaaacttttggtggcgcccttaacacaccagttctcagttcttttctgtgcttctcgaaagggagtagagaagagtcttgagttagatcaggtgaggaaacaattcttcaacacatgggtcggtgacagacaatctcatcatttgacatcacagacttacaagaatctttcttcaaacctccccacatcacttcttgacaaaaactcaaggcccaaacattcactcaggccagttgttgaaatacacattccatttcatattgaagctgagcagacccgtatattcaaaacaacaaaaggtcaccatcagtagaaagaagaaattcctccatgttcatgatactgcacagagtagcaatcactcataaccaatgtatcgaaacttagaagaaggtgctattcatgtgatacaaaaatacactggaaagaaatacctacactcttcccgtgatatcaagaaaggctgagacagaacgattatttcactctgttgtctggattgctgtaagtgatgctggctcaatactttagaagaagcctgttgtctctgttttaaatagatacacttctctgaggtattatgtagtgtccttcagttgcacatatttgttagtgctcaacggaaagtattggatgaagatggtggtggaaataagagtggagatgatggggacaagggtggctggatctggaatctgattctaggagcagctcttcagttatgactcagataggaaaattctccgggttgtacagagaatttggccacttttgctactgtaggaaagggaaggtgtttccacatatcattaggggaggccacggatgtagtaagtgtgactgtttttgcaattagttctctgtgatgttttgccattagcaataagcgattctatcaacagttattctttttaagagcactccaaagagaaagcactgtcaatggacacatgtgcaacttctccaaggctctcctggcatagcgccaactgcagatgtggcctcagcagaagggcagttcagcttcgcctgtccttgtacccccacagatggcacctggccgatggttgccacttatcagcaatggggcagaatccactgagttaggacattagttggttaactatatgagaaatagggtgcggtccataagttctagttcagtctcctgggtatttcaaagaattcaacataaaactggtaggagtagcaacaagaataaaataagctcttttgcaacaaggtggaaaagggagtttcctatattgctcactgaagtttgacataaattagaatttaaaaagacaatggaaccatcagcatttcaaagacgtttcttctcattttcccttctagttttatttttcggcaaaagttaatttctttcttgttaagaattcatattcaagagaaatttttgtttcatttcctgactgacatatgaaaaaaattccaaatcaaaataagatgacgccagctcctaaaagaagcaaagaaacgttttttcagggagatggttttgcagcaatgttttggcacagggaaaatctaattataaggcctttactgtctagaaaagaaatgtcaaagtaagacaaacattatcatatacagaccgtaaatctcactttattattcactattgaacaaaaataactgtcaaaaagtcatggaaaaatattggtttgccaaagatctaagcaaaaacattaagtatatgacaatgaagcctcatccatatccagctgataaaaatcaaaatgaaaccatgacaacagcattaatttttagaactactccccaaacaatttaatgtgtggcttggccgtggagggctgccctgaaacatcatctctaccccaacatccctgtgcatgcttcagctggggcttaccctagtcatccttcccaacctgactcaaagatcacaaaaggaaaagcaaggaaggctctagcagcctcataccaagcctggacatctctttgaacacggccctgatgcaagggtgactaacagatgagtaggcaacatcgtttcaaaaatggagaagcctctttgtcccagaaaagtatctgcttgttgatggttgattctttggatttttttttaaattactgagaggcaaactggagtgctaatatatgtcttagtacacatctaaaggattcggtaaattcaatcttctcctgctaaaagattttggagacattatctacctagatattcaaattacattctgatattctcaaatcttatctttttttttttttttttgagacaaagtctcactcctccaaccaggatggagtgcagtggcaggatcacagctcactgcagcctcgatctcctgggctcaatcaatcctcccacttcagcctcccaagtagctgggactacaagtgtgtgccaccacgcttggctactctttccctgttgcactacattgaatcatttctgacagaatgtgcatttgattctgccaagtctacctttaaaacagctttccaatcatccccccttctgcagcccattgctttaggtcaggcactcctctgtctgggctcctgggctaatttatataccgcttcaagttcccaccagaggtgtttgtaaaacccaaaatcaatcaggccacatgcatgtttaaagacctgattgctttccaatcagggaaaaagttccaacttcaggcccacatatagaatccttcatatctgcccccaacctcctttttgggtatcaactcctgtcctcccccataaaaagtgccctgagcttcagtcacgtagaactaacttctccctgttgttagaatatgtcatgccctttcatgctaattttgcctttgcacatgttggctcccttgcctaaagtgccacgggttaaagatcatatcttctgtgaacctgccacttagtgccctagatggtcttcatctctgctctgtatttctgctacattttatgtgcacattttctactatacttagctctgtctattgttaatcagttgttcatggctttgtcttccccatgaactctgcttctcaagagcaaaaagtttcttaatgtttttatttccaagacctagcacaggacctaccacacagaagggctcaatgatttggaggaacaaataattagggaaaaggccactcaccgaaaatagaggttaaaggcactaaacattaacttaggtcactgcattgttttttctaagcctttgtccagctactctgtgaccttgacttttcattggctattctacatactgctgcttaaactataggagctggcaaggggtgctcttggaccccagtgagaatttaagtaaatcaaaccctcaaatatcagaattgtttgtctaatctggtccctggtcagttatgttggagtctaagagggttgattgggagcatttcaagaagcatcagtcttggcctggaagaaagaactcacttattcctttaacacatctttcttgagtgctgccatgttccagggaccactccagatctggaaaaagggcagcaaacaggatggacaaggtcctgtccctcacggagtgagtgagaaaaagagataagatctctccattcatgggaggcaatgactgggctttgtggaggagctgaaaccataaggacaggacagagccagccaagtgaccaccagagagatgagagcccaggcacagggagcaggaggccttatgcaatcgcacattagagactagggtgtctgtgtcaaggctgcttcttaattaaagactagttatactattaggtatactctgctgccagaagttaaggaaaacttgagctaaatgatgactaggtataaacaaaaaggtataggtctaggtgttttatgaccatcatcactttcccctatcacccctactgccccatgtctaatttcactgaaatgcagggaactgagaggagctaagcactgtgggtttgggcaagtactcaatctctgagcctaagtttccttatttgagaaatgaggataacaaaatacccaccttaatattgtgcctggcatagaagcagtgctaaataatattagctatttttatgtatgctagtcatcagcaccagcaaagtacacagaacagaataggctcctatctggatatttactaaacatatattagatttaagtatcatagccacactccaaaacatcacgttttcataagaccaaagtattctaagcatagagtcctcctagattgcattctctattctttttttttttttttttttttttttgagacagtgtctcactctgtctcccaggctggagtacagtggtgcaatcttggctcactgcaacctccgcctccagggttcaagcgattctcatgcctcaacttcctgagtagctgggtctacaggtgcccaccaccatgcccagctaatttttgcatttttagtgaagacagggtttcgccttgtcggccaggctggtcttgaactccagacctcaggtgattcatccacctcggcttcccatagtgctgggattacaggcagaagccaccacgcccagcctgcattctctattctataggtaatttcttgagaagtgcaacaacacagtgaattgtgaggggggttgttactatcaggggagagccaggataactcctttctgttcccatgagtttaaataaaggacatcaattatcatagaaaaaaacactataacaatagcctgggattcaaattaaacaccagaaactgaagatttgttcaaatacacatttgattattcgtaggggtttaaaatggtttgcagcattcagggcagataagtgctctgaccaccagctcagacactaaccagactttacatcttgactaagagcaccagcaaggagaatgtccagctgggctagcaagaggagggttctggtggagtgcgactggcagccaggcaccaaataaccgattgatacggtttggctgtgtccctacccaaatctcatcttgaattgtagctcccataattcccatgtgttgtaggggagacccagtgggagataattgaatcacaggggcagattcccccatactgttctcgtggtagtgaacaagcttcacgagagctgatgattttaaaaggggtttcccctttcacctggctctcattttgcttttgcctgctgccatgtaagatgtgcctttgttcttccctcaccttccaccgtgattgtgaggtctcccaagccacatggaactgtgagtccattaaacctttttctttataaattacccagtcttgggtatgtctttatcagcagtgtgaaaatggactaatacacggatgtagccaccaaaagatgtggagatttaaaaaagatgcatgcagggaaagggcaaaatcagggatgaatgaggattaaaaagaaaaatgttataaaagtttgtagtaaaatatttcctcactttaatgaggctaatgccattgcttataatgctgagatatcaatggggttttatctctcctttaacatttattaaggatgaaaagactccaaagtctgttgaaagattgaaaacgtttattctctacaagttaaaatggaactggaaactggaaaacagtgtcctaatttattacatattggcaagcaacaacttaactttttcctgtaatttaaaacataagtattcacagatcttggagatctttagatgaaagttgtaaggtaagcacaaaatgttgaggtgctctcacttaggaggtatgggtaatgcaaggtttgatcttcatattcagaatccccctgacaagtagcacagaagacccatgtttgatgtattaagcgagtaaaagtaccaaatatttggtctgtcctttttaacaactaaaaccctgtttgtttttcctattgtttaatttttaggaatgtttgatattttttactaatggatttccaggcaaactaatttttttggcactcttagggagtgttacagtttactcacacattatttggctcccctttcagacctaaaacccactgaacgtggccagataattttgactagacagctgtttatccttcagtaatgccactagagaagtaatgaatgagaaaagtaccacacaagtgctggagagtctggcaagttcaagggcagcaggagaaaagtgaaaataccatcaacacacaggaacaaacagaattgtggtttcaaaagaacaggtgtactaacaacttgcgtggtgagaaagatggaaatttatgtcaatgtgttttcagagatggttaagccagagaaagctagcacattctatctgggcagacatcaactatttcaatttgtctttatgattccaagtatataatacaagttaaatgttctcaatttttatccttggaacagaaacaacattttactgaatctctacttcttaagtagtaagatatgcctttaaggttactcagaaaaatcaatgaaactgagtggacaggcagtttcatttcctcagagttctctgaagttttgccagattctaaaggatctcactgatgtttgggtgtttaatgcagagagaggcaaacaaaagtcacgagaacactgatgagcacaatcctccctgaagaataaccggagagtaaaacatttaatggcagaaacaaaaataactcaatatatccaaacatgaagcagtttgtttaaagcatttcaaatattgaatgcatacttaatcaataataacaagaacctcttcggatctgcagataacacttgctccaaggccaaagtgaaataaactctgtgagcccccagagtcctgggcagcagccccacctctgaccagggcatgcacagtgggagtgagggcagaatccaggtgattgacactggacatcccaagcaggtgaggaggccactcaggaggaaagaacatggaaggcagcctggagctccatgcctaatgagaggcaaatggctaacaggaggccttgcagcaggagacaaagggatgaacagccaagggccaggataaaaaaccaaaccaaccaaccaaacaaacaaacaaacaaatcaaaacaaatgcccctgagttaccacaataggcaccacgaagtccatgcaattagagactaactcaggacctattcagtctcagacgcaattctagcaatatgtgcggtgtctggtgtcctaattttatagcaggctagaatctgcaagtcaggaagatgcatactgctggacataatctttgtagaaggaggaaaggagaagaaaagtataaattgtaaaagtagaccacaaactaaagtgtctttacctgtttttccaacattaaatgatccacactgacgtatattgaagacaccactgaaagatgcatactacaataaaaaaattaaaatgatgaccctacatcattaagatagtgagagactcatggcatagttaaggatggtttagacctagcaaaaaggtttatatcccatattcctgtcattaatcctatttatctacagcaatacaatgtgcctgccttcttcacctgataccttgcaaaggtcacaacgataagcacatgaaaactttcactatcctggcataaagttaggcatatagactgaaaagagagaaaattattacaggctaagcagtatgcctcatgtgccctgcatctccactggaatgatgtttccaaatattaagtaacagcttttctcattcctagtaattttgtcaccctgtgaccctcaacccaggaagcaggcagggagatccatgtctgggctccggaaatggatagtcagcaggtggatgagctaatagatttagcttaagcaatcactcagagccaggggaagagagaggactggaaacgaagctaaaggacatggctgtgaccttaagcacacatcttgggctctgcccccaggactggatctagtgtagaagaaataatggacggagggatacaagagtggaaagaaccatgcctcatcccctggaggagccggggggcagatgagaggatagcaagactccctgcggttcttgtgcccagtatagtgtggcagcagcagatgacaatggttgcacaaggtgatggaaggcaggctcagaggcttctcacaccacagtgtggaaggggttgcagctgaactgatgaatgtttttgatttggtgttgagaagagcacaaatgtggcacagagatggtccaaagagtctccgcaggcaaggaggtcgcagcatgatctagatggatgatataaaaaggccagccaggaacaggaatgtttctgcagaggcttgtgcaaggatgactatggaccacacacttccttcagctccaacgcactggctccctggaggggagccaggatgagatcatgaattaactgagatgatctgaattgactggaaccaggtttcctccacccagcagaatagggaccccagaggtactgcgttcagtgacagggtaaaaaagaagtaagttatattctttgcagatctaagtttgtgcactgaaatttgtgattactatgcatatgtgtgagcactatggctggatgtcctagacttgatggatataataattgtgttaggctattttgtaggcgaaatagaagttaaatccatttttattgttttggttattttgaagcagtaatatggactcattccaagactttacatttttatgtaatagcaactataatgataggaaaagtactgaaatcagaagaaagtttgtttctataacatgcctctcaggcttttcaaatctaacatccccacccttttcataacaaatattttgtgatgctcctttgtcctgaaatggaatttatatacaatactgtaactatatgtctaattaaaaaaaataactctcagtgtaatacagagtagaaaaaggcaattaataataaaatagcatgtatttcataggaaaatgcgcaggttcaaccctaaaagacatagcaaagtggttagatgagtgcatacagttatagacgaaataaatttggacttaaggccattctatagtagaaatacaaaaaaaaagagagagcagggataaatgctaaaataaagattagaatattaattatatattaaaaccacgcaaaaaatactttgtgtttatgtgtaaaacatagagactagacttaggttctagtctcagaaaattgtaaacaagcttttaatcttcatgactaaccagcaggatattttgtaagttgtacaggacttgggacaattcctcactgtgtggggttattacgggcattgcatcctgagccccctactcactaactatcagtaacactcaagtgaatttctaaaatactctcagtaaaaaccactgccctatacaatggcaggattgggacatatggccagagataggtagtgacctctctttcaagaggcttcacaggttagcactcattaccttgtgaatttaacacagtttggggtctggcctaaacctctgtaagcttataaataattctaacagcatatggaaagaggttccactttttagaagcagaatcactgtaaatgatatatatataatcacaaagtcaattaattgatttacaaagtaaatttatcacagtgactggcatgtttatggcccatgggagtggcataaatgtatgggaaatcaagttataatcagatctcctggtaagtaaggactcagatataatatttgtatttttgtaatatgtggactctcataataattatttttcagatctaaaatatattctataaatataaaatatttatatttactatattcaaaaatgcactaaaagctgctttaatgagaaaattcaccaatttttaaatatttttttctagcaactaagacttcaaaaatgattaatctaagttcattcaggaaaaaatagataacgtacatgccctatacccattaaagacattgaaattagtaattaaaaacctccccacaggccgggtgcggtggctgacgcctgtaatcccagcactttgggaggctgaggtggatggatcacatgaggccaggagttcgagaccagcctggccaacatggagaaaccccggctctactaaaaatacaaaaattagccaggtgtggtggcaggcacctataatccaagctactcaggaggcggaggcaggagaatcgcttgaacccgggaggcaaaggttgcagtgccgagactgtgccactgcactccagcctgggcgacagagtgaggctctgtctcaaaacaaaacaaaacaaaaccttctcaccaagaaaatttcaggcccaaatgccttcattggcaaattctaccaaacatttaagaaaggaataatactagttctatacaaactctttcaaaaaatagataggaatcctgtacttcccaacttattctatgaggccagcattactctgacaccaaaatgaaacaaagacattacagaaaaagaaaaccacaatgaacacaggtgtaaaaatctttaacaatatttaggaaatcaaatttagctttatataaaaaaacatacattagttttctattaccacacacttagcagcttaaacaatacacacttattattgtacagttctgcaggctgtacaatacattcagctgctgaggcctgtacaagtctgatgcaggtctcactgggctaatgtcaaggtgttgagagggctgcattcccttctggaagttccatttccttgcctttctagcaaatccatttccttgcctttctagcttctagaggctgttttcactccttggctcatgtcttttgagcttcatagtagagttatgagtggattgcataccagcaatacagtaagagagtattctgagtttgtccaggtacttaattttacctgtaggttttatactttgaaaagttttcttttgcacattagcgttttttctttcagactgaagaactgcctttagtatttcttgcaagatggatctagtggtggtgaattctctcagcttttgtttgtctgggaaagattttatctctcctttatatttgaatgataattttgctggatacaatattcttggatggcaggctttttttgtctctctttgagcaatctgaaaatgccattccactccctcctggcctgtttagtttccttagagtaatccgttgccacatgaattagagctactttacgtgttatttgcttcttttctctgctgcttttaggatcctctctttgtccttgacctttgagagtttcatttttctatgccttggagtagtcttatttgggtcaaatctgtttggtgttctctgacctttctgtagctggatatttctctttctcaagttttggaaagttttcagttcttatccttttgaatcaactttctaccccttgctctcgcttcactctctcttgaacaccaacagcagtaattcttagatttggtcttttgaggtaattttttacatattgtaggtggtctttgttacattttattcttatttcttttttcttctctgattgtgtattttcacacagctggtttttgagctcatagattctttcctctgcttggctcactctgctgctcagagcctcttaagagttcttcagtttggcaaatgtatttctcagttctaagatttctgtttgattttttaaaattatttcaatctctttgttagatttctctgataaatttctgcttttctgtattatcttggagatacctgagtttccttaaaactgctattttaaattattggtcagaagctaatagtcgccatctcgttagggtcagtcattggatttttgctttgtcctttggggagactgtggttccctgtttgctgttgttacttgcgggtatatgtctatgtctttgcattgaaggattaattattgattctagttttctctgtccagcttgttttgtctttcattgaatatatttgcttaatctttgcaactagattgctgcctccttttcggctctaggtggcgctataagcccaggttcactttggctctagtaaacggttgcagtgctgcctgtcccaaatgggggagtcaccaaagggattatcccaggtatgttctacaggctcctaggcaggaacccctagtcagcagtgtgggaagactggctaggggttcctgcccatgggaacctgtggaatgtacctcctacagtgtggtgctgctgaatagccactctgatttggtgtctcatttggctgagttacagagcagagtttccagggttggggatggtagtctcaccttctgacctttgttgcagcctgtcctcagagatatttctccctacaggcactcacaatgcttcccatgagttaaggcagggacaggactcctgctacggaacccaagaaggtgaggaagctggttgaccactcaatttcactttttccagtgtaaaaacagaattgagggagattttccacatgcttggtgctgaaagaatgtaggggaggggactcgcagacgtggaaatctgattctccaatcatatgctcaaggtttttccacttctctgtggccctgggggctgtctcatcctcatacttgaactctgggttgttgctggtgaaaatctcaatgctatatatttgtttttggtcttctattgagggattgaagctggcttgcttctatactaccattttgaaatcctgcattccttgattcatgccctcttccttcaccttcaaagtcagcaatgggcgggcgcagtagctcacgcctgtaatcccagcactttgggaggcctaaggaggcagatcacgaggtcaggagatcgagaccatcctggctaacacagtgaagcccgtctctactaaaaatacaaaaaaattagctgggcatggtagcgggcgcctgtagtgccagctacttgggaggctgaggcaggagaatggtgtgaacccgggacctgggaggcagagcttgcagtgagccgagatcgcgccactgccctccagcctggcgacagagcaagactccgtctcaggaaaaaaaaaaaaaaaaaaagtcatcaatgatggttgaatccttttcatatcatattacccgacctcctcttctgcctccctcttccacttttaaggtcaccgattgcactggtccaaccagataatccaggacaatctcctcatcttcaggtcagtttatcagaaaccttaatttggtctgcaatcttaattccccttgtcatataacataacatattcacaggttccaggctttagggcatgtttggaggcaggagggagacgggggattactctgcctaccacaaacatgatgataaagtgatatttatcccaagactgcaatcaattttcaaatagaagaacagagttagaagaattatactatccaatttcaagaactactataaagctacagtaatcaagatttcatggaactggaatggagtgcctagtaaaacaaccacatttaaatggtcatttgctttttagcaagggtgccaaaccaaccaatagggaaatagttttttcaaaaaaaaataatgctagagtattctgatatctacgttaaaaaaaacaaacaaaaccttgacaaaccctacttcataacacacataaaaattaaagatgaatcatattacaactcaataataaaagataaccaaattaaaatattgacacaggatttaaatagacatttctctaaagaagatacacaaaaatagatggtcaatagatacacaaaaagatgtcccacattagtcatccaagaggcacaaactaaaaccataagaagataccactttatacccaataggattactatataacaaaaaagacagacaattgacaagtggtggtaaggacgtggagaaactggaacactcataaattgctggtgggagtgtaacatgatgcagctgctttgaaaaacagtgtcttagtcttgttttctgttgctgtaacagaataccataggctggttaatttatatagaaaacaagtttatttagctcatggttctggaggctgggaagtctaagaacatggtgctggcaccaggtgagggccttcatgtggtgtcataacatgacagagggcatcatatgataagagggcaagagcaagagagactgagagaactcacttttataacaaagccactctcaatgtaatgaacccattcctgtgacagtgacattaatctattcatgatggcaaaaccctcattaatccattcatgaggacagaaggattcggtttccaacacatgaacttttgggagataccttcaaaccatggcaaagggtttagcagttcctcataaagttaaacatagatttaccacatgatccaccaattccacacctaggtatatacccaagagaagtaaaaatatatgtccacacaaaaattggtacctgaatggtcatagcagcattattcataatagcccaaaaaagtaggaacaacccaaatatccattaactgattaatggattttttaaaatgtatattttcagcaatgtatagcaataaaagggatattatgcatcagcaaaaagaaatgaaatactgatttatgctacaaaatggatgaacatctaaaacattatgccaaataaaagaagccagacacaaaaagccatatattgtatgattccatttttacgaaatgtctagcttagtaaaatccataaggacaaaacatagattatgtgattgacagagggaggaaagggagttgggagtaactgctaaggggtagagaatttcttgtatgtttaatttttaaaatgttctagaattagacaatggtgatgattgcacaactttgtgaatatactaaaaaccagtgaactgtatactttaaaaggatgaatttcatggtatatgaattatatctcaataaaaacaatactgtatgaggaaaaagaagatagatcaaagacctaaatgcaacagctaaaaccataaaacttttatagaaaaacagagaataggtcttagaataggtcaaaagtttcttaaaaccaacagttttgtttaatatatttatgtataaaaatagataagacccataatggtgtaccagggagcaaaatgatgatgtaacttcagagggggaataagcagtgggagaaagtacagctctggtcagctggggagatctcattgcaagtaagcacccatcctggatgttttgccatttggatgagaggtgcgttaaagaaaaaatcctacattcaggaaaagtcttcctagtgtcacaagaatgtaaaaaatctgcttcatttaaacagtccaagcctgcccactccatgtatatttcagaacacaagcagggatatatctcagcacaaaagatgtgattcctcgagacagcattctaaatacttccctaattatcaaaacccagagcttccaagacatgtcagattctttgttcttgttttcaccagtccatcaaatttgcttggcttcttttataaaacagtagacctcctctggagtcaatgtgcttctctttctcttacaggcccctacttttatactgcattttttcagcgaggccttttgtggtaagctgaccctacaaaacatctgcctggcatatgaaacacaaaattcttttttggaaagctttctgtatgtatcagagaccatttcattgtttattccatttttggcttcctgaaagtttatggaatcaaatggaaaatgacttcaaaatagataagagattacatgaatcttttctatacttcacatagtcatgaagatatattaaccatatcagatatgaaatcatgtgctggtgatttctttttaatttacatacagtaaaattcacttattttggtgtgcatcattatggattttaacaaatagagtcatataaataccaccacaatcaggatagaacattctatcactgtgatataactcctttgtaccacctctttgtagacaaattgtacacccagccttaacccctggcaaccactgatgcttctctgtcgttaaggttttgctttttccagaatgtcatataaaaaaatcatagtgtgtgtaatcttttcagtctggcttcctgcattcagcataatgcatttgtgattcatccatgctaatgtgtgtatcaacagttcattacactactgagtagtagtccactgcacagaagtaccacatctgtttatctatttgctagttgaaggacatttgggtttttcagtttttagtaattatcaataaagatgctataaatatatgggtattgttttttgtgtgaacatgctttcattcaatttcattcaatcccatgaatgagactgctgctttcaaggtatttttttttttcatctttagttttcagcagttccattatgatgctggtgtagttttctttgagtttatcctgtttggatttcactgagcttcttgaatttgtacatgtatcttgcaccaaatttgtgaagttttcacacattattcctttatatattttttctacactaatatttctgctctctttctggactctaatgacataaatgctagaccttttgatattattccataggtccctgcagcactgtttttcttccttttttctgtgtttcaggctgtataattttctttcttttctttctttcttttttttttttttttttttgagagagggtctcactctgttgcccaggctggaatgcagtggcgctatctcagctcactgcaacctctgccctcctgggttcaagcaattctcctgcctcagcctcctgagtagctgggacgacaggcgtgtgccaccacacctgactaatttttgtattttttggtagagatggggtttcatcatgttggccaggctggtcttgaactcctagccttaagcaatctgcccacctcagcctcccaaagtgctgggattacaggcacgagccaccacgaccagcccagactgtataatttctattgatctatcttgaagttcaccgactcttctttatcagctccattctgctattggacccatagagttaattttaaatttcagatattgtgtttttcagttctataattttcatttgttttgtttgttcatttgtttggctttagtttctatttcactgctatttttccattcatttcaagagtgttcaactttgtctcatggagaatggttacaatagctgcattaaagtttttgtctgacaacaccaatatttggatgatcatctcaaatgagctcatcacagctgaaataatctatttttagtcttttcccttgagtactgctcgtattttcctgtttttttttttttgtataatgagtaattttggactgtctattagacattttgaataccatgttctgagcctctaggtctagttaaaatcctctcgagggtgttgatgtttgtttggttaagcagagaatcaacctagtgagactcagaccacaagttttgtctcaccttctgtggacagtggctctaatgtcagtttagtttttaaagcctttgctatgaggtttgggtttgcccagcgcatgtgccactcaggggttaatctaggacctgggcagtggttcacatggcagttgagttttcgaagcctctgctttgctcctttgggcctgtgtggcatatatgcacttggaggtgagcctggggcttagctcatacacagaatcaggggatcctcttctccagttcttctctccctttagatccttcagatccacccccaacctccgctccaggggcccctttatgtggtttctctgatcagaaaaacaggtttctgttaggttgtagttccccattctgtcatgcacttctgcataactgaggttgcctttgggagcaaagtagcaaaaaaaaaaaaaaaaaaaaaaaaaaagaggaaaataacagagattatctcacactccggtcagaaatgtgggtcttcttttgagattttaggtgcctgcaccccaccacaacaccaatgcagatcttcaactggggcctgtcttggggtagagttaagaaagaaaagggaaagaaaaagaaaaaacagtctggacactgtggctcacaccagccaggcaacatagtgtgatccaatcgctaaccaaacataaaaaattaaaaaaaaaaaaaattagccaagtgtagtggtgcatgactgcagtcccagctatttgggaagctaaggcaggaggatcacttgagcccaggaggtagaggctgcagtgagctatggttacaccactgtactccagcctgggcaacagcgtgagactcaatctcaaaaaattaaaagaaaagaaaaaacaaataaaataggaattccccatattcttgagcaagagcccactttcctagacctctggttagaagtaggaggtttctcttggagatgttgctgccagtgcctgctgcatagttccataattccattggctcttaggtcaaagccaagagatagaggagagaaaataaacctccaaaactcaccacacaagggattcatgaagctttgactttattccccattctccattcacctgattttgttttcttctctgtccctattcttatcatccctgctgttatattaggttggtgcaaaagtaattgcagttttcgaaaacctcaattactttagcaccaacctaagtacttttaagaagcctcagatagttgctttcagtattatccagagtttttaatcaatgagaaagatatttgttgacttcctccatcctggtgagcacgggaaggtggtgcccatgattttaatgagaatgggctaagggaacttgtgatacttgtcttgattttttttaaaccttcatctgaattgatacaggagcatacttcatgtcaggtaagaataaaaaaggaaacaattatttgacacaccttaattaagcacctgctaggtgcccgctactctgggaaaaggcaacaggggttcaacacatggtccctgctttcgagggaggcaacatccacagaaagcatagcctatgtgaaaaaatacaagactgtacacaactaagggcaaaaaagatacagagaaaggaaacaaggtaaaaactggggaattagaggtgacacggaggccgttcaagcccccagctagaccttgatggagaagacaaggcactttccatcagagggcaaggggatggggcggggtgattattattccaaagttggctttgtacctttttattacacagtgagtttgttttcccaaaaggaaagaaagagactgtttctaagggcatttgatcactcctgaccctgttcttccctcgccttctctcaacgtggtggaaaagtgtttccaggactttggttcagagtgaggactggaggcccagccacactggagtgagtcatgagatctttcctggggagtcttgaattaccacatacaaaactctcagtaactgtcggaactcagctggttgctggttttgcttgcatgctttagctgcgttaaagcactcggtagtttatttttcatattttatttgggttaattcctaaaaatcacaaaggcagcgccttcatgctaggacagtatctattatattttttaaaattttgttaagtattcaggaaggctttgcgtggactgctcctgttagaagacaaccacaaagcgggggaggccacgggtagagcggttgcacagatggcaagtgtaagcaaatagcggccaagtccattgtgaagtttcacttgcagctgtgtggaaaatacctatgctggtgactcaatgtctttggatttctagctttaaattacagcagagaagactcattttcaagtgctgagcatatagggagactggcaaatgtgggccagttttgagcccatcagttaccatacactgcactacagaaggataattaaaagcagggggaagggggaagtcttgtggtaatcagggcatcaagcatggtacctggacagctggcatggcaaccaacctgacagcaatactgtgtctatttccaataatagaaatttagctcccttccagtgtagctgtatgctggggtcttgattttcttttctggaatgaggtgtgcgcagatgcaacgttattgctcacctggcccatcagagtcacgtataaatggtcaggccagtgactgtatcatacttgtgcctctcacagttttgtctgggaactctaccttgtgttgtaaaagaccttgtgtcctctgacccccctcccccgacttccactctcctcttggtctgccgctgggactgtattttgtcgcttatctaacacaaaataaacagaacaatctggagctaatttaagtggtttaccatatcaggatacagctgggaaagattttaagaaaaggctcaacaggaacaatagcgctgtgaagtggagcagcagcggagagcacaggaaggcagtttcaggcagcctggcagacagctgtcagccactccaataacaattcctgcagccaatgaaaacgggcaggctctgtgcgggcagcctggccggaacaccaacaatgaaaacaagggattagagagcattctcagttaatggcttgagtgtcagggccaccagtctcccgggagccagtgctcccaaccagcaaggactggagaggaactgcagatgaaacaacacttcatttctctacaacactggccaagacttttttttttttttttgacatgcatgcatccacgctggctttatcctgacttatgaatccagcaaggcccacagaggaacatctggttttgacattaatttcttctactctgcaggatggttgggtttttaactcattgggggcctttggctagaccttgaatttcctggtgcaacttgacagaggtgagagggcttgagggagttaaataaaactatgtgctgcccttgaaaggacttgcaaatgctttatatattaaacaaagaaactccacttggatcaagctcttgacaaagatccaaccaattaggtaaacggtatagtctcgaaaggcagtgacatttcatgcaaggaatactgaattggaagcatggagacttggactcttggtctacttctgtcactgcaaaaggtttctgggtcaaagtttcctcacttaggaccatgtgcccttatcctcttcttcatcatttcatttatgatattagcttatgctcacacatttttttttccagagagtacttgacttagtaaaaatttccctctaacaacagcaacttttgggtttattataaagtaattccacatgtttaagaataactttaaaaaataatctgtgtctgtgttcttaagttgtagggaaaagagagagagatcagaccattactgtctctatgtagaaagggaaagacataagaaactccattttgatctgtaccctgaacaattgctttgccctgagatgctgttaatctgtaactttgccccaaccttgagctcacagaaacatgtgttgtatggaatcaaggtttaagggatctagggctgtgtgggatgtgccttgttaacaaaatgtttacaggcagtatgtttggtaaaagtcatcgccattctccattctcgataaaccaggggcacaatgcactgcagaaagccacagggacctctgcccaggaaaactgggtattatccaaggtttctccccatgtgatagtctgaaatatggccttgtgggatgggaaagacctgaccatccccccagcccgagacccgtgaagggtctgtgctgaggaggattagcaaaagaggaaggcctcttgcagttgagatagaggaaggccactgtctcctgcctgcccctgggaactgaatgtctcggtataaaacccgattgtacatttgttcaattctgagataggagaaaagccgccctgtggcgggaggcgagacatgttggcagcaatgctgctctgctactctttactccactgagatgtttgggtggagagaagcataaatgtggcctacatgcacatccaggcatagtaccttcccttgaacttatttgtgacacagattcctttgctcacatgttttcttgctgaccttctccccactatcaccctgttctcctgccgcattcctcttgctgagatagtgaaaatagtaatcaataaatactgaggaaacccggggaccggtgccggtgcaggtcctctgtatgctaagcaccggtctcctgggcccgctgttctttctctatactttgtctctgtgtcttatttcttttctcagtctctcgtcccacccgatgagaaatacccacaggtgtggaggggctggcccccttcataaagtaagaagaatgtcatctgaaggtccaataaaaataaacaaatgaagaagtagaaattaatgttgtattagtcactgccccatctattgttacatcacatcataatacatcattgaaatagcattgattattaaagtttccatgataatagaatgtaagactaaattttcagtgtaaaaataagagagatatggataggtcttctaaaagcagaaaagaagatgaaaacttctaaaggataaaaagatgggtaggattgggaaatatcccctttagaaatagaacatctcttctatttctagaccaagtaagttcagacaacgattacttcaaaaatatctgagcacactaaaaaaatttttaaaaatccaactatctgaaaatataaaatctctctagaacagctctcaagcaatagtgtgtcgaatcacctagaagtcttgtgaaaacagactgctgggaaccatctccagagcttctggtccagaaaggggcctgagaatttgcctttctaacaagtttccaggtgatagtgatattgctgctcctgggaccatacttagagaactattgctccagaaagagatttaatggctaatacaataaagtcaagtgatcttactctgtatttttgttgttgttgttcttttaaatcaacaaaagtgattcaagtgtcaagtgtggttgaatggtgagaatgaaaaaataagcaaaaaacgaaggggtattgaatcagtgcagaatagtcagaagtcacacacagagaaaatggatgtattttacctttggtgaggagtaaattataaaaggactgtagctactttctgaaaggtaaaattgtcctgactcaaggatgaaaaggtatgtcaaaggggaatgttttataataatgagtccctgggtctagacctgataccagtggttctcatcctggctacattatagaattacttgggcacactttgggaggccaacgcagatggatcatctgaggtcaggagtttgagaccagcctggccaacatggtgaaaccccgtctctactaaaaatacaaaaattagccgggtgtggtggtgcacgcctgtaattccagctactcaggaggctgaggcactagaatcgcttgaaaccaggaggcggaggttgcagtgagctcagatcgcacaactgcactccagcctggggaacagagtgagactccctctaaaaaaaaaaaaaaaaaaaaaaaaaaaaaaaaaaaaaaagaataacttgggcaattagaaacttgaaagggggctttccgggtgatttccaagtacagagaagattatgaacctgcctacaaggtgttctactctgcagaaaagatgaagtgttgaatcacaaagagacgagagacacagctttctatggatggtgattttaattcccatgactggaccacagaatctcaatacaaagacaatgaggtcaagatagattaaatgatatgcaagaggctgtacagctagttaggggcaaatccactattaaacctcttttcctgaagcccatccaaatttctgtctaccatattatttgactgaatttgcaataataattttaaaaatagaaaaaaggtggtatttggggagaatctaaaatagagatctcagtacacaacagtaaggtcaattatcacattggagattccagtgttttcaatcaaaatatccactataagaaactaagaagtcaacacaggctttcatcaattctgaaactacctctaatgtaaacagagctttcactatctacaagccaagtggttccagtgaggttggttactgacgttattgtagtacacaaaagccatgggaaattgaagcataaggaaaaagagagaagatggcctacagtgatgttgtctggcaaccttaagagatcacaggcaggctcttctccagcaagctgtttctcatactccatcaacgatatcaacatattgcactgggagaggtttgccagaaggaaagtgaggtcatggagtgatttggtgaagcccacagctcgtctgtaactcagcctactttatgggactcaaagtgaattaaaactacattttaaaagctgtgtcttccacctggttctcctcactgtttttggctagcaggaaaagggcctgtcagttttatctgtaggaggtaaaaaggaacagcacatttcagggaaaagcaaataaacatatttgctgcggtggtttcaggtttaccaatgcagcaggtgggtcaggaagcacagcactgatcccaatcactgcaacattaacattttgctcaaccaaacatgatgtcacatggcccatgagaaagcatgttttgagctcataatatgaaatagaggtcagacaggagcttctcccccatgtgaccaacgcatctacattttacaggaatttcttcctcttgggatcaattcacaatacctctatccatttccatgtcttgataaaaaccaaatagaaaatcagaaattatttttaaagcagctttgctgaaagaatattcaaggcattagaaagaaagaatcaatatatcattttgatcacttaaaagctttttttcatggttactcaaaacccacgcagagctaggagatagggctcattaaatcagagggattctggaagaccatttcctggtcagctggagcaatgttgcctgcaccagtcctatccctaacagccaaaaactgtgatgagaaccaggcttttaaaatgtagttttaattcgctttttttttttttttcttttgttgagacagagtctcgctgtcgcccaggctggagtgcagtggcgcgatctccgctcactgcaggctccgcctcccaggttcacgccattctcctgcctcagcctcccaagtagctgggactacaggcgcccgccacctcgcccggctaattttttgtgtttttagtagagacggggtttcaccgtgttagccaggatggtctcgatctcctgacctcgtgatccgcccgcctcagcctctcaaagtgcttgggattacaggcgtgagccaccgcgcccggcttaattcgcttttgagtttcataaagtaggccaagttacagacaaatgcagcagtgtgaggtagactttctatttttcctatcctgttgtgtgatggaacttacttatttcttttgattctcaggtttctcatgctataattaaacacaaatgtggctcctatcattttattttacaaaagtgagttagagcctcttaatccatatttcaatataggctcagtgttacatatttgtgtttggagctgaaatccacagacctgccagcttagtgcatcacaattattctctgctactatgtgtacatgtttataccaaagtataaaggtacccaagatttcagctgggggaaaaaaaatttctttgctagctgtagtcacctcaataatgatttcttaagatgactgctattgttaaaactcatgtttttaaaaaaatttttagtgtcagaaaaattttcactataaaaggttaaatatttaccttaggagtagaataataataattcacattttcctctttatacctttcaataccatgattttttttttttttttttagacaagataccactttatcacccaggcaggagtgcggtggtgcaatcatagtacgttgtaacctcaaactcctgggctcaagtcatcttctcacctcagccttctgagtagctgggattacagatatgtgccaccacacccagctaatatttaaaacttttttttcgagacagggtctcactatgttgctcaggctggtctcaaattcctggcctcaagtaatcttcctgccttggcctcccaaagtgctgggattacaagcatgaaccactgtgcccagcagccacatattaatattttttatcagaaacattatcaaatttttaattaaaattaatgaacaaataataaggatttctttcaaaagctgactttaaatctaaaatcatgtggtttattatacaataaagtctaatctggtaatccaaaagttagaaagtattattttaaatattaatttacaaagaagaaagaaatgaactaggaagtactaccttgttttacagagaaaagtaacatttcagagtctattatttaacaatataaaagaaaacaagcccttaatgtgaccaccaatccttctcaatgccacaccttgttggacagaatggcccacgtatcagaatggagcagcccaacaaatactcagagccatcagatgatgccaaggatacctcattattcgttttatttcatgaaagtctttgtttttgagacagagtctcgctctgtcactcaggctggcgtgcatgatctcagctcactacaatctccgccaggttcaagcgattctcctgcctcagcctcccgagtagctgggactacaggtacctgccaccacgcccagctaatttttctgttttcagtagaggcagggtttggtcatgttggccaggctgttctttaactctggctcaagtgacctgccttggcctcccaaagtgctgggatttataggtggtagccaccacacctggcctcatgaaagtcttcttatggacattaaacgttcctattatttttctagtaatttgccaggcaatgggctactttctttagtttttgagcttgctccttgttccttatgtgtgtatttttgcctagaagagacataattcaattctggcagaaactttcccttttgtcaaacaaatctggttttcactatcaatgcgcaatcagcttggtttctgcttcccagtcatttcctggatacctttttgagttatttgataattacttgaccaagaactactgctgccacctctaatcaattaaaattgacacaatttctaggcccttggctttttttttttcttgaagtttcatcagtcatgaccttaggacctttctgagctgcattgataccgtaactaaaaggaaaacaagtgattccaggaaaagactatctgcattgaggatcgtgattaggaaagcactttgttaatgtcagtcgaaggcaagctaactctacacactaaaagaaaagatgtcctacaggcaataatgagaaaggtcaaataggctttctactaaatatggatactacattaatttggggaaaaaaagaaaaggagagtgagggtatgaataagaaggtaaaatggaagctaacaccaaccagatctaagtggacactacaggttgaatactccttgtccaaaacacttaggaccagaagtgtttgggatttaaaattttttttgtgggatatttgcatatacataatgatacatcttggggctgggatcaaatctaaacacaaaattcatttatgtttcatatacacatagcctgaaggtaattttatacaatattttaaataattttgtgcatgaaacaaagtttgactgcattttgaatgcgactagtcaaagaaggtcacgtgtggaaccttccacttgtggcatcatatcggctcaagaagttccagatttgggagcatttcagatggtggattttcaggttagggatgctcatcctgtatagcctttatgtagtcttagtttgtgtcttcattaatgctctgagattagcatttattacaagtcttccttaagatcaatgattcattgtaaaattactgaagttcgggatgaatataatgtggtaagcgcgtatgacttccataaaatccaaaatatccaagatacttacatctcatatgtgaacagctgataataattacacactctaccttacatttcttttaaggctctcagcaggcggtctatgacagcttcccatgcaagttctaaggcaagataagagacaaagctgtggccaggtgccctgactacggaaagaaagagaaaaaaggcccagaaatcttccctggcctgttccagtccagaagaaaggagactgggcctgggcacacagacaaactgtctttagtttaaagaggagaacagactttatcagatttcagggttaatgtggtaaaacactaaacttgcctgtcttccgggaaaatgcacgtagaacaagaggtcactgagatgaggacccctgggaatcctacctcaagaccctctgtttccttcccatccccaaagacatctttctcttattgataaaaacagaaagataagaaggaagctacaacatcaatttgttctgcagattaaatgttacattaatgccaagttttctccttgagatttatcattttcctattaagttgtatcatttatcatgtcctaaaagcaatacaagtgtgtaagaaaatcaggaatggagcaaagaatgagacaaaggtttagtaagtggaggttgttattcattcttggggggatctttttggcctgtttctaccagtaattataaacacatagatacacacacacatgtatttcaatgtcaaactttaaattaccaacttgctatgtgccaagcacagggaatgatatagtggtgaacaagacagacaaggcccctgctcctataaagctgaattctggtgaaggagacaggtgataaataaggaaagcaaataataaacgttgagagaattcccactgtggtgagtgccaggacagaaaccaaacactgtgatggggcagaccatgagggaaaagggagagggtgcagaagatagaggagttgacttctgagctgagaattaaaatgaccaggagtcaaccctgtcaggtcaggatgaagagagctctaggcagaggaagctcaagttcaaaggccctctctaatacagtattaggtagttggatacattgtgccaaagttccttttaaactacagactatattctatattcctatagttgtctgttgtcaagaaaaacttaagctaaatgcataaagcacaaaggaacgtcaactcaaattttatgattatcattacttctctctcattatctgtataacccacctacttaattttattgaaatttatttatctgataggatacatgcccatctgaagtcatttttttttcttttttgtctgagcatacgcatttttctcaattaaatcactggttttttaaaatgcaattgtgtttgttttattttattttattttattttgagacagagtctcactctatcatccaggctggagtgtggtggcacaatcttggctcatcgcaacctctgcctcctgggttgaagtgattctcatgcctcagcctccagagtagctcggattacagttgtgtgccaccacacccagctaatttttatgttttcagtaaagacgaggttttgccatgttggccaggctggtctcgaattcctaacctcaagtgatccacccacctcggcctcccaaagtgctgggattacaggagtgagccactgtgcccagcctgcagttatgtttaaaggtggaatattaaaccacaggttcaagggggaatcaaggaagactagatatacttcaatcaaatttggccaccatcagttaatttcttagaaacttataagagaacagaccaagagacagacacaactcaaacagtcaccacacttccttacgctggctcatcagcatcatgagacaggctttcaaccctaaagacaattcattctagtttttaactataaatttgactgaggtgtagaaaatagatgtattagtaaataggcttattgtttctcttaggaattgtattgtcttctaaatacagcaactaaatatttgacatgtaattttatagttaatatatctgcacattagggatttctgatggcactattacatacatattaaaaccactactcttaatgcttctgttagctgaagtcagaagctttaggaaggcaacacattgtgaggtttttttattaagttattttctacgtggaattaaactttatagaaacttttcagggatgttttaattcagttcattgcagactgtatcaaattttatttcaagggactttcttacactgaaaaaaataaattccttattttagaatagttttagatatacagaaatgttgcagaaagtttccatatgccccaagcccagttttctctattgctaacaactgacattagtctcataaattttaagtggcaaaaatctcaatatcatgtgcacacacacacacacacacatgcatgcacaaatacacatctaaagaactttcaacccaacatggtatttctgaaacttagaaactttcaagacctcttcttaatgcctgattttctaaaatgttagaataacagtgatttattaaattaagtaactcttcttcagacatttttagagtcaaagcaatttttatcaaaaggtcactaccaaataattagctaattagcaagaacatttttttctcagttcaaaaagtaattagaaattataaccatgaaggggtgctaattgggttttcacagaagcattaagtgcctgaacatttttttcatttgtttcacccctctgccgatgaaagttaccgtgattaatcctttctcttctgcatgacaacagcaacataaaatgctgcagttgagtactggtaatagaggataaggaacagagtcaattaagatttgggattttccataagtgtgagatttcctattgattggctacaatttcaatacaggaagctaggaaccccactctccaatctgagagaagaaggtggagttgcagagagaatggagctcaatattccctcgtgggctcacctgctgtgactttatacagcatgttagctgatgttccggtgaacctgtgacccacactggagaatgatcatgacagggcaagctgtggggaccacatagtccttattccattaatgtctgcttaccacaaacatcagcgcacttgcaacatccccgtggttcttgaatgtggagaagctgccagtgccagtagctagcctgggattggacttcaggcagagttcatgtatgatccaaatacccaagtttggtcaagtttgattcacttttgtgtgcttagtgtgcagccctgcattgaggaaccactgagagagttacttatttattcatttattcatttatttatttatttatttatttttgagagggagtctcgctctgtcacccaggctggagtgcagtggcacgatcttggctcattgcaacctccgcctcccggattcaagtgattctccagcctcagcctcctgagtagctgggattacaggtgtgtgccaccacacccggataatttttgtatttttagtagagacggggattcaccatgttggtcaggctggtctcgaactcctgacctcatgatctgcccgcctcggcctcccaaagtacaggagtgagctgggtttacaggagtgagccaccgcaccctgctgagagaataattttctaatagatgaagaagtaaagcgttcacttaccctaaaagaactgcagagattttgagtgatacatacctctagaagcccaggaatcaagggctttccaataaggcaaacacaaagctctcatctgaattcagagcactggctggtttgcacagagcactggctgctaagtgcccagactcctgtttggcaagccagtgtcctagggagcatgaatgcattttcagggaaaaaaaggccagcttcacatccaaacccccaagagataggaggagggaatttggacagaggagccacctgttacaaatgaattccagaaagggtaacaagtgtgttctctgagaaaagaaattgggtggctggagggaggcagacttacttttcattcagatgctcttgtcattttaaaattttgtactttgtgcactgttggttcaaaaataaaataggctggatgcggtggctcacacctgtaatcccagcactttgggaggccaaggtgggaggatcgcttgaacccaggagtttgagaccagcctgagcaacatagcaagactgtctctaataaaaaataaaataaattattatttaaaagtgaactctggatgaagtcatttatctggaataagactactgtgcagtcatctgagcaacacttcaaacaggagacaggatggaagtcaggggtagaaagatacactgtgagacttaggtcttagtggtcctctaccctgctagccacaggccatacctgcggcgggttatcagaaccctcagaaggcaataaggctgggacagcagtgggggacacacctccaccacaggggatggggtgagcatccctcggcacctggactcttgtccccatagagctctgcacatctggtgatctgactcctaaaaccattcctctgtgcttcagctcctcatagatcaccatcagaagtccttacagccagaacctctggctcacattgagatctggctctccccagaggacaactgcttcctctgcagccttgttgcttgttactgcacttcctaactttttcccaccctcctttctaactgctgccccgccaggttagaagcccatgctatcagactatactacttgattacagggatttacaaactcctggatcagacctgccaggagtttgtagattctcttttgaagattttaagacctaacatcctatcagtctctccactctctcataaaccttgatgaattcaaagctgacacagatgatctttcccaaaacctggacgctcaatgacctgtccttttctccttccatgatctaaatttccactctgctaaagaaactcaatcccagagttgtatcctagatcttaagattataaatatttgcaaaccctccacaatctcagtttcaagtctcactctccaatgaccaccaaccatcttccagctcacttcctttagagctgagctgttcaaaacaatacccactgggcacatgcggctagaaatgtggctagtctgaattgaggtgttctgtaagtataaaatacacaacagactgtgcgtgtgtgtgtgtgtatacacacacatatatgtgtatgtacatacatatgtatgtgtatatatgtgtgtgtaaaagactgtaaaacatctcatcaataactttttatattgattataaactgaaataatattttggatatacggaatatctaattactaaaattaatttcacgtgtttctttttagttttttaatgtggctatttaaaattacatatgtggagaagattaaaatcatatcatgtatcttttctgaccacaatgctttgaaaccagaaatcagtaacagaagagatctggaaaattcacaaatacagtatgtggaaattatacaacatgctcttgaataaccaatgggttaaagaagaaatcaaaagggaagtcaaaaatatcttgagacatatcacttaaatgtctccttcatatcactaaaagaggcattgaagagggtaggaaagacagtcacgaattgctgccatgcctcacacatctccccagtagcagctgcgtggcacagagacagaatctgtgttcttgggggaaggaaggtgtagcgattgtgggactgtgcactggaactcagtgctgccctaaaacagtggaaagcaacaccggcagaattcagctggcacccgtggagggagcatttagaccagccctggccagaggggatcaacaatcccagtggttggaatcgaagttccagcaaggctcaccaccatgggctcaagtgctctgggattctaaataaactttaaggtagtccagggtacaaggactgcaatttctaggcaaatcctaataccatgctgggcttagagccagtggatttggtggggggggaggagggggcacgtgacctactgagacaccagctaggatggccaagggagtgcagctcgcagccctgggaaagactacttctttccactcaagaagaggagagggatgactaaagaggcctctgtctaacaacttggataccagctcagccacagcaggatagggcaccagacagagtcctgaggtccccattccaggccctacctcctggaggacatgtctagatatatcctgggccagaagggagcccactaccttgaagggaagaacccagtcctggcagcattcatcacctgctaacttaagagcccttgggctctgaatagtcagcagcaatacccaggcagtacttgcagtaggccttgaacgggattcagagccaggctggcttcaggtgtgacccagcacattcccagctgtggtgcctataaggagggatgtcttctgcttgagaaaaggagagggaattgtaaagcggacttttgtcttgcagcttaagcatcagctcagccacagtgaggtaaagtaccaagctgactcttgatatccctgattccaggccttggttcttagcatttctggagctgcccctgggcagtgacggggtttcaccatgttgaccaggatggtcttgatctcctgacctcgtgatcctcccgcctcggcctcccaaagtgctgggattacaggcatgaaccaccgcacctggactataataacagattcttaatctttcaagctccaacctgctgtgagttggtcaggacaagggagtcagtatgaacatgtgactataaggaaacgctttttgaaattatctttgcttggaccaaaggcagaagtttgcatgtaggtagtttatgttggaagtgatcccagagagcaggagggaaaggctgggagagccaaacagggagggagggaaaaagcaacacctggatgtgttatcaagttggctgaccaccgccacaggtggctcatgctccatctcactgggaccctttgagaattccaataagattcatctcacagctgggggatccatgggggaaacatccatccactggttcccaatgagtaagtgtggccccatgggcactgactcccagcacacctgggttatgcacatgtgagcccctcagtgtcagaaaacatgggctcagggcaaggcactgtgattgcccctgtgagaaactcacgaaagcctgctctgacctggtcaccatagcagcagctggaacaaaatatggtgcttcaagcatctgcagtgatgcatagacgcgtctacaagagacactgtcttagtaagtgtggtttctaaatgacagcctggagctgaaggatgcaattgtggcttttgctttaactatggatcacagtcccttaagctcacgtcgtcatctgaaaaacagagaataacatacctacctcacattctggaaaagacttaaaactaaaatgctgccattcaatagttttaagaatttcagtaagatttaaagacagcaattggctattgagtcattagctcctgcttgccccaatcctacccagttgcaaattctgaggacttcagtgaataggttcagctctgctcaggccctagagactgacagcttcatgttgagtctacagttttctctgctaccctacagtattatgtgtgggcatctgcctgctttccaaatgtacattccagtttcctgaaagcgaggttccaaggcctgcccagcccttatgaacctccttttccagggggtgctgggctctgtccacatagcatggctgaatatgatcctgcttcttcctggacctacggaacctaaacatggatataatatttgtaattgcccagagattactgctgcagtatcctcaccaaccagtgcaaaatggcaaaagcccagatagtgatgatgatgaagataataataatagctgtatttattaaattcctgcttatgccaggcctggtgctaggtgctttatgtgaattctctcatttaatcctcacaatagtccgctgagcaagctttatccctattttgcagataacaaaacagatgctcagaaaagtaatttatccatatcaccaaattagtaagtggtagaatgagggcctgagcctcaggtctgtacaattacagagcctctattccgatttaatcattgtgctacacagtctctccaagatgggtcctaaacctgccatgtctacttggccgtgataagtcagactccttgtcaattttctggagcctgtcctatagccagctcagcctcctatctatggctttgcccagccttggcttcccaccttctccctgttcccaacatgccaagttgagtctactattaacaatattttccaaggaattgactggacctggaatctttttggtacatttccgtatcagtcatttgacttgagcagtctttgaaatcaaaaagtgatataaagtcctcatgtattctttgagttacgattaaatctaggtttattaccaagttcctacgatgagcaatatatgcccaaagctaagactagtaagagagcaaggagaatgtgcttcagggaatagactgaattggggttgagataatgacatgtaactttaaaagcaaagcattgtcctgaaacaccaacaattaaaatcatttttcttttccaaaatgtgtctcttactctctacacactgtatatatacatgacagggagaaagatccaccgaccattattttcacacctgcaaacatattctcaaagttccatatgtttttcaaggcctcaatgcttaagaaaatacaccttggctgactggttgcatatctccaaggaagaggctgtttatgtctgctcctgtctgaatcttgagacttggaacaccttattatcatgacccataatttcttcctcatttacagttctcagcaggatctccagttgatggctacacagaccgtgccctaatccataggaacacagtttctgcattcaatgtaaaaagtgatcttgcttaagtcccaaaatcaattagtgcttcaagacttgggaaaatattatcaacaaaggaatagccacccaaggaaaaaagcaaataaatccctgcagagaaaataaatgccattcatttccagtcatatacagcaataaaactgattaaattcctcacaaatataagctgacaaagcagtgggaatgtgataatgaaggtctcatagcttcacagggactttgcctccgagaagctagcaaggatgcctaaatcctttttattactattgggaggaaagaagtagcaagattgagaattctttacctctgttacagttctataaatttttataaataactgtattactaagcaaagcacagggtagaatttaagaaaaaggaatgcccctaaaaatgagatatacctccccacttttcagaacagtatgttctgtcgtaaacaagacactttactattcacatagccatgtgatactatgattgcagcacctgaaatggaaagtaaaagatctaaattttcaaaccatttctggcactggtcccctgtgcttttcgacaaatgacttccctgtgtttatttcccgatttacaaaacggtgataattatttctaacctaccccagagaagtagaagataaagcatgctccagaacaaaaagtatttttaaaagaccttaataataacaaccctcttttttggaaaaaaagattgtttctattttatggggaaatactttactaatcgtgagtttgtccatagaaagattttataatattaaaaaagaaagattcctgaatatggatggattagccttgagaatatatttgaactatatagtttctaatgattaaaatttcaaagaaaatatgttttacaatatggatcctgaataacatattcaggatcccacaatcctatttgttgtatgttataataacttttcttccggccataatcctattttttatatgttgtaataatttctcttctggcaccaaggaagaaaggatagcacatcacagcaaacaagttaagcatctgggttttctttgaagcagctggaaaggctttctttccccattctgcctccattatgttgcattctgcattgatgaaataacaataggtatgatcgtggttcctgtccaagtgcctttctacatgctgagtccccactggaggtatggactataagaaatgaaacttgcttcccccactttttttttttctttaacattccaaccccagtcttatgcaaccaaatgaattgcatctttcaatggagtcactgggaggcaatacccttatttcaaagatgatgctcaaaactggttttggaattgccttcgaagccagtttatgagtttcctaagcaaaatgactttactactcctgcctccaaagtacattaaacagacacagcttttgccttgaagactcttacagtctactatgtgttattctcacccagcctgatcattgcaagagaaaatcttcaacaaaataatccctggagaactctcaagaggtatgaattactgcaattatgaagctaccatctaaagcagcactgtctaatggaaacaaaatgtgagccacaaatgtaatttaaaatcttctagtggccagatcatgaaaagataaaaataaactgttgaaattaattttttttgagacagggttttgctctgttgcccaggctggagtgcaatggcatgatcaccactcactgcagccttgacctccctggctcagtcaatcctcccacctcagcctcccgagtagctaggaccacaggcatgtgccatcacacccagctaatttttgtatctttttgtacagatggggtttcaccctgtttccaaggctggtctctaattcctgggctcaagtgatcaagttctgggattgcaggcgtgagccaccacgcctgcctggctgaaattaattttaataatatattttattcaacccaatatataaaaatattatcatttcaatatgtaattcatataaaaattatggaggtattatttttcattattttttcatatcatctttgaaattcagtattttacccttacagcacatctcaattcaactttaccacatttcaaatgctcaatagccatgtatgactagtggctacctgttgaacagcacagacccaggcccttttctcccctgaataatgaaggccagggcactatttagtattgaataactgagctcttcctgccattttcttaattcctttaatttatgagtagataaagtataaaaacactatctataacactgggcagtttggtgttctaacaaagaaaatcttaggtcaatccaacacacaccggaaagaatagaagtcaaaacagagatagtaaagaaaggcttagaggctctttcacccaccaccaattctgcctctgattggcctctgatgccacactagcttggagagactgtatgcagcttcctcaaagctgggaaaaggccagaggcagctttgaaccagaggagtttgcctctgcctaggaaaaacagaacctgttatctaaattgcctaatgattcacaacccaaacaaaggaaactcacaagaccagaatccagagacagcagggggccagaaaaagctgagacaggaatgtcatgcttaggaccagaaggggagaaaggagatgaaattgaagactcaagaaatgcctctgaagactcttaatttcattatctcaagagaccaaggcagccaggcctctgtgcattcttaggagtgcagactccatggcccagactgtgcgcagacagacttcatatctgtcacatgggatggaggcacatccttcggggagtcacattaaccatcatcaagatttgccagtgtcaagaagcacaggatgagtatgatgggtccaaagggcctgggacctgaagagggctgtctaacagccaagcaaaccccatggccacatgctagactgcttccccactgcccacagggagctaagggaaaccatagctcgtgcctcatgatgtaagtaaggatctgtgggcaactgtgattgccatttgcttttgcttttttttttttttttttttttttttttgagacagagtcttgctctgtcacacaggctggagtgcagtggtgccatctcagctcactgcaatctccgcctcccaggttcaagcgattctcctgcctcagcctctgagtagctgggactacaggggcataccaccacatctggctaattttttatatttttagtagagatggggtttcgccatgttggccaggctggtctcgaactgctgacttcaggtgatccgcccacctcggcctcccaaagtgctgggattacaggcgtgagccgccatgcccggctgcttttgctatttttgtgaatgaaggaataaagttgatctcctttaaagaatttaaaattcttccatcgaagaatcaaaagaaaacaatggaaacctgagattttgaactttaacaaaaatccatgaaattaattgtattctcttccataatttgcctgttttaatataacaatgttttaaattattaaccagataaattatttattttcccttctatatattcaagcaaaatgaacactccaggaagatgtgccccatttctcctgtggtcttgtgtgcctctttgaacaccaaaggctggacaggcctagtcaacatgctcagaacacaccttcacttcctcttcctacatccctgctcactccccatgcccaaaacgtcctgctctccgtgtccattgcctacctacatcttaacaatcactcaagcacagtttaatggatgtcccgcctcccctaagaagctcctcaatgacccctctgctgtccagacttcatctttctgttctgcccttaacctggggaaccgtggctcctgcagatgtgtagctgaatcttgaatccacgcatactcctgtacctcacacagtccccgagttctttgctaggcattgtgctagactagtgcctgacatgtttttggtccctccttcacaattcacactccctttggtaacatttcttctcatactaagtgattttcagtctagagggcaaggaatcaacacagtctttacaggggatggatcatggcctcagacacgggaaaggaaatctccacaccacacacttgcctgaccccctcttcacccacagaggaatctgagacttgtgcctcacactgaattagagaccactaccatgattctaggtgtgctttaagagaggagactggcccggcgcagtggctcactcctgtaatcctagcactttgggaggccgagacaggtggttctcctgaggacaggagttagaaaacagcctggcccacatagcaaaaccccgtttctactaaaaatacaaaaaaatttgcccagtgtggtggtgggtgcctgtaatcccagctactagagaggctgaggcaggagagtcactagaaccctgggggctgagattgcagtcagccgagatcgcgccactgcactccagcctgggtgacaaagcaagactctgtctcaaaaaaaaaaaaaaaaaaagagggagactgtatcttactgatcttcagaactcctcaggacagtacattgtcttaaataacaagtagagttatgcttgttaaagttatgcttgttaactgactaatttctgttaccaaaaagaaaataatgagtggtcaggtgacctcacctgggaccagcctgatgatcacaacccaccatagacaccaaccggtcaggccactccctccagcgactcacagatgtgatctgaatgcactgtacacagggttatttgcagccctgagttttccttaggccccactactcagcctgctctattacctctggactccagagggaccttcaaacaaaaggggacaccaaagtgggagtttaaaatggcaacctacggccagcactgtcagcgcaaacacagcactccctttgttccccacctctatttcttttatattttgactaatttgcatgtatctgaatagttcaccagatcacaggctattttgaggacaggtatataacttttttggtagcttccacggcaatggatgtcattcttaatgtttgctaaatttgttacaacaatcctcattttttaaaaagaagatattgacaagaaagtgttctgagatggaaacaaaagaaaaagaaaaagaaaaaaagatccttttctttgaatagtcacggtaggagaggctgattagatatggcccatactgtgaaagaaaaatacaaaaaaagatcataaagattacagtcagttaagagtgtaaaccactggaaaggaataaacctgtggtgccaataatctctgaaatattttctcattaagaaaacatgaaaaaagagtcctacaaggttaaggattgttctgtaagaaaggaacaagcctggaaggcagaatttctgtatacaacattttgttgatgctttgtacctaactgccaaagacagcaagagaagcgactggggatttttttcaaatatatttttattattgtttttaagcctgatggggcaatctcatgcttctgaaagcaatggacagcagcctgtttgaagccaagcacagcggggtggtcccccaccaagagcttaggcactgcgttcccaggccctccacggaagagcaagtctctgataaactcctggggaggaaggcgactgtagtctttcctcagctgactaagccagagcttcaaatcaagtcagagaaccacagtaatctttgtataaccccaaagcggagaggaatctgggacagaatgccaacaaaggctagcccgggaaatctctctctcgttttctggagcgaatgccttgatacaaatatattgcacacatatgtgcagcagttaccactgccctcaaggagaaccccacacaaggagagtaaaatgggaaagtattagtctgttttggttctttagtagctaaaatctaaccaactttcattttttttcttagaaatattactacagggtaaatcctcatttttacattctagaagagatgagtataaacaatgcatcacttttgttttttcaactgataatactggtgccccctttgaaacctaaatgtctatcttgaatctattactaatgacaatgttaaaaagattccagaccaaaagcaccagcatctattttccgctcattcatgaatgcatattcctcacttagtgcccccatcttcctccagctgcctgtctctggccatttcactgctcattaatatttctactggaaggggaggagaacttgagaaagataaaaaacacaatcagcccatttttaccactggtttctgggtagaatgcaagctagaaaagaatatgaaattttgtagagagtcatgttttcacatgaagtgatatgaaaacatgactctacaaaatttcattattctttggcaaatatagtttgtcctatgctgattggtatggtttggctgtgtccccacccaaatctcatctcgaattgtaatccccaggtgttgaagaagggacctggtgggaggtgactggatcatgggggctggttctcccatgctgttcacatgatagtgagtaagttctcacaagagctgatggttttataaagggctcttcccccttcactttctctctctctcctgccaccatgtaagatgtgcttgctttcccttccgccgtgattgtaagtttcctgaggcctccccagccatgtggaactggctcttaaacctctttcctttataaattacccagctcaggtatttctttatagcagtgtgagaatggactaatacactgattttcacccaattccaaaagatggctgcatatgtatcaaaaaggcatacttcagccaaaaagtcacgagcagtctaatagctctttgttttagttggaattcagtgaactacattctcccatggtggaatccattcccaggggtattatgtcagataccgctttacctcccatgtgactgaggcagcctatagctgccttctgacagtcatcaaggcaacgctaacctttctgcatcattatcagatggactcacctaactgtggtaagaggacaagtgtaagagacaaggctaagtctccattctaacataagtggttgcacttagcctctctgggtctctgtttttaaaatgaaaacattgtgtggggattgtctctaaaaccctttccagctctatctttctagaacttcaattatccaggatttctctgcatggctcccatactctaagctgacctggatcacagcctactgacacagtgattataagcttgagctctgaaatcagacaggcctgagtttgactccattcctccacttaggaagtgctatgctttgaatgagttatattactctctaagcacctacttcttcatctagaaattggggataatagtagtacctattaaatgggtagatacatgtaaagtgcttggcacaacaactaggttacaggaagtactcataaatttttggttgttactgtcataatcattctccattattttctccatggaggcatctggaatggaccattctctctctctctgcctattcaaactctagcatccttccgccaacagctcaagccccagctcctctgtgaagtcttctcacacaactccactcatatttcccctccctactacgaaacagcacttactgtcattgtcaatgtcacaccatttagaaattagttgtataaagtcttacactattagcaagtgggttggatagctagccttactgctcatataagaatgtaaactcttgaaagcagaacctggaacttttatatgtgcgtaaacacagaggtgacactgctcatcacacagaagatgctcaataaatgaaggtgagttgaggtttttattttaccgaaaaagtattaatgcaagttcccaaggtgtcaaatatatacccatggattgaagaatgggcctgaatttttataatcgtttacagcttcctacgtatttttctggatttacaacaaaatccctaagtagaagaaatcagtccatggatccccaagaaaactagagccagctcccgctcaagtttcaaaggctctgaggtgtgatgctgttaaaagcatctatttgcccaaagttgttcttatcttcacagtcactcacaagtcacaatattttaaacaattattcccaggcccacaacaattacttttttttgtggaggtcaatggcgatagagtcgctattgtctgtttttcagagaagtctgctgagctgccttgtggatggggacactgggactatcacacaagtattaggacgagcatttgcatgtgtggtgaatgtttctcctaggaaaagaactagtagaggatgggaggtgatcagaaagaatactaaaaaatttcaatcattccaaagtgactgcatggaattatggtccccaaagatgtcctaacctcagaacctgtgaatatgttaccttacatggcaacggggagttaaagttgccatggaattgaagttgctaactagctgacctaaatatagggagattatcctggattattggagagggcataggttatgagctctaaaagttaaagaaggaagaatagactagagtgacgagagagaagaaaaaggaggagagattcaaaacatgaggaggactcaacccactgttaaaggctctgaaggtggaaggagaaagtcaaagaataaggggaagcctccagaagctagaatgagccttaagctgacagccagacaatgagggtcttggtcataggaccacagggagttgagttctcccaaaaaacccaaatggtctctgcattagccctagaagaccaaatagcccaatgcttactttaatgccatttctggcatcctggaacatcaataatggtgaggtacagtttaccagcacagataatcagtgtagctacatcacagtaaaacaaggcacattatttggtgttagtattaatatctgaatagtctctttcaaatatagataagcattctggatgtcatttggagcaaaaaacctcctatgtcctttactatatatgttacaattttaatcaaagtatagctgtttagtataataaaaataaaatactacaatcattaatggttaatattttgttataaatatgattgctgatattataataatatatatacttaagaactttcagagttaaaaaataggaaaatgaatgaatagttaatgaaagagaaaatgttactttggaaggccaaggcaggtggattgcctgaggctaggagtttgagaccagcctggccaacatggtgaaaccctgtctctactaaaaatacaaaaatttggcaggcgtgatggtgggcacctgtaatcccagctacttgtgaggtggaggctgaggcaggagaattacttgaactgggaaggcagaggttgcaatgagctgagatcacgccactgcactacggcctgggtgacagagcgagattctgtctccaaaataaaaaataaaaataaataaataaatgagaaaatgtggtagatagataactttaggaagaaccttgtatatttatgaaaccataaatatttattaaaattaaataataatacatggcaaatagattatataattttgatttttctagtagtatatggtaaactagcattcatcactttaaacaaaatgacctttaagcatcacatttaatttttgattatttaatttcatttttaagtcatacatttttcaaaaaaaggagatgaattaaaagcagaatttcaactttgctccctcaataattaatggtacaaaaaactccaaaatcatatccaatagcttgcataataaatcaccttcaatttaaacataaagaatataagaaatatgaagaaaagaagaaagtatcagaggaaataatgaggttctcaaaacatattgtattctcagtaatcaaaatcaaagactgctttaaaaaataattcctcatgattttcagaagctaaaatataaatgaaaaatgtgtcataataattgttacaggctgctaaccatcttcagtagaagaaggaggattcttgacattcctgatgctcattaacagactattgaattaggaaataagccacttcgtcctgtgcatagtcagcctcattccctactgtttcccagggcctagcagagagcttggcccgtggcaggtgtgccgctgatgagtgaacaagtgaatgaatgaatgaataataagcataggtagtagcaaatagcctgatgagagtaacaagaggaaacagaagccataaaaacaaataaaaagcaaaccggagaccaaaggctagaaatggtttaatctctagccacttagctattattatatcacacaacctaataacaataaagcactcagtatgtgtcaggaagtgctgcaatctcatcagtactatcgggtagttataatttttatccacactttgctgatgaagaaaataaggcactggaagtttaagtatcttacccaagattgcataggcatcagtgagtgttggactcaggccatctgcctcctgagtatttacaaaagtcccaacgtccctctctgggtatttttcgttctctctcctcccctctcctccactcccctcccctcccctccccccttctctccttcccttccttccttccttttctttcctcctttcttttctttctgtctttctctctgtctctccccccccacctccctccctctctctttccctccctccctccctctctttcccttcctccccgcctctctctctttccctccatcccttcctctctctctctctttttttttttttttggtggattctcactctattgcccaggctggagtgcagtggcgctatctcagctcactgcaacctccgcctcccgggttcaagcgattctcctgcctcaacctcccaagtagctggaattgcaggcacaaggcatcatgctgggttatttttgtatttttagtagacataaggttttgccatgttggccaggctggtctcgaactcctgacctcaagtgatctgcctgcctctgcctcccaaagtgctgggattacaggtgcgagccactgtgcctggccagggtctttatttctttctaagatcagatgatcttgtaagatccttacaactcctaagaaaaaaaaaaaaagaggggtggggaagggataggtgtaatacaaaatgtcaagttgcccttaacccttaacttgaatcaaaataaatgaacctctgctcacataggaagctgtctttctcacttacctcaagagatttctcaaagcctgcaggtctcactggtgcctgctaattccctcatgattttattttgcatctctagtcagcagagtcttgaagtttgataagccctgcataggtctttatgcttagacagggctcacctagctacttgtccaaataggagtcctaacagtaatgcattcaataatgtttgtttgcagagttcacagacacattaataattagtttgtctttgtagattctatatctttaaatatttggctagacgactgtaggagacagcagatatgggtaccagataagaagcaatgtaagtaaatgcatttttttagcagcttgtgacaacctgaatttatttcagctccttcttcttgctgtcactgtagtttccaggtgattatttctacatagaatctacttttcattttgcttcatcctccagtgcagcctgtccaacataacatagctcttgcctcacagagaattttggctccagtgagttctgagaggagcataaaatataagaaacggattcatcttaaatgtgaccttcaaaatggagtgcaaaagatgagattaaagtaaacccaaacaaattggaaagtttcttgcaatttagtcaataaatatgctcagttcaaggaagttcgatatatatatatcttacatatatatgtaagatatatatatgtaagatatatatatcatatatatgtaagatatatatatgtaagatatatatatcatatatatgtaagatatatatatgtaagatatatatatcatatatatgtaagatatatatatgtaagatatatatatcatatatatgatatatatatcttatatatataatgaatatatatattcattaattataaactcatagaaaggccacagtgctctcttctcacagaattgtgaaaatcatgactacttcatgtttctcctgctaaaagttcataatatcaacaataagacattatagcatagtatatattaagtactataataaaacattgaagatctgataaacatagagattgagaggcattttttccttcgactctgggattatgaattcaatggtttgacacagagaatacaaatgcaagaccctttggtgcggggtgggggtggttttaaaatgtattggttattgatttcggaacttctagttccaaaatgataacacagacacaatctaggttcactcctctccacagaaaaccaaaacaaatataaggtgccaagattatcaccagcaacatcgcagaactcaaacatgaggatgattccatttccagggtcacagagaagtgaaaaactctgaggagatggtaaaagaatcaaatgtccatatctgctacaccccccacccactgtggcccaactcatggtttctacactggaaaaagtgagatggaggtaaacaaccagcttccccaccatcctgggttccctggcaggaggcctgcccatgctttaacccatgggaagcaacacgagtacccaaagggcaacacatccctgagaacagccagagacaaagaggggaggtgggactaccatccccagccctggaacctctgctttgtaactcagccagggacaccaaatcagcatggctgttcagtaaaatgtattggttattattttcactcaataaaataatcaacaaattagtacctattactaataaaattttaaagtgatccaacatgctctcagtgtggacattaacaggtgaaatctaaagaggtggcatgaattaatgactggctatggaaaagttcattcaagtctcattattctgaggcatgggttgtaattttcctctatgatagacgcgccaaataaatgcataattgcaaagagtaatagaatgtggacacactcactgatttattcacataacagcttttccttagctttgtcagaaattcatttaagtgtctgaagaacccagtgagattggtttcctagcacatataactttgttcctggcacagaatttctataatattttataagtctgccaattgcataagtatatttaaaaccttgaatgagctctctctttgccaactaccagttttgaaggaaattcttatatgtaaggggaaaagggacgtaagatttagaggaattagttaagattattaactccatttgagtattaaatcacatgtaatattgtgaaagctcagataataagtgctaaaagtttagactctgcaataaattgctctatttgtctaagtagaaatgtgttattgaacaggatccggtcactgtcccttaatggttgtgctactgacatctgaggcaggacacttcactgcaggactggcctgagcactgcagatgcctgttcactaaatggaaacttcaccctcaagtcactgtgacaaccaaaccacttctgctctccgtctcatgtgtactatgaatctatgcactctgatgcactactgctatgtggattatgtgggtactctggccatgggcttcactctttccagctctttgcagatgtatccatgccatggggagaacatgaaaggctttcattagcactgacaacatcctgaaaactggcagaattacaaaaccatcagctttcctagtaaaaagagctctcaacatcaagtggtccaagctctcctatgtatttctttttttttttttaatactttaagttctagggtacatgtgcataacgtgcaggtttgttacatatgtatacatgtgccatgttggtgtgctgcacccattaactcatcatttagcattaggtatatctcctaatgctatccctcaccccttcccccgaccccacaacaggccccggtgtgtgatgtttcccttcctgtgtccatgttttctcattgttcaattcccacctatgagtgagaacatgtggtgtttggttttttctctttgcgatagattgctgaaaatgatggtttccagcttcatccgtgtccctataaaggacatgaactcatcattttttatggctgcaagtattccatggtgtgtatgtgccacattttcttaatccagtctatcattggtggacatttgggttggttccaagtctttgctattgtgaatagtgccgcaataaacatacatgtgcatgtgtctttatagcagcatgatttataatcctttgggtatatacccagtaatgggatggctgggtcaaatggtatttctagttctagatccctgaggaatcgccacactgacttccacaatggttgaactagtttatagtcccaccaacagtgtaaaagtgttcctatttctccacatcctctccagcacctgttgtttcctgactttctaatgattgccattctaactggtgtgagatggtatctcattgtgattttgttttgcatttctctgatggccagtaatgatgagcattttttcatgtgtcttttggctgcataaatgtcttcttttgagaagtgtctgttcatatccttcgcccactttttgatggggttgtttgttttttcttgtaaatttgtttgagttcattgtagattctggatattagccctttgtcagatgagtagattgcaaaaattttctaccattctgaaggttgcctgttcactctgatggtagtttcttttgctgtgcagaagctctttagtttaattagatcccatttgtctattttggcttttgctgccattgcttttggtgttttagacatgaagtccttgcccatgcctatgtcctgaatggtattgcctacgtttttttcttctagggttcttatggttttaggtctaacatttaagtctttaatccatcttgaaataatttttgtataaggtgtaaggaaaggatccagtttcagctttctacatatggctagccagctttcccagcaccatttattaaatagggaatcctttccccatttcttgtttctgtcaggtttgtcaaagatcagatagttaaagatatgtggcattatttctgagggctctgttctgttccattggtctatatctctgttttggtaccagtaccatgctgtttcagtcactgtagccttgtagcatagtttgaagtcaggtagtgtgatgcctccagctttgttcttttggcttaggattgacttggcaatgcgggctcattttggttccatatgaactttaaagtagttttttccagttctgtgaagaaagtcattggtagcttgatggggatggcattgaatctataaattaccttgggcagtatggccattttcacaatattgattcttcctacccatgagcatggaatgttcttccatttgttggtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtatattgattttgtatcctgagactttgctgaagttgcttatcagcttaaggagatttggggctgagacgatggggttttctagatatacaatcatgtcatctgcaaacagggacaatttgacttcctcttttcctaattgaatgccctttatttccttctcctgcctaattgccctggccagaacttccaacactatgttgaataggagtggtgagagagggcatccctgtcttgtgccagttttcaaagggaatgctttcagtttctgcccattcagtatattggctgtgggtttgtcatagatagctcttattcttttgagatacgtcccatcaatatctaatttattgagagtttttagcatgaagggttgttgaattttgtcaaaggccttttctgcatctattgagataatcatgtggtttttgtctttggttctctttatatgctggattacctttattgatttgcatatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctgcctggctttggtatcaggatgatgctggactcataaaatgagttagggaggattccctctttttctattgattggaatagtttcagaaggaatggtaccagttcctccttgtacctctggtagaattcggttgtgaatccatctggtcctggactctttttgtttggtaagctattgattattgtcacaatttcagagcctgttattggtctattcagagattcaacttcttcctggtttagtcttgggagggtgtatgtatccagtaatttatccgtttcttctagattttctagtttgtttgcgtagaggtgtttgtagtattctctgatggtagtttgtatttctgtgggatcagtggtgatatcccctttatcattttttattgcatctatttgattcttctctcttttcttctttattagtcttgctagcggtctatcaattttgttgatcttttcaaaaaaccagctcctggattcattgatattttgaagggttttttgtgtctctatctccttcagttctgctctgatcttagttattccttgccttctgctagcttttgaatgggtttgctcttgcttctctagttcttttaattgtgatgttagggtgtcaattgtagacctttcctgctttctctcgtgggcatttagtgctacaaatttccctctacacactgctttgaatgtgtcccagagattctggtatgttgtatcttttttctcattggtttcaaagaacatctttatttctgccttcatttcattatgtacccagtagtcactcaggagcgggttgttcggtttccatgtagttgaatggttttgagtgagtttcttaatcctgagttctagtttgattgcactgtggtctgagagacagtttgctataatttctgttcttttacatttgctgagtgctttacttccaactatgtggtcaattttggaataggtgtggtgtggtgctgaaaagaatgtatattctgttgatttggggtggagagttctgtagatgtctattaggtccgcttggtgcagagctgagttcaattcctggatatccttgttaactttctgtctcattgatctgtctaatgttaacagtggggtgttaatgtctcccattattattgtgtgggagtctaagtctctttgtaggtctctaaggacttgctttatgaatctgggtgctcctgtattgggtgcatatatatttaggagagttagctcttcttgttgaattgatccctttaccattatgtaatggccttctttgtctcctttgatctttgttggtttaaagtctgttttatcagagactaggattgcaatccctgcctttttttgtttttcatttgcttggtagatcttcctccatccctttattttgagcctatgtgtgtctttgcacgtgagatgcatctcctgaatacagcatactgatgggtcttgactctttatccaatttgccagtctgtgtcttttaattggagcatttagcccatttacatttaaggttcatattgttatgtgtgaatttgatcctgtcatgatgttagctggttattttgctcgttagttgatgtagtttcttcctagcctcgatggtctttacaatttggcatgtttttgcagtggctggtatcagttgttcctttccatgtttagtgcttccttcaggagctcttgcagggcaggactggtggtgacaaaatctctcagcatttgcttgtctgtaaagtattttatttctccttcacttatgaagcttagtttggctggatatgaaagtctaggttgaaaattcttttctttaagaatgttgaatattggcccccactgtcttctggcttgtagagtttctgccgagagaccgactgttagtctgatgggcttccctttgtgggtaacctgacctttctctctggctgccgttaacattttttccttcatttcaactttggtgaatctgacaattatgtgtcttggagttgctcttctcaaggagtatctttgtggcattctctgtatttcctgaatctgaatgttggcctgccttgctagactggggaagttctcctggatagtatcctgcagagtgttttccaacttggttccattctccctgtcactttcaggtacaccaatcagatgtagatttggtcttttcacatagtcccatatttcatggaggctttgttcgtttctttttattcttttttctctaaacttctcttctcacttcattacattcatttgatcttgaatcactgataccctttcttccagttgatcaaatcggctactgagtcttgtgcattcgtcacgtagttctcgtgccgtggttttcagctccatcaggtcctttaaggacttctctgcattggttattctagttagccattcatctaatcttttttcaaggtttttaacttccttgccatgggttcgaacttcctcctttagctcggagaagtttgatcgtctgaagccttcttctctcaactcatcaaactcattctccatccagctttgttccgttgctggtgaggagctgcattcctttggaggaggagaggcactctgatttttagaattttcagtttttctgctctgttttttccccatctttgtggttttatttacctttggtctttgatgatggtgatttacagatggggttttggtgtggatgtcctttctgtttgttagttttccttctaacagtcaggaccgtcagctgcaggtctgttggagtttgctggaggtccactccagaccctgtttgcctgggtatcagcagtggaggctgcagaacagcggatattggtgaacagcaaatgttgctgcatgatcattcctctggaagttttgtctcagagggttacccggccatgtgagatgtcagtctgcccctacaagggggtgcctccctgttaggctactcgggggtcagggacccacttgaggaggcagtctgtccgttctcagatctcaagctgcgtgctgggagaaccactactctcttcaaagctgttagacagggacatttaagtctgcagaggtttctgctgccttttgttcagctatgccctgcccccagaggtggagtctacagaggcagacaggcctccttgagctgcggtgggctctacccagttcgagcttcccggccactttgtttacctactcaagccttggcaatggtgggcgcccctcccccatcctcgctgccaccttgcagtttgatctcagactgctgtactagcaatgagcgaggctccatgggcgtaggaccctctgagccaggcgcgggatacaatctcctggtgtgccgtttgctaagaccattggaaaagcgcagtattagggtgggagtgacccgattttccaggtgccgtctgtcacccctttctttgagtaggaaagggaattccctgaccccttgcgcttcccgggtgaggcgatgcctcgccctgctttgcctcaggctcagtgcaccacacccattgtcctgcacccactgtccaacaatccccagtgagatgaacccagtacctcagttggaaatgcagaaatcattcgtcttctgcgtcgcacatgttggaagctgtagactggagctgttcctattcggccatcttggctccacccctcctatgtatttcttaaatctgtcctcttatctccatccaccttccctctgcctttactcaagtgctccttatcttctctcctctctttattgtcagagcctcctaaaaggtcggcctgcttccaatcaccctccatttcagttctaaagtgaaaatctgatcctgcttaaaacttttaagtgcctcactgtcaccatgagacccttcacaattcctccctgcatgtgcacaggccccttctgagtggacccctgggtcatgctctctagcctcacatctcgctgctctccaccttgcagtccaggctccagcaatgcagacccccctccaggactgctctcccaacctccctgtctttatttatgttcctttctcacaggctagaatgctgcccaatctcctccccacctgtgttctgcttatctggccaagccattcccaacctttccatctcagaaagcctccccacaccctgggctctgagaggtggctcttattgtgtgcagacagcaccctgggcttcatcctaatattcccactgcataataataatacatgtacctgtctacttcactagagtgtgagtttcctaagggagcaatatgtcccagttatctttttatctgcaatgaaagacggagtgaataaatgaatggtcaatcaacttgcgtttaacagataatgaaaccgaggctagactctacatataactcattggcaggaaagttgggactcaaactctgatcatgttctatcagagaaggattagaagtgtcatccttggatttaaaaaacctggaattaaaaagtgctagctagagtaatcagacaagagaaagaaataaaggcatccagattggaaagaaagaagtcaaattatccttgtttgcagatgatacgatcttacatttggaaaaacctatagcctccacaaaaaaactattaggactgataagcaaattcagtaaagttacaagatacaaaatcaacatacaaaaatcagtaacatataaaaatcggtaacatttctatgtgccaacagtgaacaatcagaaaaagaaatcaagaaagttatcccttttacaatagctaccaataaaataagatacctaggaataagtagtaagtagatcactacttaaccaaagtagtgaaagggctctacaatgaaaactataaaacattgatgaaggaaattgaagcagacacaaagtaatggaaagatatttcatgttcatgattggaacaatcaatattgttaaaacgtccatactacccaaagcaatctacagattcaatgcaatccctatcaaaataccaaagacattcttcatagaaagagaaaaaataattctaaaatttatatggaaccacaaaagacccagaatagccaaagctatcctgagcaaaaagaacaaaactgtaggaatcacattacctgatttcaaattatactatagagttatagtaaccaaaacagcacggtactagcataaaaacagacacctagacaaaaggaagagaatagagaacccaaaaataaatccatacatctacagtgaacccattttcaacaaaagtaccaagaacagacactggagaaaggatagtctcttcaataaatggtgctgggaaaactggatatccatatgcagaagaatgaaactagacccctatctctcaccatatagaaaaatcaaatcaaaatggattaaagacttaagtctaagaacacaaactatgcaactactaatagaaaacattggggaaactctccaggacattggactaggcaaagacttcttgtgtaatatcccacaagcacaggtaaccaaagcaaaaatggacaaataggattccattgagttaaaaagctcctgcacagtaaagaaaatgaccaacaaagtgaagagataagccatggaatgggagaaaatatctgcaaactatccatttgacaagggacaaataaccagactatataaggaactcaaacaactctatggggaaaaaaaatctaataatctgattaaaaatgggcaaaagatctgaatagacatttcttaaaagaagacatataaacggcaaacaggtatatgaaaaggtgctcaacatgattggctatcagagaaatgccaatcaaaactgcagtgagatatcctctcaccccagttaaaatggcttttatccaaaagacaggtaataatgaatgctggcgaggatgtggagaaaagggtacttttgtacaatgttggtgggaatgtgagttagtacagccactatggagaacagtttggaggttcctcaggaaactaaaaacaaaactaccacatgatccagtaatcccactgctaagtatatacccaaaagaaagaatatcagtatatcaaacatacacttgcactgccatgtttattgcagcactattcacaatagccaagatttgaaaacaacctaagtgtccatcaacagatgcatggataaagaaaatgtgctacatatacacaatggagtactattcagtcacataaaagaatgagatcaaccacgtgcaacaacatggagggaactggaggtcattatattaagtgaaataagccaagcacaaagacaaacatcacatgttctcacttatttgtaagagctaaaaattaaaacaatagaactcatagaggtagagaatagaaggatggttactagaggctggaaagggtagtggggtgagggtaggggggaagtgggtatggttaatgggtacacaaatatacttagatagaatgaataagagctagtatttaataacacaatagggtgactacagttaataataatttattgtacatttttaaataatcaaaagagtttaattggaatgttggtaacacaaagaaatgataaatgcttgagggcatagatatccccattacccagatatgattactatgcattgtgtgcctgtatcaaaatatctcatgtactccataaatatatatttatacctactatatacccataaaaataaaaaatagaaataaaaaaacaaacccagaatagtatgtgtgtaatgagaaagacaatatttgttaacagtggtattaatcacacactgcagaagaaatggcatgaatcaattaaggttgtgatttatatgcagtaagaacatggaaagcagaataattaaatttaaacttttctcgtcagctttttgaagagtctatttctagaaataggtgcatttacctgaaatgaaaactacctaggagcgcctgaacttcaaacccagttggtttccagctgtcatatatatattcctcctagtgaggaggatatatgtataaacataaatatatgtcaaatttaaataaccacatacattccttgtaaggtaaattcctaaagtttgaataagagttaccttagctcagaggttctcaaatttctgtgtacaaaagaatcacctgaattcttgttaaaaatggagatttttgggcctctgggtttctaattcagctgggctgtgatagagtctgagaaactgaatttttaagattgtggtgaaattcacattacatgaaattagccattttaaagtatccaattcagtgacatttagaacatggcacaatgttgtgcagccatcaccttgaaaattgcatttttaacaaatgctccactgctgcaggtggtccccagacagcgcactgagaataactatgctaagatgatgggtagaggtggcaaggaatgaatcatggatttctctcagattataacagaaatttttaaaagttagctttatcaaacatcaaaatctaaaaattatgcctttgcctttaccgatcaccaaatataatccaacaccaggaagctagattgttttcatggttttctgtactaatggactcaacatttattgatttgaatgcaaccagtattcttatccttataaagaagtacagggctaagtgaagtaaagtgagagaagtgggaaaaaatgaatcactgctctgtgattagttagtccaggtccttgggttataattacattattatagcacattattaatttcaacttcaggaaatgaaattgtcaataaacacagaagtctctggagaaagaaatgcaaattaggtttctccttatattcaaaccctcatctaaatgtaagtaaaactaattattctggtaaggcttaatacaggctgggcgtggtggctcatgactgtaatccgagcactctgagaggctgaggtgggtggattgcctgagctcaggagttcgagaccagtctggccaacatggcgaaaccttgtctctcctaaaaatacaaaaattagccaggcatggtggtacacgcctgtaatcccagctatttgggaggctgaggcaggagaatcacttgaacccgggaggcagtgattgcagcaagccaagatcatgctactgtactccagcctgagtgacagagcgagactccatctcaaaaaaaacaaaacaaacaaaaaaaagagttaatataaatacacaatggctgcattaagatgttgaggtcaatcactgttttcagggttgcagaatcggttttcctagtcttaactcatgacctagttactcaagagttgtccctaaccttaactcattttactccaggtcagattcctgtgcaggttcctggaatttagcaactacaaagatcagccatggtgacaagcatccagaatacaatggtgtcttcctaacagccactagtgctgcttctctggaccactaccctgcgaaaacaacaaacacagaacaagatgaaaccccatcacaacataagaaaccaagatggacagacagcttataatgccagaatcttggaaacatgtccagaaactacaagaccagagaagctgggctgaggaaataagaactggcccaccctgctttgcctcatgacacagagcccttcacctagattaagagaggcaggaagacagcctgagaagggatggcactaatttaagcagaggagaattattacctcctctacttctgtgtgcttagagatcacaactcccagaagacaataggcaggaaaagagaaggtctggcagtgctggcacactgtatcctgaggaatgtccccaaaaataaagccctgaaaatgtggagataggaagagtctggggttcttttagcctgtcaaagaattagagtgccaaaaaagaagaaactgtaactaggtgggtcaggttcaatagagtagaacacttaatgcctatatgccaccaggaactctgtgaggtgtatgcatcaacctgacctcaagctgcagatttgagaaggaatcaaccaggaaacagtgaccagaggccacaagacggccacacattctgtgtgtgcagatccttcaccactatactccaaggaagagcatctagctggcaatgacttcctataaaaataaagattttagaaaagttctattcagaaaggttcaggaaaaggatgggtcctgtgaacacaagcgtagaaatgcagtacaatgggatgaaataaatggaaaagaaaatgagatgcaaaaagacaactgattaggttaattgggttttgacctcaagtagatctgggtttgaattctggctttttcagttgttagctgtgtggccttggactaatcgcttaatttctttaagcggctcacactgataatcctagcattttgggagtctgaggtgggaggatcacttgagcccaggagtttgagaccagtctgggcaacatagcaagaccctatctttatttttttattttattttttaaaaagaagttttgatttcttcattggtaaatgggatcaagaaaccatttactatctcacagggttacattgaggtttaatgctactaaatactatactatactatactaacaagcttggaagaaaagggtactgattgaaacagagacagcattgcaaaaaaactaaaaatacaatcaacaataatctatgttggagatattaaggtgtaggattaaaattgcaaaagtgtctaaactggtaatgcagaagagctccaaagcctgagaaaaaggacaaaaaaaatgaaaaggatgagagaaaagctgaatcagggattcaacacagtaattaaagatatttttgagacataaatcaagtagaacaaaagcaataagctaaaataggaacaaggaaagcctcctggagtgaataatcatctcagcatgcagtttcagggctcactatatttcaggcaaaattaatttcaaaacattttaaagacacacacctagatataattcagcaaaaaatgtaaactatggaaataattttttaaatgcctccacaaaaggcttcagggaccagctaaacagaaagatctttccaacattctataaactattccagagcatagaaaaagatggcaaaactaaccacattattttatgaagtgagcacaaccaagacaacaaaacctgacacaaaaaagaaaccactaactctacttccacttctgaattgatgcaaaaatcctaaatgaaaccctagcaaactgaattcatcagtataataaaaatacataggcacggtcaagttggatttaacctaacaaagcaaagatgatccaagattaagatatctattaatatagtatcaaaatataagacaatcctatttaaggtgatcctcattttctcagtgagaagctccaaatgttactactaccagcttgaataaatatagatgtttatgaaatagtcaactatctgtttgaaagtacaattatacatacacatttgcaatcatataataaaggaaatatttatcttaaaatatttttccattctcaaatatcatgaaaaaaattgtattccacctcttcccatgcactcttctttctttctttctttctttcttttgaaacaaggtctcgctctgttacccaggctggagtacagtggcgcaatctcagctcactgcagcctcaacctcctaggctcaagcaatcctccagcctcagcccctccagtagcttggactacaggcacatgccaccacacctggctaatttttgtattttttgtagagacagggtttcaccatgtttcccaggctggtgttgaactcctgaactcaagtgacctgcctgcctcggcctcccaaagtgctgggatcacaagcgtcagccaccagacccagcctcccatgcattcttgatgggaatgttatcacaagagccacttagagatatttaatacagtcttccagaactagcatcttcacttctgtctgagcacatttaagcccacgtacaatacattaatccatatatactttcactttagaaaatcatttgtcctgaaattgtctaattgtgatctctagaacaaagacttgttttataaacttatgacttccaattcttgcaacaatgaggtcatttcccaggaataattttgctacaccagtgttacatgtcctagcatcttttttttaattgattctttctagtgacttctctaggcattcaaaaccagcactgatcaaaatgctatgccaggatattcaaaataaattaaattgagaatgactcccagaatctgagagatcttgttaagggctgaaatatgtctaccttttttttctgaagagtaagttttgggagaaaaacaaattttaacctttttcacagcaggacatacttagaaaattatagtatttggatagcacccacacaagtgaacaaggctgctcagggtagatgctattctggccctgcccaggctcctcagtagatcaatattgcagcacaccatatggaaagctctgctataccatgaggtcctatgagaacactgagatcatcatctgggaggcaggatactgtagtggagccaggctctgcctggctgcatgacctggggcaagttacttatgccctttgtgcttcagttctcacatctgcaagatgggacaataatagttcccagagaatccattatcatgaggattcactgaactaattcgcatgaaacacttagaactgcgtcccacacatagtaactgctcaacaaatgccacgttcaataactatgcctgattgaaagcaaaacaaaacaactcgtgaaaaaacaaaaccacaaaagtatgagtagaataccaaaatgaattcctcaacatgtcacctcacccctacatggtcatgttacagtaaaactcaccagatgacaagccctgacctggcacttggagtttccaatcaaattgttagatttcagccaagaatctctagggatttgagaaaaccaaaccactctcattaaagacagactataacaaagatataaacaaactgaaaaaaagaactcaaaaggaagagagataatgttggcaatatcagcaaactttaaaaaaagtatatacatacatatatatacacacacacataatacacatttaagagtaatggttaagagcacaggctttggggaaacaagttatgacatctataaattaaaaacagaacttcacaaaaaaggaattatcagaaaacacaaaagagttgctggtaattaacagacatggcagttaaaataaattcaataggaagcttacaaaacagtaagatttcccaaatactagaagaaaaataaagaaaacaggagagggaaaaaaaaaactaggaaaaattagaggactgacctggtgaccaaataataggagttctgtacagaaaaaataggggaaggtgggacggagggccacacaattccaaaataaatcatataagaaaattccccataacaaaaggatctgcattttcagattgaaagtgctctctgagtactcagcatgatgaataaatgatgatctacacccaaagcacatcacagtgaaatttcagaaaaccgtctctaatgagagggggaagttgcacatgtaacagattaggaaacagaatggcatcgccataatgaaaatgattttcaaaagtaatctctgagattatgagttttatttctcccttttctaatttgtctataataacatatataacttttactgtcagaaaaaaaatattttttttgagacacagtctcactctgttgcccagactggagtgcagtggcacagtttcggctcactgcaacctctgcctcctggattcaagcagttctcctgtctcagcctcccgagtagctgggactacatgcactcgccaccatgcccggctaatttttgcatttttagtagagaagaggtttcaccatattggtcaggctggtctcgaactcctgacctcagttgatccacccacctcggtctcccaaagtgctgggattacaggcgtgagccaccgcgcccggccccaaaaacaattttaataccaaaaaaatctaaacttggagacactttcatagatttaaatggctccattatttgtcttcataatgtcacaatctgtctctttgcagtgatacagagacccttctagttggtgggagttgtgaccatagaggatgtctgggttgtagagagagctgggaacaagccactctagggattcactacccagcagccctgtatatgagtgatgtccactcatacttactcagttagtgaacatgtgttttcaagccacagtcccagaatattttgatatctgagggaacgggggaagcccatcattctttttccttagatatatctttccatccacaattaccatgtctccactattgcagtttgcatttattttaataaggcaatgctaaccgctccaatttgtcttcattccacttatcaaataccatgtcctaggctttgccaagagatgattttcctattgacagacttacctgtagaaaagatgaacaccgtgttgttccagagcccactgctttttaaagctgcagtgacatttcctactgcttcatccataagggacaccattcctgcatagtgatgcctgttcttgtcttggataaagtcatatggcttcaagtattcctcagggacctgaaggggctcatgcacagactggagagcaaggtagagaaacagaggctggaaagaaagtttgtgcaaaccagttaagaggatattgaagcattaaatatagaaggataagacagttcagatttatgcattaataaaaataatatcaagacaacctacagaatgcattgaaagtatttgtgaatcacatgtatgataagggactcatctccagaatatataaagaacccttacaactcaatgataactcaactacaaaatgggcaaagaatctgaatagcaatttctccaaagaggatacacaaaaggcaataaacacatgtaaagacagtcaacatcatcagtcattattaagatgcaaattaaaaccacaatgaggtaacacttcacatctgttaggatggtgataatttaaaaatggaaaagaacaagtattggtgaggatatggagaaattggaactgtcattcattactagcaggaatgtaaaatggcacacatagccactttgaagaaacattttggcagttcctgaaattgtaaaacatagagttaccatatgacccagcatttccattcctagagaaatcaaagcatacatccacccaaaaacttccatgaatattcactgcaacattattcataatagccaaagagtagaaacaacccaaacatctatcaattgatgaatggataaacaaaatatggtatattttcagcaacatatggcaataaatgaaataaagtattgatacatactacaacatagataaaccttgaaaacattatactaagtgaaatcagtcaatcgtaaaagtcctcatattatgtaatttcatttatatgaaattccagaaatataggcaaatctatagagacagagggtggttgcctggggctgtaggaaattgtgggggagaggaatggtgagtgattgctaacagatacaaggtttttttggggggatgatgaacatgttttaaacttagattgtggtatggttgcataactgaaaatttactattgaactgtatactttaaatgagtgaattttatgatatgtaaattttgtttcaataaagatattaaaaaatataacaaaagacacaagacaaaaaattgaaaataaaagccagagtcccagaacggcctcaatggacctaatccaaacaaataataatatcagtaatggcaaccacatattaaatgttgtctacatactagacagtatgataataatttacacattctatctcatttaatgaaaccaccctatgttacagcaattttacagatgagttaactgaggcttagaaaggttatatgtgtgacttgtccaactccacattaaccgaagagcaatttcctattggaaaacccactattacgatatggatgtgtaccaatagaggctttagctttttgctttagctgaaaataagccctcatcttttagaagaggtttagtatttttaaactatattttatgagaaaaaaagtgaacaccatgccttgttagtctttgatgcaggaccaaacataagaccagtttaattcctgaaactaagaagtatgacacactgattctattttaccacttacatcaatttgcaacatttaacattagtggcataccaggtcagcttctcctttttaatgagcctttctgaaggcattctcttcatagtgctacagaattctttaatgagttgaaaagcctcaaagagacaacaactagtttaacccaaaaataaacgtataattctgttaaagtatttgaggcatttaaatctcataaatgaatgaaaatggttagaaacagactttggtgggggggtggtgctcatatttcattcttcattgttgacaagttgttttaaattttatattacacatccttgtaatgcaaaaaggagtatccatacatagagctcaaatagaccccccaaaagtttatttattgttcaggtctttggaactcagaaatacgttttccctaaactcacaaagttaaaaatagctgctaaatgtcaaagtcgttgctttaaaacctattaaactaaggacgcagctgatggagtgaaaatgatgataatgtagaacccgtacttccattatttccatgggaaaacattccaaattcccactccaaaagtctattctataacctctgacaccatttcagttctgcctctgcttccactcgacacacatacaccttctactccagctgcatggtcatgctgaagcgtctatgttcgtgtagaccatggtgcaggacatcccaacagatgccctgcctgggggtgatgaaggtcttggctgcgatgtctggagggaagaacgtgcaggtgcatcgctgacctgacagtgcagtatgggtctgctctgggtactgctatctgggtcttcagcactagactgagccaactccagccaccagccaaggtccagatggggataggattaaaaatcggaagtctacaacaatttgcagcccacgtaaagttttaaaaaaaatcaggaaatatcacatcgatctgtttttatataaaaaaacttttttggaaaaatcagaatttctgactactctttgtccacactccatctggtaacaaaaggctggagtatgagaaacaggggccccatccccctcaaatgctatccaattttctagtttcccactgttctacataaactgcttcacttctttaggttagcagcctggcccttgcaaacacgagattttgtgactctgatctggactcttaacagtggcagggggcaggggatacagtggggagagagggggcccacagcttaaggagaagatgttctcatccaggtcattagcagcaacatggcaaccacctggcgaaggagagaaaggagaaagagggtaggtgattcccagccagcaattgattactaaaggcaatggctgggaaggcggacaggggagttcttgaacaatgaccagggaaaaaaagatttggggatcattattaaaggttcttataaatattcagtatagaaatcattctactcactttgttaaatatggtgaaaaataatctgaaaatctttcctataattattccttagtagctaaagacattaccatcacttttataaaagaatataaattttcaggaccctctaaattatgccaaggggaaaattaagtcctggagactgtgtcacgtagcatgtttgcaacttctgtttcttagattatagagtaactctcttccttattgttcttcttctgtaaataactaggaaagaccagagaccaggactcctccccttcttattgaagatctttgttatagattaaccacctcctttattgtcctgtacctaactcagaccagatgacccaaaaaacaccatgactgttacatcttcagtgtggaatgttaaacatacctttcccaaaagaaaaccaccaccttgactaatcagatcattgtaattatgcattaagccttgtacagaaagatgttgaaattcttttaagctcccctaaattttgtctatgtaagtgatatggtttggctgtgtccccacccaaatttcatctttaattgtagttcccataatccccatgtgtcaggggagggacccagtgggagttaatggaatcatgggggtggttacccccatactgttctcttgacagtgaataagttctcacaaggtctgctggttttataaggcgcttttccccctttgcttggcacttctctctcctgctgccacgtgaagaaagacttgtttgcttccccttccacaccattgtaagtttcctgaggcctccccagccatgtggaactgagtcaattaaacctctttcctttataaattacccagtctcaggcagcttttttttttttcctgcaaaaaccctcagctcactggagggccagtggaactcaggcagttctttataacagcgtgagaatggactaatacagtaagaaatcccaaacttctacactttgaaacacggacttccattctttggaatctgtgcttcccaagaggccatccttaaactctgtacttgaataaactctctttaaactagattctgatccttttgattattttaagttgacactcttgaggggttaaaaataagaaactataccagtccatgtcggtactatagcccatttcaagaggtcaggactgatgcacattttagatatttccatcccatactacaaaaaataaagtttcaacactcagaaggtgaactttattcatgaaatattataactcattccccaacagtagtaaatgtgaaatatttctatactatttttaaattgaaaaaagagaaagagtagtgtttttaatactatatggtagcctagtggaatgaattaactaggactccaaggttctccaatcacagtgaggaccccacctgcagccactattcctaggaccctgcctgtgaacagctgtggtcaattttcccactcctgccaaccagagctcggctcactgtcagcctaaagccagcagctgccatcactggagcctgatctctcccctgctttttcttaggtccagatccctgttctcatcaactgtcacagttactgccttagctccaaccctacctgtaaccctttccagtgtcttgggaatgtgaaatgaaatcctaggcatgaaatcattactaaatatctaagtattacataaaagcaagacattatcacctagagctattagcatattcatgtttgagatattgggggttcttttccctttatttatgctacatggttcctaagatatatactgtaaatatcctcaccatgctaagaaaacttatttcagtgaggaagaaagtcttattttcatttctttagtgtattctcctaatttaaagtataaatgaaaaaaaaagcatatgataggttttgaaattgtttttctttgacttctaaattaagacattcttttccaaattgtgtcacagaaaagtaagagtcttccactagaaattaacattttctttaagaagcttctagtagatcaggtgtataacattacatttgcttccattctgcaaagtgctgacatgggggtgtttttttgtttgtttttcttgagatggagtcttgctctgtcacccaggctggagttcagtggcacgagcttggctcactgcaactcttcctcccgggttcaagcgattctcctgcctcagcctcctgactagctgggattacaggtgcatgccaccaggcctggctaatttttgtatttttagtagagatggggtttaactatgttggtcagggtggtctcaaactcctaacctcacaatccacccgcctcggcctcccaaagtgctgggattacaggtgtgggccagtgcacccggctgacggggggctgtttttaaaagaaagatattttatgaatatgttactttcagtctgtagtgtcactagtatggggaattatcctgctgaaaaagagaaagaaggttccttcttaacatatgtgaaatggtaattagcagtaccttcctgagtccagcatcagcaactgtgtttcagttatgaactgcctccaaatgcttttttcctcttaagtgctttttaaaataggcacaattttaagttagcctgtggattcttcatgtggctttctttaatgatttttatcttagaacaagttccttatgctacaatctatatatagtacctgagaaattagcccagaattagattcaacatcgggataaaatcgtgaaaagctcagctcctcaaactggtgagttgcatcattttatacagaattgaaaatgtaaacatgtattagctgtcttaaacattcttgggttacagcttgactattgattatttcattcacttatgtctatgactgaaactttcctttgaagatactgggaatgctggatactgctatagcatgtttcagacacaataggaaaatgaccatcctctcatctggcaatttccaaacagttacctacgaacagcggctatggtaataacactccttccatggctagcaagcttttagggcctcctattgtcctcagttccgtgttttccccaccaccctagttaagagagcccacccacaaagatctattatttcactccagttgcttcctcttatctgcttaatgttatggaaccctgtgagggaatattccatcgttcttcagtaggaatgaatttgtattgtgggcagattacagttgttgcacagattaaggtatggcagattgtgaacctgtaataggtagctggcttctgcttgcctctccatatttgagaggaatgccctgaatgacccatccgagaatggctgtcactgcaccaggtgtcagtgatgactgcacattagaatcactggtaggagcccaggaggaggaataatgaaacaccaatgattgggtcccacctcagaccaatgaatcacaatatttggcatcagtatttcttataagtttcccagatgattctaatatatggtcaggactgaaatcattaaggtgaatcatgagctgggactcagaatctctggtcttggatattagctgtgaactagggaggctgattaagtacatgaggtctggagtcagagagcatgagtttaaattctgattctgactctcaatagctctgtgaccttgaacaagttacttaacttctctaagccagtttgcttatgtgtaaaatggtggctccctcaaagaataatacacagttctcttaagactttaccttgttaagtgttaaggtgcatccataaaatgtcaaatatgtagaagaaaactgaggatttaagccaattacctagcaactatttttccaattatctgaatatttgtttagatttaaatttaaaatctgtgtatttccacatatttgagagaatgttcccatttcttcgtgttccacagaaagcatggttgcttcaagatatcagcataggagagtgatcgccaaaagtgggacgcagctgaggacagacacctctatctgtgttttcacttctacatgtgctcgatttttttttttttttttttttgagacggagtcttgctctgtcgcccaggctggagtgtagtggtgcgatctcggctcactgcaagctccgcctcccgggttcacgccattctcctgcctcaacctccagagtagctggactacaggcacccaccactgcacccggctaattttttttgtatttttagtagagacggggtttctattattttttaatgaatgtcaggagttgtataacatttgatagtgtaaatataatttgaagttcgaggtaaagttgtcttctgaaagattttaccttagcttgtggaagtcaaataaggatgccagcaatctggcatttaactcattcagggaagatttccaatactgagttcaaacaggcagaaactggaaggggaaccagcagccacataccaagtccaaacaggtatgtaaaccagaatccacacggtgatcttcttatagtttagatatttgaccctcctccaaacctcatgtttaaatttgatccccagtgggagcctaatggcagctgtctgggtcatggaggtggatccctcacgaatggcttcatgccatctttgcagttataagttctcactgtattagttcctgagagggctggttgttagaaagagcctggcatctctctctctctcctctcctgccatgtgatctgcacacgccagctcaacttcaccttccattatgactggaagcttcctgaagcccttacccagaagcaaatgctggtgccatgcttcttgtagagtctgcagcaccacgagccaaataaacctcttttctttataaattacccagcctcagctattcctttatagcaacacaaacagactaagacagacctgcaccaaggaccttcaggcattgtcaaagaggcaaagtgcaggaaattggaagaaccagggagcactgcatattctataatttgttgtgtcagggtcccactgaagtattatttttatgggtgttcttaatgaagccatattttgagcccagtgtctgacaatacaaatatttgttcccatttcaaaagcatttataagctaaatccagagaacttagcttaaactttacctcatgaagttaactctaggttaacaaaataatcataataataagattattcatgtgttacacaaaagcatcagtatagtaaatgtgaaaaataagctcattggtataccaggtatatggattagaagacccaatattgttaagacatccattctccccaagttgttctatagtttcaaatataaatccaagcagacactttgggcaggggggagctggcatatagaaattgactagatgattctaaaattaacatggaaatgcaaaagatctagaatagcaaaatattcttgtagggaggaagtacaaggttagaggaactgccctgatcccaaaatttatggatcccttaaccaaaagtttgtcataataaagcctcaccttacacctaagccaatcattttttaagtcattttattaattactcacagcacatgcacgtaatataccaaaatttttaaactatatttctattgaaatactaccaacatagtattcctcaaagtgtgatctggggaccactcttaagaatcaccttttaagagtttctctaaaatgctgatgtacggatttctcccacgcctaataaatcacaccctagaggtgggctccaggaatcttcctttttaacaagcttcccaggctgattctgggatactgtataatttgaaaaggacttccctagaatttattagatttttccctaaacaacaatggccttttcctacatttgtctgaaaagacattagtgtaacaagattttgctatcagtaaatagaagcaaaacttaccttctctggtggatggttagttatgagggctatagcccttttggtgaatatgtttgttgaatacatatttttatatcctgttgcaacttcttcgccatctcgaaaatcaagagcacatcgtgtgacattcagagcgtcaattaatgtacagcgttcatgggaataataatcttcactacccaggagatatcctgcaagaatggaagacgaaaatagtcagcatagcataaaacttgttaaacaaactaatgtttcagcatttaattgcctaatgcaattgattacccgtgacgaggctaatcaaatgacaaggctaatcagcaccatttctcaacatgtctatatctggtggcagaaggcattaaaacattactgcataaaaactcaaatctattcctcattcgcctttagaatataggcgctatcatgtaacactaacagtttttttttttatcagagttgaaactcagtaagggtgataaaatctcaatccttcaaagctatataatggtaaaaataatgtacagttaatgtgacttgttacaggtttttactctaaggtgatcacataaatgagtgcaggattcaaacaatgtttgttgttactgatgttgcgagactggcttcaaggttatttacagaagtggttctaggaagagtcatctttagtcagatgctgacacccactggtgaaagatacaaacctttcctaatagaggatctctagacataacagagccaacagatcaaactaaagtgagcactgaaataagacttttctacctaaaatgatctcaatttcaccccagatttaaatggcatcaacggcctatcccataatttagacttcacatggaagaaaatgggttttctcaaatatagttgtttctgcaaatgttccatcttttctatattttaaaatattatatttctatattttaaagtattaaaataagctgtgctacgtatgattccacttgtattaaatgcccacaacatgtaaatctatagagacagaaaatagattagtggctgcctagggctggagggactagggggaaatggggagtgattgctgaggtggatgagtttcttttttggggatgataaaaatgttctacaattggattgccatgatagtggcacaaccttctgaatttattaaaaatcattgaattgtacactttaattgggtgaattgtatgatatgtgaattatactttgataaagttattaaaaagaaatatttgctagactcttagctatctcctgacatatactgcttattaaccttaaaatgaggatgataaaattgacctagctctttcttcagtcctgaactttccctataatgaaaattaagagctttacatagtttatataataaatcaattcattttaaattaaattctccttttctatgactcaataaattcaagatcttgaatacaattaatactttggtcttaaaataacttttatatggcaatcttttctcctatgtatataatggaaaacgaaatacaaagtacttgttaattaatgtgtaacagagaaagaaatgtatccataaaaataatttcagcccttacatgggtgattagaatgtcagaacactggaggtctatttaaggtttttaataactactgggcattaaagcttgaggaaatcacttcaggttctttaactgttaagtgtgagctgctttctatcagttagcagaatataggacagatacacttcattagcaaaggcatgaactacaaatatttaaaagataatacagataggagaattccagaaataaaactattcacatacttggcaaaactaataccaagcaaccatgtgacaatcacatgaagcttttcttcataataatgattcacaaatttgaacttcaatactgagcctaaagatgatggcagcctatgcttttgggggaaaaaaatagaaaatgcttcttgaacaaccaaatcttctctgatgctttatgtaccagctgcattgagatataattcacataccacacaagtcactcatttaaagtgtaaaagacattggtttctagtgtattcacaggcttgtgcaactatcccaccatcacctgatttttagcaaaagagctgagatgtaacagtgagaagagctgtgtggtcatcataaccttcttggctgcaagtctcccttcaaatgaatttggggtgtgtgttcatctaaatccaggttaggcttcttaattctcataaaaggatatcatttctaccttctgtccagctgaatttttaagtacctaacttggttttaataaacaattcaaaatatctacagcccatcctcttcccagagtatagatattgactcatcttttagcaaaggcctgattgaaaaatttctaaggatgtacaggctgtttgctcctctagaatttccaagatgacaaagtgatcttacatcaagtctaattttaacagctatttgaggtactgagaatacatccgggtccatttaaaaaaaaaaaaaaaaaagctaagattgagtagtgaggtctgctggtggacctggatgagagtggggcacacacaccctcctgtctgacatccttgcatcttgattttaaccctgaatccaatgaggcattacagagccatgtgcttcagctgcattgttttggcccccatataattacttttactgaattgcactttggtgctctggccctagcttgaacagaagaaaatacctcaaaacatctacaagaaaaccacctaacgtattattaaaatgacatttttaaagatgttgtccaccttaccttctccttctcccaaaggagaaatttctgtcaggcctaagagccagaaaatgcttttgcttttcctgaacatctggtttccatttatcttgtaaataatgtaactcttatagtcttttcctttctttctccctcttcggacaaataaatttcaaatctcaggctgggcgcggtggctcacacctgtaatcccagcactttgggaggccaagatgggtgggtcacgaggtcaggagttcgagaccagcctgaccaacatggtgaaaccctatctctactaaaaatataaaaattagctgagcgtggtggcacacacctataatcccagctactcaggaggctgaggcaggagaactgcttgaacccgggaggcggaggttgcagtgagccgagatcatgacacagcactccagcctgggcaacagagcgagactccgtatataaaaaaaaaaaaaaaagaaatttcaaatatcagagatgaatatgaagacagcctagagccatgcaacttttctgtaatttgatgccattaacctattccatctttttctactcatcctgattatttaatcctgtttaaactttctatgttcaatatgtgttcctttttggctacggagggttgtaaataaataaatgaacagatgggaggtaggtaggtagctaaatagctaaacagatagctcactataaaaagaacttgaaagaaagatatatagctactggcaagatacacaggttattaattcaggcacaggttattacaggtttaaagagggcatattttaaaacaaactctaggtttcacatttagtttcatagggctatcaagtttataaaatacttattattatttcttattatccttcttattaccatttatttggcctcctcattttcctttgttttttaaaacctatcttccccaactttgtgattgcaaaaacagatttcacaggtggaagaatgccaatggaagagtcttcccccacccccttcaaaaaaaaaggaaaaattgtgaatacattccacagggagaaaaaaacacaccaaacctttgtgaaggaaatattcattttttattttattattattattattattattattattattattattattattatttttgagacagagtcttgctctgttgcccaggctagagtgcagtggcatgatctcggctcactgcaagctccacctcctgggttcatgcccattctcctgcctcagcctcctgagtagctgggactatgggcaagtgccaccatgcccggttaatttttttgtatttttagtagagacagagtttcaccgtgttagtcaggatggtctccatctcctgacctcgtgatccgcctgcttcggcctcccaaagtgctgggattacaggcgtgagccaccgcacccagcctggaaatattcttacattaggttttgccaggcattaaaaaaataaaaaatcaatccatatccctttttggtaataagggtctctgagagtacagcggtctccaacgtggatagtaaactcttgcaaggccctaaggtggcatttagaactccaacaaaggtaatgggtttgcccaccataaggtcagcacagagccctgtttacagaggtaacattagaaagcagccccattacagtgccgactgattcactctgtgttcaaatatccagttctttcatttgattgcacttgggtgtgttttatgagatggctgcagttagtctaagttgttaaagaaacatgtgcatttccattaccaaagtaggtatcaaatcctcggcgggttggaaggcattctttccggtacattcccaggtgccattttccgaccatatgggtagtataacctgcttcttttaggagctggggcaggagtttttcatccagaggaacacagctgggctgacagggccagattatttggtgctgtaaacctgtacggatcttacagagataaacataaaattatagattaatgacattgaaatattgtgaacaagcagataaaatggccttctaccttactgatcatatctgttgacttggatgtttaactctattcctgtactggcttgaggatatttctgaaaggcagaattctcttattcaaatgaagtagtggacataaacaggatttgaaagacaaataaaaccattccaacgaacagatattttcaatatttatcaaggcactatgttagaaaccattaacttgttactttttgcctcaaaaaaagtagcaataatatgtggtgtgaatctaacaagaaaaaagcgttccaattttgggcacacaagaagttggtgtttgattagaagacacttctgtaatcttcgaaaacttggtgatttttttacaagtggttttgtttttgtttttgttttgagatggagtttcactcttgttgcccaggctggagtgcaatggcgcaatcttggctcattgcaacctccacctcccaggttcaagtgattctcctgcctcagcctcctgagtagctgggattacaggcgcccaccaccatacctaactaatttatttgtatttttagtagagacggggtttcaccatgttggccaggctggtctcgaactcctgacctcaggtgatctgcctgccttggcctcccaatgtgttgggattacaggcttaagccaccgtgcctggctgagttatttaacagtataataaaacgattattgcattttttattctactttatgtaaatcattatctcaaaagagagtgttcaactttttcttataaaaagcggccatctgactgctgcttgggagtggctcacacaagtatgcccagggcataaggtccatacagcaactaaactttaagcaatgaccacttcttaacttttggtgtaatattgagtagaatacccacaattatatgaaaaggatattaaaatagccctcccttttccaactacacatctttgtggggccagatttttcttcaacttttactaaaaataatatatcataacaggttaaatgcagaagcagatacaacaacctagcaaacttctattagtagaaaagatgtacaaaaaatataaaacaatgccattcttctcacttaactatttggttttgaaaaatagagcttttttcataagttatttatgttaatatagtgggtttattactatttttcattgaataaaaaaatttataatttgttttaacttatggggcaaattttgaatggtaacaacccatttaaatctatgctccctggggtcctcaataatttttaagcaagtgcaaaaccctaagaccaaaaagtttgagaactgatactctaatgtccaacagtgatcattgccatgaggaaaagtaaagaaggagagggagacagtgacagaggtggcacttgtgatagagtggcaaaagaaagcttctctgggccaggcggggtggcttatccctacaatcccaacactttgggaggctaaggcaggaggctagcttgactccaggaattccagaccagcctgggcaacatgccatgatctcatctctactaaaaataaaaatagaaaaaattagcaaggcatggtggcctgtgcctgtagtcccagctaccaaggagactgaggtgggaggatcacttgagcctgggaggtcgaggctgcagtgagctgtgatcataccactgcactgcactccagcctgggcaacagagcaagaccctgtctcaaaaagagaaagaaagaaagaaaccttttctgaagaggagatatttgagcagtgaccagaataaagtgaggcagtgagacttggagaaatccggggtaagagcaatccagacctaaggaataaaaacttcaaaggccctgagacctgagcttactagacaagttcaaaaggcccgcccagaacccagtttggccctgtcacagctcttgtgctggtgggtgccactgtagcccctgctgcggcatgacagggtatccctccttgtctacccagtcccacccttccctaaaacttaacacctcctgcctccttgtcctggcttagccagggagatgctcttctttgtagaaagtgggactggggtctcaaattcaactctgcaccagacaccagccttccccagccctgggagctcttgatttatagaataaacaggctctggggacacaggaggtaagagtgccagttctcaacccaggccacggctggtcccttcatcagctataaggtggagagcaagaaacttgttgctaacaaatgatttttataagtgtttgtgagtattttatttgccttataatttaaagtggaatagcataaggctcagaggattaaatcccatcctggctttatcacttatgagctttgtaaccccgggcagtaacttcattcagtaactcactaacttcaataactttagtaagttaggaattgcacctgctattgctttactgcatgatctctttccacatcctcctaaaagaaccacatggaatatcttaagtgttaagttaaagtgggtttatcttgaggatgatagttaagttcactatcttgatgtggtgatggtttcacaggtatatacctatcaaagtttatcgaattgtatacttgaagtgtgtacagttcattgtatgtcaatcatatctcaataaaactgtttaaaaataaaagtgagtttaagtttcctactgagattgttatgcctctcctagaaataattagacacctatctacattgggagatgtgtcagataccttctgtttgcccttcaaatccacgctgctttctcagtcctgctctctgccctaggaggctgacctatgaggatcaagtcaaaggacacttgtcttcaggtttctgattgggcttagccaatggggagccctggcaggagtgagagggaaagaggagagtgcatggcctcacctgacacgctgcttagcctggctacatgagtctctctaccaaaggtcactctggaagcagacttctttctctatctgcctctctccttctaggttctggtaattggcccttcctttcttctcttctggtctaggagtagtaacagctccactggattactacactatccctagcattttgccccacacattcacaccttttaaaatggtccctttgtaaataaaccctccctaatttgaatgtgccacctctttccagctgggaccctgaatgataaggatgttataatatccaggctgggaaagggaagcattcctcttagcacatttgcacgcatacgtacacacacacacacacacacacacacaccccaaatcaaagtattctttccatggttaactctggaagcttactgaagagaaaattgaccctaggactcaaaaacttcatagcatatagtatgctaattggcaaccaggcaggataagtaaagataatattttatggaatccaaaagccccagtggagataaatgctctgcgaaaattcccttaaatggaaagctcatccatcacatgcagagaattaattctgattgctagaaagcactgccaagagatgttgtgtgatttggttttcctaagccgtgggcaccaagccaggtggtcagctgaagccttcctccattactgacaatcatatggagcagggaatgtgttcttttcagttcctgagaatttatttgacagagcatttttatggcattattgggaagcagaagccaaaccctggatgacatccaaaaacatgttttcggtctgttcaaacactatctgaaggaaggaagctgtaatgtgtagagaagcagtaaacaggcaaatgccgaactggttccaacccagcacttcagcacagaactacagagccacgccatgctgcaaggggcaggaaggcaaccgggcaccaataggaatcaaaagaaaaaaataagggtgccctgataaacacaacagaatataaaacaatttcattctaacacccatctgcaatgtccaaagaagtgtgtgtgaatggagaaggttctacatgtaatatacgaaagtccaaggggttacttccctatctaccatgtgtggctgtctcctcttcattaaaccaaatcttctctcaaaaaacaacttctcctaagattttacttgaccatcaaaaatcctctccacaaaggcaaaaggtctgcaaatccagtggaggacctggcttgttctaggctctttctgtgacataactgagagatccttatttacatattggttgcacgtaacaatttatttggtccagtgtgttattctgtcttctgcacacctaggagttccttgcagtatagtctcatgagcttaaaggagaaaatccaatctcttgctgggggagaggaagatggcagctcccatatcagaatctctttcaactcccctttcagaggtccagacagtcaattgattagttatctatatgggagttcagagcacaatatttcagctacactcaaactctcccaagagcgaagcaaaccactgctgcacagaaggcgatagatgctctttctctcctcacctcaacagtgttgagataatatcccgttgaacagaagggaggttctgtccagtcagtctggtctgagcaaaatgaactcatatcctcatgtgcccacatatgtgtgcaatacctcctgctgcagtacttaaaaattcagaaaaatgggccactctacccctccaccttatacaccagagagcctatgggaagcttcatgatcagaacgcaatcacagaacatgctggtggcaaagcaggagttcagaatttctagcctgtgcctcggccagtacacagcaggttttaatcacggtcaagtaacacttgtgccaccttagggtttattcctggagatgcccaaagaacaaatggatagtggaaaatctgctccctccccacagaagccatctgaaaagcagtcagctgcccatgctgctgaagccaagagcctacagacacgcattatgtgtgctaggggcctggctttgccatctggcttggcccttcaggactcgggctgcagaactggcccgtgtcactgacagttttaagagtctatttattttggtgttgattagtgaagagtgcaaatctctgactaaacccacaaagggatgttgtttgtaaaaaagaataaacaagtcagaaagggtttcagtgcctccctctgtttaaattataattccaaagaaagcccaaatggaaaaggaaggaaaatatgaagaaagctgagggaaaggaatctctcaaaaggtgatatgattaaggaaacgcaaacaaaagataatgaccagagagcaacagcttatgctcaaagtgattcctgaaatgacaaacctcgtaaatcaagcaaccagaaaatcctctaactccactggtcatattccacttagctccaaacttatttccttatttcctcatttgcaatttcctggcaggtaaaagatataaaatctggaattgtttctttaaaatagctgcaatgtttgcagaatgaggcctccgcactccccttccctcctgggaaaatgtctcttggatttggctaggcttaggaaggacacctggctttagcaaacccatgaaagtcaccccagggctctgctgtgctttagtgaggccatcttgcttgtccctatggagctaatgcatcctttgtttctccccctaaaggagcacagaaataaagacactgttttctcttaggaggcacccatggtctcaaggctacatggtcctctgacagctccctcctcctgtgcctttgccaggggatcctaggagcgcccaccttgagacatgcactttccccaatccctgcaccctgtaaacatttcttccagctctgcactctcctgtgccccacttctgaacctcaaagtccagggagaggcgaccactggcaggagtccactgagaggccagcaggcgaggagcaggcaggacagtgagggcgaggaggacaagaagcaggaaagggagggcatgctcaggcagagcgcctgcaccaccatgccctcttctgcctgcagcatgcatctttcctgctcaccttcttgaagcaaacttgaagcaaaagtcaaaaattacccacgatgctccagcacagcctccttcctatatttcctgtccaaggttccgcctcaggggtgagtgaaaagccgtgaaaatgtcttgtccatttatcagtgtgattaagaaaaatgtggtttggatcccttaagaatgaaaccttggagtcatctttcattgcttctattctgtgccaaggtttatggagttctggtggagtggcccccttggtacccaaggtaaggacattcccagttgaggaccagagttacttttcttaactattttcccagaagagtgttttcctttaaggcctatcactttcttactctttaatcttttcaatttcttaaaaaagaagtaaaggcattagaaatgacatggcaatttcaagcagtttaattaagatggtgagctctttcacgaactgtgtaaaagtgcttctcacatttgatcatttaattgtccaacactgagtgcttctttagcccagagacagacaaggcaatctaatggagaagtcagacctcagaaccacttatcacaattaaaatatgtattaggaataacaaaggtataatgaatattttgtatagaataaagtcaatttgtaagaatatggaaaattagtaatattaagttttctatttgaactaaatgcagtacacaaattctattagaaaagctggagaatttttaaattaatatttttaatcttgaggttttaaacaagggaaaaataaatataaaatcgattttctcatatgcataacatgcctccaagcgatatcaagaaaccaataaacaggagctgcctatgggaaggagggtggggagacaggctgaaaagatcctcatctacatgtttatattttttacatcttttatatttgaaggttttgaatgtatttcctggagatgattttaaaaacaggctacttttttttttttttttttttttttttgagacagagtctcactctgtcacctggactggagtgcagtggcaccatcctggctcactgcaaactctgcctccccaggctcaagcgatttcccgccatctacccccctgcccccgggtctcaacctcagtctcctgtgtagctgggactacaggcgcttaccaccacacttggttaattttttaactttttatagagatggaatttcaccgaggctgctctcgaactcctggactccagtgatccacccacctaggcctcccaaattgctgggattacaggcatgagccactgcgcccagccaagcttatttcttttaaagaaaaagagagaatatgtacaattaattctaattggaattacatgcatccaaagaatgccacatggcacttgactgtatttccttaaaatatgcccatttagaacactgttagattcgaaatgttctttagtgtataatagcctcaatgtcaccttactataaaaactgacacaaaaaaagttcaagttttaacactttttaatgggtgggcagcattaaacccagggagacccagcctccctcctctagctcttggcctgcctctggcaccctcattcactcagctaccatctcattcttacaacaagctcgttccagcctcaagagctttgcttctgttgctccttcctccacgttaaactttgctaggatatgtgcatggctgactcccttcattcaggcctctgctcatactacctccttgaagacaccttcctgagtcaagatcacttgacctactttattttcttctccacatgtattgtcatgctatttaaattcaccttacttgtttgtatttctttctttccccacttcccccccgcgagatggagtcttgctctgttgctcaggctggagtgcagtggcgcaatctcggctcactgcaatctccgtctcccgggttcaagcaattctcccgcctcagcctcatgagtagctgggattacaggtgcgcaccatcatacctggctaatttttgtatttttagtagagacagggtttcaccatgttggccaggctggtctcaaactcctgacctcaggtgatccgcctgcctcggcctcccaaagtgctgggattacagacgtgagccaccacgcctggcctgtttgtatttatttcacttccctcttggttactccttctccttacctcacccccttcagattataagcaccaagagattcccagagtacagtggcgtaacttgctgctcagtaaacatttgttgaatgaaagaatgaatgaatatatcacacttaatggtgatcgactgaaagcttcccctctaagattggaaacaagacaagtatgtccactcatgccacttctactcaatattgcactggaggtcctatccagggtaattaggcaagacaatgaaataaaaggtatctagattagaaaggaggaagtaaaacttcttctacttgcagatgacatgatcttgcactaaaaaactctaaagattatacacacacacacaattagggctaacaagttcattaaggttgcaaaatgatcaatgtacatatatcagttgcatttctatgtaacagcaatgaactactgaaaataaaattaagaaaggaagtccatttacaataccactgaaaatagtaaaacaggaataaatttaaccaaagcacaatgcttacacactaaaaattataaaatattgttgaaagaaattaaagaagacctaaataggctgggtgtggtggctcacgtctataatcccaacactttgggaggccaaggcaggtggatcatttgaggtcaggagttcaagaccagcctggccaacatggtgaaaccccatctctattaaaaatacaaaaactaggtaggcgtggtggtgggtgcctatagtcccagctactcaggaggctgaggcaggagaattgtttgaacccatgaggcagaggttatagtgagccaacactgtgctccagcctgggcaacagagcagagtgagactctgtcttaaaaaaaaaaaaaaaaaccctctaaataaacagaaagacatctcatattcttaaattggaagagttatattgttgaggtagtaatactctccaaatagttttacagatcactgaaatccctgtctaccaaaattccacttcccttttttttaatagaaatgtacaagttgatcctaaaatttatgtggaaatgcaaggggccgagaatagccaaactatctcgaaaaagaataacaaaattggaagacttgcattttctaattctgaaacctttgtaatacaaagctacagcaatcaagacagtgaggcactggcataaggataggcatgtagatcaatggaatagaattgtaagtcatacgtctatggtcaattgagtcttgacaagggtgcaaagggtgcaatgaggaaagaacactcttttcaacaaatagcactgaaatatttggacacctacatgcatccacatacctcaaattgtacataaaaatgaactccaaatggatcaaagacctaaatgtaaaaactgaaaactataaaatactataaaacatagaggtaaatcttcataatcttggattagaaaatggtttcttagacatggtaccaacaatataagcaaccaaagaaaaataggtaagttgtacataaaaatttgtaacttttgtttacatcaaaggacactatcaggaaagtaaaaagcaatccacagaatgggagaaaatatttgcaaataatctatctagtaagggtttatttaatagtatccagaatacataaagaaatcttacaactcaagaatgagaagataaattacccaattttaaaacaggcaaaggatctgagtaaacatttctccaaagaagacataaaaatgatcaataagacattaaaagatgttcaacatcattagtcattagggaaatgaaaatcaaaactacaattaaataccacttcctactcactaggatgacttgaaggctataatcaaaaagataatgacaagtgttggcaaggatgtggagacgctaaaacccacatacgttgctagtggaaatataacgtggtatagctgctgtggaaaacaatttccaattcctcaaagagttaaacatagagttaccacatgatactaagacagccaggtgggagggggtccctggcaaaactccagctggactgtgcactggggtggagccacggaggtggcgcctggcctctcctcttcctatggcacctgggattcaaacgggcaatgagggaagcactgtagcagggactctgacctttcagtgggtccctgtttcccccttttttccttttcacccaataaaaccctgctttactcacccttcaaaccatctgcgagcctgaattttcatggccatgggacagacaaggacctcatcgttagctgaactaaggagaagtcctgcaacaatacggcgtttcactcctacatattaacccaaaagaacttaaaaaatatgctgatacaaaaacttgtacatggatgttcacagcagcattattcataatagccaaaaagcgcaaacaacctaatgtccatgaattgatgaatgtatgaacaaaatgtggcatgtccatatcatggaatattattgagccataaaagggaacaatacatgctacaacatagatgaaaggacatctattgtattccatttatatgaaatgtccaaaataggtaaagtcacatagataataagaaggctggtggtttccaagggctggtggaatgaggaaatgaagagtgactgctaatagttgagtggtttctttctgaggtgatgaaaatattggttacacaaccttgtgaatgtacaaaaaaccattgaattggatactttaaaatggtaaattatataggatgtgaactataacttaatattgccagtgggaatgtaaattggtacaatcccttaagatgcaattttgcaatatttatcaaaattacaaatgcatctatccttaaacccagaaaattccatttctaggaacttatccttcatatacgttccaatatgtacaaaatgacatatgtgcaaagtattcacttcaccattctttgatatatcaaaaggctggaaacaacctacatgttcatcagtatgcaactggctaaataaactacaatgtatccatttaacaaaatattatgcagccctaaaagctgtgaggataatctttagtcaacaaaatggaatgattgcaaatgttaagtaaaaacaaacaaacaaaataggagctgcagatcagtgtgaagagtatgttaccattcatacagaaaaaagagagaaatgatatataaaaatatataattcagagcattatttgtctacaaacataggaactgaatgtctaaggaagtgtgtgtatgtgtgtgtgtgtgtgtgtgttttggtagattttcactgtaagcccttttgcagcttttaagtttttaagccatgtgaatgtattttctattttaaaaataaaatacggatttttttaaagatttcacaaataatgaatgaatgagtcatagggctgtgggaaggcccctagcctgagtgtagagagacctgaatttctagttcttttttttttttttttttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgaatttctagttcttgaatttaccagtaactacttaccccatctgctaattagtctcctccattgcctccaacctgtacccagtccctacacatatttcaccatagcatgcacatttaaaatagttcatttgtgagggctgtgaacaattaaatgtctcactataaaaggctgaattaagtaagttcctagcagcagaacaagtagtacacgcaatttgtaagatacactgtgttgggcaagattaatctttctaccagtagatggggttagtatgataggtatgataatgtgcatttgccaagttagaaactcgccctaatggacacaagagccttagagttaaattaatttagagctagacaaagtctagagttcagcccaactcctctgtttcacagatgtggaaatgatggccagcgaggtcacagtctgaccagccaagaccaaaacctacatctcagttcctaaccagtcctctttactcaataaataatttctgaaaccaaaaaaactaaaactcaggatttcatgagagtataaagtccagtcagtctaggcttgtttatcaacttgtgcttttcttttctaaagttaaataattatgggaaaggggtctgtaaatattaacttaaagcatgactgccaagttcatagatatgactcttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccagctaattttttgtatttttagtagagacggggtttcaccttgttagccaggatggtctcgatctcctgacctcatgatccacccgcctcggcctcccaaagtgctgggattacaggcgtgagccaccgcgcccggccagatatgactcttaacaacttccttcaagtaactcattttgagacagtcaaaaaattccttcattttattgtctaaaattatgcataacaaatgactcagaaataaaatctatttttattttacatggaatataggcaattcctaactcagaaatatgatgggttgattctttaccttgagatatttaggaatgacccaaatgtccaaaagtaatacagggattatttagtatgtatgaagcagtccttgggatgttatttttaataattttgagtaggcaatatggcttagtggttataggcatcaaccctagggccacgtgccctgggtcaaatcctggtccaacatatactagccctgtaaccttgggcaagtttcttaacctcttccagcatcagtttccttgttacagaacagagatgatagagttgttgtgagaatcaaatgagttaacacttgtaagtgctcagaacaataccagcatatagtatctgacggagactcctgagccttccctgaaatttctacttcattaaaagtggacacttgctcaccctgggtaacatctacttgggtctcatgaactctaagagaataaagtgggtgagaaaactggaggaaaaaaaatgtttggggaagcaaggctgctttagaatcagctacactgagaggcctctaaacctttcagagtgcccagcttctctactcatcctttacttcataaccatggggtactctaaatactaaagtttgttctccaagacataattttggtgactggtgggggaggatgttaggggacaaaagcaactgattacgggaatgggttttttattttattttgttttgagatggagtcttgctctgtcgcccaggctggagtgcagtggtgcgatctcggctcactgcaacctctgcctcccgagttcaagcgattctcctgactcagtctcccgagtagctaggactatagacgcatgccaccacactcggctaatttttgtagttttagtagagacggggtttcgccgtgttggtcaggctggtctcgaactcctgacctcaggtgatccacctgcctcagcctccaaagtgctgggattacaggcgtgagccaccgttcccggcccaggaatgggtttctgaagttggtatttgctttcctgtccaactctgttggaagggaggaagttggagaaatgaatggcccttccattcttttgcaatctgagttcagttctcttacttcaaagcaaatgcagaaccctttgggcaaacctcacctttcccttcttcttcttctttactggcacatccctttactcccacaaagtgtccagggtgagatttacacaatgtaggggattcctaattacacgtagcagccaaggtcagaaccgccaaaagtactaaggtggatggtgaagggaagcatcctttactcccatttctaaccttggctacagctatttctcacccttagcaacacccaatctttcctctttataaaagccttcagaccactgcgcatatctttatcacaagtaagccctcccttctcttgatcttaggaccacgtgaggctagggttgatctgacaggttatgcgaacacacacttgggagggcaacattcaaatatatatcccctgtcagtagcacagtaagctcaaaatatttttgttgagtaaacagcatatgtactctgtgaaggcatgcaggtggtatccaacagttcccatttactgtatttaatatggtcataataacttcagggtcttagaaatatgacaatcgtattcagattgaggggaaaaaaggccaatttcataagcccgggacgaccagtggatgcaggaaaagcacaacggacactgccttgaccactttctagctgtgcgattcttatgccaacgagcctttacaggcttcctgcctcgtctgtaaaacggggtaaaaacaactacctcatgcactgtttcaataattcactttaaaaacaacaaagtgctatgcaaatgttcttgatattcttagccatctaacatctatgcacgctctacatttatatttccttcgttaactgtggagccgttcctaaagggaagcttttaaagcgataatgaagatgctcagaagagttcaatacaaggttacatgtgaaaggaatgtcagcagcctaagaaaaatcaacctagcatcaggtttcattccaggggtgttgagaacctggaaaaaaataatctttggtgggacactcctaacctatcaccgctgggttcccacgggccagggtcgcacccacggcgagcaccccttcattttacctctcccctcgtctttgctcccagcccacgccctccccagcctcccacctcaggaccgctccgcctgccggccgcggcgcccagcacccggcattcccataaaccccttcgcccggagcttcagaaaacgaaagacaaagccacccgcccaacccggcggccggggcgcgggtccgcggggcgccagagccgggcatgcgcagaggccgcggcgggctgccggcctggaagagcgaggttggggcgagaagccgccgggacccataactgggtcggcggtccgagccccgcctgccagcgcccgcggcctcaagggccgggtaggagcggcagggcgccggcgaaaggcggggcgggggcggcgcgggcggcgggggcgccgcgtacctggtagcggccagtgagcagctggctccgcgacggcgtgcacagcggctgcgtgtagtagttgtccaggagcaccccgccggccgccagcgcgtccaggtgcggcgtgcggatgcgggagccgtggaagccgacgtcgttccagcctaggtcgtctgccagcaagaagaccaggtggggcggccggctggccccggcgcccgagcccggcggcgccaacaacagcagcagcagcagcgggaggacgacggggaggagcagccgccgaggtccggggcctcggggcaagctcgccgcgccgcgcggacccatccttgtccgcccgcggtcccagcgcctgtggcgccaccagccccttgtaccgctgatagaatgaggaactgggctgccggggcctgctccgccccggcgcgggacggcacccccagcgggccgtgggcttgcgaggccgggcgctcggcccccgccgcctccgacccgggcccccggctgctgtggcggaggaggagccagagacgaacccgcgggcgcccgctgcccggcttcttggaaactcagctgacgcttggagggcaccaaggcccgttatcttccccggcaattaaatttgcactgtggtttcctaaaaaaaaaagatgtgttctttaataacgcttcacaatttacaaagcatcttcacagcccgcgtctcctgtaaagcctgcaacaactctgacagttagacattataattagtgccaatttttcataagaaaaaagcttataaatggttaaacctctgactcagatcctgaaccatgatgtctagctagcaagtcatttctagcacaagagcccagcctgtggcaggtgggaggacggtgaaaaggcagaggtctaaatagcctttcacattcatttatgcgtagtgtacacccatgaagccgcttcctccccactagcaaacaggaggccaaacacacagtctgattgcacggtgccctttggaaggtgcggttactttcaagttgccctgggaggatttggagtgttgcgtggtcattgaataaatagctcattcgcttgtccggatatgaccccactcagagctggctcccccactaagcagtgacactaagaagcacacagtatctagttagcctgaaatatctgagtggaaggaaaaaatcctttagtcacgtgcttattgaattaggaagttagccgtatgaccagtagattcccgttgccatccagactttctgtctactctgtctggagatattatagttgttaacaggtgtaggggaaaatttttgcattgcctagagaccatacccttccaggttgagtctgattccgtggaagttgtttacaactttataagttatagataaataacaatggaaaataattcttatttatatatacacaaatgaactttatccagcggagtagcaatccttcccctccaccactaccaaggaaaacagtttcacctccgcttgcatatttattttagtattcctgatctgttctttggattgtcctttgaattggttttaacaccttaccaatttccttattaatgagttaaataaaatcatgtattcactttt

SEQ ID NO: 394 - DNA, 170433 bp, Homo sapiens
tgtgaaactgtatgtggcagcctgtcaaaaaaggtggaggaaagcatctgggcctacattttcctgaagatggcttttcaaaatttctgtttttagctgacttcactcttctctatatgctattaggtaataagaaaagttccaaacattattcactgggatgctcaaaagtaagctacatgtgccatattactgtaagacaagtataaagggcttgcattttatttccacaaggaatgaataaagggaaaggaatttacttttgggaaaaggtaacacaaagaactttggtctatgaaggacacaaatgaattctcatcttcaaagatattttgaaataatataagaaatgacccatctgtggtagtttatggttgatctaagtaagacagcctcctggggccccttctttcttggagaaggcacttttcctatgatgccaggttcctagttcccgcctcttctgccacttctgcaggagccacccgaggccttgaggggccctttcagaaccttgggtctgaagtcatttcttatgccctgggttatcatcttcagtagaaagttggtggtagctacaacagcagcgagcactcaggccagtctgtaaaacacacaaaatgactttcctgaagatatacagatttctcagggtacggttgtatcaggactgcatttctagtccaggagatttcttacaatctcactagactgtgaattcctaaagggcaaggactgtctccttcattattctagtgcctaacagggcctagaaaagaaggtgctcaacaaagactcttactgattaagggggcttgattagctctgtcagcaaattctgcctccaaaagtccttctctgtttggctcccggagaatatttcccttctgtgtgtcactccccagccccaccctcagtcacagatttctggtccctgaaccctggatttccaggtgtcattccaaggtcaggtggaaccaagggctccatggtcttcaccccctggtgttactcctgagattatgttatgtttggtgggaaaaggaattctgcagatgccattaaggttactaatcagagagcatctgcatgggcctaacctaatcacatgagccttttaaaagtagggaattttctccagcttgttacagaagcgagattcttgttacagttgagagattctaattgtgagagggattcaacaagaggaagcttctccattgctgactttaccatgaaagggtcaatgggacaagaacttgagaagctgagggtagtccttgcggagacaacagggacttcagtcctacaaccacagcaactgaattctgccaacaacctgagcaagcttggaagaaggttcttctgcaaagcctccaggtaagagcccaacctgactgacaccttgaattcagccctctgagaccctaagcagagaacccagttgagcctgcccagccttcagacctacagaactgtgaggtagtaaacaggtgttattttaagctgctaaatttgtggtaatttgctatacagcgataggaaataaatgcagcagccctctgggcccttctgtagcagtaccctccttgtcttccggacttcagttcaatcagttctctactgggagagataaagaatgatcattagtaggcacaaaataacaacagctatggtgaccactgttgtccttgttcactgaccaataatccaactgcttcactctctctggtttatgcttccctccccaaacccacacatccttcacagcttcctctctgttctttctctaggtgagctttggcaatttatggtaaaagcctctatccttgagctatatcctttatgttcccaggacccactcggcttcaacataagcaaatagaaatataaataaagataaaagtatgtgtagatcctgcagaatatctacagtcaggtctggggcaataaatgggtgcctttaagagtcagatctgatttgaacagaaataaatcaaattaagatctctgataggccgggcgcggtggctcacacctgtactcccagcactttgggaggccaagaggggtgaatcacctaaggtcaggagtccgagaccagcctgaccaatatggtgaaaccacctctctactaaaaatacaagaattagctgggtgtggtgccatatgcctgtactcccagctactcaggaggctgaggcaggagaatctcctgaacctgggaggcaagggttgcagcgagctgagagtacgccactgtactccagcctgggcaacagagtgacagcgagactctgcctcaaaaaacccaaaaaaacaaaacaaaaaatgtctctgatatacaactaagggctgggcacagtggcttacatctgtaatcccaacactttgggaggccaaggcaggtggatcacttgaggtcaggagttcaagaccagcctggccaacatggtaaatcctcgtctctactaaaaatacaaaaaaattagctgggcatggcagcacgtacctgtggtcccagctactcagctggctgaggtaggagaatgacttgaacccaggagacagaggttgcagtgaaccaagatcacaccactgcactccagcctgggtgacagagcaagactccgtccccctgtgccgccccccaaagaaagatctctgatatacaattaagatctctgtggatctctgatatacagctaagatctctgtagatctctgatacacaactaagatctctgtagatctctgatacacaactaagatctctgtagatctctgatacacaactaagatctctgtagatctctgatatacaactaaggctgcacaggcttgagcatctagggccgagacagctgcaatcttggatactcttagttatatctgagataaaagtcctgcatctgagatacatatctgagataaaaactcccatttgtaaggttcagggctttacccaaactacatggtgctcagcagaatggccatctagaatcttgcacggttcgcatttcatttcttctttcagaaaccccactttccttgggtttaaatggaaagaacccataaaataaagctctttttttttttttttttttttttttttttttgagacagagtctcgctctgtcgcccaggctggagtgcagtggcgtgatctcaatctcggctcactgcaagctccgcctcctgggtccatgccattctcctgcctcagcctcttgagtagctgggacttcaggcgcccgctaccagaagggacatgcttttcaagtgtcttgcttgatctcctatcataatgaatccttcctttctccttaagcaaccttgctcaatcctctttttaggactaacttgattctgttttgcattgcaagcagttgtttatagatgccccctcccacccttgccctggccctctctggctccttaggggcagaggccatgtcccattgatctttacacttccctggggcctgcacagtgagcagtgaatacccgttgaaggagtttaatttctgcatggagttagatttatagttgagatttcctttgctgttaggtttcaggtaggtgcttaagatcccttgatccagggagaaaagggccaggcggcagttgccactcagtctgcttctgaaatctccccacaggagtaaggaaggggctgctgggaggtgatggtcctaccatcatgaggaggttgaaagaaagggtaggggaaggaagctccgagggccaacctcacttcccatccctcagccagcagcaagcagggctgcttctcaaatttgatctgttctctgccttggcaaagaccaagtgcattccctgtatgtgaaacaatgcagttgctgtttcaaggcagacaaaaagactgtgggtgggaaaatatgaggaaagtctttttcgtgacttattttttttcaaaacgtatgttgtgagaaaaggtgtcatgaagataaaatatgcagtaaattctgaatcatgaaggaaaaacatttcccactgtcctctaaaatctactatatttagttatttattcaatcactcagcacacttcaaatgtgccctgactaggtgatgcttccctttgggagatttgtgtatgtgcttgtcttctagactggagggtctccagggctgggaccttccacagttcgtcttcatatccctaatgcctagcactgtgacagcaagagctcaggagatggcagagccacagagactgaagggggccacagaggtagagaggaaaaaggcagagccaaggggcctgggaggccaagtgctttaggacaagcactggcaaatggcacagaagggccaagtcagctcatgctgaaaaggagccaagggattcagaaaacccactggtcacctgcagggggctgctatggtttgttgctccaaaatccatatgttggaacccccaaggtgatggcattaagaggtggggccattgggaagtgattaggccctgggggctccaccctcatggataggattagtgcctttatccaagaacctgaggaagagagttcttcccttttccccttttgtcccttctgccacgtgaggactcaatgtttctctcctctggaagatgcagccacagggcaccatcttggaagcagaaaggagccctcaccagacaccaaatctgccggcacctcagtcttagacttcccagcctccagaactgtgagaaataaagttttattatttataaattacccagtctgtggtattttgttaaagcagtagcaatggatttagggatatttaggaaacaaggttgattgcagttgggtcaaaagtaaatggaagaaacattcactgatatctacaaataaacatgtttttaaaagtctctactaaaaatacagaaattagctgggtgtggtggtggacgcctatagtcccacctactcgggaggctgaggcaggagaatcgcttgaacccgggaggtagaggttgcagtgagtcgaaatcgcaccactgcactccagcctgggcaacagagcaagactccaactcaaaaaagaaaaaaaaatcatgtaaatatacactgctacatgactggctaaataaactacagaataccatgcagcagttaaaagaataaagtagacctttatcagggtttctcagcctcagcattattgacatttcaggtggaaaactctttgtcatagggctgttctgtgcattgtgggatgtttagtacatccctgacttctacctactagatgccaatagcattccccactcaggtcgtgaccaccaaaaatgcctgcaaaaattgccaaatctcccctggggggctcactagcccctggttgaaaaccactgatttatacttacggatctggaaagatctccaagacagatcattgacagaaaaaagtatgtggcaaaaaaaaaaccccacaacattttatatgatattatctatgtaaaaaaaaaaaagtattgtacacaccactgctccataaatccatattgtatacataagcacatctaaagtggtctataaagtcaaaactgttagcagtggtcacctctgtggagggggacagggaataagggtcatagtgaactttgttttgttttatttatttatttatctgagacggagttttgctcttgtcacccaggctagagtgcaatagcgtgatctcagctcactgcaacctctgcctcccgggttcaagctattctcctgcctcagcctcctgagtagctgggattacaggcatccaccagcacgcccagctaatttttttgtaattttagtagagacagagtttcaccatgtcagccaggttggtctcgaactcctgacctcagatgatccacccacctcagcctcccaaagtgctgggattacaggcgtgagccactgcactgggccaattttggttttatttgtatggctgtgtttaaacaaataatgaaaatggaaatgtatttggtgttaaaattagtaaatgaatggaaattgaagatatggagaaagcacatgcaaactacttctgacaaggtttagtggtgagagtgaggcagaattcaaggaaggaatttttagaatgtgggaaaattgagcactgctaaattcagtcaagttacaattttgtataaagcactatgaggaggcggtgcatatcttctagaatgcttctacttattagctcaagatttcaataacactttgccagcaatgactttcccactagaattaaatatgcatgaaataacagaattcctctttctgtttttctaccacatgtttctttaatttgtgtttctttggtgtgtgtacagctttctctaactaaactgctgatgccattatggaaactgtcactcttcagagttggaaagacccaagaataaaagctgactctgacttgtttggtctggcgtggctggggatactgcaggagtgtatttgtttttcattaatttgtttgtcatttttctccatgatctatggaacatttatttcccctgaagcaaaaagacctgaaatgtcaaaggttttttggtttctgttggggtaatgaattgttgagaaaaagagattttttcttatatgctattttattgtagaaagagacattttgtgaccttttgctgttttacagtgataatgaattttctgacagacttggaaactttgggcttctatgttaaaataataaagtttgaggaataacattgacctggacctttggagaattaatcaaatacagattttggaaaattgatgactttggtctttatcaagacactctagtttattactgtcatcaaggcagtacacagatttataccacataaaaacatccaacaattaactacagacccaagtccctgaacagagattttgacactcttggtggttgggaggtttaggcccaggagaccttcagcctgatcagtgttgctttgttgccttttttctttgttctttttcaaaaatttagttgcaaaagtaataggtacactgaattgaataaaaacgatactaaaaattatacataatctcaccctctaaagctaactgaccattataacaatttggtattctctttctaatcctgtttttttcttcgtttgtttgttttttgagacggagtcttgctctgtcacccaggctggagtgcagtggcgtgatctcggcttactgcaagctctgccttccgggttcacgccattctcctgcctcagcctcctgagtagctgggactacagatgtgtgccaccatgcccagctaatttttgtatttttagtagaggcagggtttcaccatgttggccaggatggtctcgatctcttgacctcatgatccgcccgcctcggcctcccaaagtgctgggattacaggcgtgagccaacacgcctggcctctaatcctgttttaatgtctatattatttttacacaactgagatactgaatacaaaattttattattttgtggtttttcctctcaaatattgcatataatgttttgtttctaatctcaaaacactttaaaggaaaactgtaggaacattaataaattctaccattgtccctatgaatgtgatgattagatccatttttcacatgctctgaaattgtaggtgtgtttttgcttttatttttgggaggtgagaaaacaggttcactgagtccaggaggcaggccaagctcacataatgatgacactgggcaagatgctctgtgtcccttggagacacagtaactgaccaatgggtgtcccagtgactactttggcctggtgtgtaataccaggccacagaaatctctcagccatttaagaggcatgagcatggggaattttcctcttttgcacaaagtagtggcactcctaatcacctagtttctctactaaaactctttctggggactttttggggtttgcctatacccatccatagtacttccgcaagatcagaggaagtacttgaaagaagtcagaacccatagcctaagtaggtttccccaagaatgttcataggagaagaaatctgctacctgattcttgatttccagggaccttcttctagggtggtagatactgagctccttgccattttttagaagcttgggttttctttctgaatgttcacataaggagaaaaccaggaacaaaaggaaaagagaccaagcttctgtgatgagctctaaaatcttcatgtcttgctggcttgaatatatcttaaactttttttcagcaaatgcatcatgttactttaggatcagaaaacattttggcatttggataatctgaaagataatgtaaattgctatacaactagcttaaatagaaatgtgggggaagagattataaatacttatgatataatttggatatctgtttcctccaaatctcatgttgaaatgtgatccccaatgttggagggggggcacagtggggagtgtttgggccataggggcagatctctcataaatggcttgatgccctccttgagtcttgttctgttcatgttttaaagagctgttctttaaaagagcctggcatctctcttgctgccactcttgccatgtgcatacctgctctccctttgccttctgtctgaggcctcatcataagctgagcagatgctggtgccatgcttgtacagcctgcagaatcatgagcgaaataaacctcttttaaattacccagtctcagacattcctttacagcaacgcaaaacagactaatacaatttataaaacagttctgaaattcaaggtcttacatctctgtctttaattagatatcttagaaaaaatatttagtcttaaatacttatacaaatattttaaattctaaagattgagcttcaaattgggtgaaagtcctctagactaggggctcaatattcaaattgtagtcagagacccagcagtattggcaccactcaggagtctgttagaaatgctgaatttgggccccaccccagcctgactgaatcaggtgattcgtgtgcacattcaggtatgaaaggcactgctttaagtgtagggtaatagaccagatgtgtggaatgccaatgttttcacctagtattcccaggtgagttcctaggatatacaggaaagttatcagacctgttcacagcctgctgttttcttcctcattaatagcctaatttctggtattatcttttcatcatgacttaactaatcatcagaatctgcccccaactgctgagagagacagtagctcataactatctgtgattttctgaagtaggaaaacaatgccaagattattgtcctcttggttttcagtcaggttaagataggcagaaaagaagatggctggtttaaaagcattttaacagctgcactggtaatatactgcattttgacagatgtggttagtaactctaaggagtgcatttttctctcacttgcttacttttgtttctagaagtaaaacagcctatgggtaataataagttttcagaagtattcaaaagtaggcctacggtcaggaatgtgtttggtttagcagttaggagaatttaaactcaaatccagttggtttttaattcagcttaatcaccaaaacctgataaagtgccaccaagttatctaaaagcaagcagatactgcacaatggaagagttgatgtcatccttggagctgccaaaccatcaacaatttggaaagcgattttaaagagaaaatgtaaaatatgaaaaatgtagttcttagcttttcttacatgctcttccaagtgtctgtgatttatgggcatctttttcctttcttttctaaattggttttcactgtcattattttcatttaaaaaatgtttattcatttcagctcaatgcagggtaaatgctgctgtttataatttgtggaaagactaagaaaaaaatcccatatacatttgaaaatatgattacaattagaaaaagggaaaggtttagattccttttcagtctctaacatttgttttttaaaacattagttgttaacaattagaaatcaagtactatattctaacttgtccaaaaaataacccagatccaatcttcaactttctttaaataaaatgtatttatgtcacaaataattcttatatctcagtcaaaagataagggaaggtagtacttaagctgactttctcattcctcttttattatttttttcttttttgagaaagaagctaaaagtcagctataagcactgaactatttttttcgaaggagtttttacaaaatgatgtaaaagaaaggatctgaaatgaatataaatagttcaaatacccatgacttcctctttaagtcattttaaatttatactaatgtcagtctcaagtaaacctcagtctcttaaacttgccatcaattaagccaaatctaagctttcttacgtctcactttacaaacaagcattagctattacaatcaagtacctctgacatctatccaatcttttccatagatcttttttaaaggttaaaaaagttaaccccatgtctttcctttttctttctttttttttttttgatggagtctcgctctgttgcccaggctggagtgcagtggcacgatcttggctcactgcaacctctgcctcctgagttcaagggattcttctgccttagcctcccaagcagctgggactacaggcgtgcaccaccatgcctgactactttttgtattttcagtagagatggggtttcaccattttggtcaggctggtcttaaacccctgaccttgtgatctgctcgcctcagcctcccaaagtgctgggattacaggcatgagccaccatgcctggccccttttttcattttttctttaagaaaagacatttattcaacaactacttattgtgctactgttctagatgtttgggtatagaaaagaacacaaaagactaaattgtctgccctcgtggaacttgtattttaatggagacaggaggatgataaataaatatttaaaaaataatatgtgctctaaagaaaggcaggtactgggggcagggggtagctacacagtgcctagaacacagtgcactgtcaacaatggttagtttcttttctttattgctctccatgtgatttctctcaactccttttacttaattgtgtatattctctggttcaaaactgcttctgtgaaggcatttaggaaagaaaacaaatagcacaggtgttacccctcatgtattaaaggaagaagctaaagctgactgcaagctcttttgctgtgaaaacagtatgatacccccaaaataagtgagagagatactaacagacttctacaaacattccaaatttgaaaataagggcaggtaacagggcagaatggaagcctccaagggggaacctatttggctgccatgggtcaggagcattaggaatcacctatgacaggaagtcccagagcatccctggcatatcagaaggaaagggcacctacagggggttcatcctaataggggcacagccagctgcatacctagaacagagtccagatagtgacaagagactgtaaacctggccccagatcaacggctccatcaaatagagcccacctagacatgattttctctttctaggatggcccactgtaccagtcacttctcatccataggctattagaccactaaactagttataaatatcttatataaactacttctcctgccttttttttgaaatagagtcttgctctgtcgcccaggctggagtgcagtggtgcactctcagctcactgcaacctctgcctccccggttcaagcaatcctcccaccttagcctccctagtaactgggactacaggtgtgtgccaccatgcccggctacttttttgtattttttagtaaagacggggttttgccatgttggccaggctggtcttgagctcctggcctcatgcaatccacccaccttggcatcccaaagtgctgggattacaagcatgagccactgtgcccagcccctcctgcctttatacttgagattattctaacactttgctgagatggattccaaggataatccagcaatatcatttttagtaaaaaccagcctacaaaggaaaatttatattttactcatatgactgaatcaggcccacccaggacttcctcttggttgaggcacttaaggatatgggacttggattacatctatcaagtcctttcaggcagtgcctaaaccagcctttgtttggataattgggagagaaatggctagactttgactagggctgtcattccaaagaattctgggacccacagtcctaacggcaaaacaagagtctctacaaataaacttccacaatttctgatttttttttttttttacttcactgagagtttccggtcaaacaggaagtgctgaaaccccagcatctatataaccacctgtggaattagcagatttttctttattttgggattaaaatagtgcagacacaaagggactttcctgtggacaacagcaatagctgttttaaaaattctacaaactaagaataggagggagttttcttacactgataaagagtataaaaaaaatctgcaatcgatatcatactgaacggtgaaatgttgaaagctctccctaaatagaaatagaaaaagcccaccaaaatattaacaatgcttatttctgggtagcagaataataggtttagggtgattttttttgtgtgtatttttaaaaattttgagcttttctgtatttttaaaaatttcttgcaccacccccccatctattatttgtacaaaaggagcttccctgctgcatacaggatgaaatcccatctccttagtgtgacatattgtccttgtttagctttcccatctcttctttcatgcctcccctttgtcccccaaataggctcacacaccttttgctcacagccttttctatttcctttgatggtcttttccacctaggaactctttgaggttcagtggaggtgaaagagggcctgagtgttttagccctccttcactctcatagcaactatcagactccatggaaatgatctgacaattaagtacaacttgtaacgtctctaccaccatagctttcaactgttatctgattttcttttaactttttgtatgttcttgttctctccaactaggttataagcgacttgttgtatttttcatgaagtctagggcaacacagcaggtatttgtggtagcagaataatggccccctaaagatatccacgtcccaatccccaggacctgtgaatatgttaggttacacggcaaaggggcattcaggctgcagatggaattaagattgctaatcagctgactttcaaatagggaggtgattctagattatttatccaggtgggcccaatgttatcacaagagtccagaaaagttgaagaaggaggcagaacaggtcagacaagatgagatgatggaagccaggttcaaagaatgtgctagaaaaggacccaaccttccattgctggctttgaagatggaggaaggaggccatgggccaaggaatgtaggcagcctctagaagcaggaaaaggcaaggaaatgggatgtcccctcagcctttggaagggactgcagccctgccaatcggtaccctggatttagtccagtgagacccatgtcagacttctgacctacagaactgaaaacattcaaaaaatacgaaaatagagtgatggttaagtattggttgttttaagccattgagtttatggtaatttgtttgatcagtgatagaaaactaatagtgttaaatattcttttccttcattcacattaaaatcaagaaagataaaactaaagttgttgaagtaatggacaaatttaaagatatcctttttgagaacacctttcctaatcactcccaaatgctgtcacttcttcatttgtccttactgcttatattatatcacttatcatttgttctactttattttataactgtgttaatatcctttcctgggcatatgttttcctctgattcaaaagaatctttagaagcaggggccatatactcattccctaggtattttctgccagaggtaacagacttcagtctataaatgcctgattactaacatcttacattatgggttactaaacaggccgtttagtctgttttcaacaacgtcccagaaatgttttcaaaagttttatttcagccttatacacaagcaccctaaaacccctaaaaattctgacaagatcaataaatatttacaaaatagatttactttgtaaattttaatttcattggatatgttccctaaaattttatgaggttttatgtttttacagaattttatggtagactctttcaagaaagatggatatatttatctttacagatggtaagactggggaactgaggtaggagaatgactggtccagactgggagaggaaaaaaggagtctggacaccaccaaatctttaccagacctggggaggctccagggtggaagacggaaggggcggagccactggacctgagagggactgtttggaagttagtctgcttttgtgttgaaattcaaaatcagcatagaacctttaatcaactataattaacaggctacacttggaagctatggctaaaatttctaggctgtaccagaattaaagaaaagtaagcaaataaataaatggtcagttggacatgagacagtttggcatcaaagtaaccctggggaaaaaaaaacaaacgctgatgtacaaatggagttatgggccactaaccacgtggtgctgtagagaagggatctggtgaggcagctggcccttcatcaaatggcctaactccagatgcagggccaggccaagtccttcaggtcagcttctgtgatctggctcagagaagccctagaaaatgttgcttaccctgatttctccaaacataaaattggggcagcgggatttgccatttctgcgtagcctaggccagtggtgagagttaattagtgtttttaaagtgctgtggatttggtttggtttgtgtattttctcgggatgaaagccaggatgccagcaccaagtgttaacagtgaaggtttcatgcgtgctccttgagatgtgctgtgtgaagtggggtggaggggatacgaggcttgtgggactgcctttggcatcaaaaaggccacatttccaaacagactttagtgctccccaaagcggagggggcagactagaagcctttgaaaattaaaaaggagaaagctatctgtgttttggctctgtgattgagggcatgtagcaacccacaccaaggaaaatttgacgagctgctaaagacaaatattggcaactagagacgacacaaaattctaactgctctgacctagtacaggcaggcacggaagcagcaactcccactctataagaacccagcagatttcagatattccatgcttaccggaaccctccttggaggtggttttcacaaataaagctttatggctttattcctgattaaggaagtcacatgtgctcataatttaaaattaaaactagagaaatacataaagtgaaaagtgcaactttcccaccctgccccaatcgtagcagccagaatgtaattgttgttcactgttgtttggacatatttacaggagatattgttataatcgttcccaacgtataggtgatgaaacagatggctggaagaacttacccacaagctcacaggaaataagtcagagctggtattgaataaaacccagggctttctggcacccccaaactctacctgttttactaggtgacactgcccaccccacacacagctccctcatccccccagcaccctccagtggagtgaatacaaggcactgacagggcttccatgactagctctacaagcagaagctaccaccatctgcagagtcagattacatgtgaatctagcaaggctaatgtgactactcgacccatttttccagcctcctttaaatgagtcatgtcccatcaacatgctattatataggtgagatgatcgtaactcatatctgggtgcccttctcccacaagacaagggtaggacacaaagcgatgagacctgcgaaatcagtaggacatgatgtacatgccgggtctgaacagccctgagttccagctctgatatttaacagcatgcatgacctggtgcctcagtttcttcacttggattataaagagtgaacaaactgccaaggggcccttagcctctggcattctatgcaatgctgagcaatctgtagcagggtgagccccatgcattccccctaactcttgattctgcttaatatctaatttcaggctgaaagaaagatgcctctgtgtcactacttctctaatagacccaaaaagaaataaaaatgccttgaaaatgatgtatgaaattactattgttctcattagactgattctaatcgaatcagctgatgataaattattcatttattagcgtgcattctttcaatatgtattaatctcttatacataagacaccgagagaactatacaatgaagccttgctctccttatagctccggatggggaaaacacgtgaatataaatactgcactatgaggcagcaagagctcaccgtcctgggaagctccagagaaactcaagggactcaagttcaaaagaatcagagagggcttcacggaggagtaggaatgtgcactgaactctacagaaggcgcagggcaacaagggagataaacaggactgaaggagggcattgcaatggtgctgaatggtgggcgttgtaggagggcttgctagtggacagctgggaaccaccaacagccttccagcagggtggggagaggctgtgtccatgccctcttccagactcttccagactgggttttagccagacctttaggtttggctttagcttaactgatctcgagtatttataacagtacctcatgcatcccaggccatcatcgtttatttatttactgaataaacaatcttggaaatggcaacataatactgggaaatggctctgaatgtcgctctgaggaggaaacagggagcagctccaagcattccaacctggacgactcttggatctcaagcatggatttggcaattgcaccacagaaaatgtgtgtgtgagagaggagagggtgggaagaaggctgttctttcaccctataatcaggagcagaaataacatctcattagaaactttaaagagaagagggcctttaaatgaaatagtaacaaagctgtatggaatcactttgaagagctggcctttggtggggtggaaaatgctaacatctgtcactgcccttcatctataatcaagcttctaccagcagaatgtgtgtgtctcctgtgtgtgcgtacgttttaaatatatacacctatgttacatgatcggatatgtgtgttccagccatcatagaatgccacgtctgacttccaaagtgagtcgtggtctcagatggggcaggatcattactgcagaacagccaagatcaagcccggcacctgcaggataggtgtatatgtttttcctcaggcaaaataatgcctttgaagcagttctccttgtggtctgagccatgcttgctggggccttgcaggagtgtggaatttggggctggagctctccttggaaccatgtagagctgaattcagacctgcaggacctcttgcctaccctgggattatggctgttccccaccactttagaggtttccaggctttcccactaatcagcttcaatggtgctattccccaggctctctcacgggtttcttacactgaccaccctgtgctgctggacgaagacagaagtattttaaagacatggaggaataaataattcttaggagttttctcagaagggaacaaaggaaaagagaagggtactatctgaacagagaccaaagcacttccaaggttacttcagaacaaagccttcaaaaatgaataaaaagtctcctcaaagcacacaggaaagcaattacatcccacactctgacacaggtcatgaagctgggaggcagtggagggaggaaggggataaaagcagagctagggttggggcactgagataaccagtgaatgatgaaacaaccagagggaacatcccagaaaacaggagcagaaccgaactcagaacagcaagaagaggcagagccccagactcagagggaagtcaggccgagccaggccagaggcaaaggctttataaatctctatttgtctattgaggaggtctgggaaaagggatgaagttgggcagggaaatcccacatcatcttttctggccgatcttttcaatgcagggagcgatgagggtgggcacttagaagctgaatgaacagtttcaaacatctgtatataatgtcaattacaacttaataagtgacttgtagcttctaagttatttttacttaggcacaaaaggtaggtttggggtttaaaaggagtataagtggccatctggaggtacttttaggctcaggaaaggctgtaagacaataaaacaatgactttgacaggttgatctgtttatcattcattagcagatatttactgatattaacccaacaacttactacgatgttaggttctgtgctacggagaccttactgtgcatatggcagtaaatgaaaaagatagagaccctattctcatgcagtttctcttcagttttggaaggagggaaagttacgttttatttattttttatatttttaaattgtggtaaaatacaaacaacataaaatttactatcctaaccacttttaattgtatggtccagtggcattaaatacattcacgttgttatgctgtcatcatcaccatccatctctacacccactcaacaatcatgccccattctcccctccccacaacctcaggcaaccaccattctattttctgtccctatgaatctgaccactttaggtacctcatgtaagtggagtcatatagtttttccttttgtgacttgcttagcataatgtctttaaggttcatccatgttgtagcatgtattagaatttctttcactgttagtgctggatactatttcatggtatatatatgtgtatatatatatatatatatatatatatatatatatatatgccacattttgtttattcatccattcactgatggacatttgggttgctactaccttttggctgttctgagtaatgctgagtaatgctgctacaaacatgagtgtacaaatacctgttcaagcccctgcttttaattcttttaggtatatactcagaagtgggattgctggatcctatgataattctatttttaatattttgagtaatcacacaatgttattgtccatagaggctacattattttactttcccattaacagtgaataagggttccaatttctctacatcctcaacaattcttattttcccctccctccctccctcccttccttcctttttccactctctctccttttctttctttcattttttaaattgtagtcatcctaatggtataatttacgtatgcatccttgagactttatgctttactgcagaatggtgaatctcctgatctatgagagatttggtgacccctggtgtgtgtgcatgtttctctatgaatgtgtacgtgtatcaatattttgtgccgatctttgagtatttttactgttagtatccaagccacaacctaccatgtgcatgtgaccatgaaaaaaatcctgactccaccagcaggatgggcctctgggcaccctataatttgactaggggaatggggtgtgtgttggcagggagcgggggaggtgtagctgctgaaatccaagaggccagcttctgggagcatgtggtgctaggcagagggcagaaatctcctgggaagtgcgtaatgcctattcgtatgattcacaatcagaggagacattggtcaacaaaccccaggatgacccactaagggaaagaggagatagaaaagcggatcgatacggtgatgtttcggaacggaaatcagaaaggtggccaggatatagtaataagaaactcataaaataattcaaattcctctagtgcatataatgtttctagcatttgcacttgtgtttatctatttatgatcatgcctttggcaacatcactgcttatcaatggacacactccttctagcaggcagaaaaaggagagaagcagagtaagcagctttgctcctttgaggtcccattcatatagagacccacagaacactgaagccagagggaccttggagatcatttaattccttctttactccacaggtgaggaaactgacgaagtggctttagggaaggtggaggtggaacgctaccttcttctcccgcagtaagcaccaacgatctgggaagagctggagtgagaaaccacagaaatgcttctgtgataacactgactccattgttaaccctcagtttacacccgagattggctacttctgatttaactccacaaaagcctctgtgctctatgaatatgatatccagacttggctgtcccctaagtacatgtttttttatagctggatttaatttttcctcataaatgaattgcatagaaaaggaaacgggcttgtatcatcatcctaaaaatgagcaggcacccaaagacagctcttcttgtttcttcttctgcctctcagtagagtgaagtgaatataaaaactgggcagaaaaggcccatgggattgccatgtgtgaggaggtgggtggcaccttgctacctgcaggcacagacagcagagaacgctgtgtgtgtgtgaagcaacagtgaatgtggttctacatccttgcaagagctgacaatgtccttcgttatctgcaggagtcagagcaggagtcccaagctggtggggaagccaacatgaaggcctgggtgggctccagagagggaaggaagagcagcagaaggccaaagaggatgcctaaatttgtggcggcagtactgggtcttataattctaccacataatacataggaaactgagtccaagagaagtaaatgtccttacagtctatggatggcaagattaggaaaattttctattctaatttccatgctcttaccaacttttactctggagaaaccttttgcctgtgctgttattttgctagggccctttaggtaagacaggagaaagcacagcaagttgcaccaagaaccctgcagcacacagtgctgtggtgatagtgtattcgtccgtccttgcattgttataaagaactacctgagactaggtataaataagagaggtttaattggttcagggttccacaggctgtacaggaatcatggctggggaggcctcaggaacttacaatcatgacagaaggtgaagaggaggcaggtatgtcctacatggctggagcaggaggaagagagcgaagggggaggtgccacacactttcaaacaaccagatctcatgagaactcactcactatcacaagaacagcaagggggaatccatgcctatgatccagtcacctcccgccgggcccctcctccagcatgggggattacaattcgacatgacacttgggtgggacacaaatcccaaccatatcacataggagtatagttctcaagctcctacttcaaatgccaaaccaaaatacagcttagtgagtgaggggtcttaaggtttttcatttgtaggtggaatttagcaggtgaagacatttacaaccattataatgtgggtggcatattccacatatcccctagacctaggttatactgggctttgcagtgcattaaattactcagaaagttttaaagccattcctgcctccccactattctcttccagccacccttagagactttgatatgactgaaatgtatctcttaggtgtactggggtagagaaaagtttaggagtcattgatgtagcctcacagtaactattcacagctctgtgatcagctcagctgatcaacttacttcctagcaccttctagaaggggtttttaggccaatagaaatataatgcaagtcacttatgtaagttaattaaaattaaattttctattagccacattaagaaaggaagaggagagaagtaaaacactaacaatatatttaattcaatatatccaaagtattatcctttcaacaaataataaatctataatattgtatgcatataatacataggtgtactaagtcttgaaaatcggatgtatatattctactcacagcacatctcaatccacagttagccatattttaagtacctgacagccacatgtggcctgtggctactatactggacagcacaaatctagactgttcttacagtccttagggctcaaaccttgcccttgcctctctcactgacatgcgtttactccaaaagaaatagaaatttctccacgatgtagccattctcgcctgtctcagggccctttcctgtccaggtcttaatgtgtccacttggtctttattgcatctcaactctccaattgtccactgagtcatcaagtaatcattactgagtgcctagcaagctcccagtatttgtgttaactgacaaggataaaaaaatacaggagatgctgacttccaggagctctcagcttggaaatgcaggcacaaacacgaacatgtgagggatgctatacggagacacatgcacacaggaaggagtgactgctccttctggggctctggaaagcattcacagagggagacatggggctgggtttttaagggatgagagagattatagacaggtagggaaaatgtgtttcaggcatagggaaaagcatattcatgacagtacgatgatctgcatggagatgacaagtgtctaggaagtgagaacatgacaaggagtgcctggagtgaggctggccgggcaagtggggcccgagtgcctggtgacacatttagaatgactgtggggtaattctctgagcaggaatctctgaatgagaatattttgtggtgagctataatgcagtttggaaaaaacaaagaagtaaggagagcctgaactaagtgggcagcagtatgtccagaaaggagcggatgggagcccccatgtgaataagggaatataagggcactgtttgcaagatgagcattatgatgaaagctgggcaaagggtctaattgctaaggctttctatgcccaaactcactatgctgagggcattagggccactcgcatggtatttatacaggcctattacagtccgttgtgatctggaagcactacatgcatgcctgccctgaaggaaatggtaaggctctttacaggttaatttaggcaggaggcagaatcaagcggaatcacttccaggactgctaggaaagtcacacttgtgacacccagcaggtgttgggcagtacctgaccagcccaatcagataatgtggttgctcacactacctggaacccaactgtggcttatctgactgtgagttttctggaaggtggctctggagctctcaggtaagaacagggcagcaacatgacatctacagtgagaaggagcctcagagatgccatgagttcttcttttgtaaatggggaaggctggggcagggagagttcaatggcttaaaggctagtaagcggcagagcaagaatagaattcacctttcttatttcataagctggtgttgctttcacagcacactgccctctgagatgagcgggagatatgtcccgaagaactgtttacctttatagcaactcaggaaaaaagagaaagctaggctagagacacactaggtaatcaaaccatcttggtgggccaattagatttaatctagtagcaatgcactggtactcacacggtgaagagtccacgaagttcgggtcaatattatgcagcagctcaattctgggggatgggcttccttcactggaaaacaatttttaagggaatgttaatttcctctctctaatgggcatgaattattttaatacttcccttccttgtacttataggaaataacaaacctgccagttaacaactctgtcatgaatttggaggtctccacaatcacggctggtgcatcttcaagcagtcatcgtttgtttacattgaccgaaccctttacataagaacttcagtgtcaagcatatgaagatattttaaaaaatgattctgggaccctttgaaataaatattgtggccttatttaaacatgaccattttttacaccagagaaatgagaactcaagtcacctcatatagacttcatactgaacacttacgagtaaatgaagaaactgcatctgccaaaatggtggcaccaatattacagatgcaacatgcctcttaaagagtaacctacatcagaaaaattaatgtcctccatgtccaaatttgcaacacggatcttagatttaatataaatacatgagaaatacctagatctctttaaggctttaaaaaatgtgtacacacaaatacaatcacaacctacatttgtgctgaaaagtgacttggagatcgcttagttcaaccccctcttcttacaaatgatgaaggtacatagtaagttattggtagaatattgggttgtgtgactctcaaagcagtgttcttaagaaattgggagcataaacatcaccagatgtatgtagggagcacaataggcacccaggtcattttgctagtgtagactcagccttacagaagtagctaaaaacaatttaaatcattgagggtgtactgaggactccctgataatctaatacagttcagctaagtactaaaggttgcaaagtactgttaacaccacaggattcatacataatataaataatcaataaggctcctgacgtaaccaagacatggtttcaggtgtcccagtgtccacacgccaaactcacagttagctgttgatagcagtggtttgggatttcaatgcccaatacaatttcaaaaaatctgggttgtgattcacaactttgtatttgccaagtaaggaaatataaaaacaaatcttaatgaattaatttaaaacaaaacaaaataacaaacttcaactaccatcaccattattttataaaataaacagcaaaaaaggtaggaaagacacgatctctgaataaataacagctccttaaattgagcatatttaactttggtattctatcagatgtcattgtccccctctactccataaatcacagtgatcagagacagtggaagagaaacattcaggggtgcccacggtcctgggacagcagcggcagcactgcaggggtgggggtggggcatatttcccaggacctttcttttctcattttctttcggagacacttaactgcctgaatatcctggagactatcaaccagtccaaaatgccaggaactacggtttgatcccagaagctctgaatggaagtagaaatgatatgtaaagaaaatggtaaatatgagaaaatctaaatagaatgatgatgatgtctaatttgtgggcttaaaaccaaacaagtatgccaggtacaatggctcacgcctataatcccagcactttgggaggctgagatgggaggatcccttgaggccagccaggagtttgagacaagcttaggcaacatactgagacctggtctgtactactactactactactactactactactactactaataataataataatttgagcatggtggtgcatgcctgtagtcccagcaacacaggaggctgaggcaagaggatcccttgagcccaggagttcaaggctgtagtgagctatgatcacaccactgcactccagcctagatgacaaagtgagactctgtcttaaaacaaacaaacaaataaaaccaagcaaacagagttaaaatcctggaaaataatagcaagcaaggaaaggaaatcaaatgaaagcattttaaagtatttatattgtttggaagtggggtaaagctactgattaaatttagatttagctaagtaaaacttttgtgttaaatttttagggcaactattaaaaataaaggctttttctggactataggttgaaaactcaaaaatttcagggccagtatattaatacataactacgcagctttaaaagtagagttcactgtaataccccaaaatattaggcacaattaaataaaaacattttcctaataactttagagagagtttatatacatactcttcattcatgtcatttttttcattattcagaagagtcacaggtattttaaaataagtaaatttaatacgatgagatgattttttgaaaccaagcgttgtgtataatcctagttgattgttaggaaaaatcttcataggcagaatcatcatgatgcaaataggagccaacccctccaactatcttaagtatgttgtcattctacttttaaaatgcactcatcagaatattttgataaggatgtggttagagatatgggccaagaaaacacaatatatgacaagtgattgaaacaatgaccaaacaccattagggacttcctgagggggaggtagagagggattgtggatttccgttaatagttaacactttattaacacagattcaagtaattataccctccaccaccacacacacacacacacacacatcaacttaagaaggcacagaaactgcatggttaatttcagtgcagacaagggtacagtgtactgatactgcaaccaagaaggtgggttcaagtcacctggagaagacaatctgggggcatgggacagaaacggagcttgtcggaaggaggggaaggggtgggtgatgagaagtctcaaagctaactctgcaagcctcataattttgcctaggagatatttcagagtcataattttgaaaagaccagtaaatggcagagacaatggtcattagagagacatggccgattgctggggaggagaatcctcagggctgaatgccatatataggaagagcatgccccagaccctgcgcagggcccactgtctactgaggagttaaaatttccccagaccgaagaagctggacatgggtacacagcttgggaagaaatgttcaccaccatattaataaactttctctttataaattcaaagaaagggaagttcagtaaatacccatatgttttcagcattaaagaccctcttaagaacccacaaattcttggccacttaaatttgagtagtctccaataatcacatgaaagatccctctcttggatttagaaggaaaatgcctggtgtgtggtgagttttctgtttttgtttttgtttttttccctttttttttttttagagaaaacgttttccattgttgtctcactgccatcccttcctcactcctctggaaatttttgatatcaataatctccactttcttatgcatgttcatctatccttctgttaaaaacaaaataagaaaattttattaaccatcttatttgccattaggtatcttgttttttgcagtactcattctcaaactttgctgtacattagaattacctgggaagcttttaaatcccagatgcacaggctgcatctcatacccgtaagatcactggcggtggaacccaagcattggtacttttggactctccagatgattccaatgtgcagccaagcatgggaaccgctgctcctaagcagtgcttcccaaaccttaatgtacatatgaatcatctggggagcttgttaaactgtggatcctgatgtacttgaactgaatggggcccaataatctgcatttctaacagtttcccaggtgacattgatgctgctggtctcagaaccacacttgaggtatcatggtttgaggaagcctcccggagtccttccacatgggatctcaactcttttggagtctcttaaattaaaatcttatttggattagggctgattcaaacataatgattctcaaccttggctgcacaatacaatcacctgaagaactcttaaaaaatactgatgcatgggttcaatcccaggagactgagttctgagtttcagcctgggcataaagatttataaaagcacccaaacttagctttattgaagtataattttaaaaccatacaatcacccatttaaactgcacagttaaatgtttttggtatattcacatggttgcacaatcatcaacagtctaattttagaacatttttatcctcccaaaagaaatactgtacccattagcagtcattcttcattttctacttcactcccctccccagccctagccgattgttaatctgtctctacagatttgcctattctggacatttcatataactggaaccacacaatacttggccttttgtggctggcttctttcacttagcataatgttttcaaggatcatcaatgtggtagcatgcatcaaatatttcattcctttatatggctaaataatatcccattgcttgaagatatcacattttctttatccatttacttggttagtattttgattgttttcaatatttggctattatgaataatcctactatgaacattcatgtacaattttttgtgtgggcattcgttttcatatctcttgggtctataactaggagtggaattgccaggtcatatggtaactctacaacattttgaggacttgccgaacaattttccaaagcagctacgccatttcacactctcaccaggaataagtgcttcaatttctccacatctttgacaacacttattaatgtgtctttttgaatgtagccattctagttggtgtaaagtgatatctcattgcgatttgatttgcattttcctaataattaatgatgagcatcttttcatgtatgtattggccatttatatatcctctttggagaaatgtctattcagatcatttgctcgtattttaatggggctacttgtctttttatgattgagttgcatgaattctttatatattctatttgcaagtcccttatctgatacatgatttgctaatattttctcctattctgtgggttgatttttcacttccttgagaatatcattttgagaataaaagtttgcattttgatgtagttcgacttatgtattttctcctgtgttgcttttatctaagaaactactgtctgacccaagatcacaaagctttactcctgagttttcttctaagagttttatagttttaattcttacatttaggtctatgatccattttaagttaatttttgtgtatgctgtgaggtagagatccaacttcattatcttctttttttattatgtttaattgacatataaatatacatatttatgggctagagtatatttcaatatatgtgtacaatgtgtaatgataagtcagtgtaattagcataaccatcacctcaaatatttatcatttctctgtgttgggaacattcaaaattcactcttgtaacttttcaaaaatatacaataaattgttgttaatgatagtcaccctatagtgctatagagcactagaccttattcctcctatttaattgtacttttatatccattaactaacctttggctattctcctctcccctacccttcccacccctcaggaaaaacactactctactctttgcttctatgagatcaacgttttttagcttccatgtatgagaacatgtggtatttatctttctgtgcctggcttatttcacttaacatagtgaccttcagtttcatccatgttactgtgaatgacaggatttcattttgttttatggctaaagagtattccattgtgtatatataccatattttcttcattcacccactgatggacccttaagttgattctatatcttgggtattgtgaatagtactgcaataaatatgggagtgcacatatctccttgatatactgatttcatttcctttgcatatatacccagtagcgggattgctggatcatatggtagttctatttttagttttttgaggagccttcatattgttttccacaatggctagactaatttgcattctcaccagtggtggataagagtacccctttctctacaacctcgccaggatctgttattttttaactttttgataatggccattctaaccgggttgagatcatatctcatcgtggttttaaatttgcattctctcatgattagtgatgttgagcatttttaaaaataaatctactagccatttgtatttcttattttgagaggtgtctattcagctcatttacccattttaaactggattatttggggggtttttctgttgaattgtttcagttccttatatattctggatattaatcctttgttgaatgaagagttagcaaatattttctcccattatgcaggctgtctatttgctctgttgattgtttcctttgctgtgcaggagattttagcttgatataatcccatttgtctatttttgcttttgttgcctgtgcctttgaggtcttctccataaaatctttgcccagaccaatgttctgaagcatttctcctatgttttctttcaggagtttcatagcttcaggtcttatatttaagtcattaacccattttgagttgatttttatatatggtgagagatacaggtttggtttcatttttatgcatgtggatatccaattttcccagcaccatttattgaaaagactgtctcttcctcaataaatgttcttggtgcctttgtcaaggatcagtaggctatacatacacgaatttatttctaggttctctattttgttccattggtatatgaatctgtattttacacaagtaacatgctgtattggttactatacctttatagtatcttttgaaacctggcagtgtgatgcctccaactttgttcttttcattcaggattgctttggctatagggtcttttgtgggtgcatgtaaattttaggattttttaatttctgttgagaatgttattggtatttagatagggattgcattgactctgtagattgcttttggtagtaagatcattttcacaatatttattcttcaaatctatgaatatgagatatcttttcattttttgtgtgttctcttctgctagcttgttgctggcatatagaaatgctactgatttctgtatgttgattctgtatcctgcaactttactgaatttgtttatcagttgtaagagttttttggtagagcttttagggttttctgtatatatgatgatatcatctgcaaatagggacaatttgacatcctcctttccattttggaggtcctttatttctttctattgcctgattgctctggctaggacttccattactctgttgaacaaaagtggtaaaagtgagcatcgttgtcttgtttcagatgttaggggaaaggctgtcaactttttcccattcagtgcgatgtttgctatgggcttatgatatatggcctttatcgtgttgagctgtggtccttctataactaattagttgagtgttttgattatgaagcgatgttgaattgtatcaaatcctttttatgtatctattgagatggtcatgtggtttttatacttcattctgttgatgtaatgtgtcatgtttatggatttgtatatgttgaaccattcttgcaactttgggataaatcccacttgataatggtgaatgatcttttaaatttatttttattttttgagatggggtctcattttgttgcccagactggagtacagtggcttgatcatggctcattgcagtctcaatctcccagactcaagcaatcctcccacctcagcctccctagtacctgggctataggagcatgccaccatgcctggctaatttttaaattttttgcagaaatgggatctccctctgctgcccaggctggtcttgaactcctaggttcaagtgatcctcctgccttggcctcccaaagccctgagattacaggcatgagacaccacacctggctgtgaacgatctttttaatgtgttgctggattcagtttgctagcattttgttgaggctttgtgtgtctatgttcattggggatactggcctaaagttttcttttcttgttgtatctctgtctagttttggtatcaacataatgctggtcttgtggaataagtttagaagaattccctcctcttcaattttctggaagagtttgagaagaatttttattagttctttaaatgttttgtagaattctgcaatgaggtcatcaggtcctgggcttctcttcaatgggagactttttattacaagattcaatctcattacttataattggtctattcaggttttctatttcttcttggttcaatcatggcacattgcatgtatacatgaatttatccatttccactagattttctaatttgttggcatatagttgttcataatagtctctcatgatcacttgtatttctatggtatcagttgcaatgtctccttttttgttggtgattttatttggaccatttacattcttgattcatctagctaattatttgtcagttttgttaatcgtttcaaaaaccaacttttaatttcatcgatcttttgtattattttttagcgtgaatttttttattttattattattattattttattattattatactttaagttttagggtacatgtgcacaatgtgcaggttagttacatatgtatacatgtgccatgctgttgtgctgcacccattaactcgtcatttagcattaggtatatctcctaatgctatcctcccccctccccccaccccacaacactccccagagtgtgatgttccccttcctgtgtccatgagttctcattgttcaattcccacctatgagtgagaacatgcggtgtttggttttttgtccttgcgatagtttactgagaatgatttccaatttcatccatgtccgtacaaaggacatgaactcatcattttttatggctgcatagtattccatggtgtatatgtgccacattttcttaatccagtctatcattgttggacgtttgggttggttccaagtctttgctattgtgaatagtgccgcaataaacatacgtgtgcatgtgtctttatagcagcatgatttatagtcctttgggtatataccccgtaatgggatggctgggtcaaatggtatttctagtctagttctagatccctgaggaatcatcacactgacttccacaatggttgaactagtttacagtcccaccaacagtgcaaaagtatttctatttctccacatcctctctagcacctgttgtttcctgactttttaatgattgccattctaactggtgtgagacggtatctcattgtggttttgatttgcatttctctgatggccagtaatgatgagcattttttcacgtgtcttttggctgcataaatgtcttcttttgagaagcgtctgttcatatcctttgcccacttgttgatggcgttgttttttctcgtaaatttgtttgagttcattgtagattctggatattagccctttgtcagatgagtagattgcaaaaattttctcccattctgaaggttgcctgttcactttgatggtagtttcttttgctgtgcagaagctctttagtttaattagatcccatttgtcagttttggtttttgttgccattgcttttggtgttttagacatgaagtccttgcccatgcctatgtcctgaatggtaatgcctaggttttcttctcgggtttttatggttttaggtctaacgtttaagtctttaatccatcttgaattaatttttgtataaggtgtaaggaagggatccagtttcagctttctacatatggctagccagttttcccagcaccatttattaaatggggaatcctttccccattgcttgtttttctcaggtttgtcaaagatcagatagttgtaggtaagcggcattatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcaatgtgggctcttttttggttccatatgaactttagttttttccaattctgtgaagaaagtcattggtagcttgatggggatggcattgaatctataaattaccttgggcagtatggccattttcacaatattgattcttcctgtccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgcatcctgagactttgctgaagttgcttatcagcttaaggagatttggggctgagacgatggggttttctagatatacaatcatgtcatctgcaaacagggacaatttgacttcctcttttcctaattgaatgccctttatttccttctcctgcctaattgccctggccagaacttccaacactatgttgaataggagtggtgagagagggcatccctgtcttgtgccagttttcaaagggaatgcttccagtttttgcccattcagtatattggctgtgggtttgtcatagatagctcttattattttgagatacgtcccatcaatacctaatttattgagagtttttagcatgaagtgttgttgagttttgtcaaaggccttttctgcatctattgagataatcatgtggtttttgtctttggttctggttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctgcctggctttggtatcaggatgatgctggactcataaaatgagttagggaggattctctctttttctattgattggaatagtttcagaaggaatggtaccagttcctccttgtacctctggtagaatttggttgtgaatccaactggtcttggactctttttggttggtaagctattgattattgtcacaatttcagagcctgttattggtctattcagagattcaacttcttcctggtttagtcttgggagggtgtacgtatccagtaatttatccgtttcttctagattttctagtttatttgcatagaggtgtttgtagtattctctgatggtagtttgtatttctgtggtatcagtggtgatatcccctttatcattttttattgcgtctatttgattcttctctcttttcttctttgttagtcttgctagcggtctatcaattttgttgatcttttcaaaaaaccagctcctggattcattaattttttgaagggttttttgtgcctctatctccttcagttctgctctgatcttagttatttcttgccttctgctagcttttgaatgtgtttgctcttgcttttctagttgttttaattgtgatgttagggtgtcaattttggatctttcctgctttctcttgtgggcattcagtgctataaatttcccactacacactgctttgaatgtgtcccagagattctggtatgttgtgtctttgttctcgctggtttcaaagaacatctttacttctgccttcatttcgttaagtacccagtagtcattcaggagtaggttgttcagtttccatgtagttgagcagttttgagtgagtttctgaatcctgagttctagtttgattgcactgtggtctgagagacagtttgttataatttctgttctattacatttgctgaggagtgctttacttccaactatgtggtcaattttggaataggtgtggtgtggtgctgaaaaaaatgtatattctgttgacttggggtggagaggtctgtagatgtctattaggtccgcttggtgcagagctgagttcaattcctgggtatctttgttaactttctgtctcattgatctgtttaatgttgatagtggggtgttaaagtctcctattattattgtgtgggagtctaagtctctttgtaggtcactcaggacttgctttatgcatctgggtgctcctgtattggttgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctttgtgtgtctctgcacatgagatgggtttcctgaatacagcacactaatgggtcttgactctttatccaatttgccagtctgtgtcttttaattggagcatttagcccatttacatttaaagttaatattgttatgtgtgaatttgatcttgtcattatgatattagctggttattttgctcgttagttgatgcagtttcttcctagcctcgatggtctttacaatttggcatgattttgcagcggctggtaccgattgttcctttccatgtttagtgcttcaggagctcttttaggacaggcctggtggtgacaaaatctctcagcatttgcttgtctgtatagtattttatttctccttcacttatgaagcttagtttggctggatatgaaattctgggttgaaaattcttttctttaagaatgttgaatattggcccccactctcctctggcttgtagagtttctgccaagagatctgctgttagtctgatgggcttccctttgtgggtaacccgacctttctctctggctgcccttaacattttttccttcatttcaactttgatgaatctgacaattatgtgtcttggagttgctcttctcgaggagtatctttgtggcattttctgtatttcctgaatctgaatgttggcctgccttgctagattggggaagttctcctggataatatcctgcagagtgttttccaacttgcttccattctccccgtcactttcaggtacaccaatcagacgtagatttggtcttttcacatagtcccatatttcttggaggctttgttcgtttctttttattcttttttctctaaacttcccttctcgcttcatttcattcatttcatcttccatcactgataccctttcttccagttgattgcatcagctcctgaggcttctgcattcttcatgtagttctcgagccttggctttcagctccatcagctcctttaagcacttctctgtattggttattctagttatacattcgtctaaatttttttcaaagtttttaacttctttgcctttggtttgaatttcctcctgtagctcagagtagtttgatagtctgaagccttcttttctcaactcgtcaaagtaattctccgtccagctttgttccgttgctggtgtggaactgcgttcctttggaagaggagaggcgctctgtttttagagtttccagtttttctgctctgttttttccccatctttgtggctttatctgcttttggtctttgatgatggtgatgtacagatgggtttttggtgtggatgtcctttctgtttgttagttttccttctaacagacaggaccctcagctgcaggtctgttggagtttgctagaggtccactccagaccctgtttgcctgggtatcagcagcggtggctgcagaacagcggattttcgtgaaccatgaatgctgctgtctgatcattcctctggaagttttgtctcagaggaatacccggccgtgtgaggtgtcagtctgcccctactggggggtgcctcccggttaggttgctcggggttcagggatcagggacccacttgaggaggcagtctgcccgttctcagatctccagctgcgtgctgggagaaccactgctctcttcaaagctgtcagacagggatatttaagtctgcagatgttactgatgtctttttgtttgtctgtgccctgcccccagaggtggagcctacagaggcaggcaggcctccttgagctgtggtgggctccaccaagtttgagcttcctggctgctttgtttacctaagcaagcctgggcaatggtgggtgcccctcccccagcctcgctgccgccttgcagtttgatctcagactgctgtgctagcaatcagcgaaactctgtgggcataggaccctctgagccaggtgcgggatataatctcctagtgtgccgttttttaagcccattggaaaagtgcagtattagggtgggagtgacccaattttccaggtgccgtctgtcacccctttctttgactaggaaagggaactccctgaccccttgcacttcccgagtgaggcaatgcctcgccctgcttaggcttgcgcatggtgcgctgcacccactgtcctgtgcccactgtcttgcactccctagtgagatgaatccggtacctcagagggaaatgcagaaatcacccgtcttctgtgtcgctcacgctgggagctgtagaccggagctgttcctattcagccatcttggctgccagatctccgtgaattttgtttatttctgctttcatcattatttctttccttctactaattttggatttggcttgttcttgcttttctagtttcttgagatacattgctacgttgctgattggaaatccttctactttttggatgtaggcatctattgctatacattttcctcttaacacttcttttgctgtataccataggtttttgatatgctgtatgtctattttcatttctttcaagacatttaacattttccttcttaatttctttattgacccattgaccattcaggaacgtgtttaacttccatttccatgtgtttgtaaaatttcaaaagttcctcttgttattgatttcattgtggtcaggaaagatatttgagatcattgcagtttggtggttttctgcagtaacaaggttttctcttgtttctctttctcctttgtgcatctgctctaccagcgagttttacacttgtgtgtgttttcatgagaatgattatcatcttttttcttccagatacaggactcccttgactgtttcttgtaaagccagtctagtggtgatgaattccctcagtttttacttgtctgggagactttctttctctctcatttctgaagggtagatttgctgggtatcgcatgcttagctgacaatttttttttcttttggtactttgaatacatcatccacttctctcctggcttgtcaggtttctgcagagaaatatgctgtaccctagaatggcagaacacagctgttatttgggccctggaagacaatgtgcagcacagcaatgactccactccccagagtcaagggtatctcagcagctcagacttcaggaggctagtacagccccaggaaggaaggacactagagctgtttggcctgcaggatggggtgtctcagctcagccactgctctgtttccctgggacacaggataccatgtcagcacagccctgggatttgcagctattcagctcagccagggtacaaattccccagagggtgatgtgtcatttcggcttgagtccaacaggtatgactgctctgggtggaccaggcaccatttccctaggatgcagcgtgctgctttgacttaggcattggaggggcatgatttctctgagcagtcaaagtactgttttcccaggaatcaggacactgcttcagctctggcctgaggaggaaagggtggtgggaggtggagcagctccacctctgcttggccccacaggggagcacaaaacagttgctcgacttggggatgtcaggccattgggctggggcagttcagcaatggcttagcctcagggataaaagagagccatgcatacttgcccccagagcaagacacatccagccatagttccaactccaagatggcatagcatggtagctatgtgggccacagggtgtggatcatagtattggctccttctctgggggaagcacggacatgtggacttcaggcagctccctcagctaggcttagtgtctgtgaggattgcaggggaccccagtgctcaggtctgtaggtatccacggtgttgatggggctgctgggatccttttgtttacctccttgcagtagggaaacgttcctcctagttcattcccagctgcttccaattggggttagggtaatggaggcctggcatttcttcccattctctatgtggccatcccaagtttctgtgctcaccagggtatctgttacttctcttgtgcaccactgtgctcctcctcagttatttttgttaaaatgaagttgtttattcattgttctggctatctttttgagggagaatagcactagggtcttctagtctaccatcttgctgatgtcatgcttcttcaacttcattcttctgcatgtgggtagccagttatcccagcactatttttttgaaaggactattttttccaatagtcttttcaatagttccaatggaactatcttggcacccttgtcaaaaatgcaatctgattttaacccacatctaagattaagaatcactgctctctggccttgttatagaggtcaccatatgtgattacatgttctaaattcttgattttgttcctatagagcaaaagatgggtatctagcttttaggacacttaggtaagaagtccatatataatgataatggcttccccttgaaaacaagtcctggtttcccagaaagtatcttaagaaatctgttgataactttctataatcaatatcttaatatatgccatatagggatattagtaccttgaacacaaagctttatcacaatgacacaatttcttccacaaaggtgtgtataccaaagtgggttggagaaaaagtgtatgttgtatgttcataacacagtttcagcaatatcaactcttgtgatcacttgtgatcttgcagaataaacagtggccctatcagaaccataaaatggttgtggggttgattattgctatactataatcatgtgttagcttctatcttctctatgtctctctctacacacacacacatatatgcatgtattcatttttaggtaatgctacaaatactatagtattccaggacatcatacagttccaaagtttcatttccatacaatcatcagaaaatgaactttcctcctgaccaatttctgaagacatcactctctcataagaagtatagcattgtctttgggagcaaagcctttcagggtgtgcatcccaactccagaaattactggctatataaacttgggtgttgtttttctcatcagcagaatctagataaaagtacctatcttacagagttgttatgagaattgcatgaggcaacaaaagcccttttattgtaaaatatagatccagattctgcagacatggaaataatataacctcaaagactataacctgggacacagacacaagaataatatgaagataaaatgaaacattaatattcctacctattcttcttgctggcaagtgctccctttatgaaacacactggggtagatgtaattttaatttctaagacattttatgatgttctctccaatatgagagtctctttttggaaaaatatcagtgtcaatatagtcaagtcacacagtctactcattatagactgtatattaaaaaatacatattgcaatctgttatctaggtattttccttattttttggttttggtagatgctatagtttagctgcatgagctatactgtctttatcagattgttgattttatttgtgaaataaaaatctctaaataatgactgacggtgttaatgataaacgggttttcaataatcacacaagttcatgaaatgtcctggttttacgtgaatcaaggtaatgggtgtttttattacagcaaatacttgggctccaggcttataggaacaaagcagagctctctaattagcttctttaaggtaggcacccatgggacagttcaaggattgccaccgtacaatgtttacccccatcccagcacatattattggctatggcagtaagtagacaaagacctatgtaaagaaaataacagaactatcttgtttgccatttgccacttagtgatgaagacctacctctaaaccggtgaagttggcaagttttacccatgcctataacaaccaaactagttattttggggtttcatttgttttggctaggctagtttggataacagtagcttgcactgatagaacattttttatgtgcaacacaccatttaaaatactttacacgtatcatttcattcaaccttcaacactgtgaggtagagacaagcttggcatggcatggttaagtgacttacacaatcatgtggttgagcaggtgacaggactgggtttggagctcaggcagactgacccccaaatcccatctctaaccttctatgctaaattctctgctcagtaagatgtacacatggcctcagtgtctccttgaatgtatggtgtttccattcatttggtttatttttaaggctccataaacaaatatctctattaactgcaaatgcttctattaataaaagttaaacatttttcttcaccctcttctcttgaaaacttataaagtagtatatcattgtctctgatgatattttcagtattctgtttgaatttaccccaaatttcacatttgctagagtatttttatttacaaaaacagggcaaggagacagccactgaccagtgaccagtttccaatatgctataaatattttctaaaagtctacagtttcagacactgagatcacagcactgtccatttataaatagtttccagtttttgattttcattttcctattagttgaagggtggggcaacaaaacatttcccataaataaatgaaatggtattacattccatacttcttttaccactaactgctgaccatctgtcataaaagacacaccctgaaaggcagtatcaaatttttagaaatagcaatgacaatactttctgagaagaaattttgaagaaaaaaaataaccccagttactaatgaaaacattgaccaacacatccacagggtaatgtccgacctgttaaccctttggaagcaccatcatccttgttatcatcttcactaccagctaccgagttcttacaatgttccaggcatggtgctaaatgtttcaaacacactctctcactaaatcctcacataggtgtctacaggataggttgttatttgttacatttgttacagacaaatgtaactattattacattttacacaaggaaatcaatgcttaaagattgcacaagtaattaatggaggagacaggatttaaaccagatctaatcaaaaagtaccgatttttaaccactatcccggtgaaactccttacaggacttatttcctttgttaagggtgtgtgtgtatggggggcaggtgatatttggtttgtgtaaatcccatgcttcctgaaaagccatttcaacatgcaaatattaccataaattaagagtataggcacggaaattagaaaatgttgatgaaattcagtgaggaaatatgtaagttgaattcactgggtctagagttatatatggaaagatatttttcatatagattgttattaagaaggtttattaagttttttaagtagtctagagaaaaaagtaatcaaaaatcactgaatcatacccttaatataatcttttcctattcattactaaaaaataattggtaggacttctgggttaattcaggataaacttcagggactaatatgcctttcttccaatttccattttaatatccacgaagaattacaaaaagatgaaaactggcaacagcgttggaaactaaagagaagaccatatgccaaagtcccaaggggattttcactaatgccaatgctgaagagacgaacaacacattcttggattctgccataagaatcaaaacatgatcccaaagaaagtagaagaagatggatttgctttgcctccatcgaatgatgggactcaggggctatgctaaacaaacaaaaaaaaaagagtgatgatcttccatgaactgtccttagagaggcaccattgtgcctcctctcaccccgaatgctggctgctttcctctctatgtccacccccacagcaagcagcagactaacatggaagagatcaggcatgagatgtagcttcctggaacatggaaccacctaacaaaacaatctgaaacaacctcagaacactccatactgtgagtgtaggatagaagcccttttatccaaaaggttgggaaattagggaatcaaataatatagcattccttaaacatttagtttgaacttaaaaacatagatacttccaactatgttgtcaattttggaataagtgcaacgtggtgctgagaagaatgtatattctgttgatttggggtgcagagttctgtagatgtctattaggtccgcttggtccagagctgagttcaagtcctggatatctttgttaactttctgtctcgttgatctgtctaatgttgacagtggggtgttaaagtctcccattattattgtgtgggagtctaagtctctttgtaggtctctaaggacttgctttatgaatctgggtgctcctgtattgggtgcatatatatttaggatagctagctcttcttgctgaattgaagtaaagcactcctcagcaaatgtaatagaacagaaattataacaaactgtctttcagaccacagtgcaattaaattagaactcaggattaagaaactcactcaaaactgcactactacatggaaactgaacaacctaatcctgaaggactactgcataaataatgaaatgaaggcagaaataaagatgttctttgaaaccaatgagagcaaagacacaacataccagaacctctgggacacatttaaagcactgtgtagagggaaatctatagcactaaatgcccacaagagaaagcaggaaagatctaaaacttgacaccctaacatcacaattaaaagaactaaagaagcaagagcaaacacattcaaaagctagcagaaggcaagaaataactaacagcagagcagaactgaaggagatggagacacaaaaacccttcaaaaaaatcaatgaatccaggagctggttttctgaaaagatcaacaaaattgatagaccactagcaagactaataaagaagaaaagagagaagaatcaaatagacacaataaaaaatgataaagggtatatcagcaccaatcccacagaaatacaaactaccgtcagagaatactacaaacacctctatgcaaataaactagaaaatctagaagaaatggataaattcctcgacacacacaccctcccaagactaaaccaggaagaagctgaatcctgaatagaccaataacaggctctgaaattgaggcaataaattaatagcctaccaaccaaaaacagtccaggaccagacggattcacagccgaattctaccagaggtacaaagaggagctggtaccattgcttctgaaactattccaatcaacagaaaaagagggaatcctccctaactcattttatgaggccagcatcatcctgataccaaagcctggcagagacacaacaaaaaaagagaattttagaccaatatccctgatgaacatcgatgcaaaaatcctcaataaaatactggcaaaccgaatccagcagcacatcaaaaagcttatccaccaagatcaagttggcttcatccctgggatgcatggctggttcaacatatgcaaatcaatgaacgtaatccatcatataaacagaaccaaacacaaaaactgtatgattatctcaatagatgcacaaaaggccttcgacaaaattcaacaatgcttcatgctaaaaactctcaggaaactaggtattgatgggacatatctaaaaacaataagagctatctatgacaaacccacagccaatatcatactgaatgggcaaaaactggaagcattccctttgaaaactggcacaagacagggatgccctctttcaccactcctattcaatataatgttggaaattctggtcagggcaatcaggcaagagaaagaaataaagggcattcaattaggaaaagaggaagtcaaattgtccctgtttgcacatgacatgattgtatatctagaaaaccccatcatctcagcccaaaatctccttaagctgataagcaacttcaacaaagtgtctcaagatacaaaatcaatgtgcaaaaatcacaagcattcctatacacaaataacagacaaacagagaaccaaatcacaactgaactcccattcacaattgcttcaaagagaataaaatacctaggaatccaacttacaagggatgtgaaggacctcttcaaggagaactacaaaccactgctcaacgaaataaaagaggacacaaacaaatgggagaacattccatgctcatggataggaagaatcaatatagtgaaaatggccatactgcccgaggtaatttatacattcagtgccatccccatcaagctaccaatgactttcttcacagaattggaaaaaactactttaaagttcagatggaagcaaaaaaagcccgcgttgccaagacaatcctaagccaaaagaacaaagctggaggcatcacgctacctgacttcaaactatactacaaggctacagtaaccaaaacagcatggtactggtaccaaaacagagatatagaccaatggaacagaacagagccctcagaaatacaaccttctgatctttgacaaacctgacaaaaacaagaaataaggaaagtattccctatttaatacatggtgctgggaaaactggctagccatatgtagaaagctgaaactggatcccttccttacaccttatacaaaaattaattcaagatggattaaagacttaaatgtttgacctaaaaccatagaaaccctagaagaaaaaaacctaggcattaccattcaggacataggcatgggcaaggacttcacgtctaaaacaccaaaagcaatggcaacaaaagccaaaatagacaaatgggatctaattaaactaaagagcttctgcacagcaaaaagaaactaccatcaaagtgaacaggcaacctacagaatgggagaaaatttttacaatttacccatgtaacaaagggctaatatccagaatctacaaagaacttaaacaaatttataggaaaaaatcaagtaaccccatcaaaaggtgggcaaaggatatgaacagacacttctcaaaagaagacatttatgcagccaacagacgcatgaaaaaaatgctcatcatcactggtcatcagagaaatgcaaatcaaaaccacaatgagatactatctcacattagttagaatggcgatcattaaaaagtcaggaaacaacaggtgctggagaggatgtggagaaatgggaaggcttttacattgctggtgggagtgtaaactagttcaaccattgtggaagacagtgtggcgattcctcaaggatctagaactagaaaaatcgtttgacccagtgatcccattactgggtatatacccaaaggattataaatcatgctactataaagacacatgcacacgtatgtttattgcagcactattcacaatagcgaagacttggaatcaactcacatgtccatcaatgatagactggattaagaaaacatggcacatatacaccatggaatactgtacagccataaaaaaggacgagttcatgtcctttgtagggacatggatgaagctgaaaaccatcactctgagcaaactatagcaaggacagaaaaccaaacactgcatgttctcactcataggtgggaattgaacaatgaggacacttggacacggggcggggaacatcacacactggggcctgttgtggggtggggggtgggggtagggatggcattaagagaaatacctattgtaaatgatgtgttaatgggtgcaggacaccaacatggcacatgtatacatatgtaacaaacctgcacattgtgcacatgtaccctagaacttaaagtataataataataaaaaaaaatagatagtcacttcatagtctttgcatgcagggctactgattgttgttcctatcatctttatttcataaaccatatctataatgttttatctatagtttctagtgctgtttttcttaaagtggaataagaacctaagaacatgtgaatttttagattttcatagaataatggtggccatctaaatttaaaatcccttcatacattctctttaaaaaccatattgataaagaaagaaagtaatatcaaccaaagcagaagcctatgacacaagcaggagacaaggcctatttaaaccctgggtgaagtgaggaaacaaccctctgagacctgaagagtcaggactggtacccacccaagggcagagtcaggctagaattatgcaaaagagggttagggggtacaagaggagtgtattagtccgttttcatgctgctgataaagacatccccaagactggacaatttacaaaagaaagaggattaattggactacagttacacatggctggcgaagcctcacaatcatggtggaaggcaaggaggagcaagtcccatcttacatggatggcagcaggcaaagagagaatgaggaagatgcaaaaggagaaacccctgacaaaaccatcagatctcatgagacttattcactaccacgagaacagtatggaggaaactgcccccatgattcaattatctgccaccgggtccctcccatgacacatgagaattatgggagtacagttccagatgagatctggtggggacacagagccaaaccatatcattccacccctggcccctcccaaatctcatgtcctcccatttcaaaaccaatcatgccttcccaacagtcccccaaagtcttaacttgtttcagcattaactcaaaagtccacattccaaagtctcatctgagacaaggcaagtcccttatgcctatgagcctgtaaaatcaaaagcaagctagttatttcctaaatacaagggggatacagacattgggtaaatccgaccattccaaatgggagaaattggccaaaacaaagtggctacagggcccatgcaagtccaaaatccagtggggcagtcaaatcttaaagctccagaaatgatctcaaactccatgtctcacatccaggtcacgctgatgcaagaggtgggttcccatggtcttgggcagctctgcccctgtggctttgcagggtacaacctccctcctggctgctttcatgggctggcattgagtgtctgtggcttttccaggtgcatggtgcaagctgtcgtgggtctatcattctggggtctggaggatagtggccctcttctcacagctccactaggactccgtataggggttctggccccacatttcccttccatcctgccctagcagaggttctccgtgagtatcccacccctgcagcaaactcttgcctgggcatccaggcatttccacacatcttctgaaatataggcagaggttcccaaaccccaattctcaacttctgtgcactggcaggctcaacaccacgtggaagctgccaaggcttggggcttacaccctctgaaaccatggcccaagctctacattggccccttttggccatggctggagtggctgggacacagggcaccaaatccctaggctgtacacagcacagggaccctaggcctggcccctgaaaccactttttgctcctaggcctccagtcctgttataggaggggctgccatgaagacctctgacacgccctggagacatttttcccattgtcttgagaatcaacatttggctcctgattacttatgcaaatttccacagcctgcttgaatttctactcagaaaatggaattttcttttctatcacattgtcaggctgcaaattattcaaacttttatgctctgcttcccttataaaactgaatgcctttaacagaacccaaataacctcttgaatgctttgctgcttagaaatttcctctgccagataccctaaatcatctctctcaaattcaaagttccacaaatctctagggcaggggcaaaatgtcaccaatctctttgttaaaacatagcaagagtcacctttgctccagttcccaacaagtgcctcatctccatccaagaccacctcagcctggatttcattgtccatattgctatcagcattttgggtaaagccattcaacaaatctctaggaggttccaaactttcccacattttcctgtcttcttctgagccctccaaactgttccaacctctgcctattacccagttccaaagtggcttccacattttcaggtatcttttcatcagtgccccactctactgggccaatttactgtattactctgttttcatgctgctgataaagacatacccaagactgggtaatttaccaaagaaagaggtttatttggacttacagtttcacttggctggggaggcctcacagtcatggtggaaggcaaggaggagccagtcacgttttacatgaatggcagcaggcaaaacgagagcttgcacagggaaatttccccttatattaccatcagatcttgtgagccctattcactatcatgagaacagcataggaaagacctgccccatgattcaattacctcccactgggtccctgccacaacacatgggaattcaagatgagatttgggtggggacacagccaaaccatatcaaggggaaaggactcaaataacgtctgataagataaactccagaaagagaaggtcacacccaagggacaaaatgttgatagaggtctcatacctgacagatcaaagcactggctagtggggagtcaaaagggagtccaaggaagtagcttggataaggaagtgtgcaggacgagagtggctgccttgggcagctgagatgctgagagaggagcagctgaagaacaagtgtcctttggaagatggatggtaaagggaaggaaggacatggccaaagatcagggttccattataataacacagtgtcagagaatcatgagaaggcagaccaaaaagaaaggggctgagccaagatggccgaatagggacagttccggtctacggctcccagcatgagcgacgcagaagacgggtgatttctgcatttccatctgaggtaccgggttcatctcaccagggagtgcaagacagtgggcgcaggccagtgggtgcgcacaccgtgcgcgagccaaagcagggcgaggcattgcctcacctgggaagcgcaaggggtcagggagttccctttccgagtcaaagaaaggggtgacagacgcacctggaaaatcgggtcactcccacccgaatattgcgcttttcagactggcttaaaaaacggcgtaccacgagactatatcccacacctggctcggagggtcctacacccacggaatctcgctgattgctagcacagcagtctgagatcaaactgcaaggcggcagcgaggctgggggagaggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagccttgaagagagcagtggttctcccagcacgcagctggagatctgagaacgggtagactgcctccacaagtgggtccctgacccctgacccccgagcagcctaactgggaggcaccccccagcaggggcacactgacacctcacacggcagggtattccaacagacctgcagctgagggtcctgtctgttagaaggaaaactcacaaacagaaaggacaccgaaaacccatctgtacatcaccatcatcaaagaccaaaagtagataaaaccacaaaggtggggaaaaaacagaacagaaaaactgggaactctaaaacgcagagcgcctctcctcctccaaaggaacgcagttcctcaccagcaatggaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcaagaagggacgtttagagaaaaaagaataaaaagaaatgagcaaagcctccaagaaatatgggactatgtgaaaagaccaaatctacgtctgattggtgtacctgaaagtgatgcggagaatggaaccaagttggcaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagtggatctcttggcagaaaccctacaagccagaggagagtgggggccaatattcaacattcttaaagaaaagaattttcaacccagaatttcatatccagccaaactaagcttcataagtgaaggagaaataaaatactttacagacaagcaaatgctgaccgattttgtcaccaccaggcctgccctaaaagagctcctgaaggaagcactaaacatggaaaggaacaaccggtaccagccgctgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaatgctacaattaaaagacacagactggcaagttggataaagagtcaagacccatcagtgtgctgtattcaggaaacccatctcacgtgcagagacacacataggctcaaaatgaaaggaaggaggaagatctaccaagcaaatggaaaacaaaaaaaggcaggggttgcaatcctagtctctgataaaacagactttaaaccaacaaagatcaaaagagacaaagaaggccattacatactggtaaagggatcaattcaacaagaagagctaactatcctaaatatatatgcacccaatacaggagcacccagattcataaagcaagtcctgagtgacctacaaagagacttagactcccacacattaataatgggagacttcaataccccactgtcaacattagacagatcaacgagacagaaagtcaacaaggatacccaggaattgaactcagctctgcaccaagcggacctaatagacatctacagaactctccaccccaagtcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaagtaaagatgttctttgaaaccagcgagaacaaagacacaacataccagaatctctgggacgcattcaaagcagtgtgtagagggaaatttatagcactaaatgcccacaagagaaagcaggaaagatccaaaattgacaccctaacatcacaattaaaacaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaacaaagaagaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggagctgaaattgtggcaataatcaatattttaccaaccaaaaagagtccaggaccagaaggattcacagccgaattctaccagaggtacaaggaggaactggtaccattctttctgaaactattccaatcaatagaaaaagagagaatcctccctaactcattttatgagtccagcatcatcctgataccaaagccaggcagagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctgcttcaatatacgcaaatcaataaatgtaatccagcatataaacagagccaaagacaaaaaccacatgattatctcaatagatgcagaaaaagcctttgacaaaattcaacaacacttcatgttaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggggaaggaaataaagggtattcaattaggaaaagaggaagtcaaattgtccctgtttgcagattacatgattgtttatctagaaaaccccattgtctcagccccaaatctccttaagctgataagcaacttcagcaaagtctcaggatacaaaatcaatatacaaaaatcacaagcattcctatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacaggttcaatgccaaccccatcaagctaccaatgactttcttcacagaattggaaaaaactactttcaagttcatatggaaccaaaaaagagccctcattgccaagtcaatcctaagccaaaagaacaaagctggaggcatcacactacctgacttcaaactatactacaaggcttcagtaaccaaaacagcatggtactggtaccaaaacagagatatagatcaatggaacagaacagagccctcagaaataacgccgcttacctacaactatctgatctttgacaaacctgagaaaaacaagctatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaggaaactaccatcagagtgaacaggcaacctacaaaatgggagaaaattttcgcaacctactcatctgacaaagggctaatatccagaatctacaatgaactcaaacaaattacaagaaaaaaacaaacaaccccatcaaaaagcgggcgaaggacatgaacagacacttctcaaaagaagacatttatgcagccaaaaaacacatgaaaaaatgctcaccatcactggccatcagagaaatgcaaatcaaaaccactatgagatatcatctcacaccagttagaacggtaatcattaaaaagtcaggaaacaacaggtgctggagaggatgtggagaaacaggaacacttttacactgttggtgggactgtaaactagttcaaccattgtggaagtcagtgtggcgattcctcagggatccagaactagaaataccatttgacccagccatcccattactgggcatatacccaaatgactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacaccctggggactgtggtggggagggggaggggggagggatagcattgggagatatacctaatgctagatgacgagttagtgggtgcagcgtaccagcatggcacatgtatacatatgtaactaacctgcacaatgtgcacatgtaccctaaaacttaaagtataattaaaaaaaaaaaaaaaaagaaaggggctacatttagcaaagaaactgcacttcactatagcaatacacagcgctcttgaagcacctgaagtaaatgaaagtgtccaaatcccactcctacggattgcctgctatcttagatccaggaaacgccaacatacataaacgtgaacaaaaccaaaaagaactcagcatctatgcaaagttaccatacgagttaaaaaaaatagaaaatgagaattcaaaaatttggcaaatgaaaacattctcctactatggaaaaacagtcataaggcagaagaaaaccattacaggatatttcaacatgaattaaatataatgaaatcatcaactgccaatattaaagaaacaacaaccatgattcagaaattgtaaaactcagacatcacactttttaaaggaagggaactgggaaaaaaaggacaaaatcttagaaatgacaaaacattatacatgacattctctatgtgaaagcgtgtagagaatagaaattaaaagagaaaggataattaattcaaaataaagaaaaaataaagaggcaaagaggatacgagagaaattgacagaaaccaaatttatgtaaagaagattcaataatacctataactaggagttcctgaagaagaaaaacaaaacagtagaatataatatttaaaactgtaatttttttttttttttgagacggagtctcgctctgtcgcccaggctggagtgcagtggcgggatctcggctcactgcaagctccgcctcccgggttcacgccattctcctgcctcagcctcccaaggagctgggactacaggcgcccgccactacgcccggctaattttttgtatttttagtagagacggggtttcaccgttttagccgggatggtctcgatctcctgaccttgtgatccgcccgcctcggcctcccaaagtgctgggattacaggcgtgagccaccgcacccggcctaaaactgtaatttttaaaaactctgaaataaaagaagatctgaatatacaaagtgaaataactcacttttatctgagaaaactgacacagtagggtcacctttgtgacacatctggaaaaattcttagattttaaatcataactataataatagtgataataaaaaatcttctgggtgcccagacaaaaaacacaaagtcacttgcaaaggaataaaatcaggctgatattagacttatcaacagtaacatagaaaacaagcaaagattagggtaacattttcaagaaactcaaagcaagaaagtgtgggacaagggttttattttaaccggttgagctggtgttcaattatcaaggttgtagaaaatgttttaataaacatgcaagaattcaaagaatcctgagaaatctattcaaggatgaattcctccaactaagagataattgtgaacactttagaagtggatgggtggtcagtattgaatatattattgaagatctaaaactaaaacaaaattgtggataaagagagaacagtattacatattacatgctctgatacagtaggaataacactacttaaatcacaaaactggaagagaatgaaaagttacataagttgcttgatttccttatgggtaataagtggaagctgaagatgtcatttaaatgtgacaaaccaaatagtggaacctaagtaagaaaaaagggactaaggaattatataaagatatttgtataatgataaacagtaggataaaatataaatttttctaaatattaaagaactactaaataaaaggtcaaagataaaaagtaaatgtaacaaaacaatgaaaaaactaagaatagaaataaaaatatttataaatatgtataaattcatctactaaaacattacagactggatcataaagaaaaacctaacactatacttaacaactacagaatacgcattcttttcaattacacctgatgtggacaacaagaaagaccatctactaggccaagtctcaaatttaaaacaattagcccaggagtgatggctcacacctgtaatcccagcgctttgggaggctgaggcaggaggattgcttgagcccaggagtttgagaccagctgaggcaacatagtgagaccctgcctctacaaaataaaaatttaaaaattagctggttatagcagtacatgcctgtagtgccagctacttgggaggctggggtggaaggattgcttgagcccaggaggcagaagttgcagtgagctatgattgcaccactgcactctagcttgggtgacaaattgagaccttgtctctgttaaaaaacaataataataattgaaataatacaaagcatttcaattatttgtggtcctcaaaaccacaactgaaataaactagaaatcaataatttaactagggaaaaacccaaaatttggaaacttaacaatgcacttctaaatacatggttcaaagaaaaaaatcaccatttgcaccattccccatagaatacattctttcaaatgaaagaactcaaacataaataattacattcaaacataaataatattaatattctaacattcaaacataaatacattcaacatattacattcaaacaaaaataatattaataatatacagaattcttgttaaatcctttctgctcaagatgctgtagacgttagtttattgtctactggtgagtattattatagcaaagtgaaccaggtaaaggcaaacaaaaacaagacaggattgcagttttggtatttgacaaggtggagtttatgccaacattgttggtaagtatcatgatcgaaagatgaaataaatacattctttcatttttaacaataattatttatattattattatttttttttttgagacagagtctcgctcttttacccaggctgaagtgcagcggcgcaatctcggctcactgcaacttccacctcatgggttcaagcgattctcctccctcagtctcccaagtagctgggactacaggtgtgtgccaccacacccagtcaacttttgtatttttggtagaggcagggtttcaccaggttggccagcctggtctcaaactcctgacctcaagtgatctacctgcctcaggctcccaaagtattgggattacaggcataagccactgcgcctgacctatattactatttatgtttgatggtaatagaaatatattctttcatatgaaaaatttggaagaactcaccatttatgtacctctactgaaaaattactttaaaatattaatcaactaatcaaaagattaatcaaacttaagaactaaggaaagttataaataaaaatgttggtaacattaaacataattaaatatatatatataaaatttcgcaacatgtgattacaaagtagaatgaagaagaaacttgctttggaagaagagttataagatttaaagtattcaattgcaaaaagctgggtctgtactgatagattgaatttaaaacacttgaaagtgagaaataggcaagaaaatactggtaaagaaagtaaaggcacaataaatttttctttggatacttctgcttccagccaaattagatttacttaaccctcttgcctaaaacaacccaaagaaaaatggacagaatatttaaaacagtattcaaaacactggatatcaggcaaagaacaatgattattccaagatgaaaaacaaagcaggtgagtttttaatcattgcccagtttactgccttgagagaatttctaagccctggtgcagggaagggcaactgaaatgtagtccaatgaattccttgagttgagcagacagagctgagtccagagaccaagggagcttgagctcttaggacagaggaccagagaagagaaagctgcacagaatgagaatcctggaaatctgcagaggatccccttagagcagaggtcccccaacaaagactgtggaccggtacccatctgtggcctattaggaactggacctcacagcaggaggtgagcggtgggctagcaagctttactgcctgagttctgccttctgtcagattagtggcagcactaaatcctcataggagtgcgaatcctactgtgaactgcgcatgcgagggatctacggtgtatgcttcttatgagaatctaactaatgccttatgatctgagtttcatcctgaaactatcccccgaccaaccctggtcggtggaaaaattgtctctcacaaaaccagtccctggtgccagagagtttggggaccattgtcttagaaaaagatgcctgtgagtgaactactcacaacacgggaaagaactacctgtaaggattaaggggaagactgctcagcattcacacagagttgggaacagtacccgttcccatcagccagccttgaaaaactcacaggctgctgtgagaaggtttgactagagaggatttgactcagcagtggagtataattagctgtagactgagcactgctctgcagttgcctaataaatcctaaaagcaatgctcaaaacgatcaaactgtttccaaataacttaactgcatctcagaacaaagccagaagctttatttttatttatttatttatttattttgaggcagggtctcagtctgttgctcaggttggagtgcagtggtgcaatctcggatcactgcaacctctgcctcccgggttcaagcgattctcctgcctcagcctccctagtagctgggatcacaggcgcccgccaccatgctcagctaatttttatatttttattagagacggggtttcaccatgttggccaggatagtcttgaactcttgacctcaggtgatccacccgccttggcctcccaaagtgctgggattacaggtgtgagccaccacaccctgcctagctagaagctttacaagaatacaaaaatatccagcactcaacagggtaaaatgtacaatgcttggcattgaatcaaagaccaaaagggatagaaatatgaccggtataatgaggagaataatcaatcacaaccaactgagaagtgatatagatgttggaattagcaggggacattaaaatatttattataactgtattctatatgttcaggaagttaagtagttacagggaggatattaaaaagacccaagtggagcttcaagaagtgaaagctacaatgtgtgagatgaaaaatacattgcatgaaattgatgaaagatcagacattgagaaaaaaatcaaaaaccttaaaggcttagaaatagaaactgcccaaaatgaaataaagagaaaacagaattttttttaaataaaaagagcattagtaaactgggggacaactttaagtgtccaagtgaaaagcatgaatatgtacattgttgccagattaatttacaggcttaatctcactcagtataatttttgagaagcttttcttttaatttaacaaaataattctagagttcaccaagaaaaattaaaaagtgagagttgtcaagaaaattttataaagacaatataatgaaggacaggccgataaccatttctaccagatatttaaatatactcgaaaaagacaatgattaatagtcagatgccagcatgagaacagataagtcagtgggctaaaacagggggccccaagacagagcacagtactcataagaacttaaaacctaaaatagtgccataagtcagtgaaaagagaaatattattcaataattagtctgagttctcttgttagtatgtggaatgaagtatcattttatgtgttttttttttttcttgaagtatccattttagatcagaggttaacatttagctcatggaccatcatgctttatttggcttcatggcatctgtaaaattgaggtgaaaagatttgtttttcctttaactttcttcttgaaatgatattgatagtgggggaaaagtctttataatgacatactaagtttttaagatattttaatattcagttgtcaccactgtcatgttatgacatcttaaagtgtttcccattgatgataaaaaagaaattcctatcattatgatcaggagattgctttttttttttcctgaaacaggatcttgctctgttgcccaggctggagtgcagtggcatgatcacaactcactgtagcctcaagctcctgggctcaagtgaacctcctgcctcagcctcctgagtagctgggactacaggtgtgtgccaacacacccagctaatttttgtattttttgtagagacagggtttcgctatgttgcccaggctggtctcgaactcctgggctcaagcaatcctccctcctcggcctcccatagtgctgggattataggcgtgagccaccacgcctagtctgcttatgttttacattgtttaattaaatataaaataattaaaaagaaacttgcaaggttttaatcctttggttttcctttttgtcaatcaaccttatgaaatgtcttcaaacaacctataggctgattattgagctgaaaagcagaaaaactacacagaattggaaagagcttagagaagtcatgtcccctagaaatggcaaacatagtctgtggcttgcaacaaagaaaaactgaagcagtcgaaggagctcctattgtaaataatgtcacccactccagaactactatttcttctaacattttaatattttgaagcagtcctaagagaaatttgtaactatacagctaataaaacttctgatgctctcagcacagacaactgtttttcatccgttactggcattcctatttcacgagcctcttcaaattttcaaaaactaccatcatctcgaaagtggtatttccatttctggaaaaaagtttcagacctctgggcacagatcgggtgtctctgacatttggctgtccatttgtttttgctgctttggaaaagacacaacagacgtcaatgtgactgggcgatttctgtatcagcaggcaggggtgccaaatgttctgccaccgattccgaacttgcctaatgctgtgagaagcaccaacttcattaggctcgaggctgaattattatttcaggaatttttctcaagcaatgggaacagaatgagagcggttttttgctttctaaatagaaatttgctgaatttccagaaaacaagtcttgaaatgtatgatcaaactttgggcagaaattttacttttaaataaaaaaaaaaaagaaagcccattatctcatgatttagcctacttggacaataattttggccatatcttttggttaaagccccgcagtcaccactatgtacggtactgaagaacgtgcccctgttccataagagattggccgctaggagaacgtgctaacaccgaagaaagatctgcaatttggagctaagagtgattagacttttcccaatttctctgcagtcagaagcaaacatgagccaaattcttaaaggttacttctgatcaacataatcttaaggttgaaatgtgcatttgtaatccaaaatttagctatatggacaaacatcaatgatgtgaactttgccaaagataataacctcagtaaatttgggactcaaaatgaattcaactatttttcgattcaatcccaccctcacctggcaaagtgtcctataaagctttgattccacatgctattatgtccttatgcaagccagggtttacaacatttttgccaccaaaacaaaacaaaagaaaaatcaaaaatgattggatatcaagcatgccacaaatgttgccatctcaaagtcactcaaagctttctcctactccaagccaaaccgctacagcctttatattgaaagttgatgataaactgaattaaagttcaagatttgctttgcttggaaatctttgttttatttttaccatgaagtgggcattaagttttgcattaaaataagcaaaaggggcataggcttgtaaagaatgttttagaaaagaatgtgtaatcaatttctaatatcacaaaataggtaatatctagatttttgtgcctatgtttaggtacttttttcctgtaagttcatagttttcatcggtcttaaagaggcctacaatcttaaaaaactgcaaaaaacattactcctctgatttagacactgacctcacataacacgcacaccatcttgcaacaatttaagaattatggctgagcacaatggctcacacctgtaattccagcgctttgggaggccaaggcaggtggatcacttgaggccaggagttcaagactggttggaccaacatggcaaaacccaggctctactaaaaatacaaaaattagctgggtatgttgatgcatacctgtaattccaactactcgggaagctgagacatgagaaccgcttgaacccaggaggcagagatcgcagtgagccaagatcatatcactgcactccagtctgggtgacagagcaagactctgtcttaaaaagaaaaaaaaagaaaaaagaaatacatggaagaaactcaaaccacaacacctagaagaaaatagatatttagcacatttgaagctgagaaaaatatttctgaacaaaaaagcaagagaaaaacatttcattgacaaataaacatgggaaagacatccatgtagaagacataaacaaaataaaaagacaaaaaaaaaggaaaaatatttgcaagaaatacaacaatccaaaaacctgacataaagaagcaaacaaatccacaaaaaacacctacttttcagtaaaataagtggaaaagcacatggaatgaatactttcaaagacaaaatacaaatggaatataaaaagttaaatattaatctccataataataaaaaatcaagttaatacaagactattttgtctataacattagcaaaggttttttaaaaagcttgataaggaaaagctatgaggaagatgagcactttctacacctgtacaagagtacattgatacagcctttttagaaagcagtttggtaatgtttatcaaatgcttttaaaatcatgtaggggccacccttggccctccgcaagttcactgaaaaatcagttcacaaaaggtgaattaacaggagaaaaggcatacaaatgtatttaatgtgtatacatgggagcctttagaatgaagacccaaagatatagaggaaatcgttcatttttatgtataggtttaacaaagtatggacagccatatagaaacatgattggataaaagggtatgctctaatgctaatagcctgagtggggaaacccagcaaggtctgtctctctggattcttctcggcctctctgggcatgcattccttccttctggatgtggggttggacccgctctggaatgggaatgttatgacctacagttaaaacaagttaggccagataacttttttatggccactttttacacaaatagggcagagggaaaattagaataatatttctaggttttatgattagccctggggagaaggggttctggtttctatgacctgccctggggaagaaggattctggtttccatggcttgcctcaggaaaaaatgagactgagagacaagagagcaggaggaggtcagagaaaaacttctgttgtagaggctgcttctggggcctccagtttggggtattgtttttcaagccccaacattggtcactttctttagctcaatgatttaatttcaaatcatttatatctaagggaaaaagtccaaaatgtagacaaacagttcatgtagaaagagctcatttcagagctaatgttttaaaaaactaaaaaagaaagtcaagggaatgggtaagtatatcaaggtatatccatgcgattgaatgtgcagtgactgaaatagtgtttgcagtaagtttcttggatgacacaatcaaaaaccaatggtctgttaaataaggaaaaaagatgtagtaaaaaaatgctgaaaagaaaaattctaaggaaatatgacaaaatgtttatagtagttgtttctaggtaagatttgagtgattttttttttttttttttttttttttgagacggagtcttactctgtcgccgaggctggagtgcagtggcaccgtgttggctcactgcaacctccatctcctgggttcaagcaattctcctgcctcagcctcctgagtagctggaattacaggtgcccaccaccacacccggctagtttttatatttttagtagagacggggtttcaccatgttggccaggctggtcttgaactcctgacctcaggtggtccacccacctcagtctcccaaagtgctgggattacaggcatgagccaccacgcccagccaattatttttattttttgtagtttgcaaattatctacaatgacatatagtactcacgcttggggaaattaaatttaaatttaacatatcaagtttagatcatggatagaggcagaaatgtttcaaagaaaaagaaaaaaaagtcatcgcatatgaatgagcacataatgagcacaaagcttcaaaatttctggtgagagaaaaggttttactgctttgcttctcagcttagctgttcagtggcattactttttctgtgacttggatgctgtagagtgttcttgaaatgacaaatcataaactgatcactgtctccaaactgacaaatcaacttttcaggcaagaataagagggaacaatttgaggctagtgaggattttaaaataatatgaaaataatatgactcataagaaccaaaataatgtttagaaatggtgaagaaatggctacccaatactataaatgttgctgcttgaaaagtgatctttaaaatttaataaattctcgaaggaaaacatggaactttgagttgcaaaataattgaaagaaggttataaagctaattaaatcagattttcccttgggtttgtaagagatgaggaccttccctagtctcacccttctgggtgaggcccattagagaggaacccatagactccacgttgtgagaggttgagcggcctggctgaacacttcttctatccattcctgaactcacaggactttaaactttaatgtttaaacttgaatagctatcaaacttcctttgtaaaaactaatcttaggctgctgaaccctactattttttaacattaattattaattacagaaaaattgataatataaaaagataagaaataatctatatattttgcaactggaaattggtcaaagtatggtatttccagagtgttgaatactatgattatgttcagcagggactataaacttaaatgcctacagagactaagtaggtaacctaaatgagtgcagtggatctgtattggaacttgggaacaatagagattgaagatttgaagggtggatacttcatctacagaaggcagcagctatttgattctagtcagttgttggccttctggaaatgtgggtgcagtgctgtcagaccttcctatttttaaaacacttttatttggaaataatttcaaatttacaaaaagttgcaaaaataagacataacaaaagaatacttatgcaccttacctatattcttttatttaattttgcagtccatttgaattctctctgtgcacatgtacatacatacacacacacacacacacacaatttttttctgaaccatttgagggtatgttaaatatatcatggctttttgctcctaaatactccattgtgtatttcctataactagagacctgaaacctgctattcttgagctgggatacctggagtgggatgaagagatggcctgaggaagtcctctccccctggccactaagggacagtcaatcagctgctaaccccaaacagagctgtaacaccaaacagaggttgaaaaccattgcactaggtcattccacccgtaaaaataatacctccaatatatgcatatttatttataaattagatttatgtacaagtctactaatatattatgtgtcttaaaaaacatatactttaaaaaggatgagatgaaattagatattaatacaaatacaagattgaaattttcttcctgtactccaagggaacatcttgcaacctctaaggcatgtgcctcccaaccttgggggctattgctctacactgtgggggttaaacaggaaaaagaccatcacgatttccaaatctgagtctgggtcctgttccctgatgtatcttcttcacatcagccagctctatctatcacaacatacttttttgccttcctggcacttatcacaactggcagtcatcttgctcatctgtgtgttcatttgtccaacatctttctcccccaactagaatacagcttcctgagaggcaggatcttgactgacttgttcattcctaatttctcagcatctagaagaaggtatggcacatagtaggtgcttgttagatacttgctaataaatggaaataaacatatccctagttcctattccagctttttccctgctgttttgtcctccattcttccagcagacaacaggactagttccctgaccccctgcaggaagctaacaataccctagcctacttctaagcaaaacgtcgcagcttcaaagaccttccatggagggcgatgggctgaggacaatcttgttcttcacgtaaaacacaggcccacaatctcaaatttataatttaaaaatatatatacttacaatgtctctaaaggcacttatttttcttaaaaatcatgtatttgtaagctgaactatcattttaacacaaaagctatcattcttgctcaatggagtcaggctgctcttggagtttctgtcctgggaggaaaaagggcagggtgtaggtacctgatggttttccacacgtcgaagccatccagaggctttgtgccattggtgtgtcccctggccagcttcacgagtgttggcagccagtcagagatgtggatgagctcccggttcttcacgcccttctgcttcagcaaggggcttgccacaaagcccacccctcggacgcctccttcccacaggctccattttcttcctcgaaggggccagttattaccccctgccaaagtctgccctccgttatctgaaacacagtaaggtcttggcatgaggatgatgttaactcttaaatacatttaagaacagagactgtatgtacattgttactaaatggtgcttaaataataaaaaaaaagaaaattccttgccttttcccaccctaaattcccttttcccattgacatagcctttcattattcagacataagtaaggcccagtgtgatacatatctacctttaaatcctccatggagagagccactggaaaacaaggcagtccctcgatgatatgcgctttggagatccctaagctaaacaatccactaaactttaaatacacctgtgtaactttgtatagcatgggagaatgagtccatggaagctgggaccctctccatgcatgaagagaaaactaagggaatttcacttagtgacttaatgctccttataggtggagacaaaaactgacctttttcttttcctcttggaaaaaaaattctacaatttaaactggaaaatgaattaacactctacactctggcaataatatctctttcttaagtgtgaaagctgagtatttctccagtggttgataaatgtctctgtaaacagaacattagatggaaaaatataattgtgaaaaaaatttttcccctcttgacaggatggtgaaataaagtttcattatgcacaataccagggaagagaaggtttctcttccaagacaacagaaggaatgggagatcttggcaaagacagggtagaagctactagagtaactgaagttaagtatcttcccagccaaatgagggctcagagttaagacattaaagtgggcagtagaaaagaaaaagtgccatttcttacatactggggttatagaatcatacaaactcccaaagtatccacagatttaggtgactttagagacacattttaaataacacatattttgcattaaactttaaaaaaaaaacccactattacccaaatgagccacatgagggcagtatgacagaccacctgctgtatagaatgttacatataaaaatttattaagaaatcagagatctatcaaagctacaagatgcatctgggaggaaagagaatgaacacttgttaagcactgactgcactaggagtgactctgattttgcattatctctcacagaatctggggttggcagacctggaatagaagcctgaggccagacactcactagctgtgtggccaggggtgatataccacctcagtttcctcgtcttcatgtggaaataacaatcactaattgatttagtccattttgtgttgctataacagaatactgagactaggtaatttataaagaaaacaggtttatttggctcacaattctgatgactgataagtccaagcgctaggcactggcatcagttgctggtgagggcttttgtgctgcatcataacatggcagagaagtggaaggagaggcaggtgcaggtaaagagggaccaaagagcaggaagagcctcactttataacaacccactctcatggcgactaatccattcccttgagattgagaactcgatcctgggagacagcattgatctattcatgaggaacccgcccccatgacccaaacacttcctactgggccccacctcccaagatgcagtggcaattagacttccacatgagctttggtggaaacaaaccacatccaaaccatagcactacttcatgtattatgatggaaatgaagtgacattgcttatgatcttttcttggcagggtacctgacacaacctaagtgctcaatacatggtagtaactgctgttgttcttaaaatttacaacaacccaaatagtttagtattataaccattttgtcacgttttttaaaaggaagtttgaaaaagccaaacagtgaatagatggcaatgctaggattccaacaaggtctgtgtgacaccccaggcctctgcccctagagcaccacactcctgctatccctagtatagagtgggctcacacatgtaggccacataaactttcacttcctgatgaaaaccacaagtacggtcaacctcagcaaagtgtacactcttcctatgagtgtacataggaagttatttcaaggtaatggtaattccttttagagaaggcttagctgctgttggggaagaaattcaaggctctactgccaaggaaacttttggtggcgcccttaacacaccagttctcagttcttttctgtgcttctcgaaagggagtagagaagagtcttgagttagatcaggtgaggaaacaattcttcaacacatgggtcggtgacagacaatctcatcatttgacatcacagacttacaagaatctttcttcaaacctccccacatcacttcttgacaaaaactcaaggcccaaacattcactcaggccagttgttgaaatacacattccatttcatattgaagctgagcagacccgtatattcaaaacaacaaaaggtcaccatcagtagaaagaagaaattcctccatgttcatgatactgcacagagtagcaatcactcataaccaatgtatcgaaacttagaagaaggtgctattcatgtgatacaaaaatacactggaaagaaatacctacactcttcccgtgatatcaagaaaggctgagacagaacgattatttcactctgttgtctggattgctgtaagtgatgctggctcaatactttagaagaagcctgttgtctctgttttaaatagatacacttctctgaggtattatgtagtgtccttcagttgcacatatttgttagtgctcaacggaaagtattggatgaagatggtggtggaaataagagtggagatgatggggacaagggtggctggatctggaatctgattctaggagcagctcttcagttatgactcagataggaaaattctccgggttgtacagagaatttggccacttttgctactgtaggaaagggaaggtgtttccacatatcattaggggaggccacggatgtagtaagtgtgactgtttttgcaattagttctctgtgatgttttgccattagcaataagcgattctatcaacagttattctttttaagagcactccaaagagaaagcactgtcaatggacacatgtgcaacttctccaaggctctcctggcatagcgccaactgcagatgtggcctcagcagaagggcagttcagcttcgcctgtccttgtacccccacagatggcacctggccgatggttgccacttatcagcaatggggcagaatccactgagttaggacattagttggttaactatatgagaaatagggtgcggtccataagttctagttcagtctcctgggtatttcaaagaattcaacataaaactggtaggagtagcaacaagaataaaataagctcttttgcaacaaggtggaaaagggagtttcctatattgctcactgaagtttgacataaattagaatttaaaaagacaatggaaccatcagcatttcaaagacgtttcttctcattttcccttctagttttatttttcggcaaaagttaatttctttcttgttaagaattcatattcaagagaaatttttgtttcatttcctgactgacatatgaaaaaaattccaaatcaaaataagatgacgccagctcctaaaagaagcaaagaaacgttttttcagggagatggttttgcagcaatgttttggcacagggaaaatctaattataaggcctttactgtctagaaaagaaatgtcaaagtaagacaaacattatcatatacagaccgtaaatctcactttattattcactattgaacaaaaataactgtcaaaaagtcatggaaaaatattggtttgccaaagatctaagcaaaaacattaagtatatgacaatgaagcctcatccatatccagctgataaaaatcaaaatgaaaccatgacaacagcattaatttttagaactactccccaaacaatttaatgtgtggcttggccgtggagggctgccctgaaacatcatctctaccccaacatccctgtgcatgcttcagctggggcttaccctagtcatccttcccaacctgactcaaagatcacaaaaggaaaagcaaggaaggctctagcagcctcataccaagcctggacatctctttgaacacggccctgatgcaagggtgactaacagatgagtaggcaacatcgtttcaaaaatggagaagcctctttgtcccagaaaagtatctgcttgttgatggttgattctttggatttttttttaaattactgagaggcaaactggagtgctaatatatgtcttagtacacatctaaaggattcggtaaattcaatcttctcctgctaaaagattttggagacattatctacctagatattcaaattacattctgatattctcaaatcttatctttttttttttttttttgagacaaagtctcactcctccaaccaggatggagtgcagtggcaggatcacagctcactgcagcctcgatctcctgggctcaatcaatcctcccacttcagcctcccaagtagctgggactacaagtgtgtgccaccacgcttggctactctttccctgttgcactacattgaatcatttctgacagaatgtgcatttgattctgccaagtctacctttaaaacagctttccaatcatccccccttctgcagcccattgctttaggtcaggcactcctctgtctgggctcctgggctaatttatataccgcttcaagttcccaccagaggtgtttgtaaaacccaaaatcaatcaggccacatgcatgtttaaagacctgattgctttccaatcagggaaaaagttccaacttcaggcccacatatagaatccttcatatctgcccccaacctcctttttgggtatcaactcctgtcctcccccataaaaagtgccctgagcttcagtcacgtagaactaacttctccctgttgttagaatatgtcatgccctttcatgctaattttgcctttgcacatgttggctcccttgcctaaagtgccacgggttaaagatcatatcttctgtgaacctgccacttagtgccctagatggtcttcatctctgctctgtatttctgctacattttatgtgcacattttctactatacttagctctgtctattgttaatcagttgttcatggctttgtcttccccatgaactctgcttctcaagagcaaaaagtttcttaatgtttttatttccaagacctagcacaggacctaccacacagaagggctcaatgatttggaggaacaaataattagggaaaaggccactcaccgaaaatagaggttaaaggcactaaacattaacttaggtcactgcattgttttttctaagcctttgtccagctactctgtgaccttgacttttcattggctattctacatactgctgcttaaactataggagctggcaaggggtgctcttggaccccagtgagaatttaagtaaatcaaaccctcaaatatcagaattgtttgtctaatctggtccctggtcagttatgttggagtctaagagggttgattgggagcatttcaagaagcatcagtcttggcctggaagaaagaactcacttattcctttaacacatctttcttgagtgctgccatgttccagggaccactccagatctggaaaaagggcagcaaacaggatggacaaggtcctgtccctcacggagtgagtgagaaaaagagataagatctctccattcatgggaggcaatgactgggctttgtggaggagctgaaaccataaggacaggacagagccagccaagtgaccaccagagagatgagagcccaggcacagggagcaggaggccttatgcaatcgcacattagagactagggtgtctgtgtcaaggctgcttcttaattaaagactagttatactattaggtatactctgctgccagaagttaaggaaaacttgagctaaatgatgactaggtataaacaaaaaggtataggtctaggtgttttatgaccatcatcactttcccctatcacccctactgccccatgtctaatttcactgaaatgcagggaactgagaggagctaagcactgtgggtttgggcaagtactcaatctctgagcctaagtttccttatttgagaaatgaggataacaaaatacccaccttaatattgtgcctggcatagaagcagtgctaaataatattagctatttttatgtatgctagtcatcagcaccagcaaagtacacagaacagaataggctcctatctggatatttactaaacatatattagatttaagtatcatagccacactccaaaacatcacgttttcataagaccaaagtattctaagcatagagtcctcctagattgcattctctattctttttttttttttttttttttttttgagacagtgtctcactctgtctcccaggctggagtacagtggtgcaatcttggctcactgcaacctccgcctccagggttcaagcgattctcatgcctcaacttcctgagtagctgggtctacaggtgcccaccaccatgcccagctaatttttgcatttttagtgaagacagggtttcgccttgtcggccaggctggtcttgaactccagacctcaggtgattcatccacctcggcttcccatagtgctgggattacaggcagaagccaccacgcccagcctgcattctctattctataggtaatttcttgagaagtgcaacaacacagtgaattgtgaggggggttgttactatcaggggagagccaggataactcctttctgttcccatgagtttaaataaaggacatcaattatcatagaaaaaaacactataacaatagcctgggattcaaattaaacaccagaaactgaagatttgttcaaatacacatttgattattcgtaggggtttaaaatggtttgcagcattcagggcagataagtgctctgaccaccagctcagacactaaccagactttacatcttgactaagagcaccagcaaggagaatgtccagctgggctagcaagaggagggttctggtggagtgcgactggcagccaggcaccaaataaccgattgatacggtttggctgtgtccctacccaaatctcatcttgaattgtagctcccataattcccatgtgttgtaggggagacccagtgggagataattgaatcacaggggcagattcccccatactgttctcgtggtagtgaacaagcttcacgagagctgatgattttaaaaggggtttcccctttcacctggctctcattttgcttttgcctgctgccatgtaagatgtgcctttgttcttccctcaccttccaccgtgattgtgaggtctcccaagccacatggaactgtgagtccattaaacctttttctttataaattacccagtcttgggtatgtctttatcagcagtgtgaaaatggactaatacacggatgtagccaccaaaagatgtggagatttaaaaaagatgcatgcagggaaagggcaaaatcagggatgaatgaggattaaaaagaaaaatgttataaaagtttgtagtaaaatatttcctcactttaatgaggctaatgccattgcttataatgctgagatatcaatggggttttatctctcctttaacatttattaaggatgaaaagactccaaagtctgttgaaagattgaaaacgtttattctctacaagttaaaatggaactggaaactggaaaacagtgtcctaatttattacatattggcaagcaacaacttaactttttcctgtaatttaaaacataagtattcacagatcttggagatctttagatgaaagttgtaaggtaagcacaaaatgttgaggtgctctcacttaggaggtatgggtaatgcaaggtttgatcttcatattcagaatccccctgacaagtagcacagaagacccatgtttgatgtattaagcgagtaaaagtaccaaatatttggtctgtcctttttaacaactaaaaccctgtttgtttttcctattgtttaatttttaggaatgtttgatattttttactaatggatttccaggcaaactaatttttttggcactcttagggagtgttacagtttactcacacattatttggctcccctttcagacctaaaacccactgaacgtggccagataattttgactagacagctgtttatccttcagtaatgccactagagaagtaatgaatgagaaaagtaccacacaagtgctggagagtctggcaagttcaagggcagcaggagaaaagtgaaaataccatcaacacacaggaacaaacagaattgtggtttcaaaagaacaggtgtactaacaacttgcgtggtgagaaagatggaaatttatgtcaatgtgttttcagagatggttaagccagagaaagctagcacattctatctgggcagacatcaactatttcaatttgtctttatgattccaagtatataatacaagttaaatgttctcaatttttatccttggaacagaaacaacattttactgaatctctacttcttaagtagtaagatatgcctttaaggttactcagaaaaatcaatgaaactgagtggacaggcagtttcatttcctcagagttctctgaagttttgccagattctaaaggatctcactgatgtttgggtgtttaatgcagagagaggcaaacaaaagtcacgagaacactgatgagcacaatcctccctgaagaataaccggagagtaaaacatttaatggcagaaacaaaaataactcaatatatccaaacatgaagcagtttgtttaaagcatttcaaatattgaatgcatacttaatcaataataacaagaacctcttcggatctgcagataacacttgctccaaggccaaagtgaaataaactctgtgagcccccagagtcctgggcagcagccccacctctgaccagggcatgcacagtgggagtgagggcagaatccaggtgattgacactggacatcccaagcaggtgaggaggccactcaggaggaaagaacatggaaggcagcctggagctccatgcctaatgagaggcaaatggctaacaggaggccttgcagcaggagacaaagggatgaacagccaagggccaggataaaaaaccaaaccaaccaaccaaacaaacaaacaaacaaatcaaaacaaatgcccctgagttaccacaataggcaccacgaagtccatgcaattagagactaactcaggacctattcagtctcagacgcaattctagcaatatgtgcggtgtctggtgtcctaattttatagcaggctagaatctgcaagtcaggaagatgcatactgctggacataatctttgtagaaggaggaaaggagaagaaaagtataaattgtaaaagtagaccacaaactaaagtgtctttacctgtttttccaacattaaatgatccacactgacgtatattgaagacaccactgaaagatgcatactacaataaaaaaattaaaatgatgaccctacatcattaagatagtgagagactcatggcatagttaaggatggtttagacctagcaaaaaggtttatatcccatattcctgtcattaatcctatttatctacagcaatacaatgtgcctgccttcttcacctgataccttgcaaaggtcacaacgataagcacatgaaaactttcactatcctggcataaagttaggcatatagactgaaaagagagaaaattattacaggctaagcagtatgcctcatgtgccctgcatctccactggaatgatgtttccaaatattaagtaacagcttttctcattcctagtaattttgtcaccctgtgaccctcaacccaggaagcaggcagggagatccatgtctgggctccggaaatggatagtcagcaggtggatgagctaatagatttagcttaagcaatcactcagagccaggggaagagagaggactggaaacgaagctaaaggacatggctgtgaccttaagcacacatcttgggctctgcccccaggactggatctagtgtagaagaaataatggacggagggatacaagagtggaaagaaccatgcctcatcccctggaggagccggggggcagatgagaggatagcaagactccctgcggttcttgtgcccagtatagtgtggcagcagcagatgacaatggttgcacaaggtgatggaaggcaggctcagaggcttctcacaccacagtgtggaaggggttgcagctgaactgatgaatgtttttgatttggtgttgagaagagcacaaatgtggcacagagatggtccaaagagtctccgcaggcaaggaggtcgcagcatgatctagatggatgatataaaaaggccagccaggaacaggaatgtttctgcagaggcttgtgcaaggatgactatggaccacacacttccttcagctccaacgcactggctccctggaggggagccaggatgagatcatgaattaactgagatgatctgaattgactggaaccaggtttcctccacccagcagaatagggaccccagaggtactgcgttcagtgacagggtaaaaaagaagtaagttatattctttgcagatctaagtttgtgcactgaaatttgtgattactatgcatatgtgtgagcactatggctggatgtcctagacttgatggatataataattgtgttaggctattttgtaggcgaaatagaagttaaatccatttttattgttttggttattttgaagcagtaatatggactcattccaagactttacatttttatgtaatagcaactataatgataggaaaagtactgaaatcagaagaaagtttgtttctataacatgcctctcaggcttttcaaatctaacatccccacccttttcataacaaatattttgtgatgctcctttgtcctgaaatggaatttatatacaatactgtaactatatgtctaattaaaaaaaataactctcagtgtaatacagagtagaaaaaggcaattaataataaaatagcatgtatttcataggaaaatgcgcaggttcaaccctaaaagacatagcaaagtggttagatgagtgcatacagttatagacgaaataaatttggacttaaggccattctatagtagaaatacaaaaaaaaagagagagcagggataaatgctaaaataaagattagaatattaattatatattaaaaccacgcaaaaaatactttgtgtttatgtgtaaaacatagagactagacttaggttctagtctcagaaaattgtaaacaagcttttaatcttcatgactaaccagcaggatattttgtaagttgtacaggacttgggacaattcctcactgtgtggggttattacgggcattgcatcctgagccccctactcactaactatcagtaacactcaagtgaatttctaaaatactctcagtaaaaaccactgccctatacaatggcaggattgggacatatggccagagataggtagtgacctctctttcaagaggcttcacaggttagcactcattaccttgtgaatttaacacagtttggggtctggcctaaacctctgtaagcttataaataattctaacagcatatggaaagaggttccactttttagaagcagaatcactgtaaatgatatatatataatcacaaagtcaattaattgatttacaaagtaaatttatcacagtgactggcatgtttatggcccatgggagtggcataaatgtatgggaaatcaagttataatcagatctcctggtaagtaaggactcagatataatatttgtatttttgtaatatgtggactctcataataattatttttcagatctaaaatatattctataaatataaaatatttatatttactatattcaaaaatgcactaaaagctgctttaatgagaaaattcaccaatttttaaatatttttttctagcaactaagacttcaaaaatgattaatctaagttcattcaggaaaaaatagataacgtacatgccctatacccattaaagacattgaaattagtaattaaaaacctccccacaggccgggtgcggtggctgacgcctgtaatcccagcactttgggaggctgaggtggatggatcacatgaggccaggagttcgagaccagcctggccaacatggagaaaccccggctctactaaaaatacaaaaattagccaggtgtggtggcaggcacctataatccaagctactcaggaggcggaggcaggagaatcgcttgaacccgggaggcaaaggttgcagtgccgagactgtgccactgcactccagcctgggcgacagagtgaggctctgtctcaaaacaaaacaaaacaaaaccttctcaccaagaaaatttcaggcccaaatgccttcattggcaaattctaccaaacatttaagaaaggaataatactagttctatacaaactctttcaaaaaatagataggaatcctgtacttcccaacttattctatgaggccagcattactctgacaccaaaatgaaacaaagacattacagaaaaagaaaaccacaatgaacacaggtgtaaaaatctttaacaatatttaggaaatcaaatttagctttatataaaaaaacatacattagttttctattaccacacacttagcagcttaaacaatacacacttattattgtacagttctgcaggctgtacaatacattcagctgctgaggcctgtacaagtctgatgcaggtctcactgggctaatgtcaaggtgttgagagggctgcattcccttctggaagttccatttccttgcctttctagcaaatccatttccttgcctttctagcttctagaggctgttttcactccttggctcatgtcttttgagcttcatagtagagttatgagtggattgcataccagcaatacagtaagagagtattctgagtttgtccaggtacttaattttacctgtaggttttatactttgaaaagttttcttttgcacattagcgttttttctttcagactgaagaactgcctttagtatttcttgcaagatggatctagtggtggtgaattctctcagcttttgtttgtctgggaaagattttatctctcctttatatttgaatgataattttgctggatacaatattcttggatggcaggctttttttgtctctctttgagcaatctgaaaatgccattccactccctcctggcctgtttagtttccttagagtaatccgttgccacatgaattagagctactttacgtgttatttgcttcttttctctgctgcttttaggatcctctctttgtccttgacctttgagagtttcatttttctatgccttggagtagtcttatttgggtcaaatctgtttggtgttctctgacctttctgtagctggatatttctctttctcaagttttggaaagttttcagttcttatccttttgaatcaactttctaccccttgctctcgcttcactctctcttgaacaccaacagcagtaattcttagatttggtcttttgaggtaattttttacatattgtaggtggtctttgttacattttattcttatttcttttttcttctctgattgtgtattttcacacagctggtttttgagctcatagattctttcctctgcttggctcactctgctgctcagagcctcttaagagttcttcagtttggcaaatgtatttctcagttctaagatttctgtttgattttttaaaattatttcaatctctttgttagatttctctgataaatttctgcttttctgtattatcttggagatacctgagtttccttaaaactgctattttaaattattggtcagaagctaatagtcgccatctcgttagggtcagtcattggatttttgctttgtcctttggggagactgtggttccctgtttgctgttgttacttgcgggtatatgtctatgtctttgcattgaaggattaattattgattctagttttctctgtccagcttgttttgtctttcattgaatatatttgcttaatctttgcaactagattgctgcctccttttcggctctaggtggcgctataagcccaggttcactttggctctagtaaacggttgcagtgctgcctgtcccaaatgggggagtcaccaaagggattatcccaggtatgttctacaggctcctaggcaggaacccctagtcagcagtgtgggaagactggctaggggttcctgcccatgggaacctgtggaatgtacctcctacagtgtggtgctgctgaatagccactctgatttggtgtctcatttggctgagttacagagcagagtttccagggttggggatggtagtctcaccttctgacctttgttgcagcctgtcctcagagatatttctccctacaggcactcacaatgcttcccatgagttaaggcagggacaggactcctgctacggaacccaagaaggtgaggaagctggttgaccactcaatttcactttttccagtgtaaaaacagaattgagggagattttccacatgcttggtgctgaaagaatgtaggggaggggactcgcagacgtggaaatctgattctccaatcatatgctcaaggtttttccacttctctgtggccctgggggctgtctcatcctcatacttgaactctgggttgttgctggtgaaaatctcaatgctatatatttgtttttggtcttctattgagggattgaagctggcttgcttctatactaccattttgaaatcctgcattccttgattcatgccctcttccttcaccttcaaagtcagcaatgggcgggcgcagtagctcacgcctgtaatcccagcactttgggaggcctaaggaggcagatcacgaggtcaggagatcgagaccatcctggctaacacagtgaagcccgtctctactaaaaatacaaaaaaattagctgggcatggtagcgggcgcctgtagtgccagctacttgggaggctgaggcaggagaatggtgtgaacccgggacctgggaggcagagcttgcagtgagccgagatcgcgccactgccctccagcctggcgacagagcaagactccgtctcaggaaaaaaaaaaaaaaaaaaagtcatcaatgatggttgaatccttttcatatcatattacccgacctcctcttctgcctccctcttccacttttaaggtcaccgattgcactggtccaaccagataatccaggacaatctcctcatcttcaggtcagtttatcagaaaccttaatttggtctgcaatcttaattccccttgtcatataacataacatattcacaggttccaggctttagggcatgtttggaggcaggagggagacgggggattactctgcctaccacaaacatgatgataaagtgatatttatcccaagactgcaatcaattttcaaatagaagaacagagttagaagaattatactatccaatttcaagaactactataaagctacagtaatcaagatttcatggaactggaatggagtgcctagtaaaacaaccacatttaaatggtcatttgctttttagcaagggtgccaaaccaaccaatagggaaatagttttttcaaaaaaaaataatgctagagtattctgatatctacgttaaaaaaaacaaacaaaaccttgacaaaccctacttcataacacacataaaaattaaagatgaatcatattacaactcaataataaaagataaccaaattaaaatattgacacaggatttaaatagacatttctctaaagaagatacacaaaaatagatggtcaatagatacacaaaaagatgtcccacattagtcatccaagaggcacaaactaaaaccataagaagataccactttatacccaataggattactatataacaaaaaagacagacaattgacaagtggtggtaaggacgtggagaaactggaacactcataaattgctggtgggagtgtaacatgatgcagctgctttgaaaaacagtgtcttagtcttgttttctgttgctgtaacagaataccataggctggttaatttatatagaaaacaagtttatttagctcatggttctggaggctgggaagtctaagaacatggtgctggcaccaggtgagggccttcatgtggtgtcataacatgacagagggcatcatatgataagagggcaagagcaagagagactgagagaactcacttttataacaaagccactctcaatgtaatgaacccattcctgtgacagtgacattaatctattcatgatggcaaaaccctcattaatccattcatgaggacagaaggattcggtttccaacacatgaacttttgggagataccttcaaaccatggcaaagggtttagcagttcctcataaagttaaacatagatttaccacatgatccaccaattccacacctaggtatatacccaagagaagtaaaaatatatgtccacacaaaaattggtacctgaatggtcatagcagcattattcataatagcccaaaaaagtaggaacaacccaaatatccattaactgattaatggattttttaaaatgtatattttcagcaatgtatagcaataaaagggatattatgcatcagcaaaaagaaatgaaatactgatttatgctacaaaatggatgaacatctaaaacattatgccaaataaaagaagccagacacaaaaagccatatattgtatgattccatttttacgaaatgtctagcttagtaaaatccataaggacaaaacatagattatgtgattgacagagggaggaaagggagttgggagtaactgctaaggggtagagaatttcttgtatgtttaatttttaaaatgttctagaattagacaatggtgatgattgcacaactttgtgaatatactaaaaaccagtgaactgtatactttaaaaggatgaatttcatggtatatgaattatatctcaataaaaacaatactgtatgaggaaaaagaagatagatcaaagacctaaatgcaacagctaaaaccataaaacttttatagaaaaacagagaataggtcttagaataggtcaaaagtttcttaaaaccaacagttttgtttaatatatttatgtataaaaatagataagacccataatggtgtaccagggagcaaaatgatgatgtaacttcagagggggaataagcagtgggagaaagtacagctctggtcagctggggagatctcattgcaagtaagcacccatcctggatgttttgccatttggatgagaggtgcgttaaagaaaaaatcctacattcaggaaaagtcttcctagtgtcacaagaatgtaaaaaatctgcttcatttaaacagtccaagcctgcccactccatgtatatttcagaacacaagcagggatatatctcagcacaaaagatgtgattcctcgagacagcattctaaatacttccctaattatcaaaacccagagcttccaagacatgtcagattctttgttcttgttttcaccagtccatcaaatttgcttggcttcttttataaaacagtagacctcctctggagtcaatgtgcttctctttctcttacaggcccctacttttatactgcattttttcagcgaggccttttgtggtaagctgaccctacaaaacatctgcctggcatatgaaacacaaaattcttttttggaaagctttctgtatgtatcagagaccatttcattgtttattccatttttggcttcctgaaagtttatggaatcaaatggaaaatgacttcaaaatagataagagattacatgaatcttttctatacttcacatagtcatgaagatatattaaccatatcagatatgaaatcatgtgctggtgatttctttttaatttacatacagtaaaattcacttattttggtgtgcatcattatggattttaacaaatagagtcatataaataccaccacaatcaggatagaacattctatcactgtgatataactcctttgtaccacctctttgtagacaaattgtacacccagccttaacccctggcaaccactgatgcttctctgtcgttaaggttttgctttttccagaatgtcatataaaaaaatcatagtgtgtgtaatcttttcagtctggcttcctgcattcagcataatgcatttgtgattcatccatgctaatgtgtgtatcaacagttcattacactactgagtagtagtccactgcacagaagtaccacatctgtttatctatttgctagttgaaggacatttgggtttttcagtttttagtaattatcaataaagatgctataaatatatgggtattgttttttgtgtgaacatgctttcattcaatttcattcaatcccatgaatgagactgctgctttcaaggtatttttttttttcatctttagttttcagcagttccattatgatgctggtgtagttttctttgagtttatcctgtttggatttcactgagcttcttgaatttgtacatgtatcttgcaccaaatttgtgaagttttcacacattattcctttatatattttttctacactaatatttctgctctctttctggactctaatgacataaatgctagaccttttgatattattccataggtccctgcagcactgtttttcttccttttttctgtgtttcaggctgtataattttctttcttttctttctttcttttttttttttttttttttgagagagggtctcactctgttgcccaggctggaatgcagtggcgctatctcagctcactgcaacctctgccctcctgggttcaagcaattctcctgcctcagcctcctgagtagctgggacgacaggcgtgtgccaccacacctgactaatttttgtattttttggtagagatggggtttcatcatgttggccaggctggtcttgaactcctagccttaagcaatctgcccacctcagcctcccaaagtgctgggattacaggcacgagccaccacgaccagcccagactgtataatttctattgatctatcttgaagttcaccgactcttctttatcagctccattctgctattggacccatagagttaattttaaatttcagatattgtgtttttcagttctataattttcatttgttttgtttgttcatttgtttggctttagtttctatttcactgctatttttccattcatttcaagagtgttcaactttgtctcatggagaatggttacaatagctgcattaaagtttttgtctgacaacaccaatatttggatgatcatctcaaatgagctcatcacagctgaaataatctatttttagtcttttcccttgagtactgctcgtattttcctgtttttttttttttgtataatgagtaattttggactgtctattagacattttgaataccatgttctgagcctctaggtctagttaaaatcctctcgagggtgttgatgtttgtttggttaagcagagaatcaacctagtgagactcagaccacaagttttgtctcaccttctgtggacagtggctctaatgtcagtttagtttttaaagcctttgctatgaggtttgggtttgcccagcgcatgtgccactcaggggttaatctaggacctgggcagtggttcacatggcagttgagttttcgaagcctctgctttgctcctttgggcctgtgtggcatatatgcacttggaggtgagcctggggcttagctcatacacagaatcaggggatcctcttctccagttcttctctccctttagatccttcagatccacccccaacctccgctccaggggcccctttatgtggtttctctgatcagaaaaacaggtttctgttaggttgtagttccccattctgtcatgcacttctgcataactgaggttgcctttgggagcaaagtagcaaaaaaaaaaaaaaaaaaaaaaaaaaagaggaaaataacagagattatctcacactccggtcagaaatgtgggtcttcttttgagattttaggtgcctgcaccccaccacaacaccaatgcagatcttcaactggggcctgtcttggggtagagttaagaaagaaaagggaaagaaaaagaaaaaacagtctggacactgtggctcacaccagccaggcaacatagtgtgatccaatcgctaaccaaacataaaaaattaaaaaaaaaaaaaattagccaagtgtagtggtgcatgactgcagtcccagctatttgggaagctaaggcaggaggatcacttgagcccaggaggtagaggctgcagtgagctatggttacaccactgtactccagcctgggcaacagcgtgagactcaatctcaaaaaattaaaagaaaagaaaaaacaaataaaataggaattccccatattcttgagcaagagcccactttcctagacctctggttagaagtaggaggtttctcttggagatgttgctgccagtgcctgctgcatagttccataattccattggctcttaggtcaaagccaagagatagaggagagaaaataaacctccaaaactcaccacacaagggattcatgaagctttgactttattccccattctccattcacctgattttgttttcttctctgtccctattcttatcatccctgctgttatattaggttggtgcaaaagtaattgcagttttcgaaaacctcaattactttagcaccaacctaagtacttttaagaagcctcagatagttgctttcagtattatccagagtttttaatcaatgagaaagatatttgttgacttcctccatcctggtgagcacgggaaggtggtgcccatgattttaatgagaatgggctaagggaacttgtgatacttgtcttgattttttttaaaccttcatctgaattgatacaggagcatacttcatgtcaggtaagaataaaaaaggaaacaattatttgacacaccttaattaagcacctgctaggtgcccgctactctgggaaaaggcaacaggggttcaacacatggtccctgctttcgagggaggcaacatccacagaaagcatagcctatgtgaaaaaatacaagactgtacacaactaagggcaaaaaagatacagagaaaggaaacaaggtaaaaactggggaattagaggtgacacggaggccgttcaagcccccagctagaccttgatggagaagacaaggcactttccatcagagggcaaggggatggggcggggtgattattattccaaagttggctttgtacctttttattacacagtgagtttgttttcccaaaaggaaagaaagagactgtttctaagggcatttgatcactcctgaccctgttcttccctcgccttctctcaacgtggtggaaaagtgtttccaggactttggttcagagtgaggactggaggcccagccacactggagtgagtcatgagatctttcctggggagtcttgaattaccacatacaaaactctcagtaactgtcggaactcagctggttgctggttttgcttgcatgctttagctgcgttaaagcactcggtagtttatttttcatattttatttgggttaattcctaaaaatcacaaaggcagcgccttcatgctaggacagtatctattatattttttaaaattttgttaagtattcaggaaggctttgcgtggactgctcctgttagaagacaaccacaaagcgggggaggccacgggtagagcggttgcacagatggcaagtgtaagcaaatagcggccaagtccattgtgaagtttcacttgcagctgtgtggaaaatacctatgctggtgactcaatgtctttggatttctagctttaaattacagcagagaagactcattttcaagtgctgagcatatagggagactggcaaatgtgggccagttttgagcccatcagttaccatacactgcactacagaaggataattaaaagcagggggaagggggaagtcttgtggtaatcagggcatcaagcatggtacctggacagctggcatggcaaccaacctgacagcaatactgtgtctatttccaataatagaaatttagctcccttccagtgtagctgtatgctggggtcttgattttcttttctggaatgaggtgtgcgcagatgcaacgttattgctcacctggcccatcagagtcacgtataaatggtcaggccagtgactgtatcatacttgtgcctctcacagttttgtctgggaactctaccttgtgttgtaaaagaccttgtgtcctctgacccccctcccccgacttccactctcctcttggtctgccgctgggactgtattttgtcgcttatctaacacaaaataaacagaacaatctggagctaatttaagtggtttaccatatcaggatacagctgggaaagattttaagaaaaggctcaacaggaacaatagcgctgtgaagtggagcagcagcggagagcacaggaaggcagtttcaggcagcctggcagacagctgtcagccactccaataacaattcctgcagccaatgaaaacgggcaggctctgtgcgggcagcctggccggaacaccaacaatgaaaacaagggattagagagcattctcagttaatggcttgagtgtcagggccaccagtctcccgggagccagtgctcccaaccagcaaggactggagaggaactgcagatgaaacaacacttcatttctctacaacactggccaagacttttttttttttttttgacatgcatgcatccacgctggctttatcctgacttatgaatccagcaaggcccacagaggaacatctggttttgacattaatttcttctactctgcaggatggttgggtttttaactcattgggggcctttggctagaccttgaatttcctggtgcaacttgacagaggtgagagggcttgagggagttaaataaaactatgtgctgcccttgaaaggacttgcaaatgctttatatattaaacaaagaaactccacttggatcaagctcttgacaaagatccaaccaattaggtaaacggtatagtctcgaaaggcagtgacatttcatgcaaggaatactgaattggaagcatggagacttggactcttggtctacttctgtcactgcaaaaggtttctgggtcaaagtttcctcacttaggaccatgtgcccttatcctcttcttcatcatttcatttatgatattagcttatgctcacacatttttttttccagagagtacttgacttagtaaaaatttccctctaacaacagcaacttttgggtttattataaagtaattccacatgtttaagaataactttaaaaaataatctgtgtctgtgttcttaagttgtagggaaaagagagagagatcagaccattactgtctctatgtagaaagggaaagacataagaaactccattttgatctgtaccctgaacaattgctttgccctgagatgctgttaatctgtaactttgccccaaccttgagctcacagaaacatgtgttgtatggaatcaaggtttaagggatctagggctgtgtgggatgtgccttgttaacaaaatgtttacaggcagtatgtttggtaaaagtcatcgccattctccattctcgataaaccaggggcacaatgcactgcagaaagccacagggacctctgcccaggaaaactgggtattatccaaggtttctccccatgtgatagtctgaaatatggccttgtgggatgggaaagacctgaccatccccccagcccgagacccgtgaagggtctgtgctgaggaggattagcaaaagaggaaggcctcttgcagttgagatagaggaaggccactgtctcctgcctgcccctgggaactgaatgtctcggtataaaacccgattgtacatttgttcaattctgagataggagaaaagccgccctgtggcgggaggcgagacatgttggcagcaatgctgctctgctactctttactccactgagatgtttgggtggagagaagcataaatgtggcctacatgcacatccaggcatagtaccttcccttgaacttatttgtgacacagattcctttgctcacatgttttcttgctgaccttctccccactatcaccctgttctcctgccgcattcctcttgctgagatagtgaaaatagtaatcaataaatactgaggaaacccggggaccggtgccggtgcaggtcctctgtatgctaagcaccggtctcctgggcccgctgttctttctctatactttgtctctgtgtcttatttcttttctcagtctctcgtcccacccgatgagaaatacccacaggtgtggaggggctggcccccttcataaagtaagaagaatgtcatctgaaggtccaataaaaataaacaaatgaagaagtagaaattaatgttgtattagtcactgccccatctattgttacatcacatcataatacatcattgaaatagcattgattattaaagtttccatgataatagaatgtaagactaaattttcagtgtaaaaataagagagatatggataggtcttctaaaagcagaaaagaagatgaaaacttctaaaggataaaaagatgggtaggattgggaaatatcccctttagaaatagaacatctcttctatttctagaccaagtaagttcagacaacgattacttcaaaaatatctgagcacactaaaaaaatttttaaaaatccaactatctgaaaatataaaatctctctagaacagctctcaagcaatagtgtgtcgaatcacctagaagtcttgtgaaaacagactgctgggaaccatctccagagcttctggtccagaaaggggcctgagaatttgcctttctaacaagtttccaggtgatagtgatattgctgctcctgggaccatacttagagaactattgctccagaaagagatttaatggctaatacaataaagtcaagtgatcttactctgtatttttgttgttgttgttcttttaaatcaacaaaagtgattcaagtgtcaagtgtggttgaatggtgagaatgaaaaaataagcaaaaaacgaaggggtattgaatcagtgcagaatagtcagaagtcacacacagagaaaatggatgtattttacctttggtgaggagtaaattataaaaggactgtagctactttctgaaaggtaaaattgtcctgactcaaggatgaaaaggtatgtcaaaggggaatgttttataataatgagtccctgggtctagacctgataccagtggttctcatcctggctacattatagaattacttgggcacactttgggaggccaacgcagatggatcatctgaggtcaggagtttgagaccagcctggccaacatggtgaaaccccgtctctactaaaaatacaaaaattagccgggtgtggtggtgcacgcctgtaattccagctactcaggaggctgaggcactagaatcgcttgaaaccaggaggcggaggttgcagtgagctcagatcgcacaactgcactccagcctggggaacagagtgagactccctctaaaaaaaaaaaaaaaaaaaaaaaaaaaaaaaaaaaaaaagaataacttgggcaattagaaacttgaaagggggctttccgggtgatttccaagtacagagaagattatgaacctgcctacaaggtgttctactctgcagaaaagatgaagtgttgaatcacaaagagacgagagacacagctttctatggatggtgattttaattcccatgactggaccacagaatctcaatacaaagacaatgaggtcaagatagattaaatgatatgcaagaggctgtacagctagttaggggcaaatccactattaaacctcttttcctgaagcccatccaaatttctgtctaccatattatttgactgaatttgcaataataattttaaaaatagaaaaaaggtggtatttggggagaatctaaaatagagatctcagtacacaacagtaaggtcaattatcacattggagattccagtgttttcaatcaaaatatccactataagaaactaagaagtcaacacaggctttcatcaattctgaaactacctctaatgtaaacagagctttcactatctacaagccaagtggttccagtgaggttggttactgacgttattgtagtacacaaaagccatgggaaattgaagcataaggaaaaagagagaagatggcctacagtgatgttgtctggcaaccttaagagatcacaggcaggctcttctccagcaagctgtttctcatactccatcaacgatatcaacatattgcactgggagaggtttgccagaaggaaagtgaggtcatggagtgatttggtgaagcccacagctcgtctgtaactcagcctactttatgggactcaaagtgaattaaaactacattttaaaagctgtgtcttccacctggttctcctcactgtttttggctagcaggaaaagggcctgtcagttttatctgtaggaggtaaaaaggaacagcacatttcagggaaaagcaaataaacatatttgctgcggtggtttcaggtttaccaatgcagcaggtgggtcaggaagcacagcactgatcccaatcactgcaacattaacattttgctcaaccaaacatgatgtcacatggcccatgagaaagcatgttttgagctcataatatgaaatagaggtcagacaggagcttctcccccatgtgaccaacgcatctacattttacaggaatttcttcctcttgggatcaattcacaatacctctatccatttccatgtcttgataaaaaccaaatagaaaatcagaaattatttttaaagcagctttgctgaaagaatattcaaggcattagaaagaaagaatcaatatatcattttgatcacttaaaagctttttttcatggttactcaaaacccacgcagagctaggagatagggctcattaaatcagagggattctggaagaccatttcctggtcagctggagcaatgttgcctgcaccagtcctatccctaacagccaaaaactgtgatgagaaccaggcttttaaaatgtagttttaattcgctttttttttttttttcttttgttgagacagagtctcgctgtcgcccaggctggagtgcagtggcgcgatctccgctcactgcaggctccgcctcccaggttcacgccattctcctgcctcagcctcccaagtagctgggactacaggcgcccgccacctcgcccggctaattttttgtgtttttagtagagacggggtttcaccgtgttagccaggatggtctcgatctcctgacctcgtgatccgcccgcctcagcctctcaaagtgcttgggattacaggcgtgagccaccgcgcccggcttaattcgcttttgagtttcataaagtaggccaagttacagacaaatgcagcagtgtgaggtagactttctatttttcctatcctgttgtgtgatggaacttacttatttcttttgattctcaggtttctcatgctataattaaacacaaatgtggctcctatcattttattttacaaaagtgagttagagcctcttaatccatatttcaatataggctcagtgttacatatttgtgtttggagctgaaatccacagacctgccagcttagtgcatcacaattattctctgctactatgtgtacatgtttataccaaagtataaaggtacccaagatttcagctgggggaaaaaaaatttctttgctagctgtagtcacctcaataatgatttcttaagatgactgctattgttaaaactcatgtttttaaaaaaatttttagtgtcagaaaaattttcactataaaaggttaaatatttaccttaggagtagaataataataattcacattttcctctttatacctttcaataccatgattttttttttttttttttagacaagataccactttatcacccaggcaggagtgcggtggtgcaatcatagtacgttgtaacctcaaactcctgggctcaagtcatcttctcacctcagccttctgagtagctgggattacagatatgtgccaccacacccagctaatatttaaaacttttttttcgagacagggtctcactatgttgctcaggctggtctcaaattcctggcctcaagtaatcttcctgccttggcctcccaaagtgctgggattacaagcatgaaccactgtgcccagcagccacatattaatattttttatcagaaacattatcaaatttttaattaaaattaatgaacaaataataaggatttctttcaaaagctgactttaaatctaaaatcatgtggtttattatacaataaagtctaatctggtaatccaaaagttagaaagtattattttaaatattaatttacaaagaagaaagaaatgaactaggaagtactaccttgttttacagagaaaagtaacatttcagagtctattatttaacaatataaaagaaaacaagcccttaatgtgaccaccaatccttctcaatgccacaccttgttggacagaatggcccacgtatcagaatggagcagcccaacaaatactcagagccatcagatgatgccaaggatacctcattattcgttttatttcatgaaagtctttgtttttgagacagagtctcgctctgtcactcaggctggcgtgcatgatctcagctcactacaatctccgccaggttcaagcgattctcctgcctcagcctcccgagtagctgggactacaggtacctgccaccacgcccagctaatttttctgttttcagtagaggcagggtttggtcatgttggccaggctgttctttaactctggctcaagtgacctgccttggcctcccaaagtgctgggatttataggtggtagccaccacacctggcctcatgaaagtcttcttatggacattaaacgttcctattatttttctagtaatttgccaggcaatgggctactttctttagtttttgagcttgctccttgttccttatgtgtgtatttttgcctagaagagacataattcaattctggcagaaactttcccttttgtcaaacaaatctggttttcactatcaatgcgcaatcagcttggtttctgcttcccagtcatttcctggatacctttttgagttatttgataattacttgaccaagaactactgctgccacctctaatcaattaaaattgacacaatttctaggcccttggctttttttttttcttgaagtttcatcagtcatgaccttaggacctttctgagctgcattgataccgtaactaaaaggaaaacaagtgattccaggaaaagactatctgcattgaggatcgtgattaggaaagcactttgttaatgtcagtcgaaggcaagctaactctacacactaaaagaaaagatgtcctacaggcaataatgagaaaggtcaaataggctttctactaaatatggatactacattaatttggggaaaaaaagaaaaggagagtgagggtatgaataagaaggtaaaatggaagctaacaccaaccagatctaagtggacactacaggttgaatactccttgtccaaaacacttaggaccagaagtgtttgggatttaaaattttttttgtgggatatttgcatatacataatgatacatcttggggctgggatcaaatctaaacacaaaattcatttatgtttcatatacacatagcctgaaggtaattttatacaatattttaaataattttgtgcatgaaacaaagtttgactgcattttgaatgcgactagtcaaagaaggtcacgtgtggaaccttccacttgtggcatcatatcggctcaagaagttccagatttgggagcatttcagatggtggattttcaggttagggatgctcatcctgtatagcctttatgtagtcttagtttgtgtcttcattaatgctctgagattagcatttattacaagtcttccttaagatcaatgattcattgtaaaattactgaagttcgggatgaatataatgtggtaagcgcgtatgacttccataaaatccaaaatatccaagatacttacatctcatatgtgaacagctgataataattacacactctaccttacatttcttttaaggctctcagcaggcggtctatgacagcttcccatgcaagttctaaggcaagataagagacaaagctgtggccaggtgccctgactacggaaagaaagagaaaaaaggcccagaaatcttccctggcctgttccagtccagaagaaaggagactgggcctgggcacacagacaaactgtctttagtttaaagaggagaacagactttatcagatttcagggttaatgtggtaaaacactaaacttgcctgtcttccgggaaaatgcacgtagaacaagaggtcactgagatgaggacccctgggaatcctacctcaagaccctctgtttccttcccatccccaaagacatctttctcttattgataaaaacagaaagataagaaggaagctacaacatcaatttgttctgcagattaaatgttacattaatgccaagttttctccttgagatttatcattttcctattaagttgtatcatttatcatgtcctaaaagcaatacaagtgtgtaagaaaatcaggaatggagcaaagaatgagacaaaggtttagtaagtggaggttgttattcattcttggggggatctttttggcctgtttctaccagtaattataaacacatagatacacacacacatgtatttcaatgtcaaactttaaattaccaacttgctatgtgccaagcacagggaatgatatagtggtgaacaagacagacaaggcccctgctcctataaagctgaattctggtgaaggagacaggtgataaataaggaaagcaaataataaacgttgagagaattcccactgtggtgagtgccaggacagaaaccaaacactgtgatggggcagaccatgagggaaaagggagagggtgcagaagatagaggagttgacttctgagctgagaattaaaatgaccaggagtcaaccctgtcaggtcaggatgaagagagctctaggcagaggaagctcaagttcaaaggccctctctaatacagtattaggtagttggatacattgtgccaaagttccttttaaactacagactatattctatattcctatagttgtctgttgtcaagaaaaacttaagctaaatgcataaagcacaaaggaacgtcaactcaaattttatgattatcattacttctctctcattatctgtataacccacctacttaattttattgaaatttatttatctgataggatacatgcccatctgaagtcatttttttttcttttttgtctgagcatacgcatttttctcaattaaatcactggttttttaaaatgcaattgtgtttgttttattttattttattttattttgagacagagtctcactctatcatccaggctggagtgtggtggcacaatcttggctcatcgcaacctctgcctcctgggttgaagtgattctcatgcctcagcctccagagtagctcggattacagttgtgtgccaccacacccagctaatttttatgttttcagtaaagacgaggttttgccatgttggccaggctggtctcgaattcctaacctcaagtgatccacccacctcggcctcccaaagtgctgggattacaggagtgagccactgtgcccagcctgcagttatgtttaaaggtggaatattaaaccacaggttcaagggggaatcaaggaagactagatatacttcaatcaaatttggccaccatcagttaatttcttagaaacttataagagaacagaccaagagacagacacaactcaaacagtcaccacacttccttacgctggctcatcagcatcatgagacaggctttcaaccctaaagacaattcattctagtttttaactataaatttgactgaggtgtagaaaatagatgtattagtaaataggcttattgtttctcttaggaattgtattgtcttctaaatacagcaactaaatatttgacatgtaattttatagttaatatatctgcacattagggatttctgatggcactattacatacatattaaaaccactactcttaatgcttctgttagctgaagtcagaagctttaggaaggcaacacattgtgaggtttttttattaagttattttctacgtggaattaaactttatagaaacttttcagggatgttttaattcagttcattgcagactgtatcaaattttatttcaagggactttcttacactgaaaaaaataaattccttattttagaatagttttagatatacagaaatgttgcagaaagtttccatatgccccaagcccagttttctctattgctaacaactgacattagtctcataaattttaagtggcaaaaatctcaatatcatgtgcacacacacacacacacacatgcatgcacaaatacacatctaaagaactttcaacccaacatggtatttctgaaacttagaaactttcaagacctcttcttaatgcctgattttctaaaatgttagaataacagtgatttattaaattaagtaactcttcttcagacatttttagagtcaaagcaatttttatcaaaaggtcactaccaaataattagctaattagcaagaacatttttttctcagttcaaaaagtaattagaaattataaccatgaaggggtgctaattgggttttcacagaagcattaagtgcctgaacatttttttcatttgtttcacccctctgccgatgaaagttaccgtgattaatcctttctcttctgcatgacaacagcaacataaaatgctgcagttgagtactggtaatagaggataaggaacagagtcaattaagatttgggattttccataagtgtgagatttcctattgattggctacaatttcaatacaggaagctaggaaccccactctccaatctgagagaagaaggtggagttgcagagagaatggagctcaatattccctcgtgggctcacctgctgtgactttatacagcatgttagctgatgttccggtgaacctgtgacccacactggagaatgatcatgacagggcaagctgtggggaccacatagtccttattccattaatgtctgcttaccacaaacatcagcgcacttgcaacatccccgtggttcttgaatgtggagaagctgccagtgccagtagctagcctgggattggacttcaggcagagttcatgtatgatccaaatacccaagtttggtcaagtttgattcacttttgtgtgcttagtgtgcagccctgcattgaggaaccactgagagagttacttatttattcatttattcatttatttatttatttatttatttttgagagggagtctcgctctgtcacccaggctggagtgcagtggcacgatcttggctcattgcaacctccgcctcccggattcaagtgattctccagcctcagcctcctgagtagctgggattacaggtgtgtgccaccacacccggataatttttgtatttttagtagagacggggattcaccatgttggtcaggctggtctcgaactcctgacctcatgatctgcccgcctcggcctcccaaagtacaggagtgagctgggtttacaggagtgagccaccgcaccctgctgagagaataattttctaatagatgaagaagtaaagcgttcacttaccctaaaagaactgcagagattttgagtgatacatacctctagaagcccaggaatcaagggctttccaataaggcaaacacaaagctctcatctgaattcagagcactggctggtttgcacagagcactggctgctaagtgcccagactcctgtttggcaagccagtgtcctagggagcatgaatgcattttcagggaaaaaaaggccagcttcacatccaaacccccaagagataggaggagggaatttggacagaggagccacctgttacaaatgaattccagaaagggtaacaagtgtgttctctgagaaaagaaattgggtggctggagggaggcagacttacttttcattcagatgctcttgtcattttaaaattttgtactttgtgcactgttggttcaaaaataaaataggctggatgcggtggctcacacctgtaatcccagcactttgggaggccaaggtgggaggatcgcttgaacccaggagtttgagaccagcctgagcaacatagcaagactgtctctaataaaaaataaaataaattattatttaaaagtgaactctggatgaagtcatttatctggaataagactactgtgcagtcatctgagcaacacttcaaacaggagacaggatggaagtcaggggtagaaagatacactgtgagacttaggtcttagtggtcctctaccctgctagccacaggccatacctgcggcgggttatcagaaccctcagaaggcaataaggctgggacagcagtgggggacacacctccaccacaggggatggggtgagcatccctcggcacctggactcttgtccccatagagctctgcacatctggtgatctgactcctaaaaccattcctctgtgcttcagctcctcatagatcaccatcagaagtccttacagccagaacctctggctcacattgagatctggctctccccagaggacaactgcttcctctgcagccttgttgcttgttactgcacttcctaactttttcccaccctcctttctaactgctgccccgccaggttagaagcccatgctatcagactatactacttgattacagggatttacaaactcctggatcagacctgccaggagtttgtagattctcttttgaagattttaagacctaacatcctatcagtctctccactctctcataaaccttgatgaattcaaagctgacacagatgatctttcccaaaacctggacgctcaatgacctgtccttttctccttccatgatctaaatttccactctgctaaagaaactcaatcccagagttgtatcctagatcttaagattataaatatttgcaaaccctccacaatctcagtttcaagtctcactctccaatgaccaccaaccatcttccagctcacttcctttagagctgagctgttcaaaacaatacccactgggcacatgcggctagaaatgtggctagtctgaattgaggtgttctgtaagtataaaatacacaacagactgtgcgtgtgtgtgtgtgtatacacacacatatatgtgtatgtacatacatatgtatgtgtatatatgtgtgtgtaaaagactgtaaaacatctcatcaataactttttatattgattataaactgaaataatattttggatatacggaatatctaattactaaaattaatttcacgtgtttctttttagttttttaatgtggctatttaaaattacatatgtggagaagattaaaatcatatcatgtatcttttctgaccacaatgctttgaaaccagaaatcagtaacagaagagatctggaaaattcacaaatacagtatgtggaaattatacaacatgctcttgaataaccaatgggttaaagaagaaatcaaaagggaagtcaaaaatatcttgagacatatcacttaaatgtctccttcatatcactaaaagaggcattgaagagggtaggaaagacagtcacgaattgctgccatgcctcacacatctccccagtagcagctgcgtggcacagagacagaatctgtgttcttgggggaaggaaggtgtagcgattgtgggactgtgcactggaactcagtgctgccctaaaacagtggaaagcaacaccggcagaattcagctggcacccgtggagggagcatttagaccagccctggccagaggggatcaacaatcccagtggttggaatcgaagttccagcaaggctcaccaccatgggctcaagtgctctgggattctaaataaactttaaggtagtccagggtacaaggactgcaatttctaggcaaatcctaataccatgctgggcttagagccagtggatttggtggggggggaggagggggcacgtgacctactgagacaccagctaggatggccaagggagtgcagctcgcagccctgggaaagactacttctttccactcaagaagaggagagggatgactaaagaggcctctgtctaacaacttggataccagctcagccacagcaggatagggcaccagacagagtcctgaggtccccattccaggccctacctcctggaggacatgtctagatatatcctgggccagaagggagcccactaccttgaagggaagaacccagtcctggcagcattcatcacctgctaacttaagagcccttgggctctgaatagtcagcagcaatacccaggcagtacttgcagtaggccttgaacgggattcagagccaggctggcttcaggtgtgacccagcacattcccagctgtggtgcctataaggagggatgtcttctgcttgagaaaaggagagggaattgtaaagcggacttttgtcttgcagcttaagcatcagctcagccacagtgaggtaaagtaccaagctgactcttgatatccctgattccaggccttggttcttagcatttctggagctgcccctgggcagtgacggggtttcaccatgttgaccaggatggtcttgatctcctgacctcgtgatcctcccgcctcggcctcccaaagtgctgggattacaggcatgaaccaccgcacctggactataataacagattcttaatctttcaagctccaacctgctgtgagttggtcaggacaagggagtcagtatgaacatgtgactataaggaaacgctttttgaaattatctttgcttggaccaaaggcagaagtttgcatgtaggtagtttatgttggaagtgatcccagagagcaggagggaaaggctgggagagccaaacagggagggagggaaaaagcaacacctggatgtgttatcaagttggctgaccaccgccacaggtggctcatgctccatctcactgggaccctttgagaattccaataagattcatctcacagctgggggatccatgggggaaacatccatccactggttcccaatgagtaagtgtggccccatgggcactgactcccagcacacctgggttatgcacatgtgagcccctcagtgtcagaaaacatgggctcagggcaaggcactgtgattgcccctgtgagaaactcacgaaagcctgctctgacctggtcaccatagcagcagctggaacaaaatatggtgcttcaagcatctgcagtgatgcatagacgcgtctacaagagacactgtcttagtaagtgtggtttctaaatgacagcctggagctgaaggatgcaattgtggcttttgctttaactatggatcacagtcccttaagctcacgtcgtcatctgaaaaacagagaataacatacctacctcacattctggaaaagacttaaaactaaaatgctgccattcaatagttttaagaatttcagtaagatttaaagacagcaattggctattgagtcattagctcctgcttgccccaatcctacccagttgcaaattctgaggacttcagtgaataggttcagctctgctcaggccctagagactgacagcttcatgttgagtctacagttttctctgctaccctacagtattatgtgtgggcatctgcctgctttccaaatgtacattccagtttcctgaaagcgaggttccaaggcctgcccagcccttatgaacctccttttccagggggtgctgggctctgtccacatagcatggctgaatatgatcctgcttcttcctggacctacggaacctaaacatggatataatatttgtaattgcccagagattactgctgcagtatcctcaccaaccagtgcaaaatggcaaaagcccagatagtgatgatgatgaagataataataatagctgtatttattaaattcctgcttatgccaggcctggtgctaggtgctttatgtgaattctctcatttaatcctcacaatagtccgctgagcaagctttatccctattttgcagataacaaaacagatgctcagaaaagtaatttatccatatcaccaaattagtaagtggtagaatgagggcctgagcctcaggtctgtacaattacagagcctctattccgatttaatcattgtgctacacagtctctccaagatgggtcctaaacctgccatgtctacttggccgtgataagtcagactccttgtcaattttctggagcctgtcctatagccagctcagcctcctatctatggctttgcccagccttggcttcccaccttctccctgttcccaacatgccaagttgagtctactattaacaatattttccaaggaattgactggacctggaatctttttggtacatttccgtatcagtcatttgacttgagcagtctttgaaatcaaaaagtgatataaagtcctcatgtattctttgagttacgattaaatctaggtttattaccaagttcctacgatgagcaatatatgcccaaagctaagactagtaagagagcaaggagaatgtgcttcagggaatagactgaattggggttgagataatgacatgtaactttaaaagcaaagcattgtcctgaaacaccaacaattaaaatcatttttcttttccaaaatgtgtctcttactctctacacactgtatatatacatgacagggagaaagatccaccgaccattattttcacacctgcaaacatattctcaaagttccatatgtttttcaaggcctcaatgcttaagaaaatacaccttggctgactggttgcatatctccaaggaagaggctgtttatgtctgctcctgtctgaatcttgagacttggaacaccttattatcatgacccataatttcttcctcatttacagttctcagcaggatctccagttgatggctacacagaccgtgccctaatccataggaacacagtttctgcattcaatgtaaaaagtgatcttgcttaagtcccaaaatcaattagtgcttcaagacttgggaaaatattatcaacaaaggaatagccacccaaggaaaaaagcaaataaatccctgcagagaaaataaatgccattcatttccagtcatatacagcaataaaactgattaaattcctcacaaatataagctgacaaagcagtgggaatgtgataatgaaggtctcatagcttcacagggactttgcctccgagaagctagcaaggatgcctaaatcctttttattactattgggaggaaagaagtagcaagattgagaattctttacctctgttacagttctataaatttttataaataactgtattactaagcaaagcacagggtagaatttaagaaaaaggaatgcccctaaaaatgagatatacctccccacttttcagaacagtatgttctgtcgtaaacaagacactttactattcacatagccatgtgatactatgattgcagcacctgaaatggaaagtaaaagatctaaattttcaaaccatttctggcactggtcccctgtgcttttcgacaaatgacttccctgtgtttatttcccgatttacaaaacggtgataattatttctaacctaccccagagaagtagaagataaagcatgctccagaacaaaaagtatttttaaaagaccttaataataacaaccctcttttttggaaaaaaagattgtttctattttatggggaaatactttactaatcgtgagtttgtccatagaaagattttataatattaaaaaagaaagattcctgaatatggatggattagccttgagaatatatttgaactatatagtttctaatgattaaaatttcaaagaaaatatgttttacaatatggatcctgaataacatattcaggatcccacaatcctatttgttgtatgttataataacttttcttccggccataatcctattttttatatgttgtaataatttctcttctggcaccaaggaagaaaggatagcacatcacagcaaacaagttaagcatctgggttttctttgaagcagctggaaaggctttctttccccattctgcctccattatgttgcattctgcattgatgaaataacaataggtatgatcgtggttcctgtccaagtgcctttctacatgctgagtccccactggaggtatggactataagaaatgaaacttgcttcccccactttttttttttctttaacattccaaccccagtcttatgcaaccaaatgaattgcatctttcaatggagtcactgggaggcaatacccttatttcaaagatgatgctcaaaactggttttggaattgccttcgaagccagtttatgagtttcctaagcaaaatgactttactactcctgcctccaaagtacattaaacagacacagcttttgccttgaagactcttacagtctactatgtgttattctcacccagcctgatcattgcaagagaaaatcttcaacaaaataatccctggagaactctcaagaggtatgaattactgcaattatgaagctaccatctaaagcagcactgtctaatggaaacaaaatgtgagccacaaatgtaatttaaaatcttctagtggccagatcatgaaaagataaaaataaactgttgaaattaattttttttgagacagggttttgctctgttgcccaggctggagtgcaatggcatgatcaccactcactgcagccttgacctccctggctcagtcaatcctcccacctcagcctcccgagtagctaggaccacaggcatgtgccatcacacccagctaatttttgtatctttttgtacagatggggtttcaccctgtttccaaggctggtctctaattcctgggctcaagtgatcaagttctgggattgcaggcgtgagccaccacgcctgcctggctgaaattaattttaataatatattttattcaacccaatatataaaaatattatcatttcaatatgtaattcatataaaaattatggaggtattatttttcattattttttcatatcatctttgaaattcagtattttacccttacagcacatctcaattcaactttaccacatttcaaatgctcaatagccatgtatgactagtggctacctgttgaacagcacagacccaggcccttttctcccctgaataatgaaggccagggcactatttagtattgaataactgagctcttcctgccattttcttaattcctttaatttatgagtagataaagtataaaaacactatctataacactgggcagtttggtgttctaacaaagaaaatcttaggtcaatccaacacacaccggaaagaatagaagtcaaaacagagatagtaaagaaaggcttagaggctctttcacccaccaccaattctgcctctgattggcctctgatgccacactagcttggagagactgtatgcagcttcctcaaagctgggaaaaggccagaggcagctttgaaccagaggagtttgcctctgcctaggaaaaacagaacctgttatctaaattgcctaatgattcacaacccaaacaaaggaaactcacaagaccagaatccagagacagcagggggccagaaaaagctgagacaggaatgtcatgcttaggaccagaaggggagaaaggagatgaaattgaagactcaagaaatgcctctgaagactcttaatttcattatctcaagagaccaaggcagccaggcctctgtgcattcttaggagtgcagactccatggcccagactgtgcgcagacagacttcatatctgtcacatgggatggaggcacatccttcggggagtcacattaaccatcatcaagatttgccagtgtcaagaagcacaggatgagtatgatgggtccaaagggcctgggacctgaagagggctgtctaacagccaagcaaaccccatggccacatgctagactgcttccccactgcccacagggagctaagggaaaccatagctcgtgcctcatgatgtaagtaaggatctgtgggcaactgtgattgccatttgcttttgcttttttttttttttttttttttttttttgagacagagtcttgctctgtcacacaggctggagtgcagtggtgccatctcagctcactgcaatctccgcctcccaggttcaagcgattctcctgcctcagcctctgagtagctgggactacaggggcataccaccacatctggctaattttttatatttttagtagagatggggtttcgccatgttggccaggctggtctcgaactgctgacttcaggtgatccgcccacctcggcctcccaaagtgctgggattacaggcgtgagccgccatgcccggctgcttttgctatttttgtgaatgaaggaataaagttgatctcctttaaagaatttaaaattcttccatcgaagaatcaaaagaaaacaatggaaacctgagattttgaactttaacaaaaatccatgaaattaattgtattctcttccataatttgcctgttttaatataacaatgttttaaattattaaccagataaattatttattttcccttctatatattcaagcaaaatgaacactccaggaagatgtgccccatttctcctgtggtcttgtgtgcctctttgaacaccaaaggctggacaggcctagtcaacatgctcagaacacaccttcacttcctcttcctacatccctgctcactccccatgcccaaaacgtcctgctctccgtgtccattgcctacctacatcttaacaatcactcaagcacagtttaatggatgtcccgcctcccctaagaagctcctcaatgacccctctgctgtccagacttcatctttctgttctgcccttaacctggggaaccgtggctcctgcagatgtgtagctgaatcttgaatccacgcatactcctgtacctcacacagtccccgagttctttgctaggcattgtgctagactagtgcctgacatgtttttggtccctccttcacaattcacactccctttggtaacatttcttctcatactaagtgattttcagtctagagggcaaggaatcaacacagtctttacaggggatggatcatggcctcagacacgggaaaggaaatctccacaccacacacttgcctgaccccctcttcacccacagaggaatctgagacttgtgcctcacactgaattagagaccactaccatgattctaggtgtgctttaagagaggagactggcccggcgcagtggctcactcctgtaatcctagcactttgggaggccgagacaggtggttctcctgaggacaggagttagaaaacagcctggcccacatagcaaaaccccgtttctactaaaaatacaaaaaaatttgcccagtgtggtggtgggtgcctgtaatcccagctactagagaggctgaggcaggagagtcactagaaccctgggggctgagattgcagtcagccgagatcgcgccactgcactccagcctgggtgacaaagcaagactctgtctcaaaaaaaaaaaaaaaaaaagagggagactgtatcttactgatcttcagaactcctcaggacagtacattgtcttaaataacaagtagagttatgcttgttaaagttatgcttgttaactgactaatttctgttaccaaaaagaaaataatgagtggtcaggtgacctcacctgggaccagcctgatgatcacaacccaccatagacaccaaccggtcaggccactccctccagcgactcacagatgtgatctgaatgcactgtacacagggttatttgcagccctgagttttccttaggccccactactcagcctgctctattacctctggactccagagggaccttcaaacaaaaggggacaccaaagtgggagtttaaaatggcaacctacggccagcactgtcagcgcaaacacagcactccctttgttccccacctctatttcttttatattttgactaatttgcatgtatctgaatagttcaccagatcacaggctattttgaggacaggtatataacttttttggtagcttccacggcaatggatgtcattcttaatgtttgctaaatttgttacaacaatcctcattttttaaaaagaagatattgacaagaaagtgttctgagatggaaacaaaagaaaaagaaaaagaaaaaaagatccttttctttgaatagtcacggtaggagaggctgattagatatggcccatactgtgaaagaaaaatacaaaaaaagatcataaagattacagtcagttaagagtgtaaaccactggaaaggaataaacctgtggtgccaataatctctgaaatattttctcattaagaaaacatgaaaaaagagtcctacaaggttaaggattgttctgtaagaaaggaacaagcctggaaggcagaatttctgtatacaacattttgttgatgctttgtacctaactgccaaagacagcaagagaagcgactggggatttttttcaaatatatttttattattgtttttaagcctgatggggcaatctcatgcttctgaaagcaatggacagcagcctgtttgaagccaagcacagcggggtggtcccccaccaagagcttaggcactgcgttcccaggccctccacggaagagcaagtctctgataaactcctggggaggaaggcgactgtagtctttcctcagctgactaagccagagcttcaaatcaagtcagagaaccacagtaatctttgtataaccccaaagcggagaggaatctgggacagaatgccaacaaaggctagcccgggaaatctctctctcgttttctggagcgaatgccttgatacaaatatattgcacacatatgtgcagcagttaccactgccctcaaggagaaccccacacaaggagagtaaaatgggaaagtattagtctgttttggttctttagtagctaaaatctaaccaactttcattttttttcttagaaatattactacagggtaaatcctcatttttacattctagaagagatgagtataaacaatgcatcacttttgttttttcaactgataatactggtgccccctttgaaacctaaatgtctatcttgaatctattactaatgacaatgttaaaaagattccagaccaaaagcaccagcatctattttccgctcattcatgaatgcatattcctcacttagtgcccccatcttcctccagctgcctgtctctggccatttcactgctcattaatatttctactggaaggggaggagaacttgagaaagataaaaaacacaatcagcccatttttaccactggtttctgggtagaatgcaagctagaaaagaatatgaaattttgtagagagtcatgttttcacatgaagtgatatgaaaacatgactctacaaaatttcattattctttggcaaatatagtttgtcctatgctgattggtatggtttggctgtgtccccacccaaatctcatctcgaattgtaatccccaggtgttgaagaagggacctggtgggaggtgactggatcatgggggctggttctcccatgctgttcacatgatagtgagtaagttctcacaagagctgatggttttataaagggctcttcccccttcactttctctctctctcctgccaccatgtaagatgtgcttgctttcccttccgccgtgattgtaagtttcctgaggcctccccagccatgtggaactggctcttaaacctctttcctttataaattacccagctcaggtatttctttatagcagtgtgagaatggactaatacactgattttcacccaattccaaaagatggctgcatatgtatcaaaaaggcatacttcagccaaaaagtcacgagcagtctaatagctctttgttttagttggaattcagtgaactacattctcccatggtggaatccattcccaggggtattatgtcagataccgctttacctcccatgtgactgaggcagcctatagctgccttctgacagtcatcaaggcaacgctaacctttctgcatcattatcagatggactcacctaactgtggtaagaggacaagtgtaagagacaaggctaagtctccattctaacataagtggttgcacttagcctctctgggtctctgtttttaaaatgaaaacattgtgtggggattgtctctaaaaccctttccagctctatctttctagaacttcaattatccaggatttctctgcatggctcccatactctaagctgacctggatcacagcctactgacacagtgattataagcttgagctctgaaatcagacaggcctgagtttgactccattcctccacttaggaagtgctatgctttgaatgagttatattactctctaagcacctacttcttcatctagaaattggggataatagtagtacctattaaatgggtagatacatgtaaagtgcttggcacaacaactaggttacaggaagtactcataaatttttggttgttactgtcataatcattctccattattttctccatggaggcatctggaatggaccattctctctctctctgcctattcaaactctagcatccttccgccaacagctcaagccccagctcctctgtgaagtcttctcacacaactccactcatatttcccctccctactacgaaacagcacttactgtcattgtcaatgtcacaccatttagaaattagttgtataaagtcttacactattagcaagtgggttggatagctagccttactgctcatataagaatgtaaactcttgaaagcagaacctggaacttttatatgtgcgtaaacacagaggtgacactgctcatcacacagaagatgctcaataaatgaaggtgagttgaggtttttattttaccgaaaaagtattaatgcaagttcccaaggtgtcaaatatatacccatggattgaagaatgggcctgaatttttataatcgtttacagcttcctacgtatttttctggatttacaacaaaatccctaagtagaagaaatcagtccatggatccccaagaaaactagagccagctcccgctcaagtttcaaaggctctgaggtgtgatgctgttaaaagcatctatttgcccaaagttgttcttatcttcacagtcactcacaagtcacaatattttaaacaattattcccaggcccacaacaattacttttttttgtggaggtcaatggcgatagagtcgctattgtctgtttttcagagaagtctgctgagctgccttgtggatggggacactgggactatcacacaagtattaggacgagcatttgcatgtgtggtgaatgtttctcctaggaaaagaactagtagaggatgggaggtgatcagaaagaatactaaaaaatttcaatcattccaaagtgactgcatggaattatggtccccaaagatgtcctaacctcagaacctgtgaatatgttaccttacatggcaacggggagttaaagttgccatggaattgaagttgctaactagctgacctaaatatagggagattatcctggattattggagagggcataggttatgagctctaaaagttaaagaaggaagaatagactagagtgacgagagagaagaaaaaggaggagagattcaaaacatgaggaggactcaacccactgttaaaggctctgaaggtggaaggagaaagtcaaagaataaggggaagcctccagaagctagaatgagccttaagctgacagccagacaatgagggtcttggtcataggaccacagggagttgagttctcccaaaaaacccaaatggtctctgcattagccctagaagaccaaatagcccaatgcttactttaatgccatttctggcatcctggaacatcaataatggtgaggtacagtttaccagcacagataatcagtgtagctacatcacagtaaaacaaggcacattatttggtgttagtattaatatctgaatagtctctttcaaatatagataagcattctggatgtcatttggagcaaaaaacctcctatgtcctttactatatatgttacaattttaatcaaagtatagctgtttagtataataaaaataaaatactacaatcattaatggttaatattttgttataaatatgattgctgatattataataatatatatacttaagaactttcagagttaaaaaataggaaaatgaatgaatagttaatgaaagagaaaatgttactttggaaggccaaggcaggtggattgcctgaggctaggagtttgagaccagcctggccaacatggtgaaaccctgtctctactaaaaatacaaaaatttggcaggcgtgatggtgggcacctgtaatcccagctacttgtgaggtggaggctgaggcaggagaattacttgaactgggaaggcagaggttgcaatgagctgagatcacgccactgcactacggcctgggtgacagagcgagattctgtctccaaaataaaaaataaaaataaataaataaatgagaaaatgtggtagatagataactttaggaagaaccttgtatatttatgaaaccataaatatttattaaaattaaataataatacatggcaaatagattatataattttgatttttctagtagtatatggtaaactagcattcatcactttaaacaaaatgacctttaagcatcacatttaatttttgattatttaatttcatttttaagtcatacatttttcaaaaaaaggagatgaattaaaagcagaatttcaactttgctccctcaataattaatggtacaaaaaactccaaaatcatatccaatagcttgcataataaatcaccttcaatttaaacataaagaatataagaaatatgaagaaaagaagaaagtatcagaggaaataatgaggttctcaaaacatattgtattctcagtaatcaaaatcaaagactgctttaaaaaataattcctcatgattttcagaagctaaaatataaatgaaaaatgtgtcataataattgttacaggctgctaaccatcttcagtagaagaaggaggattcttgacattcctgatgctcattaacagactattgaattaggaaataagccacttcgtcctgtgcatagtcagcctcattccctactgtttcccagggcctagcagagagcttggcccgtggcaggtgtgccgctgatgagtgaacaagtgaatgaatgaatgaataataagcataggtagtagcaaatagcctgatgagagtaacaagaggaaacagaagccataaaaacaaataaaaagcaaaccggagaccaaaggctagaaatggtttaatctctagccacttagctattattatatcacacaacctaataacaataaagcactcagtatgtgtcaggaagtgctgcaatctcatcagtactatcgggtagttataatttttatccacactttgctgatgaagaaaataaggcactggaagtttaagtatcttacccaagattgcataggcatcagtgagtgttggactcaggccatctgcctcctgagtatttacaaaagtcccaacgtccctctctgggtatttttcgttctctctcctcccctctcctccactcccctcccctcccctccccccttctctccttcccttccttccttccttttctttcctcctttcttttctttctgtctttctctctgtctctccccccccacctccctccctctctctttccctccctccctccctctctttcccttcctccccgcctctctctctttccctccatcccttcctctctctctctctttttttttttttttggtggattctcactctattgcccaggctggagtgcagtggcgctatctcagctcactgcaacctccgcctcccgggttcaagcgattctcctgcctcaacctcccaagtagctggaattgcaggcacaaggcatcatgctgggttatttttgtatttttagtagacataaggttttgccatgttggccaggctggtctcgaactcctgacctcaagtgatctgcctgcctctgcctcccaaagtgctgggattacaggtgcgagccactgtgcctggccagggtctttatttctttctaagatcagatgatcttgtaagatccttacaactcctaagaaaaaaaaaaaaagaggggtggggaagggataggtgtaatacaaaatgtcaagttgcccttaacccttaacttgaatcaaaataaatgaacctctgctcacataggaagctgtctttctcacttacctcaagagatttctcaaagcctgcaggtctcactggtgcctgctaattccctcatgattttattttgcatctctagtcagcagagtcttgaagtttgataagccctgcataggtctttatgcttagacagggctcacctagctacttgtccaaataggagtcctaacagtaatgcattcaataatgtttgtttgcagagttcacagacacattaataattagtttgtctttgtagattctatatctttaaatatttggctagacgactgtaggagacagcagatatgggtaccagataagaagcaatgtaagtaaatgcatttttttagcagcttgtgacaacctgaatttatttcagctccttcttcttgctgtcactgtagtttccaggtgattatttctacatagaatctacttttcattttgcttcatcctccagtgcagcctgtccaacataacatagctcttgcctcacagagaattttggctccagtgagttctgagaggagcataaaatataagaaacggattcatcttaaatgtgaccttcaaaatggagtgcaaaagatgagattaaagtaaacccaaacaaattggaaagtttcttgcaatttagtcaataaatatgctcagttcaaggaagttcgatatatatatatcttacatatatatgtaagatatatatatgtaagatatatatatcatatatatgtaagatatatatatgtaagatatatatatcatatatatgtaagatatatatatgtaagatatatatatcatatatatgtaagatatatatatgtaagatatatatatcatatatatgatatatatatcttatatatataatgaatatatatattcattaattataaactcatagaaaggccacagtgctctcttctcacagaattgtgaaaatcatgactacttcatgtttctcctgctaaaagttcataatatcaacaataagacattatagcatagtatatattaagtactataataaaacattgaagatctgataaacatagagattgagaggcattttttccttcgactctgggattatgaattcaatggtttgacacagagaatacaaatgcaagaccctttggtgcggggtgggggtggttttaaaatgtattggttattgatttcggaacttctagttccaaaatgataacacagacacaatctaggttcactcctctccacagaaaaccaaaacaaatataaggtgccaagattatcaccagcaacatcgcagaactcaaacatgaggatgattccatttccagggtcacagagaagtgaaaaactctgaggagatggtaaaagaatcaaatgtccatatctgctacaccccccacccactgtggcccaactcatggtttctacactggaaaaagtgagatggaggtaaacaaccagcttccccaccatcctgggttccctggcaggaggcctgcccatgctttaacccatgggaagcaacacgagtacccaaagggcaacacatccctgagaacagccagagacaaagaggggaggtgggactaccatccccagccctggaacctctgctttgtaactcagccagggacaccaaatcagcatggctgttcagtaaaatgtattggttattattttcactcaataaaataatcaacaaattagtacctattactaataaaattttaaagtgatccaacatgctctcagtgtggacattaacaggtgaaatctaaagaggtggcatgaattaatgactggctatggaaaagttcattcaagtctcattattctgaggcatgggttgtaattttcctctatgatagacgcgccaaataaatgcataattgcaaagagtaatagaatgtggacacactcactgatttattcacataacagcttttccttagctttgtcagaaattcatttaagtgtctgaagaacccagtgagattggtttcctagcacatataactttgttcctggcacagaatttctataatattttataagtctgccaattgcataagtatatttaaaaccttgaatgagctctctctttgccaactaccagttttgaaggaaattcttatatgtaaggggaaaagggacgtaagatttagaggaattagttaagattattaactccatttgagtattaaatcacatgtaatattgtgaaagctcagataataagtgctaaaagtttagactctgcaataaattgctctatttgtctaagtagaaatgtgttattgaacaggatccggtcactgtcccttaatggttgtgctactgacatctgaggcaggacacttcactgcaggactggcctgagcactgcagatgcctgttcactaaatggaaacttcaccctcaagtcactgtgacaaccaaaccacttctgctctccgtctcatgtgtactatgaatctatgcactctgatgcactactgctatgtggattatgtgggtactctggccatgggcttcactctttccagctctttgcagatgtatccatgccatggggagaacatgaaaggctttcattagcactgacaacatcctgaaaactggcagaattacaaaaccatcagctttcctagtaaaaagagctctcaacatcaagtggtccaagctctcctatgtatttctttttttttttttaatactttaagttctagggtacatgtgcataacgtgcaggtttgttacatatgtatacatgtgccatgttggtgtgctgcacccattaactcatcatttagcattaggtatatctcctaatgctatccctcaccccttcccccgaccccacaacaggccccggtgtgtgatgtttcccttcctgtgtccatgttttctcattgttcaattcccacctatgagtgagaacatgtggtgtttggttttttctctttgcgatagattgctgaaaatgatggtttccagcttcatccgtgtccctataaaggacatgaactcatcattttttatggctgcaagtattccatggtgtgtatgtgccacattttcttaatccagtctatcattggtggacatttgggttggttccaagtctttgctattgtgaatagtgccgcaataaacatacatgtgcatgtgtctttatagcagcatgatttataatcctttgggtatatacccagtaatgggatggctgggtcaaatggtatttctagttctagatccctgaggaatcgccacactgacttccacaatggttgaactagtttatagtcccaccaacagtgtaaaagtgttcctatttctccacatcctctccagcacctgttgtttcctgactttctaatgattgccattctaactggtgtgagatggtatctcattgtgattttgttttgcatttctctgatggccagtaatgatgagcattttttcatgtgtcttttggctgcataaatgtcttcttttgagaagtgtctgttcatatccttcgcccactttttgatggggttgtttgttttttcttgtaaatttgtttgagttcattgtagattctggatattagccctttgtcagatgagtagattgcaaaaattttctaccattctgaaggttgcctgttcactctgatggtagtttcttttgctgtgcagaagctctttagtttaattagatcccatttgtctattttggcttttgctgccattgcttttggtgttttagacatgaagtccttgcccatgcctatgtcctgaatggtattgcctacgtttttttcttctagggttcttatggttttaggtctaacatttaagtctttaatccatcttgaaataatttttgtataaggtgtaaggaaaggatccagtttcagctttctacatatggctagccagctttcccagcaccatttattaaatagggaatcctttccccatttcttgtttctgtcaggtttgtcaaagatcagatagttaaagatatgtggcattatttctgagggctctgttctgttccattggtctatatctctgttttggtaccagtaccatgctgtttcagtcactgtagccttgtagcatagtttgaagtcaggtagtgtgatgcctccagctttgttcttttggcttaggattgacttggcaatgcgggctcattttggttccatatgaactttaaagtagttttttccagttctgtgaagaaagtcattggtagcttgatggggatggcattgaatctataaattaccttgggcagtatggccattttcacaatattgattcttcctacccatgagcatggaatgttcttccatttgttggtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtatattgattttgtatcctgagactttgctgaagttgcttatcagcttaaggagatttggggctgagacgatggggttttctagatatacaatcatgtcatctgcaaacagggacaatttgacttcctcttttcctaattgaatgccctttatttccttctcctgcctaattgccctggccagaacttccaacactatgttgaataggagtggtgagagagggcatccctgtcttgtgccagttttcaaagggaatgctttcagtttctgcccattcagtatattggctgtgggtttgtcatagatagctcttattcttttgagatacgtcccatcaatatctaatttattgagagtttttagcatgaagggttgttgaattttgtcaaaggccttttctgcatctattgagataatcatgtggtttttgtctttggttctctttatatgctggattacctttattgatttgcatatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctgcctggctttggtatcaggatgatgctggactcataaaatgagttagggaggattccctctttttctattgattggaatagtttcagaaggaatggtaccagttcctccttgtacctctggtagaattcggttgtgaatccatctggtcctggactctttttgtttggtaagctattgattattgtcacaatttcagagcctgttattggtctattcagagattcaacttcttcctggtttagtcttgggagggtgtatgtatccagtaatttatccgtttcttctagattttctagtttgtttgcgtagaggtgtttgtagtattctctgatggtagtttgtatttctgtgggatcagtggtgatatcccctttatcattttttattgcatctatttgattcttctctcttttcttctttattagtcttgctagcggtctatcaattttgttgatcttttcaaaaaaccagctcctggattcattgatattttgaagggttttttgtgtctctatctccttcagttctgctctgatcttagttattccttgccttctgctagcttttgaatgggtttgctcttgcttctctagttcttttaattgtgatgttagggtgtcaattgtagacctttcctgctttctctcgtgggcatttagtgctacaaatttccctctacacactgctttgaatgtgtcccagagattctggtatgttgtatcttttttctcattggtttcaaagaacatctttatttctgccttcatttcattatgtacccagtagtcactcaggagcgggttgttcggtttccatgtagttgaatggttttgagtgagtttcttaatcctgagttctagtttgattgcactgtggtctgagagacagtttgctataatttctgttcttttacatttgctgagtgctttacttccaactatgtggtcaattttggaataggtgtggtgtggtgctgaaaagaatgtatattctgttgatttggggtggagagttctgtagatgtctattaggtccgcttggtgcagagctgagttcaattcctggatatccttgttaactttctgtctcattgatctgtctaatgttaacagtggggtgttaatgtctcccattattattgtgtgggagtctaagtctctttgtaggtctctaaggacttgctttatgaatctgggtgctcctgtattgggtgcatatatatttaggagagttagctcttcttgttgaattgatccctttaccattatgtaatggccttctttgtctcctttgatctttgttggtttaaagtctgttttatcagagactaggattgcaatccctgcctttttttgtttttcatttgcttggtagatcttcctccatccctttattttgagcctatgtgtgtctttgcacgtgagatgcatctcctgaatacagcatactgatgggtcttgactctttatccaatttgccagtctgtgtcttttaattggagcatttagcccatttacatttaaggttcatattgttatgtgtgaatttgatcctgtcatgatgttagctggttattttgctcgttagttgatgtagtttcttcctagcctcgatggtctttacaatttggcatgtttttgcagtggctggtatcagttgttcctttccatgtttagtgcttccttcaggagctcttgcagggcaggactggtggtgacaaaatctctcagcatttgcttgtctgtaaagtattttatttctccttcacttatgaagcttagtttggctggatatgaaagtctaggttgaaaattcttttctttaagaatgttgaatattggcccccactgtcttctggcttgtagagtttctgccgagagaccgactgttagtctgatgggcttccctttgtgggtaacctgacctttctctctggctgccgttaacattttttccttcatttcaactttggtgaatctgacaattatgtgtcttggagttgctcttctcaaggagtatctttgtggcattctctgtatttcctgaatctgaatgttggcctgccttgctagactggggaagttctcctggatagtatcctgcagagtgttttccaacttggttccattctccctgtcactttcaggtacaccaatcagatgtagatttggtcttttcacatagtcccatatttcatggaggctttgttcgtttctttttattcttttttctctaaacttctcttctcacttcattacattcatttgatcttgaatcactgataccctttcttccagttgatcaaatcggctactgagtcttgtgcattcgtcacgtagttctcgtgccgtggttttcagctccatcaggtcctttaaggacttctctgcattggttattctagttagccattcatctaatcttttttcaaggtttttaacttccttgccatgggttcgaacttcctcctttagctcggagaagtttgatcgtctgaagccttcttctctcaactcatcaaactcattctccatccagctttgttccgttgctggtgaggagctgcattcctttggaggaggagaggcactctgatttttagaattttcagtttttctgctctgttttttccccatctttgtggttttatttacctttggtctttgatgatggtgatttacagatggggttttggtgtggatgtcctttctgtttgttagttttccttctaacagtcaggaccgtcagctgcaggtctgttggagtttgctggaggtccactccagaccctgtttgcctgggtatcagcagtggaggctgcagaacagcggatattggtgaacagcaaatgttgctgcatgatcattcctctggaagttttgtctcagagggttacccggccatgtgagatgtcagtctgcccctacaagggggtgcctccctgttaggctactcgggggtcagggacccacttgaggaggcagtctgtccgttctcagatctcaagctgcgtgctgggagaaccactactctcttcaaagctgttagacagggacatttaagtctgcagaggtttctgctgccttttgttcagctatgccctgcccccagaggtggagtctacagaggcagacaggcctccttgagctgcggtgggctctacccagttcgagcttcccggccactttgtttacctactcaagccttggcaatggtgggcgcccctcccccatcctcgctgccaccttgcagtttgatctcagactgctgtactagcaatgagcgaggctccatgggcgtaggaccctctgagccaggcgcgggatacaatctcctggtgtgccgtttgctaagaccattggaaaagcgcagtattagggtgggagtgacccgattttccaggtgccgtctgtcacccctttctttgagtaggaaagggaattccctgaccccttgcgcttcccgggtgaggcgatgcctcgccctgctttgcctcaggctcagtgcaccacacccattgtcctgcacccactgtccaacaatccccagtgagatgaacccagtacctcagttggaaatgcagaaatcattcgtcttctgcgtcgcacatgttggaagctgtagactggagctgttcctattcggccatcttggctccacccctcctatgtatttcttaaatctgtcctcttatctccatccaccttccctctgcctttactcaagtgctccttatcttctctcctctctttattgtcagagcctcctaaaaggtcggcctgcttccaatcaccctccatttcagttctaaagtgaaaatctgatcctgcttaaaacttttaagtgcctcactgtcaccatgagacccttcacaattcctccctgcatgtgcacaggccccttctgagtggacccctgggtcatgctctctagcctcacatctcgctgctctccaccttgcagtccaggctccagcaatgcagacccccctccaggactgctctcccaacctccctgtctttatttatgttcctttctcacaggctagaatgctgcccaatctcctccccacctgtgttctgcttatctggccaagccattcccaacctttccatctcagaaagcctccccacaccctgggctctgagaggtggctcttattgtgtgcagacagcaccctgggcttcatcctaatattcccactgcataataataatacatgtacctgtctacttcactagagtgtgagtttcctaagggagcaatatgtcccagttatctttttatctgcaatgaaagacggagtgaataaatgaatggtcaatcaacttgcgtttaacagataatgaaaccgaggctagactctacatataactcattggcaggaaagttgggactcaaactctgatcatgttctatcagagaaggattagaagtgtcatccttggatttaaaaaacctggaattaaaaagtgctagctagagtaatcagacaagagaaagaaataaaggcatccagattggaaagaaagaagtcaaattatccttgtttgcagatgatacgatcttacatttggaaaaacctatagcctccacaaaaaaactattaggactgataagcaaattcagtaaagttacaagatacaaaatcaacatacaaaaatcagtaacatataaaaatcggtaacatttctatgtgccaacagtgaacaatcagaaaaagaaatcaagaaagttatcccttttacaatagctaccaataaaataagatacctaggaataagtagtaagtagatcactacttaaccaaagtagtgaaagggctctacaatgaaaactataaaacattgatgaaggaaattgaagcagacacaaagtaatggaaagatatttcatgttcatgattggaacaatcaatattgttaaaacgtccatactacccaaagcaatctacagattcaatgcaatccctatcaaaataccaaagacattcttcatagaaagagaaaaaataattctaaaatttatatggaaccacaaaagacccagaatagccaaagctatcctgagcaaaaagaacaaaactgtaggaatcacattacctgatttcaaattatactatagagttatagtaaccaaaacagcacggtactagcataaaaacagacacctagacaaaaggaagagaatagagaacccaaaaataaatccatacatctacagtgaacccattttcaacaaaagtaccaagaacagacactggagaaaggatagtctcttcaataaatggtgctgggaaaactggatatccatatgcagaagaatgaaactagacccctatctctcaccatatagaaaaatcaaatcaaaatggattaaagacttaagtctaagaacacaaactatgcaactactaatagaaaacattggggaaactctccaggacattggactaggcaaagacttcttgtgtaatatcccacaagcacaggtaaccaaagcaaaaatggacaaataggattccattgagttaaaaagctcctgcacagtaaagaaaatgaccaacaaagtgaagagataagccatggaatgggagaaaatatctgcaaactatccatttgacaagggacaaataaccagactatataaggaactcaaacaactctatggggaaaaaaaatctaataatctgattaaaaatgggcaaaagatctgaatagacatttcttaaaagaagacatataaacggcaaacaggtatatgaaaaggtgctcaacatgattggctatcagagaaatgccaatcaaaactgcagtgagatatcctctcaccccagttaaaatggcttttatccaaaagacaggtaataatgaatgctggcgaggatgtggagaaaagggtacttttgtacaatgttggtgggaatgtgagttagtacagccactatggagaacagtttggaggttcctcaggaaactaaaaacaaaactaccacatgatccagtaatcccactgctaagtatatacccaaaagaaagaatatcagtatatcaaacatacacttgcactgccatgtttattgcagcactattcacaatagccaagatttgaaaacaacctaagtgtccatcaacagatgcatggataaagaaaatgtgctacatatacacaatggagtactattcagtcacataaaagaatgagatcaaccacgtgcaacaacatggagggaactggaggtcattatattaagtgaaataagccaagcacaaagacaaacatcacatgttctcacttatttgtaagagctaaaaattaaaacaatagaactcatagaggtagagaatagaaggatggttactagaggctggaaagggtagtggggtgagggtaggggggaagtgggtatggttaatgggtacacaaatatacttagatagaatgaataagagctagtatttaataacacaatagggtgactacagttaataataatttattgtacatttttaaataatcaaaagagtttaattggaatgttggtaacacaaagaaatgataaatgcttgagggcatagatatccccattacccagatatgattactatgcattgtgtgcctgtatcaaaatatctcatgtactccataaatatatatttatacctactatatacccataaaaataaaaaatagaaataaaaaaacaaacccagaatagtatgtgtgtaatgagaaagacaatatttgttaacagtggtattaatcacacactgcagaagaaatggcatgaatcaattaaggttgtgatttatatgcagtaagaacatggaaagcagaataattaaatttaaacttttctcgtcagctttttgaagagtctatttctagaaataggtgcatttacctgaaatgaaaactacctaggagcgcctgaacttcaaacccagttggtttccagctgtcatatatatattcctcctagtgaggaggatatatgtataaacataaatatatgtcaaatttaaataaccacatacattccttgtaaggtaaattcctaaagtttgaataagagttaccttagctcagaggttctcaaatttctgtgtacaaaagaatcacctgaattcttgttaaaaatggagatttttgggcctctgggtttctaattcagctgggctgtgatagagtctgagaaactgaatttttaagattgtggtgaaattcacattacatgaaattagccattttaaagtatccaattcagtgacatttagaacatggcacaatgttgtgcagccatcaccttgaaaattgcatttttaacaaatgctccactgctgcaggtggtccccagacagcgcactgagaataactatgctaagatgatgggtagaggtggcaaggaatgaatcatggatttctctcagattataacagaaatttttaaaagttagctttatcaaacatcaaaatctaaaaattatgcctttgcctttaccgatcaccaaatataatccaacaccaggaagctagattgttttcatggttttctgtactaatggactcaacatttattgatttgaatgcaaccagtattcttatccttataaagaagtacagggctaagtgaagtaaagtgagagaagtgggaaaaaatgaatcactgctctgtgattagttagtccaggtccttgggttataattacattattatagcacattattaatttcaacttcaggaaatgaaattgtcaataaacacagaagtctctggagaaagaaatgcaaattaggtttctccttatattcaaaccctcatctaaatgtaagtaaaactaattattctggtaaggcttaatacaggctgggcgtggtggctcatgactgtaatccgagcactctgagaggctgaggtgggtggattgcctgagctcaggagttcgagaccagtctggccaacatggcgaaaccttgtctctcctaaaaatacaaaaattagccaggcatggtggtacacgcctgtaatcccagctatttgggaggctgaggcaggagaatcacttgaacccgggaggcagtgattgcagcaagccaagatcatgctactgtactccagcctgagtgacagagcgagactccatctcaaaaaaaacaaaacaaacaaaaaaaagagttaatataaatacacaatggctgcattaagatgttgaggtcaatcactgttttcagggttgcagaatcggttttcctagtcttaactcatgacctagttactcaagagttgtccctaaccttaactcattttactccaggtcagattcctgtgcaggttcctggaatttagcaactacaaagatcagccatggtgacaagcatccagaatacaatggtgtcttcctaacagccactagtgctgcttctctggaccactaccctgcgaaaacaacaaacacagaacaagatgaaaccccatcacaacataagaaaccaagatggacagacagcttataatgccagaatcttggaaacatgtccagaaactacaagaccagagaagctgggctgaggaaataagaactggcccaccctgctttgcctcatgacacagagcccttcacctagattaagagaggcaggaagacagcctgagaagggatggcactaatttaagcagaggagaattattacctcctctacttctgtgtgcttagagatcacaactcccagaagacaataggcaggaaaagagaaggtctggcagtgctggcacactgtatcctgaggaatgtccccaaaaataaagccctgaaaatgtggagataggaagagtctggggttcttttagcctgtcaaagaattagagtgccaaaaaagaagaaactgtaactaggtgggtcaggttcaatagagtagaacacttaatgcctatatgccaccaggaactctgtgaggtgtatgcatcaacctgacctcaagctgcagatttgagaaggaatcaaccaggaaacagtgaccagaggccacaagacggccacacattctgtgtgtgcagatccttcaccactatactccaaggaagagcatctagctggcaatgacttcctataaaaataaagattttagaaaagttctattcagaaaggttcaggaaaaggatgggtcctgtgaacacaagcgtagaaatgcagtacaatgggatgaaataaatggaaaagaaaatgagatgcaaaaagacaactgattaggttaattgggttttgacctcaagtagatctgggtttgaattctggctttttcagttgttagctgtgtggccttggactaatcgcttaatttctttaagcggctcacactgataatcctagcattttgggagtctgaggtgggaggatcacttgagcccaggagtttgagaccagtctgggcaacatagcaagaccctatctttatttttttattttattttttaaaaagaagttttgatttcttcattggtaaatgggatcaagaaaccatttactatctcacagggttacattgaggtttaatgctactaaatactatactatactatactaacaagcttggaagaaaagggtactgattgaaacagagacagcattgcaaaaaaactaaaaatacaatcaacaataatctatgttggagatattaaggtgtaggattaaaattgcaaaagtgtctaaactggtaatgcagaagagctccaaagcctgagaaaaaggacaaaaaaaatgaaaaggatgagagaaaagctgaatcagggattcaacacagtaattaaagatatttttgagacataaatcaagtagaacaaaagcaataagctaaaataggaacaaggaaagcctcctggagtgaataatcatctcagcatgcagtttcagggctcactatatttcaggcaaaattaatttcaaaacattttaaagacacacacctagatataattcagcaaaaaatgtaaactatggaaataattttttaaatgcctccacaaaaggcttcagggaccagctaaacagaaagatctttccaacattctataaactattccagagcatagaaaaagatggcaaaactaaccacattattttatgaagtgagcacaaccaagacaacaaaacctgacacaaaaaagaaaccactaactctacttccacttctgaattgatgcaaaaatcctaaatgaaaccctagcaaactgaattcatcagtataataaaaatacataggcacggtcaagttggatttaacctaacaaagcaaagatgatccaagattaagatatctattaatatagtatcaaaatataagacaatcctatttaaggtgatcctcattttctcagtgagaagctccaaatgttactactaccagcttgaataaatatagatgtttatgaaatagtcaactatctgtttgaaagtacaattatacatacacatttgcaatcatataataaaggaaatatttatcttaaaatatttttccattctcaaatatcatgaaaaaaattgtattccacctcttcccatgcactcttctttctttctttctttctttcttttgaaacaaggtctcgctctgttacccaggctggagtacagtggcgcaatctcagctcactgcagcctcaacctcctaggctcaagcaatcctccagcctcagcccctccagtagcttggactacaggcacatgccaccacacctggctaatttttgtattttttgtagagacagggtttcaccatgtttcccaggctggtgttgaactcctgaactcaagtgacctgcctgcctcggcctcccaaagtgctgggatcacaagcgtcagccaccagacccagcctcccatgcattcttgatgggaatgttatcacaagagccacttagagatatttaatacagtcttccagaactagcatcttcacttctgtctgagcacatttaagcccacgtacaatacattaatccatatatactttcactttagaaaatcatttgtcctgaaattgtctaattgtgatctctagaacaaagacttgttttataaacttatgacttccaattcttgcaacaatgaggtcatttcccaggaataattttgctacaccagtgttacatgtcctagcatcttttttttaattgattctttctagtgacttctctaggcattcaaaaccagcactgatcaaaatgctatgccaggatattcaaaataaattaaattgagaatgactcccagaatctgagagatcttgttaagggctgaaatatgtctaccttttttttctgaagagtaagttttgggagaaaaacaaattttaacctttttcacagcaggacatacttagaaaattatagtatttggatagcacccacacaagtgaacaaggctgctcagggtagatgctattctggccctgcccaggctcctcagtagatcaatattgcagcacaccatatggaaagctctgctataccatgaggtcctatgagaacactgagatcatcatctgggaggcaggatactgtagtggagccaggctctgcctggctgcatgacctggggcaagttacttatgccctttgtgcttcagttctcacatctgcaagatgggacaataatagttcccagagaatccattatcatgaggattcactgaactaattcgcatgaaacacttagaactgcgtcccacacatagtaactgctcaacaaatgccacgttcaataactatgcctgattgaaagcaaaacaaaacaactcgtgaaaaaacaaaaccacaaaagtatgagtagaataccaaaatgaattcctcaacatgtcacctcacccctacatggtcatgttacagtaaaactcaccagatgacaagccctgacctggcacttggagtttccaatcaaattgttagatttcagccaagaatctctagggatttgagaaaaccaaaccactctcattaaagacagactataacaaagatataaacaaactgaaaaaaagaactcaaaaggaagagagataatgttggcaatatcagcaaactttaaaaaaagtatatacatacatatatatacacacacacataatacacatttaagagtaatggttaagagcacaggctttggggaaacaagttatgacatctataaattaaaaacagaacttcacaaaaaaggaattatcagaaaacacaaaagagttgctggtaattaacagacatggcagttaaaataaattcaataggaagcttacaaaacagtaagatttcccaaatactagaagaaaaataaagaaaacaggagagggaaaaaaaaaactaggaaaaattagaggactgacctggtgaccaaataataggagttctgtacagaaaaaataggggaaggtgggacggagggccacacaattccaaaataaatcatataagaaaattccccataacaaaaggatctgcattttcagattgaaagtgctctctgagtactcagcatgatgaataaatgatgatctacacccaaagcacatcacagtgaaatttcagaaaaccgtctctaatgagagggggaagttgcacatgtaacagattaggaaacagaatggcatcgccataatgaaaatgattttcaaaagtaatctctgagattatgagttttatttctcccttttctaatttgtctataataacatatataacttttactgtcagaaaaaaaatattttttttgagacacagtctcactctgttgcccagactggagtgcagtggcacagtttcggctcactgcaacctctgcctcctggattcaagcagttctcctgtctcagcctcccgagtagctgggactacatgcactcgccaccatgcccggctaatttttgcatttttagtagagaagaggtttcaccatattggtcaggctggtctcgaactcctgacctcagttgatccacccacctcggtctcccaaagtgctgggattacaggcgtgagccaccgcgcccggccccaaaaacaattttaataccaaaaaaatctaaacttggagacactttcatagatttaaatggctccattatttgtcttcataatgtcacaatctgtctctttgcagtgatacagagacccttctagttggtgggagttgtgaccatagaggatgtctgggttgtagagagagctgggaacaagccactctagggattcactacccagcagccctgtatatgagtgatgtccactcatacttactcagttagtgaacatgtgttttcaagccacagtcccagaatattttgatatctgagggaacgggggaagcccatcattctttttccttagatatatctttccatccacaattaccatgtctccactattgcagtttgcatttattttaataaggcaatgctaaccgctccaatttgtcttcattccacttatcaaataccatgtcctaggctttgccaagagatgattttcctattgacagacttacctgtagaaaagatgaacaccgtgttgttccagagcccactgctttttaaagctgcagtgacatttcctactgcttcatccataagggacaccattcctgcatagtgatgcctgttcttgtcttggataaagtcatatggcttcaagtattcctcagggacctgaaggggctcatgcacagactggagagcaaggtagagaaacagaggctggaaagaaagtttgtgcaaaccagttaagaggatattgaagcattaaatatagaaggataagacagttcagatttatgcattaataaaaataatatcaagacaacctacagaatgcattgaaagtatttgtgaatcacatgtatgataagggactcatctccagaatatataaagaacccttacaactcaatgataactcaactacaaaatgggcaaagaatctgaatagcaatttctccaaagaggatacacaaaaggcaataaacacatgtaaagacagtcaacatcatcagtcattattaagatgcaaattaaaaccacaatgaggtaacacttcacatctgttaggatggtgataatttaaaaatggaaaagaacaagtattggtgaggatatggagaaattggaactgtcattcattactagcaggaatgtaaaatggcacacatagccactttgaagaaacattttggcagttcctgaaattgtaaaacatagagttaccatatgacccagcatttccattcctagagaaatcaaagcatacatccacccaaaaacttccatgaatattcactgcaacattattcataatagccaaagagtagaaacaacccaaacatctatcaattgatgaatggataaacaaaatatggtatattttcagcaacatatggcaataaatgaaataaagtattgatacatactacaacatagataaaccttgaaaacattatactaagtgaaatcagtcaatcgtaaaagtcctcatattatgtaatttcatttatatgaaattccagaaatataggcaaatctatagagacagagggtggttgcctggggctgtaggaaattgtgggggagaggaatggtgagtgattgctaacagatacaaggtttttttggggggatgatgaacatgttttaaacttagattgtggtatggttgcataactgaaaatttactattgaactgtatactttaaatgagtgaattttatgatatgtaaattttgtttcaataaagatattaaaaaatataacaaaagacacaagacaaaaaattgaaaataaaagccagagtcccagaacggcctcaatggacctaatccaaacaaataataatatcagtaatggcaaccacatattaaatgttgtctacatactagacagtatgataataatttacacattctatctcatttaatgaaaccaccctatgttacagcaattttacagatgagttaactgaggcttagaaaggttatatgtgtgacttgtccaactccacattaaccgaagagcaatttcctattggaaaacccactattacgatatggatgtgtaccaatagaggctttagctttttgctttagctgaaaataagccctcatcttttagaagaggtttagtatttttaaactatattttatgagaaaaaaagtgaacaccatgccttgttagtctttgatgcaggaccaaacataagaccagtttaattcctgaaactaagaagtatgacacactgattctattttaccacttacatcaatttgcaacatttaacattagtggcataccaggtcagcttctcctttttaatgagcctttctgaaggcattctcttcatagtgctacagaattctttaatgagttgaaaagcctcaaagagacaacaactagtttaacccaaaaataaacgtataattctgttaaagtatttgaggcatttaaatctcataaatgaatgaaaatggttagaaacagactttggtgggggggtggtgctcatatttcattcttcattgttgacaagttgttttaaattttatattacacatccttgtaatgcaaaaaggagtatccatacatagagctcaaatagaccccccaaaagtttatttattgttcaggtctttggaactcagaaatacgttttccctaaactcacaaagttaaaaatagctgctaaatgtcaaagtcgttgctttaaaacctattaaactaaggacgcagctgatggagtgaaaatgatgataatgtagaacccgtacttccattatttccatgggaaaacattccaaattcccactccaaaagtctattctataacctctgacaccatttcagttctgcctctgcttccactcgacacacatacaccttctactccagctgcatggtcatgctgaagcgtctatgttcgtgtagaccatggtgcaggacatcccaacagatgccctgcctgggggtgatgaaggtcttggctgcgatgtctggagggaagaacgtgcaggtgcatcgctgacctgacagtgcagtatgggtctgctctgggtactgctatctgggtcttcagcactagactgagccaactccagccaccagccaaggtccagatggggataggattaaaaatcggaagtctacaacaatttgcagcccacgtaaagttttaaaaaaaatcaggaaatatcacatcgatctgtttttatataaaaaaacttttttggaaaaatcagaatttctgactactctttgtccacactccatctggtaacaaaaggctggagtatgagaaacaggggccccatccccctcaaatgctatccaattttctagtttcccactgttctacataaactgcttcacttctttaggttagcagcctggcccttgcaaacacgagattttgtgactctgatctggactcttaacagtggcagggggcaggggatacagtggggagagagggggcccacagcttaaggagaagatgttctcatccaggtcattagcagcaacatggcaaccacctggcgaaggagagaaaggagaaagagggtaggtgattcccagccagcaattgattactaaaggcaatggctgggaaggcggacaggggagttcttgaacaatgaccagggaaaaaaagatttggggatcattattaaaggttcttataaatattcagtatagaaatcattctactcactttgttaaatatggtgaaaaataatctgaaaatctttcctataattattccttagtagctaaagacattaccatcacttttataaaagaatataaattttcaggaccctctaaattatgccaaggggaaaattaagtcctggagactgtgtcacgtagcatgtttgcaacttctgtttcttagattatagagtaactctcttccttattgttcttcttctgtaaataactaggaaagaccagagaccaggactcctccccttcttattgaagatctttgttatagattaaccacctcctttattgtcctgtacctaactcagaccagatgacccaaaaaacaccatgactgttacatcttcagtgtggaatgttaaacatacctttcccaaaagaaaaccaccaccttgactaatcagatcattgtaattatgcattaagccttgtacagaaagatgttgaaattcttttaagctcccctaaattttgtctatgtaagtgatatggtttggctgtgtccccacccaaatttcatctttaattgtagttcccataatccccatgtgtcaggggagggacccagtgggagttaatggaatcatgggggtggttacccccatactgttctcttgacagtgaataagttctcacaaggtctgctggttttataaggcgcttttccccctttgcttggcacttctctctcctgctgccacgtgaagaaagacttgtttgcttccccttccacaccattgtaagtttcctgaggcctccccagccatgtggaactgagtcaattaaacctctttcctttataaattacccagtctcaggcagcttttttttttttcctgcaaaaaccctcagctcactggagggccagtggaactcaggcagttctttataacagcgtgagaatggactaatacagtaagaaatcccaaacttctacactttgaaacacggacttccattctttggaatctgtgcttcccaagaggccatccttaaactctgtacttgaataaactctctttaaactagattctgatccttttgattattttaagttgacactcttgaggggttaaaaataagaaactataccagtccatgtcggtactatagcccatttcaagaggtcaggactgatgcacattttagatatttccatcccatactacaaaaaataaagtttcaacactcagaaggtgaactttattcatgaaatattataactcattccccaacagtagtaaatgtgaaatatttctatactatttttaaattgaaaaaagagaaagagtagtgtttttaatactatatggtagcctagtggaatgaattaactaggactccaaggttctccaatcacagtgaggaccccacctgcagccactattcctaggaccctgcctgtgaacagctgtggtcaattttcccactcctgccaaccagagctcggctcactgtcagcctaaagccagcagctgccatcactggagcctgatctctcccctgctttttcttaggtccagatccctgttctcatcaactgtcacagttactgccttagctccaaccctacctgtaaccctttccagtgtcttgggaatgtgaaatgaaatcctaggcatgaaatcattactaaatatctaagtattacataaaagcaagacattatcacctagagctattagcatattcatgtttgagatattgggggttcttttccctttatttatgctacatggttcctaagatatatactgtaaatatcctcaccatgctaagaaaacttatttcagtgaggaagaaagtcttattttcatttctttagtgtattctcctaatttaaagtataaatgaaaaaaaaagcatatgataggttttgaaattgtttttctttgacttctaaattaagacattcttttccaaattgtgtcacagaaaagtaagagtcttccactagaaattaacattttctttaagaagcttctagtagatcaggtgtataacattacatttgcttccattctgcaaagtgctgacatgggggtgtttttttgtttgtttttcttgagatggagtcttgctctgtcacccaggctggagttcagtggcacgagcttggctcactgcaactcttcctcccgggttcaagcgattctcctgcctcagcctcctgactagctgggattacaggtgcatgccaccaggcctggctaatttttgtatttttagtagagatggggtttaactatgttggtcagggtggtctcaaactcctaacctcacaatccacccgcctcggcctcccaaagtgctgggattacaggtgtgggccagtgcacccggctgacggggggctgtttttaaaagaaagatattttatgaatatgttactttcagtctgtagtgtcactagtatggggaattatcctgctgaaaaagagaaagaaggttccttcttaacatatgtgaaatggtaattagcagtaccttcctgagtccagcatcagcaactgtgtttcagttatgaactgcctccaaatgcttttttcctcttaagtgctttttaaaataggcacaattttaagttagcctgtggattcttcatgtggctttctttaatgatttttatcttagaacaagttccttatgctacaatctatatatagtacctgagaaattagcccagaattagattcaacatcgggataaaatcgtgaaaagctcagctcctcaaactggtgagttgcatcattttatacagaattgaaaatgtaaacatgtattagctgtcttaaacattcttgggttacagcttgactattgattatttcattcacttatgtctatgactgaaactttcctttgaagatactgggaatgctggatactgctatagcatgtttcagacacaataggaaaatgaccatcctctcatctggcaatttccaaacagttacctacgaacagcggctatggtaataacactccttccatggctagcaagcttttagggcctcctattgtcctcagttccgtgttttccccaccaccctagttaagagagcccacccacaaagatctattatttcactccagttgcttcctcttatctgcttaatgttatggaaccctgtgagggaatattccatcgttcttcagtaggaatgaatttgtattgtgggcagattacagttgttgcacagattaaggtatggcagattgtgaacctgtaataggtagctggcttctgcttgcctctccatatttgagaggaatgccctgaatgacccatccgagaatggctgtcactgcaccaggtgtcagtgatgactgcacattagaatcactggtaggagcccaggaggaggaataatgaaacaccaatgattgggtcccacctcagaccaatgaatcacaatatttggcatcagtatttcttataagtttcccagatgattctaatatatggtcaggactgaaatcattaaggtgaatcatgagctgggactcagaatctctggtcttggatattagctgtgaactagggaggctgattaagtacatgaggtctggagtcagagagcatgagtttaaattctgattctgactctcaatagctctgtgaccttgaacaagttacttaacttctctaagccagtttgcttatgtgtaaaatggtggctccctcaaagaataatacacagttctcttaagactttaccttgttaagtgttaaggtgcatccataaaatgtcaaatatgtagaagaaaactgaggatttaagccaattacctagcaactatttttccaattatctgaatatttgtttagatttaaatttaaaatctgtgtatttccacatatttgagagaatgttcccatttcttcgtgttccacagaaagcatggttgcttcaagatatcagcataggagagtgatcgccaaaagtgggacgcagctgaggacagacacctctatctgtgttttcacttctacatgtgctcgatttttttttttttttttttttgagacggagtcttgctctgtcgcccaggctggagtgtagtggtgcgatctcggctcactgcaagctccgcctcccgggttcacgccattctcctgcctcaacctccagagtagctggactacaggcacccaccactgcacccggctaattttttttgtatttttagtagagacggggtttctattattttttaatgaatgtcaggagttgtataacatttgatagtgtaaatataatttgaagttcgaggtaaagttgtcttctgaaagattttaccttagcttgtggaagtcaaataaggatgccagcaatctggcatttaactcattcagggaagatttccaatactgagttcaaacaggcagaaactggaaggggaaccagcagccacataccaagtccaaacaggtatgtaaaccagaatccacacggtgatcttcttatagtttagatatttgaccctcctccaaacctcatgtttaaatttgatccccagtgggagcctaatggcagctgtctgggtcatggaggtggatccctcacgaatggcttcatgccatctttgcagttataagttctcactgtattagttcctgagagggctggttgttagaaagagcctggcatctctctctctctcctctcctgccatgtgatctgcacacgccagctcaacttcaccttccattatgactggaagcttcctgaagcccttacccagaagcaaatgctggtgccatgcttcttgtagagtctgcagcaccacgagccaaataaacctcttttctttataaattacccagcctcagctattcctttatagcaacacaaacagactaagacagacctgcaccaaggaccttcaggcattgtcaaagaggcaaagtgcaggaaattggaagaaccagggagcactgcatattctataatttgttgtgtcagggtcccactgaagtattatttttatgggtgttcttaatgaagccatattttgagcccagtgtctgacaatacaaatatttgttcccatttcaaaagcatttataagctaaatccagagaacttagcttaaactttacctcatgaagttaactctaggttaacaaaataatcataataataagattattcatgtgttacacaaaagcatcagtatagtaaatgtgaaaaataagctcattggtataccaggtatatggattagaagacccaatattgttaagacatccattctccccaagttgttctatagtttcaaatataaatccaagcagacactttgggcaggggggagctggcatatagaaattgactagatgattctaaaattaacatggaaatgcaaaagatctagaatagcaaaatattcttgtagggaggaagtacaaggttagaggaactgccctgatcccaaaatttatggatcccttaaccaaaagtttgtcataataaagcctcaccttacacctaagccaatcattttttaagtcattttattaattactcacagcacatgcacgtaatataccaaaatttttaaactatatttctattgaaatactaccaacatagtattcctcaaagtgtgatctggggaccactcttaagaatcaccttttaagagtttctctaaaatgctgatgtacggatttctcccacgcctaataaatcacaccctagaggtgggctccaggaatcttcctttttaacaagcttcccaggctgattctgggatactgtataatttgaaaaggacttccctagaatttattagatttttccctaaacaacaatggccttttcctacatttgtctgaaaagacattagtgtaacaagattttgctatcagtaaatagaagcaaaacttaccttctctggtggatggttagttatgagggctatagcccttttggtgaatatgtttgttgaatacatatttttatatcctgttgcaacttcttcgccatctcgaaaatcaagagcacatcgtgtgacattcagagcgtcaattaatgtacagcgttcatgggaataataatcttcactacccaggagatatcctgcaagaatggaagacgaaaatagtcagcatagcataaaacttgttaaacaaactaatgtttcagcatttaattgcctaatgcaattgattacccgtgacgaggctaatcaaatgacaaggctaatcagcaccatttctcaacatgtctatatctggtggcagaaggcattaaaacattactgcataaaaactcaaatctattcctcattcgcctttagaatataggcgctatcatgtaacactaacagtttttttttttatcagagttgaaactcagtaagggtgataaaatctcaatccttcaaagctatataatggtaaaaataatgtacagttaatgtgacttgttacaggtttttactctaaggtgatcacataaatgagtgcaggattcaaacaatgtttgttgttactgatgttgcgagactggcttcaaggttatttacagaagtggttctaggaagagtcatctttagtcagatgctgacacccactggtgaaagatacaaacctttcctaatagaggatctctagacataacagagccaacagatcaaactaaagtgagcactgaaataagacttttctacctaaaatgatctcaatttcaccccagatttaaatggcatcaacggcctatcccataatttagacttcacatggaagaaaatgggttttctcaaatatagttgtttctgcaaatgttccatcttttctatattttaaaatattatatttctatattttaaagtattaaaataagctgtgctacgtatgattccacttgtattaaatgcccacaacatgtaaatctatagagacagaaaatagattagtggctgcctagggctggagggactagggggaaatggggagtgattgctgaggtggatgagtttcttttttggggatgataaaaatgttctacaattggattgccatgatagtggcacaaccttctgaatttattaaaaatcattgaattgtacactttaattgggtgaattgtatgatatgtgaattatactttgataaagttattaaaaagaaatatttgctagactcttagctatctcctgacatatactgcttattaaccttaaaatgaggatgataaaattgacctagctctttcttcagtcctgaactttccctataatgaaaattaagagctttacatagtttatataataaatcaattcattttaaattaaattctccttttctatgactcaataaattcaagatcttgaatacaattaatactttggtcttaaaataacttttatatggcaatcttttctcctatgtatataatggaaaacgaaatacaaagtacttgttaattaatgtgtaacagagaaagaaatgtatccataaaaataatttcagcccttacatgggtgattagaatgtcagaacactggaggtctatttaaggtttttaataactactgggcattaaagcttgaggaaatcacttcaggttctttaactgttaagtgtgagctgctttctatcagttagcagaatataggacagatacacttcattagcaaaggcatgaactacaaatatttaaaagataatacagataggagaattccagaaataaaactattcacatacttggcaaaactaataccaagcaaccatgtgacaatcacatgaagcttttcttcataataatgattcacaaatttgaacttcaatactgagcctaaagatgatggcagcctatgcttttgggggaaaaaaatagaaaatgcttcttgaacaaccaaatcttctctgatgctttatgtaccagctgcattgagatataattcacataccacacaagtcactcatttaaagtgtaaaagacattggtttctagtgtattcacaggcttgtgcaactatcccaccatcacctgatttttagcaaaagagctgagatgtaacagtgagaagagctgtgtggtcatcataaccttcttggctgcaagtctcccttcaaatgaatttggggtgtgtgttcatctaaatccaggttaggcttcttaattctcataaaaggatatcatttctaccttctgtccagctgaatttttaagtacctaacttggttttaataaacaattcaaaatatctacagcccatcctcttcccagagtatagatattgactcatcttttagcaaaggcctgattgaaaaatttctaaggatgtacaggctgtttgctcctctagaatttccaagatgacaaagtgatcttacatcaagtctaattttaacagctatttgaggtactgagaatacatccgggtccatttaaaaaaaaaaaaaaaaaagctaagattgagtagtgaggtctgctggtggacctggatgagagtggggcacacacaccctcctgtctgacatccttgcatcttgattttaaccctgaatccaatgaggcattacagagccatgtgcttcagctgcattgttttggcccccatataattacttttactgaattgcactttggtgctctggccctagcttgaacagaagaaaatacctcaaaacatctacaagaaaaccacctaacgtattattaaaatgacatttttaaagatgttgtccaccttaccttctccttctcccaaaggagaaatttctgtcaggcctaagagccagaaaatgcttttgcttttcctgaacatctggtttccatttatcttgtaaataatgtaactcttatagtcttttcctttctttctccctcttcggacaaataaatttcaaatctcaggctgggcgcggtggctcacacctgtaatcccagcactttgggaggccaagatgggtgggtcacgaggtcaggagttcgagaccagcctgaccaacatggtgaaaccctatctctactaaaaatataaaaattagctgagcgtggtggcacacacctataatcccagctactcaggaggctgaggcaggagaactgcttgaacccgggaggcggaggttgcagtgagccgagatcatgacacagcactccagcctgggcaacagagcgagactccgtatataaaaaaaaaaaaaaaagaaatttcaaatatcagagatgaatatgaagacagcctagagccatgcaacttttctgtaatttgatgccattaacctattccatctttttctactcatcctgattatttaatcctgtttaaactttctatgttcaatatgtgttcctttttggctacggagggttgtaaataaataaatgaacagatgggaggtaggtaggtagctaaatagctaaacagatagctcactataaaaagaacttgaaagaaagatatatagctactggcaagatacacaggttattaattcaggcacaggttattacaggtttaaagagggcatattttaaaacaaactctaggtttcacatttagtttcatagggctatcaagtttataaaatacttattattatttcttattatccttcttattaccatttatttggcctcctcattttcctttgttttttaaaacctatcttccccaactttgtgattgcaaaaacagatttcacaggtggaagaatgccaatggaagagtcttcccccacccccttcaaaaaaaaaggaaaaattgtgaatacattccacagggagaaaaaaacacaccaaacctttgtgaaggaaatattcattttttattttattattattattattattattattattattattattattattatttttgagacagagtcttgctctgttgcccaggctagagtgcagtggcatgatctcggctcactgcaagctccacctcctgggttcatgcccattctcctgcctcagcctcctgagtagctgggactatgggcaagtgccaccatgcccggttaatttttttgtatttttagtagagacagagtttcaccgtgttagtcaggatggtctccatctcctgacctcgtgatccgcctgcttcggcctcccaaagtgctgggattacaggcgtgagccaccgcacccagcctggaaatattcttacattaggttttgccaggcattaaaaaaataaaaaatcaatccatatccctttttggtaataagggtctctgagagtacagcggtctccaacgtggatagtaaactcttgcaaggccctaaggtggcatttagaactccaacaaaggtaatgggtttgcccaccataaggtcagcacagagccctgtttacagaggtaacattagaaagcagccccattacagtgccgactgattcactctgtgttcaaatatccagttctttcatttgattgcacttgggtgtgttttatgagatggctgcagttagtctaagttgttaaagaaacatgtgcatttccattaccaaagtaggtatcaaatcctcggcgggttggaaggcattctttccggtacattcccaggtgccattttccgaccatatgggtagtataacctgcttcttttaggagctggggcaggagtttttcatccagaggaacacagctgggctgacagggccagattatttggtgctgtaaacctgtacggatcttacagagataaacataaaattatagattaatgacattgaaatattgtgaacaagcagataaaatggccttctaccttactgatcatatctgttgacttggatgtttaactctattcctgtactggcttgaggatatttctgaaaggcagaattctcttattcaaatgaagtagtggacataaacaggatttgaaagacaaataaaaccattccaacgaacagatattttcaatatttatcaaggcactatgttagaaaccattaacttgttactttttgcctcaaaaaaagtagcaataatatgtggtgtgaatctaacaagaaaaaagcgttccaattttgggcacacaagaagttggtgtttgattagaagacacttctgtaatcttcgaaaacttggtgatttttttacaagtggttttgtttttgtttttgttttgagatggagtttcactcttgttgcccaggctggagtgcaatggcgcaatcttggctcattgcaacctccacctcccaggttcaagtgattctcctgcctcagcctcctgagtagctgggattacaggcgcccaccaccatacctaactaatttatttgtatttttagtagagacggggtttcaccatgttggccaggctggtctcgaactcctgacctcaggtgatctgcctgccttggcctcccaatgtgttgggattacaggcttaagccaccgtgcctggctgagttatttaacagtataataaaacgattattgcattttttattctactttatgtaaatcattatctcaaaagagagtgttcaactttttcttataaaaagcggccatctgactgctgcttgggagtggctcacacaagtatgcccagggcataaggtccatacagcaactaaactttaagcaatgaccacttcttaacttttggtgtaatattgagtagaatacccacaattatatgaaaaggatattaaaatagccctcccttttccaactacacatctttgtggggccagatttttcttcaacttttactaaaaataatatatcataacaggttaaatgcagaagcagatacaacaacctagcaaacttctattagtagaaaagatgtacaaaaaatataaaacaatgccattcttctcacttaactatttggttttgaaaaatagagcttttttcataagttatttatgttaatatagtgggtttattactatttttcattgaataaaaaaatttataatttgttttaacttatggggcaaattttgaatggtaacaacccatttaaatctatgctccctggggtcctcaataatttttaagcaagtgcaaaaccctaagaccaaaaagtttgagaactgatactctaatgtccaacagtgatcattgccatgaggaaaagtaaagaaggagagggagacagtgacagaggtggcacttgtgatagagtggcaaaagaaagcttctctgggccaggcggggtggcttatccctacaatcccaacactttgggaggctaaggcaggaggctagcttgactccaggaattccagaccagcctgggcaacatgccatgatctcatctctactaaaaataaaaatagaaaaaattagcaaggcatggtggcctgtgcctgtagtcccagctaccaaggagactgaggtgggaggatcacttgagcctgggaggtcgaggctgcagtgagctgtgatcataccactgcactgcactccagcctgggcaacagagcaagaccctgtctcaaaaagagaaagaaagaaagaaaccttttctgaagaggagatatttgagcagtgaccagaataaagtgaggcagtgagacttggagaaatccggggtaagagcaatccagacctaaggaataaaaacttcaaaggccctgagacctgagcttactagacaagttcaaaaggcccgcccagaacccagtttggccctgtcacagctcttgtgctggtgggtgccactgtagcccctgctgcggcatgacagggtatccctccttgtctacccagtcccacccttccctaaaacttaacacctcctgcctccttgtcctggcttagccagggagatgctcttctttgtagaaagtgggactggggtctcaaattcaactctgcaccagacaccagccttccccagccctgggagctcttgatttatagaataaacaggctctggggacacaggaggtaagagtgccagttctcaacccaggccacggctggtcccttcatcagctataaggtggagagcaagaaacttgttgctaacaaatgatttttataagtgtttgtgagtattttatttgccttataatttaaagtggaatagcataaggctcagaggattaaatcccatcctggctttatcacttatgagctttgtaaccccgggcagtaacttcattcagtaactcactaacttcaataactttagtaagttaggaattgcacctgctattgctttactgcatgatctctttccacatcctcctaaaagaaccacatggaatatcttaagtgttaagttaaagtgggtttatcttgaggatgatagttaagttcactatcttgatgtggtgatggtttcacaggtatatacctatcaaagtttatcgaattgtatacttgaagtgtgtacagttcattgtatgtcaatcatatctcaataaaactgtttaaaaataaaagtgagtttaagtttcctactgagattgttatgcctctcctagaaataattagacacctatctacattgggagatgtgtcagataccttctgtttgcccttcaaatccacgctgctttctcagtcctgctctctgccctaggaggctgacctatgaggatcaagtcaaaggacacttgtcttcaggtttctgattgggcttagccaatggggagccctggcaggagtgagagggaaagaggagagtgcatggcctcacctgacacgctgcttagcctggctacatgagtctctctaccaaaggtcactctggaagcagacttctttctctatctgcctctctccttctaggttctggtaattggcccttcctttcttctcttctggtctaggagtagtaacagctccactggattactacactatccctagcattttgccccacacattcacaccttttaaaatggtccctttgtaaataaaccctccctaatttgaatgtgccacctctttccagctgggaccctgaatgataaggatgttataatatccaggctgggaaagggaagcattcctcttagcacatttgcacgcatacgtacacacacacacacacacacacacacaccccaaatcaaagtattctttccatggttaactctggaagcttactgaagagaaaattgaccctaggactcaaaaacttcatagcatatagtatgctaattggcaaccaggcaggataagtaaagataatattttatggaatccaaaagccccagtggagataaatgctctgcgaaaattcccttaaatggaaagctcatccatcacatgcagagaattaattctgattgctagaaagcactgccaagagatgttgtgtgatttggttttcctaagccgtgggcaccaagccaggtggtcagctgaagccttcctccattactgacaatcatatggagcagggaatgtgttcttttcagttcctgagaatttatttgacagagcatttttatggcattattgggaagcagaagccaaaccctggatgacatccaaaaacatgttttcggtctgttcaaacactatctgaaggaaggaagctgtaatgtgtagagaagcagtaaacaggcaaatgccgaactggttccaacccagcacttcagcacagaactacagagccacgccatgctgcaaggggcaggaaggcaaccgggcaccaataggaatcaaaagaaaaaaataagggtgccctgataaacacaacagaatataaaacaatttcattctaacacccatctgcaatgtccaaagaagtgtgtgtgaatggagaaggttctacatgtaatatacgaaagtccaaggggttacttccctatctaccatgtgtggctgtctcctcttcattaaaccaaatcttctctcaaaaaacaacttctcctaagattttacttgaccatcaaaaatcctctccacaaaggcaaaaggtctgcaaatccagtggaggacctggcttgttctaggctctttctgtgacataactgagagatccttatttacatattggttgcacgtaacaatttatttggtccagtgtgttattctgtcttctgcacacctaggagttccttgcagtatagtctcatgagcttaaaggagaaaatccaatctcttgctgggggagaggaagatggcagctcccatatcagaatctctttcaactcccctttcagaggtccagacagtcaattgattagttatctatatgggagttcagagcacaatatttcagctacactcaaactctcccaagagcgaagcaaaccactgctgcacagaaggcgatagatgctctttctctcctcacctcaacagtgttgagataatatcccgttgaacagaagggaggttctgtccagtcagtctggtctgagcaaaatgaactcatatcctcatgtgcccacatatgtgtgcaatacctcctgctgcagtacttaaaaattcagaaaaatgggccactctacccctccaccttatacaccagagagcctatgggaagcttcatgatcagaacgcaatcacagaacatgctggtggcaaagcaggagttcagaatttctagcctgtgcctcggccagtacacagcaggttttaatcacggtcaagtaacacttgtgccaccttagggtttattcctggagatgcccaaagaacaaatggatagtggaaaatctgctccctccccacagaagccatctgaaaagcagtcagctgcccatgctgctgaagccaagagcctacagacacgcattatgtgtgctaggggcctggctttgccatctggcttggcccttcaggactcgggctgcagaactggcccgtgtcactgacagttttaagagtctatttattttggtgttgattagtgaagagtgcaaatctctgactaaacccacaaagggatgttgtttgtaaaaaagaataaacaagtcagaaagggtttcagtgcctccctctgtttaaattataattccaaagaaagcccaaatggaaaaggaaggaaaatatgaagaaagctgagggaaaggaatctctcaaaaggtgatatgattaaggaaacgcaaacaaaagataatgaccagagagcaacagcttatgctcaaagtgattcctgaaatgacaaacctcgtaaatcaagcaaccagaaaatcctctaactccactggtcatattccacttagctccaaacttatttccttatttcctcatttgcaatttcctggcaggtaaaagatataaaatctggaattgtttctttaaaatagctgcaatgtttgcagaatgaggcctccgcactccccttccctcctgggaaaatgtctcttggatttggctaggcttaggaaggacacctggctttagcaaacccatgaaagtcaccccagggctctgctgtgctttagtgaggccatcttgcttgtccctatggagctaatgcatcctttgtttctccccctaaaggagcacagaaataaagacactgttttctcttaggaggcacccatggtctcaaggctacatggtcctctgacagctccctcctcctgtgcctttgccaggggatcctaggagcgcccaccttgagacatgcactttccccaatccctgcaccctgtaaacatttcttccagctctgcactctcctgtgccccacttctgaacctcaaagtccagggagaggcgaccactggcaggagtccactgagaggccagcaggcgaggagcaggcaggacagtgagggcgaggaggacaagaagcaggaaagggagggcatgctcaggcagagcgcctgcaccaccatgccctcttctgcctgcagcatgcatctttcctgctcaccttcttgaagcaaacttgaagcaaaagtcaaaaattacccacgatgctccagcacagcctccttcctatatttcctgtccaaggttccgcctcaggggtgagtgaaaagccgtgaaaatgtcttgtccatttatcagtgtgattaagaaaaatgtggtttggatcccttaagaatgaaaccttggagtcatctttcattgcttctattctgtgccaaggtttatggagttctggtggagtggcccccttggtacccaaggtaaggacattcccagttgaggaccagagttacttttcttaactattttcccagaagagtgttttcctttaaggcctatcactttcttactctttaatcttttcaatttcttaaaaaagaagtaaaggcattagaaatgacatggcaatttcaagcagtttaattaagatggtgagctctttcacgaactgtgtaaaagtgcttctcacatttgatcatttaattgtccaacactgagtgcttctttagcccagagacagacaaggcaatctaatggagaagtcagacctcagaaccacttatcacaattaaaatatgtattaggaataacaaaggtataatgaatattttgtatagaataaagtcaatttgtaagaatatggaaaattagtaatattaagttttctatttgaactaaatgcagtacacaaattctattagaaaagctggagaatttttaaattaatatttttaatcttgaggttttaaacaagggaaaaataaatataaaatcgattttctcatatgcataacatgcctccaagcgatatcaagaaaccaataaacaggagctgcctatgggaaggagggtggggagacaggctgaaaagatcctcatctacatgtttatattttttacatcttttatatttgaaggttttgaatgtatttcctggagatgattttaaaaacaggctacttttttttttttttttttttttttttgagacagagtctcactctgtcacctggactggagtgcagtggcaccatcctggctcactgcaaactctgcctccccaggctcaagcgatttcccgccatctacccccctgcccccgggtctcaacctcagtctcctgtgtagctgggactacaggcgcttaccaccacacttggttaattttttaactttttatagagatggaatttcaccgaggctgctctcgaactcctggactccagtgatccacccacctaggcctcccaaattgctgggattacaggcatgagccactgcgcccagccaagcttatttcttttaaagaaaaagagagaatatgtacaattaattctaattggaattacatgcatccaaagaatgccacatggcacttgactgtatttccttaaaatatgcccatttagaacactgttagattcgaaatgttctttagtgtataatagcctcaatgtcaccttactataaaaactgacacaaaaaaagttcaagttttaacactttttaatgggtgggcagcattaaacccagggagacccagcctccctcctctagctcttggcctgcctctggcaccctcattcactcagctaccatctcattcttacaacaagctcgttccagcctcaagagctttgcttctgttgctccttcctccacgttaaactttgctaggatatgtgcatggctgactcccttcattcaggcctctgctcatactacctccttgaagacaccttcctgagtcaagatcacttgacctactttattttcttctccacatgtattgtcatgctatttaaattcaccttacttgtttgtatttctttctttccccacttcccccccgcgagatggagtcttgctctgttgctcaggctggagtgcagtggcgcaatctcggctcactgcaatctccgtctcccgggttcaagcaattctcccgcctcagcctcatgagtagctgggattacaggtgcgcaccatcatacctggctaatttttgtatttttagtagagacagggtttcaccatgttggccaggctggtctcaaactcctgacctcaggtgatccgcctgcctcggcctcccaaagtgctgggattacagacgtgagccaccacgcctggcctgtttgtatttatttcacttccctcttggttactccttctccttacctcacccccttcagattataagcaccaagagattcccagagtacagtggcgtaacttgctgctcagtaaacatttgttgaatgaaagaatgaatgaatatatcacacttaatggtgatcgactgaaagcttcccctctaagattggaaacaagacaagtatgtccactcatgccacttctactcaatattgcactggaggtcctatccagggtaattaggcaagacaatgaaataaaaggtatctagattagaaaggaggaagtaaaacttcttctacttgcagatgacatgatcttgcactaaaaaactctaaagattatacacacacacacaattagggctaacaagttcattaaggttgcaaaatgatcaatgtacatatatcagttgcatttctatgtaacagcaatgaactactgaaaataaaattaagaaaggaagtccatttacaataccactgaaaatagtaaaacaggaataaatttaaccaaagcacaatgcttacacactaaaaattataaaatattgttgaaagaaattaaagaagacctaaataggctgggtgtggtggctcacgtctataatcccaacactttgggaggccaaggcaggtggatcatttgaggtcaggagttcaagaccagcctggccaacatggtgaaaccccatctctattaaaaatacaaaaactaggtaggcgtggtggtgggtgcctatagtcccagctactcaggaggctgaggcaggagaattgtttgaacccatgaggcagaggttatagtgagccaacactgtgctccagcctgggcaacagagcagagtgagactctgtcttaaaaaaaaaaaaaaaaaccctctaaataaacagaaagacatctcatattcttaaattggaagagttatattgttgaggtagtaatactctccaaatagttttacagatcactgaaatccctgtctaccaaaattccacttcccttttttttaatagaaatgtacaagttgatcctaaaatttatgtggaaatgcaaggggccgagaatagccaaactatctcgaaaaagaataacaaaattggaagacttgcattttctaattctgaaacctttgtaatacaaagctacagcaatcaagacagtgaggcactggcataaggataggcatgtagatcaatggaatagaattgtaagtcatacgtctatggtcaattgagtcttgacaagggtgcaaagggtgcaatgaggaaagaacactcttttcaacaaatagcactgaaatatttggacacctacatgcatccacatacctcaaattgtacataaaaatgaactccaaatggatcaaagacctaaatgtaaaaactgaaaactataaaatactataaaacatagaggtaaatcttcataatcttggattagaaaatggtttcttagacatggtaccaacaatataagcaaccaaagaaaaataggtaagttgtacataaaaatttgtaacttttgtttacatcaaaggacactatcaggaaagtaaaaagcaatccacagaatgggagaaaatatttgcaaataatctatctagtaagggtttatttaatagtatccagaatacataaagaaatcttacaactcaagaatgagaagataaattacccaattttaaaacaggcaaaggatctgagtaaacatttctccaaagaagacataaaaatgatcaataagacattaaaagatgttcaacatcattagtcattagggaaatgaaaatcaaaactacaattaaataccacttcctactcactaggatgacttgaaggctataatcaaaaagataatgacaagtgttggcaaggatgtggagacgctaaaacccacatacgttgctagtggaaatataacgtggtatagctgctgtggaaaacaatttccaattcctcaaagagttaaacatagagttaccacatgatactaagacagccaggtgggagggggtccctggcaaaactccagctggactgtgcactggggtggagccacggaggtggcgcctggcctctcctcttcctatggcacctgggattcaaacgggcaatgagggaagcactgtagcagggactctgacctttcagtgggtccctgtttcccccttttttccttttcacccaataaaaccctgctttactcacccttcaaaccatctgcgagcctgaattttcatggccatgggacagacaaggacctcatcgttagctgaactaaggagaagtcctgcaacaatacggcgtttcactcctacatattaacccaaaagaacttaaaaaatatgctgatacaaaaacttgtacatggatgttcacagcagcattattcataatagccaaaaagcgcaaacaacctaatgtccatgaattgatgaatgtatgaacaaaatgtggcatgtccatatcatggaatattattgagccataaaagggaacaatacatgctacaacatagatgaaaggacatctattgtattccatttatatgaaatgtccaaaataggtaaagtcacatagataataagaaggctggtggtttccaagggctggtggaatgaggaaatgaagagtgactgctaatagttgagtggtttctttctgaggtgatgaaaatattggttacacaaccttgtgaatgtacaaaaaaccattgaattggatactttaaaatggtaaattatataggatgtgaactataacttaatattgccagtgggaatgtaaattggtacaatcccttaagatgcaattttgcaatatttatcaaaattacaaatgcatctatccttaaacccagaaaattccatttctaggaacttatccttcatatacgttccaatatgtacaaaatgacatatgtgcaaagtattcacttcaccattctttgatatatcaaaaggctggaaacaacctacatgttcatcagtatgcaactggctaaataaactacaatgtatccatttaacaaaatattatgcagccctaaaagctgtgaggataatctttagtcaacaaaatggaatgattgcaaatgttaagtaaaaacaaacaaacaaaataggagctgcagatcagtgtgaagagtatgttaccattcatacagaaaaaagagagaaatgatatataaaaatatataattcagagcattatttgtctacaaacataggaactgaatgtctaaggaagtgtgtgtatgtgtgtgtgtgtgtgtgtgttttggtagattttcactgtaagcccttttgcagcttttaagtttttaagccatgtgaatgtattttctattttaaaaataaaatacggatttttttaaagatttcacaaataatgaatgaatgagtcatagggctgtgggaaggcccctagcctgagtgtagagagacctgaatttctagttcttttttttttttttttttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgaatttctagttcttgaatttaccagtaactacttaccccatctgctaattagtctcctccattgcctccaacctgtacccagtccctacacatatttcaccatagcatgcacatttaaaatagttcatttgtgagggctgtgaacaattaaatgtctcactataaaaggctgaattaagtaagttcctagcagcagaacaagtagtacacgcaatttgtaagatacactgtgttgggcaagattaatctttctaccagtagatggggttagtatgataggtatgataatgtgcatttgccaagttagaaactcgccctaatggacacaagagccttagagttaaattaatttagagctagacaaagtctagagttcagcccaactcctctgtttcacagatgtggaaatgatggccagcgaggtcacagtctgaccagccaagaccaaaacctacatctcagttcctaaccagtcctctttactcaataaataatttctgaaaccaaaaaaactaaaactcaggatttcatgagagtataaagtccagtcagtctaggcttgtttatcaacttgtgcttttcttttctaaagttaaataattatgggaaaggggtctgtaaatattaacttaaagcatgactgccaagttcatagatatgactcttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccagctaattttttgtatttttagtagagacggggtttcaccttgttagccaggatggtctcgatctcctgacctcatgatccacccgcctcggcctcccaaagtgctgggattacaggcgtgagccaccgcgcccggccagatatgactcttaacaacttccttcaagtaactcattttgagacagtcaaaaaattccttcattttattgtctaaaattatgcataacaaatgactcagaaataaaatctatttttattttacatggaatataggcaattcctaactcagaaatatgatgggttgattctttaccttgagatatttaggaatgacccaaatgtccaaaagtaatacagggattatttagtatgtatgaagcagtccttgggatgttatttttaataattttgagtaggcaatatggcttagtggttataggcatcaaccctagggccacgtgccctgggtcaaatcctggtccaacatatactagccctgtaaccttgggcaagtttcttaacctcttccagcatcagtttccttgttacagaacagagatgatagagttgttgtgagaatcaaatgagttaacacttgtaagtgctcagaacaataccagcatatagtatctgacggagactcctgagccttccctgaaatttctacttcattaaaagtggacacttgctcaccctgggtaacatctacttgggtctcatgaactctaagagaataaagtgggtgagaaaactggaggaaaaaaaatgtttggggaagcaaggctgctttagaatcagctacactgagaggcctctaaacctttcagagtgcccagcttctctactcatcctttacttcataaccatggggtactctaaatactaaagtttgttctccaagacataattttggtgactggtgggggaggatgttaggggacaaaagcaactgattacgggaatgggttttttattttattttgttttgagatggagtcttgctctgtcgcccaggctggagtgcagtggtgcgatctcggctcactgcaacctctgcctcccgagttcaagcgattctcctgactcagtctcccgagtagctaggactatagacgcatgccaccacactcggctaatttttgtagttttagtagagacggggtttcgccgtgttggtcaggctggtctcgaactcctgacctcaggtgatccacctgcctcagcctccaaagtgctgggattacaggcgtgagccaccgttcccggcccaggaatgggtttctgaagttggtatttgctttcctgtccaactctgttggaagggaggaagttggagaaatgaatggcccttccattcttttgcaatctgagttcagttctcttacttcaaagcaaatgcagaaccctttgggcaaacctcacctttcccttcttcttcttctttactggcacatccctttactcccacaaagtgtccagggtgagatttacacaatgtaggggattcctaattacacgtagcagccaaggtcagaaccgccaaaagtactaaggtggatggtgaagggaagcatcctttactcccatttctaaccttggctacagctatttctcacccttagcaacacccaatctttcctctttataaaagccttcagaccactgcgcatatctttatcacaagtaagccctcccttctcttgatcttaggaccacgtgaggctagggttgatctgacaggttatgcgaacacacacttgggagggcaacattcaaatatatatcccctgtcagtagcacagtaagctcaaaatatttttgttgagtaaacagcatatgtactctgtgaaggcatgcaggtggtatccaacagttcccatttactgtatttaatatggtcataataacttcagggtcttagaaatatgacaatcgtattcagattgaggggaaaaaaggccaatttcataagcccgggacgaccagtggatgcaggaaaagcacaacggacactgccttgaccactttctagctgtgcgattcttatgccaacgagcctttacaggcttcctgcctcgtctgtaaaacggggtaaaaacaactacctcatgcactgtttcaataattcactttaaaaacaacaaagtgctatgcaaatgttcttgatattcttagccatctaacatctatgcacgctctacatttatatttccttcgttaactgtggagccgttcctaaagggaagcttttaaagcgataatgaagatgctcagaagagttcaatacaaggttacatgtgaaaggaatgtcagcagcctaagaaaaatcaacctagcatcaggtttcattccaggggtgttgagaacctggaaaaaaataatctttggtgggacactcctaacctatcaccgctgggttcccacgggccagggtcgcacccacggcgagcaccccttcattttacctctcccctcgtctttgctcccagcccacgccctccccagcctcccacctcaggaccgctccgcctgccggccgcggcgcccagcacccggcattcccataaaccccttcgcccggagcttcagaaaacgaaagacaaagccacccgcccaacccggcggccggggcgcgggtccgcggggcgccagagccgggcatgcgcagaggccgcggcgggctgccggcctggaagagcgaggttggggcgagaagccgccgggacccataactgggtcggcggtccgagccccgcctgccagcgcccgcggcctcaagggccgggtaggagcggcagggcgccggcgaaaggcggggcgggggcggcgcgggcggcgggggcgccgcgtacctggtagcggccagtgagcagctggctccgcgacggcgtgcacagcggctgcgtgtagtagttgtccaggagcaccccgccggccgccagcgcgtccaggtgcggcgtgcggatgcgggagccgtggaagccgacgtcgttccagcctaggtcgtctgccagcaagaagaccaggtggggcggccggctggccccggcgcccgagcccggcggcgccaacaacagcagcagcagcagcgggaggacgacggggaggagcagccgccgaggtccggggcctcggggcaagctcgccgcgccgcgcggacccatccttgtccgcccgcggtcccagcgcctgtggcgccaccagccccttgtaccgctgatagaatgaggaactgggctgccggggcctgctccgccccggcgcgggacggcacccccagcgggccgtgggcttgcgaggccgggcgctcggcccccgccgcctccgacccgggcccccggctgctgtggcggaggaggagccagagacgaacccgcgggcgcccgctgcccggcttcttggaaactcagctgacgcttggagggcaccaaggcccgttatcttccccggcaattaaatttgcactgtggtttcctaaaaaaaaaagatgtgttctttaataacgcttcacaatttacaaagcatcttcacagcccgcgtctcctgtaaagcctgcaacaactctgacagttagacattataattagtgccaatttttcataagaaaaaagcttataaatggttaaacctctgactcagatcctgaaccatgatgtctagctagcaagtcatttctagcacaagagcccagcctgtggcaggtgggaggacggtgaaaaggcagaggtctaaatagcctttcacattcatttatgcgtagtgtacacccatgaagccgcttcctccccactagcaaacaggaggccaaacacacagtctgattgcacggtgccctttggaaggtgcggttactttcaag

SEQ ID NO: 395 - DNA, 70260 bp, Homo sapiens
tgaacttgaatccaaatgatttatttcagttttggctcttaagccacttccattgggaagaagaaactcccaggagtgacctttgagagctgagggttctcggggtggggcagtgtgaggggctgggccagtgtgaggggcaaagtccaacgggcatcccactcctgcggcctgggctttcccagctgatggggtgggggacacccatttctttagtcccagcccccagggaacggagcagagggcagagggagtgggctgcacccaccaggaagcctgggagtgcccttgctgggggctggggcagaggcagcccggcaggccctcagggaggctggggctgggggcaggggtacggttgtgcccgggtacccttaatgtttgagctgatgggggagtcagttgtccttgacagtcagggaaaggggccaaagggggctctagactttcccagcctggaatgacagaaagtgctggaaggcggggttagtgggagacaggccttcaggaccagcctcgggcaggcagcttggcattctcccaggcctggtctatggactcagaggtgcctgggcccagatctgcccgggagggcagtggctgggcttggcctggcaggggctgaatggacgaggtcagctggggccggtgagaggctggggaccctcagggtgagagcagcagctggatgagcttctggaactcctcgcggtgctcatagatgtagacctcggtctcccagagggcgttgaccagcactgtgtcactgacctcatccagcatgatgtccgtccccagctgggggttcaatctgttcgggccagggaggagggggtcaccctaggatgctcaggctgggcaggggacgccagctaggaccagggtgggcttggggaacagagcagacccttggggaagggaaagtccacactagggctgggaggggaaggtcggtgagtccgaccacgccagggcacggggccaagggctggggcggctgagccctcacctgaagtactggatgccgaccatctcgcaccaggcccgtgcccggtccacagcccgcccgtctggatccgtgcactggtgagaagcagccttggtgagtgccgggcccacaccccgcccggcccgcaccccgcccggccctgccctgcactctcggagccccagcctggggagccccaggctctttcgagtcaggctgagccacacagcagcagagcggctcgggcaaaaccccttcctgggactgcagggactgtcccagctgtgcaatcagaggggcagaggtctcagcagtgccctttcagggatgatgagtgggggaaagggtagcggctgagtcgacaggcctccatgtcccctctccctgaagtttccctccctccctcctctctctctctctctctctttctttctttctttttgagacaaggtctccttctgttgctcaggctggagtgcagtggcatgatcacagctcactgcagcctctgcctcttgggcttaagcaatcctcccacctcagcctcctgagtagctgggaccacaggcacacaccaccatgtccagctagtttttaattttttggtagagacaaagtctcattatattgctcaggctggtctcaaactgctgtgctcaagtggtccgcctgccttggcctcccaaagtgctgggattacagggtgagcgcccagcccgctctggagcctttgtccattctgggcttctacactgcgctatgtttgcagaaagggatccgcagctaaaaagcgtttgaaaacccccctgctggtggtcactgagggtccctgccccgcactgagactctgaactgtggactctctctccctccagctggctaaaggcgatggacagagccctgctgtctcctccaacaccaaaggccccacaggatgaggggaagccatcgacctgggctacagaccctgagggaagtggcctgggggaggggcccacactcacacagtccaccaccatcttgcccagttccttggccccaaaaacagtcttggccagctcccaggggttgctgggacggaagacatccacacaggtcacaggcacttgtggggacctccctgtccccagggagacaacgatggagagtttcttcaccttgttggcctgaccctgttgggaacaggacaggggcagtcagaagagaccttccacaggtagggggcacgaaggggagcgtcaaggggaggcccaagactgggctctggggcacatgagaacagggcaagaggtctctggtggcaagagcatgcctggcatgatttccagccagcctcttgcacgtgaccccagaacggctggtgcgggcatcacatgccatctgctcaggacagcatctgtgtaccaacaggaccacacatacaccagctgcaagaaggatcccgcccaccccatctgatgctggcccaagtcaagtcgtggccaggggaggaaaggcagacggtgttccttggtgttggtgatttgccaggtatttgcatcattacttcatttaatctccagccagtctgtggagagggcactgatcacccagtttgcaaatgagggctctcagcgaagctcaggccgggaagcagctgcaggggccacgtggtagggaagtaggggctaaggcttgaacctgagccctgggtgctgcctttttttttttttttttgagacggagtctcgctctgtctcccagtctggagtgcagtggcgcgatctcggctcactgcaagctccgcctcctgggttcacaccattctcctgcctcagcatcccgagtagctgggactacaggctcctgccactatgcccgcctggctaatttttttgtatttttagtagagacagggtttcaccgtgttagccaggatggtctcgatctcctgacctcatgatccacttgcctcggcctcccaaagtgctgggattacaggcgtgagccgctgcgcccggccgctgcctctcttatttgcttccgaacaagctctgctgccgatttgctggatgatcttgggtgatgcctcccactctgggtcccaggctccccatccgcacgcaataggagagttagactggctagtgtctgacagtctgacggtctctgccgcctgcaggaagcccgccctgcccgatctggcccctagagggcgcttctctgtctgcccagagcctctgctgcgctgcccaggacgccctggggcttcgggaaaccacagcagcaaggatgcagctcaggctcccggcagtgctgtgaacatttcacagacaacagcatgccaaggcctcgcagcctccccaggcaggcgctatgatggccccattaggtagctgcagtgagtgcaggcagaacggggacccccagaggcgccctggctccagggtctgagctcagccaccgcgctcgcccaccccggtcacccaccgcccgccacgccacagggcctcccctagcatgctgggtcctgccagcctctgctgtacctctgcagagagagggctgctgctcttcctccagatcactgattctgcactgctctgtccccaagggcctcaggatgggtcccctgttccatggagccctttccgagcccccaggccttttagcagaggcctcacggtcctccaccacagcaccggcaacccgtggggacaggcattcctgtgggactgtctatccacagaggtgagctcaagggcaagcatgtgtcctgtccccaggctggctcgagtggcacgttcatggtatgcatgccgccctccccactcatgcacacttagagcacagtggtcctcagatcccccttagcacagtgcttcaggcagatcccacccatggaacaggttccagtgagatcaatttgccctgtgtgcacatatgaatgagtgcgtgtgtaaaagccacctgctgtcctgggggtcggtccctagcatggtttgctgacacaggattggctccagggagcagtgggtccaggccctctggcctacggcactcaccttgcggatcaggtcctgattgtactcatggatctcggtcatggcatccagcgtggggttgttggccagcagcccaccgtccaggaagcgcccattgggtcggaagtaagtaggagctgccccgctgcttcgggccgcccgccacaccagctggtctaggggcggggaaggagggcggcccagtggcacaagggactggcataaaacccatgcactccagatctcagggtgtgcgtgttgggggctgggggtgcgggaagaggggaggctgggaactcttcagaagcaggacccacgaagccacactctctggctagttcgtcctggtggaaggcaggtacagctgaggactttccagggacttttctaacctgccaggggcctgacagctcccccgcaatccctgtcctcagccaataaagaccagtgcagcgggtgggctggtggcacggtgagggtgcctgatggcaagtgcacgactcccacccaccaccccacagcctctcgggccagtcgcttcccatggatgcatcaaacatggtttaaacctgagggctgagctggaggcctgaggttaacgttctggttgaaacgaggctcccggacagtttctggagcatcgtagttccggaagaggtggagttcagccggctgccggtcagacagtgtccctgtcagcatcaccctggagagaaatgaggcaggaggacggctgagccacccgcccatccacctttccctttccccacaattcacaccccagggccttgggtagcagagtgcccactccaacctctgttcgggataggtgggcttctccccgcaccatccccgcaaaacaggctctctccggcagtgctggaggagtgtcagattggtccaaccttgggggcacaattcagcaaaagttggtttttttgaaaggctaatccaatggaaaaacctgttgcaagactgataaaacatggctgttatctgttatcaaaatcaggaaagaaaagggggccgcaccaacacacactgcagacgttagaaaaaggagaatcggctgggcatggtggctcatgtctgtaatcccagcactttgggaggccgaggcaggtggatcacctgaggtcaggagttcgagaccagcctggccaacatggggaaaccccgtctctactaataatacaaaaattaggtgtggttgcgcatgcctgtaatcccagctacttgggaggctgaagcaagagaattgcttgaacccaggaggcagaggttgcagtgagccgagatcacgtcattgcactccagcctgggcgataagagtgaaactccgtctcaaaaaaaaaaaaaaaaaaaaaaaaacagaatattttgaacaactctaagccaataagcttaaagatttagatgaaatggacacattcctagaaaaacctcacttaaccaaaactaactcaaaaaggtatttagaaaccccgagtggtcagtctcacaaccactatagaaattaattccatcatcaaaaatcctcccaccaagcaaactccaggcctagaagaatttactatcaagttctaccataaattcaaaataaactattatactaactcttccaagaaaaataaaaagaggaaatatttcctcaaaacccaaaataggaaaaaacgggtcaagttcgcccacgagcgtggacacaaaaatcttttttttgagacggagtctcactctgttgcccaggctgtagtacagtggcgcaatctcggctcactgcaagatctgcctcccgggttcacgccattctcctgcctcagcctctctgagtagctgggactacaggcgcccgccaccacgcccggctaattttttgtatttttagtagagatggggtttcactgtggtcttgatctcctgacctcatgatccgcccacctcggcctcccaaagtgctgggattacaagcgtgagccactgcgcctggccaaaaatcttaaacaaaatatgatcaaactgaacccatcagaattctctctagagaaggcaccagtaagagagagtaggcctcaaacaggtatttgcacatccgacattgacagcagtcaatttacaactaaaatatccatcaatggatgaatggagaagcaaaacgtgtatccaacagacaatggagtttttcagccttaaaaaggaaggaaattctgacacacgctacaacatggatgccaagtgaaataagccagtcatggccgggcacggtggctcacccctgtaatcccagcactttgggaggccgaggtgggtggatcacgaggttaggagtttgagactggcctggccaacatggtgaaaccctgtctctactaaaatacaaaaaattagccgggcatggtggtgcacgcctataatcccagctactccggaggctgaggcaggagaatcacttgaacctgggaagcagaaattgcagtgagccgagatcgcgccactgcactccagcctgggtgatagagcaagactccatctcaaaaaaaaaaaaaaagaaagaaataagccagtcacaaaaagacaaatactgtatgattccacttacataaggtacggtcaaagataaaattgcaacaaatttaaagatgttaattggcttttattgatgaactgagagtcaggcaggccacaaaaccagaataggttcaaagaactctggcctgcaacgtggtcaggcagtgttgatgggctgaaaaccaaagtgaggtgtggagcttaattggtttgccttgtttgaatcaggtggccatctatgattgattaaagcttagctgttgtagctaaccagaactcagctatttgttacatgggtatacgcctaagctaactaggttcacttggcatgaatgactccatattcgtttcttctgttgggcctggtacagaatcctggtccaaatcaattatcccctaaaaattttacttaacagtacctggagcagttaaactcataggaagagaaagtaaaatggtggttactattttgagcatttctgaatgatcttttcatattttgaaaatgagtcctttgatggatgtatggattcgaaatcttttctcccactctgtggcttgtctttttactccctttatggtgtttttgttttatttatttatttggatggacccatgttcttaatggagtagaatttataaatattttttctttttatagtttgtgagtttgtttgtttttgtttttttttttttgtcttaagacagggtctcactctattgcccaggctggagtgcagtgatgggatcacagcccactgtagcctcagcctccggggctcaagtgatcctcccacctcagcctctcaattagctgggactacagccatagtgccaccatgcccagctaattgttagttttaaattttttgtagagatgagggtctcactatgttgcccaggctggtctcgacctcctggcctcaagtgatcctcctgcctcagcctcccaaagagctgggattacaggcttgagccaccatgcctggcatattcctatttttgagaagaggtagaaacttcagggtctatgcttgtatccacttctctctactgcccccaagaatagccatgatgtttttgaagaaggccaaggtggaggatctgccacccagacaccaggactcaccacacagcggtagttttttatgctctgtggtccgggcacagagacagctttccaaccagtggaacaaaacacagcctggagcagatccaagagcagagggatgcttgacccactgctgaggaagcggagggaaggacagacttcacagatggggctgggaaaaattggccaatcacgtggaaaacattaaattggatcttggatttcaccctcatacaaaaatcaattccaggttgataaaagacctcaatgtaaaaggcagatctagagagctttccagctcgacacaggagaatcgtgtgctgcttgggggcagcaaaggggtttatgaacgagaaataaaaagcacaaactaggctgggcatggtggctgatgcctgtaatgggaaaccaaggcgggaggatcgcctcagctcaggagttcaagactagcctggacaacatggtgaaaccccatctctacaaaaaatacatgtgttggcacatgctagtagtcccaggcactcaggcggctgagatgggaggactgcttgaacccaggaggtcgaggctgcagtaagccgtgttcacagcaatatactccagcatgggccccacagcaagaccctgtttcaaaaaaaagaaagaaagaaaggaaaaaatcacaaactacaagaagaaaaatatttataaatattatctacctcattaagaacatgggccaccaaaaccaaaaccaaaacaaaaaacaaaaaacaaaaacctagaaacaccacagagcagaaagacaagccacagagtgggaaaaaagattgaaggtccctggccttggaccctagggaagaccgcagaggggatgccgggcccctaagactgggggacactcactttcaaaatatgaaaaaatcactcagaaatgctcaaaacactcctcttggaacacaccattcatccagccccgaacgggatgcattgcttagtcctaggatttgggcttcccaaacaaatgtttcctggaaatgtgactttctccttcagtctgacttaaattagttcaagtcttgtaggccttaaattaaaggtaagactgaagccctctgattataacctagtagtccgatcctgggagcgagtgctgtctgaaatgtgagaaaatgtttagccgtgtcatttgaaaggccagtgggttccttttgcctgggcagcaaaaacccagcctctgcccaggtggtctcagagaagggtggcccaggctctctccaggcaagccccagacccctggccgggcagggcagagccaggcagggcagagccggcagggcagagccgggcagggcagagccaggcagggcagagccaggcccaccaggccacgcccctcctgcgctcagcaggtgtctgcatgcccaagtgagagccacaccccagccctctgcctccctgggaagggggttccctctgctcccctcaagcgtggggcgctcttccccctccctcagcaggacagggagccctctgtccccagggaacagccacagtgggcacagctgcggccacggccccagtgcgccagggcttacttgggtttcctgacgtccgtcatcttggtgtgctccccaaactcccgcttcaggaactcctccaggggccccgactcgtagggcctggagccccggaacacctcatccttcatgcgaaagtacatgccgcgcatgtaggccatggacttacctaggaacaaaggggtcagaggcggggagatgcagcggccacacgcagggctcccgtagaacagcctgcagagcgcctgaacgcaggaggtggcaggaggaagcgggtttaccgaggcctaagcaaacccaaattctgggcccttcctttgcaacctcccagacagacagagagaaacctccttccggctggacatggtggctcgcgcctgtaatcccagcactttgggaggctgaggcaggtggatcacttgaggtcaggagtttgagaccagcctgcccaacatggtgaaaccccgtctattaaaaatacaaaaattcgccaggtgtggtggcgggcgcctgtagtcccagctactcgggaggctgagaggcaggagaatcgcttgaacccgggagcggaggttgcagtgagccaagatgcaccactgcactccagcctgggcaacggagagactcaaaaaccactgaagccccacggctctgcacttcatcttgtattcatgattttgtattattttccttaaagaagagcccctcaagagtaaaagcttataaaagctagacccacgttgtttgtcacagaaaacaaggaatagccctgtcctttgagccttcagaacagacagggccaaggggccggctgcacctccaggaaggagaagctgccccacttcccccgtgaggcagtgagttccccagggccagggatgtacaagcagagggtagctgaaaggaggccatctgcccacaccggaggatcagccaggagacctctcaaatcccctccatggcccctgggagtctcaagaccccggatggggaagaaatggtccctgaagaaggacgtggcccttttggagaagaagctaggactctgcccagtctgcctgctcagacctcgtgcccgcccttggaccctgtggaagaccagagaggggatgctgggaccctgaggctggggtagagagctgggcacactgctggagacccagtcctgactgcccaattcactggctgatcctctctggttctcagtttccccatctgctcaccccgcagggctatggtgagaatcatcaaaaggaaatgaaataccagtcaataaaccgccgtggacactaacgtcccggcaacttgacagatgactctcctcctccgcccatgggactctgtccccagcacctcctggactggctgagccccctgctcctgaggctggggtatgcctggctcagctctgcatccccagcatccaacacaggcctggcccacaggccctgatacccaccctagggtggggagtcctccccgggcacctccaagactttgcatgaccaggatccagatgtgggggcgctctggagaaaatggaatctgaccagcacaggggcaggggcaccagtcagacatgttgagtcccaggacaatgtccagggggttggggggagctgaggaccctgatctggcagtgcccctccccacctgtcagcacctagaagctcagacagctccacagaggagccgtcacaacactgaccacccggctatctgtccagcaagccaggcgccttcgcaaagcggcagtgaaaggagactacacagtgccctgtggcctaggaggtgccaggctgggagtctaggggactgtgctccagcccagcgaccccatggatgagctatgtgacttcacgtcatccctccccacctgggaacttaatttcccagtaaaatttcccagtaaaatgaagtgtgcaggcgagggctctggcatcctgaggctcagtggctcctcattcctgagactgcctgctgcgtgcaccctgggaatgggattccttatgtgcagcaggctgtgtggcccctggtgcctgctttgcaggggtgaggggaggaggggttaaggcagtcgataggaaacgcttcctatgccaaaatttcacacagccagctctaccctctgtggccagagggcgggggatccccaaacccaagcccatgggcccagcccttctccttccagcctgggacctcagcacctgcagccccgcccctgcctcctcaaagtgcttatagccctcctctactcctccactctctttttgcaaagccctgaagacaaactcggccccttgaggacacaggtctcagccccgcctggccccatccccaggggccgccctcactgtgcagaatggccagggccaggatgcctccagtgctggtgcccgccacccagtcaaacaggtccttggtggccacacccgaggccttctcgatggcgatgaggagctggatgatgatgaggcctttcactcctcctccatccaggcacagcaggtggtcgtggctgcagtgggaacagcagtgggagagaggagggtcctgccacagcccagtactttacatccaccctcatagcccttgtcccctgcagctgtgtcctggcagacagacccagacggacccgaggaacttctgtcctatgcaggacagcgagggtgggggtgagggcagtaaaggaacaaatgtctagtatttcaggggctggagagtgcaacagagaaagggaaaggaaggtcgggggatagcatcactgaccaggcgccatcccagcaggatctcggccagtctccccaacttgggacacctgattttggtcagtatcaggcctgatccaaagcaggtgcctgataaagtctgttggaattaaataaggctggggaaggaggggcggggaccctacagccaggccaggaatgggcagtgacagagtatcagggcctccacacaaggtggaagaagcaggggaggagggggcagggaggaagggagaggttcatgccaggggctatgggaggggtgctaccagcattagctcatgtcattgtcccaaacgcctctgaggcagaccctccctgacatccctgtgcttatttatttagagacggagtttcactcttgttgcccaggctggagtgcaataacgcgatctcggctcaccgcaacctctgcctcccgggttcaaacgattctcctgcctcaacctcccgagtagctgggatcacaggtgcccgccaccacacccagctaattttgtatttttaatagagacggggtttctccatgttggccaggctggtcttgaactcccgacctcatgtgatccgcctgtctcggcctcccaaagtgctgggattacaggcacgagccaccgtgcccagccttatttatttatttatttatttatagagacagggtctcactctgtcacccaggctggtgtgtggtggtgcaatcacagttcacggcagcctcaaccttctgagctcaagtgatcctcccgagtagctgggactacaggcaggagccactgcgcctactctctgtgcatatttttgagtgacggagggagtgtagctcagaggttaggtgacgggaaccaagtcatatggatgcggactggacctggacccaggtctgccgcctcctgagtcacatgctctccagcgcgccctgacacgtctccccacatcctgcctgtcctcattggccatgccctgggggaatgcctttgtggttggttcagtctggaaccttcctctgatcttctcatcttcccatctcagcttgatgaagctgagagaagcctgccctgatgccatcgagaccctccctcacagcccgcctgctgctccacctgcttcctggtggaggctgcttccattccattcgcaatctttcttttactctctcctgcgctgacctggaagctccaccagggcagaagccgcctctgctctgggcagcgctgtgtgtcaaggggatgcaggaggtgcccaagagggctgataaatggaggaggcccgggtcccacctctaggggtcttttcctggaccaggtacccagccccacagcaagcctagaggtggcaggggagagactacactgttgctggaggccaaagcaaactcccgaagatgcggggctggcgacagagatcaacccagagggcgcagggctctgtagcttggaaggcccaagtggggagctaccgaggggtctcctgactcttgcctcagccccgctccaggcagggttctgaggctccagaatctggggaatctgcttttcctcccttgggaaatgtgggtccccccttcaggtgcagctgcctcacctcagcccctgcacaggtgtgtgtatgtacatgcatgtgtgtacatgtgtgtgcatgtgtgtgggtgtccatgtgcatgcatgcatgtgtatgtgtgcgcatgtgtatgtgtgtgcatgcacgtgtgtttgcatgtgtgcatgtgtgtgcgtgtccatgtgtttgcatgtgggcaacacatgcatgtgggcaacccgcaggcatgtgcatgtgggtgtgtgtgcgtgcatgtgtgcgtgtgtgtgtgcgtgtgcccgcgtgcaagagcatgcagggggcacaggggagggaatgctgatggggcaggggaacctccagggcacacaacagggtagcatggaagtgagtgcgaagtgagaggacccacagagctgcacgatcactgcctggccctgggagtggagctgcctctgattctgagaagagagctttccctgcagagggctggcactaggtatagagtccacagagaacccagagagagcctgcggtagcacaaaggacgtgggttcggaagacccggctgtgagttgccaccctgacactcactccgtgtgaccttgagcaagtcacttcacctctcaggggctcaggttctgcatctgtaaaacaaggttacaaattcctccctgggaaggctattaggaacatgagagactaataaagaataaatgaatcaactgcagcaatcaagggaggtggcgacagcacagtggctggaaacgcatttgtcctggtaccttgccgtgccagctggcactgagttcaagcacccgggattatgcctgaagggcaaggcctgggcgtcttctctttgcatcctgtcacccaggcccgcctcttacaatgggactaggtatacagcaggtgctggggaaggcagcccacgccactattctgcagtgggaggtggttaaggaagccagtaggagcagtgggaagcagctgctgagatctccccaggggggacccaggcatctccccctcttctagccataaggagatcagggagggaggccagaacactgcgccagccccaccaagtccaagaagcctggcaccctgggctggtctccagagcctgcaccgcccagcattaatgaacgagcgacacaggctctccatgttctgtctctgctgagaactataagactaggagcagagccacttcgccggctgtgagggtgcagagagtaaagccctgagcccacaacagggggtgggtgaggggcaggaaagcgcacacgttccccgctctgcccccgatctcgatccacttacgtccgcttctcgtccctcatggagcccaggatgaacgctggcttccgggcccgtgagatgtgcatgagatcctgtagttctgtgaggcacagagcagggcatgctgtggtcaggtgggtccccaagccctgctaccccagaggtccctagatcaaacctgggctgtgcctcgcccacggccacgccctcatccccccactccccctgtcatctgtcccttccccacaggaaggactctgtcccaggagaaagctgagccacaggccacaggagagaaatgggctggagtggaaaggggggcccactgctctgggaagggctccccaccctgcccagccagctcccaggttcccctcaatctcttcctcttgaaaccccaaggcatgaatacccttgcgtgtcctcttcagacaaagtgcttcttcttgcatcggagccgatgctgcaataaccacctggggcctaagaattcttattccctattgacaggtgaggctctaagagggtccataattcacccaaggtcatttagtcaaaaggctgagtcaggacgttcctcggggtttaagtccatggatgaaaggagacatccctcgtcctgatcccaggtctggaaatcccagtggcctccgggatcaggcccaccatccactctgtccatgtcttcctttgtgtccaaggcctgcctgacgtccacccaactgactagctgcccctcctgacaagcagcccagtccccaggtgcctggtgcagcagcccgcgtgaccccaactctgacagccccccaccactgtgcagagtctagaagcagcaaagcagaaccgagggctgcgaagcggtgtctccccctccccagggcacacggctccacagtgaacaagggaagcagaagagtggctgagagaggccggggacagggtgcaggggagggggcgtgtggtgtgtgcgcagctaagaaggacggattagggagtgagagctagagctaatgccgcatggctaggctcggtggcctctccaggcccagggcgttacccatctgacgccgcaccccaggcccaccatccggcctggcttgggtgactgcctgcaaaattgagagataaagatgggaggtggagggggagttcctgggaggggagagagaggtggagccaggactagaagccacagtcacggtgcctctccagagttccaggcttggtcgggctaccctggctgaaggtgctgccgcctccacagtgaagtctggctcaccaaggactggctcctggctgccctctgttcaggggaccccgctcccaaacaatggaggtccctgagtgggccagcccacagaaagtccagagaagggtcctgtctagtctggggatgtctccctgggcaccaaggaatgcaccggggcagatgctggctgcctggccacattcaacgtctgaaagtcaccacggggccaggaagggggcacacaggtctcaggcccaaccgagattcaaacagtgtgatagaggtgaagccagagggacaggtgaagccagagggcccgggcccccagtcccccgacagcactcctcactgcccaccctgaacgccctggggacaggagggcagtaacagcagccacctcatgggtgccactggaaatgcccaggcctgagactgtgtgcaggacacatcctctcaggggcaacggagcatgggacatcagccagggacaccctaggcctctgggatctgtgggttgctggctgcctagaggctgacaactccggccccatcctccccggcttcctttagtgacttccgtcctagggatcctgttgctttggtggggcctgctgtgatccaggggcctgggaaccagctggagaagagggagtcgggaggcgaggcctacctaggttgtttaggctgatcggtgggggctgagctctttccagggagaagggatgatgtggcgctgcagagccctgctccgcggggaccccgtggatgggtgggaagcagtattcggcccccacggttctcagcagagtcaagatcgccttcctggtgacaacttgtcatggtttggggaaggggagatggcacaggatcagaaatgatgtcaacatgcaaaggagaggcccctcctttccacactccgtcccctgtcccagctcccaggccctgggcacgtgggctgctccagaggcctcagcccaccctgacagggagtgctgcccccaggctggtacatcccaagcagcttcctaaggccagggaaggaggatatgggaggaggaggtcagtgtcaccctgcccgatgcctgtgggaaccccttctttccttctactccagccaagaaagcaggaatcccatggccacattcagtgattctcaaaaatgctaagtgatagttcagggttccaaagggactaatgagccagccagggggcacctactccatttgatggatgggattgctgaaaaggaggtcatagatgcggtgcatgcagacacacacgtgtgcactggcacacacacactgctgccatcaggtacctgcccacagtgacccccacagctgctgaaaccctccagagcgggctccaggcctctggtgaggaggatctgctctgtccagctctgaagctaaggctcactgtgcgagcgtgcagcacatggccatgcactctgcccacacaggcatgcccagagctcgtgcagtgtagtgcatgcacccttggtcattctagccagtggttccatcagtgaattccccaacggtggggaaagaaggctgctgctggctctcctgtccccacccctgctgggaatcttagctccctgaggtggggggcgctgcacgggagaggatgctggtatagcaagccccgtggtgggcctgcatctactgctcagggcccttgtgcttgggtaaggaagccccctctctgagtacgaggtgctcctggcagctctgagcagggcgggtcagcacaggatgctggcacctgatgcctgggacttccctcctcctcggtccctgtatccacccaaccctcaccccactccagccccagagtgcagagcacatacgtctgccgattttggaggctaggaatgtaggagtctccccaaagtcattcggggtgtccacttctgctccgaacacgatgagggccttgatcatctccacgttgtctttctgttggagatggagagaggataagacgtgcaactgccggggaagtgaagaacaaaggggcccctggctgccagccccaacctgtcaactcacccagcgggcctctcctcagcacggggagacactggaaccctcctcacccccacccaagtcaatctggtagtccaaagtctgccatttgatggctggggacctgacaaacaggcttaaaagcacccacaggggagggtgtaagaacccaggcagaaactagaagtgactcgcccctgctctgccagctccgcctccaaagatgcagtgcatctgtgaccccgacccaggagccatggggacacagtaggtcagctgctgatggctttcaggagtagcaaggagagggtgggtgagggcagggaaggccatcttgcccacccagtccagggtgtcatccctgaggggtaaccgaacacacgtgcccctaatggcagccttcgggggagtgtccccacgaagaacgtcacacatttccacacctggaggccgggcaggggcgcagagcatggcatggtttcagaggacacactggccacctggaactgtgggctctggccttgtcaccttcctcttcttgggacccgatttccctgcctagagaatgaagctgtgggtctagaatggggttttccaaacagttcttcacattctattaggacttctatggctacagatatgtgtgtgttttcagcattaactgtgattttttgttgttgttactgttttgttttgttttttttgagacggagtctcactctgtcacccaggctggagtgcagtggcgtgatctcagctcactgcaacctctacctaccgagttcaagcaattctcctgcctcagcctccagagtagctggtattacaggtgcccaccactacgcccagctaattttttgtatttttagtagagacagggtttcaccatgttggccaggctggtcttgaactcctgacctcgtgattcgcccacctcggcctcccaaaatgctgggattacaggcgtgagccaccgcgccctgcattggttaccttttatggttggcactggatggatggatggccatttatggtagtgatgcaacatttctctcaaaataaatttaagtcagtttaaaagtaagccaggccgggcacggtggctcacgcttgtaatcccagcagtttgggaggctgaggcaggtggaacacctgaggtcaggagttcaagaccagcctgaccaacatggagaaaccccgtctctactaaaaatacaaaattagccaggtgtggtggcgcatgaacgtaatcccagctactcgggaagctgaggcaggagaatcgcttgaacccaggaggcagaggttgcggtgagccaagatcgtgccattgcactccagcctgggcaacaaaagcgaaactctgtctcaaaataaataaataaaagtaagccaatttgaagaggtgattaagtacataattgtaaaggtggttgatgaatatgccaaaaactgtgaagatgggatgaagatgaccaaagtctatcagcagttcttaaagtaagacctggggacccctgtgaacacgtgataccctttcagaggtctcacacccagctaattttgcatttttagtagagatgggctttcgccatgttggccaggctggtctcgaactcctggcctcaggtgatctgaccatcttggcctcccaaagtgctggtgtacacgagccactgcagctggccagttattttttaagttttttaaaaaatttttaattttaatttttgtgggtacatagtaggcatatatatttattattgttatttttaaatgaattaatattttgaaattttcacactttaaatttctaaaatggtaaatatagataaagaaaatccagatgattaaaaaatctttgtgatcctcaataatttttcagagtataaagggatcaaataggccaaaaaacttgagaactgctgagttagatcattccaagggcccacccagtgctaaaaatgtccacagtttcaaaaatgaaactatttatagtttcagccttttgggcaacaacatctcttccaagttttgacctttggtataaaacaggatgtctctgaatgtgtcctgaatcagcttttagagtcccgggggtctctcatgttctgtcactgagactcagtaaacagacttctgtacatacggtattgctatagaaaacgtgcacacggtggggcgcggtggctcacgcctgtaatcccagcactttggggtgccaaggcgggtggatcatgaggtcaggagtttgagaccagcctggccaacacaggagttcgagaccagcctggccaacgtggtgaaaccccgtctctactaaaaatacaaaaattagctgggcatggtggcacgtgcctgcagtcccagctacttgggaggctgaggcaggagaatcgcttgaacctgggaggcggaggttgtggtgagccgagatcgcgccactgcactccagcctgggcgacagtgcgagactccatctcgaaaaaaaagaatacatgcacacacatatgtctgtaacacagtaacgtcctcctctgctaggtttaatatgttcatactctagatgtgtaaccagacagtaagggctttgagggcaggaactgtgttctataataaaccaacgaatatgcctggcacctgccacaggctgctgggctgcacactcaggctttgcctgccaggatcttacagcctcccagggaagatgagagcaacacgcggaccagtgaagggaagcaggatgctcactcgggccaggtactgcgtgtgtcacttagacattctgtagagggtgaccaagtgtccaccataacttttccacaactcttccagataagtattgacaccaccattttccagatgaggaaatcgaggctgacaggtgacatggcttgctcagggccagtctatggccagagctgtcatttttccctctcgtgccatgcaagtgccaaatgggggcacaggtggaaaaggtaccacagcacacaggaggtggtgttattttgggctgagagggggacttggaaggcttcctgagggaggagtcagggtctgaactgagctttgggtgggaagatgatttggagcagctgacgataggagggagacagtggggaggagggctccagtccggacagccctcctgcattcccaccggggccccacagggcaggacacgcggtcctgggctcaccgacatggccaggtgcagcggggtgttgccgtgctctccgcgggcatccgcgttggccccgtgggtcagcagcactatggcacagtcgaagcggttgcgcatcaccgccacgtgcagggccgtgttccccgcggagctggtgctgttcacgttgcagccccgtttcagcagcatgcgggccatctgcgggagacggtcaggctgagttagcacaggcactcggggagctgccgcaccccgggacacgtgggcactgccacttctgctctgagaggcctacaggtactgggatgttggaaagcgctagcaagaggattccaggggcaggccccagttctaggggggcctagactgcctcccatcccatcagcatcccaagactagggacaaaaagccaaagatgtgctgactgttttaagaggcttctggtcctttcctagtgccaacagaacccactctccttgcaaaggctcctctggggcctgtcctgaagcaccccgctccctgcatccctccctggaaccctgcaaaggtatcacctctcactgggccttggcaatgcacatccctggcagagccttgggaacagggaggggagcctggctttggagtcacagacctgagcccaaagcccagcttcactcatcccagctgcctgcgcttggatgggtcactgtagccatgtgcacttcagggcttctgtgaagatgggaatgcaagtccccacctcacagcatgtgatgacaatgagtgaccaaacctacacggaagggcctgactcggtgtccggctcctggaatgcagaggtaccctgaggctggcagtgccctccctcctggcccatcacattgagaagtaggccatgaactctggggcatcccattctctgtcaagctgtgcttcctggtgatgagaccagaggcctccatcctcccaggaggacagagcttagcttaggggaagaactcagaggagatgcccagccaggctccctgtgtgtgcagctaggcccagcaccaccaccaccaccatcatcatccatcatcatcatcatcatcttgatggttaataatgagtgtcaacttgattggattgaaggatgtaaagtattgaccctgggtgtgtctgagagggtgctgctaacggagattaacatttgagtcagtaggggaaggcagacctacccttaatctgggtgggcaccatctaatcagctgccagcacggccagaatataaagcaggcagaaaaaaatgtgaaaaggctagactggcttagcctcccagcctacatctttctcccgtgctggatgcttcctgccctcaaacatcagactccaagtccttcagctctgggacttggactggcttccttgctcctcagcttgcgatggcctattgtgggaccttgtgatcgtgtgagttaatgctccttaataaatccccctttaggccaggcacggtggctcacgcctataatcccagcactttgggaggccaaggcaggcagatcacgaggtcaggagatcgagaccatcctggctaacacggtgaaacctcgtctctactaaaaatacaaaaaaattagccgggtgtggtggcgggcgcctgtagtcccagctactcaggaggctgaggcaggagaatggcatgaacctgggaggcagagcttgcagtgagccaagattgtgccactgcactccagcctgggcgacagagcgagactccgtctcaaaaaaaataaaataaaaaaataaacccccctctctctctatatatatatctcctgttagttctggccctctagagaatcctgactaataatacaatcatcatcacgccaccttctatttgggaagcactttacaatttgtgccgagttttgtcacacactgccttgctgacttcatcacatcgccaaagcagaattcatggatgaggaaactgaggcacagggcggatccccccgcccagccagagagcagcagagccctgccaggatcccagctcttcatggacttctctgcctgcacacccactgcaaggtcagcccccaagtgctagcctcagggtcctctcgggaacctgcttcctgagggccctgaggacctgcggggcccggccccctgccccacccacccacctcaggatccactcacctctgcgttcttggcccagtggagggggctggctccgtaacgggggtctttgctgtggatctggctgctgtccatgctgatgatcatctccgcacacctggtgagagaggggccccggttggtgagcagaagctagggtctgcgtggcgtgggatgaagccaggacttggagcttcatctactgcttacagagagcatcactgcaaacaaagttcagcaaacccaaccagcacactcaccatggttaaggctgtactgagcccctcaaggcacaactaaccccctcctccaggaagccttcctgatgctgccaccagcaatgatcaccctccctggtactggctttagagtcagatgggcttgaagtcaagccccagcttcctcactggtggcctccagaagctgagcaacatggagagagtgctgagaggagtggctggggtgtaaggaagaccaggcatttcagagcccagttctgtgcctggcacacagccaccctccacctccttaccacactgtcagtgagtcacacagtgacctgcatgctataggaagcagtatgacagagtgggaaagagcacaattgctttctactcggtgcctgaggcaagcagtgtccaccagagatcttagcatctccagcctcagagcagaggccccgggttcacaagcctcattaggccccgcctggcccaaagaaagtgctccatcattgtatcatgggtaggaatctcggttcacaagttcagctgtgcaaggagaagactttaaaatttttctggctgggcgcggtgtctcacgcctgtaatcccaacactttgggaggctgaggcaggcggatcacctgaggtcggaagtatcaaaggacggaatgcagggacttgaatggacatttgcagacccatgtacacagcagcattcttcacaacagacaaaaggtggaaacaacccaggcgtctatcagtgaaggactgaatggataaacaaaatagtattctgccttaaaaagaaaggaaattctgatacgtgctgcaacatggatgagccttgaagacatcatgctaagtgaaataagccaggcacaaaaggacaaacgctgtatgatttcactgatacgaggttctagaacaggcaagttctgagagacagagaggatatgggacttatcgggggctgtggggaggggagaatcgggagttattaatggttacagtttctgtttgaggtgataagaaaagttttagaaaggggtaatggttggacaacattgtaaatgtgattaaaaccaccgaattgtacacttaaaagtggttaaaatgggccgggtgtggtggctcacgcctgtaatcccagcactttgggaggccaaggtgggtggatcacctgaggtcgggagttcgagaccagcctgaccaacatggagaaaccctgtctctactaaaaaatacaaaattaactgggcatggtggtgcatgcctgtaatcccagctactactcgggaggctgaggcaggagaatcacttgaacccgggaggtggaggtaacggtaagccgagatcacaccattgcactccagcctgagcaacgagagcgaaactctgtctcaaaaacaaaaaacaaaagtggttaaaatggcaaattttatgttatatataatctatcacagttggaaaaaataaacataatatatcagaatcattgtatactttcaataggtggattgtatggaataggaactatatctcaataaagcttttttttttttttttttttagtgcaattactaggacagcccacatgggtttaattcccaggtctggcacttactgactgcctgactttgagcaaattacttaatctctctaagccctggtttcctcatctgttttttgtttgtttgtttgagacaggatttccctttgtcacccaggctggagggcaatggcatgatcatagctcactgtagcctcaaactcctaggctcaagcgatcctcctgcctcagcctcccaaagtgctgggattagaggcatgagccaccacacttggccctcagctttagagggggaataaaatacatcagctctctgggctatagtgaaatagcccacatgaaggctaagccggtggctgggacagcgttagtgttcagctgctgttctctattattaggggtgcccagcacaggcccaggatttatgctgcccagctccctacagcccttatgccagcgcttggtgctcagcactaggcacatggagtcaggcccagcttctttccctgggccctctggagccccccaagtcttcacccgagtggccagctccggctagtgtccatggcttggctcgggctctgctgcccccaaaccttccctgaactccagctgcctgatgccgtctctgagctcctagtgcagcccccaggcatcctcagtctcagcctccatctcactgtctgggattatctgtttcccttcctcagcaggggcttaaccatctgagaaccgcaggcacaaaccgagctttgtgggaaaggtcagctgcattgaaaaacagcagaggtggccaggcgcggtggctcacgcctgtaatcccagcatgttgggagggcgaggcaagtagatcacctgaggtcaggagttcaagactagcctggtcaacatgatgaaaccccatctctactaaaaatacaaaaattagctgggcatagtggcgcacacctgtaatcccagctccttgggaggctgaggcaggagaatcagttgaacctgggaggcagaggttgcagtgagccaagatcatgccattgcactccagcctgggtgacagagtgaaactctgtctcaaaaacaaaacaaagaaaagaaaagaaaaagaaaaacagcgagggagctcctagtctgagctgtgagggaaccacttgtcagtaacactgaggccgtgggattcttggagtagggctgtgctggctgccaagtcgataagggatctccctgctccactcaaggtaggagcctcttcctttgtcttctgtgcaaagatcctcttatgtgatgggacgctggacccacccaggatggcctgtgtggggacagagggaccggtgagggctgaggttgtttgaagagagagaaaactggtcaattacagctcctgcccagtacagctcagggtggctggagacaagcaagagtggggccatgtgccagccctctgggtagagaagagcatcacctggtgtccactcaggtcacaacctgcaaatggggaacctgactgcggggctgggggtgttggtatcttctctgtttggtcaagtatttctgaaagctctagctcattctggctgtgcttgggagattcaaggaaaggagggtttgtccaggcttggtccagcccttagaagggctagcaatgccccatggggctagcaaggtggatgcagctcccagaggaaggaacaacctgaggacaggcacaagtgccagcctccctgcctgagtgctgcccgtccatgccttctcactgcttgtctggcactgcgctatgagattctgggtggctggggtgtctcctgtcctggagtggcttattcatttcggtgaggctggtgctttagcacagtgccaggatcgaaggactcattggctcattcattcattctagatgttgttcctgttagatagtattttttttcttgagatggagtcttgttctgtcgccctggctggagtgctgtggcacaatctcaaatcactgcaacctctgcctcccagtttcaaacaattctcctgtctcagcctcctgagtagctgggactacaggcacacaccaccacacctggctaatttttgtatttttagtagagacagggtttcaccatattggtcaggctggtctcgaactcctgacttcaggtgatccacccaccttggcctcccaaactgctgggattacaggtgtgagccaccgcgcctggcctagatagtattttgagatttgagatattcatttatctttttatctcatcccctacccctttgaagacaattttcctgacaccaggggttcccaggctcccaaaacatgagcctgtacctgcctcccaacgtgccaccagccagaaaggaaagaggcatctaggtggacgggcactcggccaccttaccaagcatttcccaggctttgagctgggcacacaagaaaccaaggagcactgaagccatcggggggctgttcagatcaggctgggctgggttagaggaggggccaggtgggccttggggttgcatcagactccagaactggagcaccacctggaggggagctggaaagaggagaccccaaagagggctaagattggttgtctccagttttatagagggagattcactcctaggaattaaggtacattaaataaatttatttttatttatttatttatttatttatttatttattttttgagacagtttcgctcttattgcccaggctggagtgcaacggtgcgatctcggctcactgcaacctccgcctcccgggttcaaccgattctcctgcctcagccttccaagtagctgggattacaggcatgtgtcaccacgcccagctaattttgtattttttagtagagatggggtttcttcatgttggtcaggctggtctcgaactcccgacctcaggtgatctgcccacctcagcctcccaaagtgttgggattacaggcgtgagacaccgcgcccagccagaaaaattttaaagtctcctccttgcacagctgaacttgtgaaccgagattcctacccatgatacaatgatggagcaccttctttgggccaggcggggcctaatgaggcttgtgaacccggggcctctgctctgaggctggagatgctaagatctatggtggatactgcttgcctcaggcacgggacaggtgacaggagagctggagcccagcaggccagcagatggggaggggaggaggtcttaccccttctgagagaacttcatggccgagtggatggggtagccgttggggcccatgatgttgcaccgagcattgcacagcagcagcacgcggaccatctcctgcttccccagctggcaggccaggtgcagcggggtcagcccttggttattcacctggttcaggccagccactgcgttccttccaaggagctgatgaaagaggaagggaagtttgactccataggatgctgataagaacgtaaagaggccgggcgcagtggctcatgcctgtaatcctagcactttgggaggccaaggtgggtggatcacctgaggtcaagagtttgagaccagcctggccaacatggtgaaatgtcgtctcttctaacgatacaaaaattagccgggcatggtggcaggcacctgtaatcccagctactcaggaacctgaggaaagagaatcgcttgaacccaggaggcagaggttgcagtgagctgagattgcatcattgcactctagcctgggcaatagagcaaaaactctgtctaaaaaaaaagaacgtaaagagaagcaccaggaaagccaagtgccagtgtggatgggagggaaggggtcgacctggcatgactgtggctcacatgaaacatttctgagtcaaggaacttaaaaggtagctgtatctcaggatgggcactgggggtccaggtgggaatgattcttgcttttcattctgtcctgactgatttttttctacatgcaggtactatgttttcaatgaaagaacagcagtattaaaaagagagccaggggccaggcgcagtggctcatgcttgtaattccaacacactgggaggtgagaggatcacttgagaccaagagtgtgataccagcctcggcaacatagggagaccccatctttaccaaaaaaattttaaaaattagctggcgtggcctgggtgtggtggctcacgcctgtaatcccagcactttgggaggccgaggcaggcggatcacaaggtcaggagaccaagaccatcctggcgaacacggtgaaaccctgtctctactaaaaatacaaaaaaaattagccgggtgtggtggcgggcgcctgtagtcccagctactctggaggctgaggcaggaggatggcatgaacccgggaggcagagcttgcagtgagccaagatcgcgccactgcactccagcctgggcgacagagcaagactccgtctcaaaaaaaaaaaaaattagcccatgtggtggcacgagcctgtagtcccagctgctcaggaggctgaggtgggaggatcacctgagtccaggaggttgaggctgcagtgagccacaatcacaccactgcactccagcctgggcgacagagctagatgctgtctcaaaaaaaagaaagtgctaggagggttttactgtctcacttttggctcagtgctgtccccatgaggttcattacaaccacagtgtacccatgtgacaccagggtcacctcacagcagtcccactggacctgaaggcaggccagagacacagcaggaagagcaaagggctggcatcgaggccaatgtaaggtcaagccccactctctcagctttgtggccctccctgggcacgcttcttaattaacaacactgaacctcagtttcttcggagaggaaaggggaataatgacctccaccccatgagtgtattctaagaattaactggaacacatacaacactcagttcaaggtcaggcaccaatcagcaccggataaaggacagctgcagtcgtgcatgactatcgagaagcgggtgtgcacacccccgcatggaggcagggtctgcgcggcaccatgctgggtgcgcagaggattctcggtgaaagtggagttcaacagtgggtggagaattcccttccctgagagcaagaagcataagatatgaatccacattttctgggccgggcacagtggctcacacctgtaatcccggcattttgggaggctgaggcaggtggatcacttaaggccaggagttggagaccagcctgggcaacatggcaaaaccccatccctactaaaaatacggaaactacccaggcatggtggcacatgcctgtaatcccagctactcaggaagctgaggcacgagcatcacttcaacccaggaggtggaggttgcagtgagccgagatcgcaccactgcactctagcctgggagacatagggaaactctgtctcaaaaaaaaaaaaaaaaaaaaaaaaaaaggaatccacattttctggtataacgtagttgcattctgatgccaaggcagagagaacatgatctttagaagaattttctaattctagacaataaaacataatccaacatcctgccttttctgttcaatctaatatatgaaatagctatttaatagtatcaccccatctgcttgcccacaattaaaaaatcacatcttttgcccaggtaatcaaaaacgttaacaggagggcctctggcacaaatgcctacaggaactggagacagtttggtttgcttggtttgaattcctgtaaaatagggttgtccaatattttggcctccctgggccacatcagaagaattgtcttgggtcacacataaaatacatgaacgctaacaacagctgatctaaaaaaaaggtccatgcatggatctcataatgttttaagaaagtttgtgaatttgtgttgggccacattcaaagccgtcctgggctgcatgcagcctgcagggccacagattggacaagcttgcaaaaggttaagcccaggtcccgctggcccacgagcccctccaggcaggcatctggctcacagtttgtgctcaggaaaagtggaactgaactaactgactggagctgggccttttttggggtttattttgctgggttggaggccgtccccaggtttatcaagcaaagagactgaggacgtggctcctggaaaagggctgggagggaagagccagggaggggtctgcaccctccatgaaggagctcaggcctcaaggaccaatgggggacagtgagaggcctgagagtgacacctgagcctaggggcccaaagggaaccgtggacaccgggaggtatcagtaccagtcaccctgcccctccccctgctcacctgcagcacctgagaattgtcaccctggacagcataatggaagacggtctctcccttgtagtcggtgacatccatctgagtgtggcagtactgcaccagctccaccaggatctccccatcacccttgcggcaggccaggtgcaggggtgtgcagccctcctcgttctccgcgcaattggcacagctgcaggagagggccagggtgagcagaggtgagcaggtgtggtacaaggtggcagggggacctaagtgcacatgcagggaagtgcactcggaaactcggactttctggtttatttgagctcaagagcattcccgccactcagctagttgggctgatttgaatgtaattatatctgatgtgacctgtatcaggtttctgttcagtttgctcactcgtacaagagatgggccccagggccacaccagcaggaagtgggcagggtggtggcacaggaaagggtcacagaacacggatatctcactagcctcaggcaattcacttaacctttctgggcgtcaatatccttatcgacacaagctgctgtgcctgccccaggaaatggacagagtgatggtgagatgagacagtgctgtccaaaagcacgcctggaaactaaagtgcagtgagggtttttgttttgttttgtttttttgaggtggagtttcactcttgttgcccaggctgtaatgcagtgacacaatctcggctcactgcaacctccgcctctgggttcaagcaattctcctgcctcagcctcccgagtagctgggattacaggcgtgcgccaccacgccttgctaattttttgtatttttagtagagacggggtttcaccacgttggccaggctggtctcaaactcctgacctcaagtgatacacccgcctcggcctcacaaagtgctgggattacaggtgtgagccaccacgcccggccagcagtgaggttttgagttctgggcctgggagcttaactgagctatctaggatagagactcagaggaggtgtggctacctctgcacaagatggccaactggtgccctgtgcaagggtggggacagtgccctcaccaggggcaacagctgctccatctgctggctgaatggattcacaaaaggaggccttcagcttccagaagagcagcctgggcagacaccaaggatccaagcccctctttcaccctctctggctgagtgacctgcacaagtcctgttagctctctctagaatgatgatacctgggccgggcatggtggctcacgcctgtaatcccggcactttgggaggccaaggagggcagatcacctgaggttaggagttcgagaccaacctggccaacatggtgaaaccccgtctctactaaaaaacacaaaaaaattagccgggcgtggtggcgggcgcctgtagtcccagctacgcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaattacccgggcatgatggcacattactgtaatcccagctattccggaggctgaggcaggagaatcacctgaacccaggaggcagagggtgcagtgagccaagatcgcgccactgcactccagcctgggtgacagaataagactccgtctcaaaataaaataacataacgtaacataaaataaaataaaataaaataaaataaaataaaataaaataaagtaaaataaaatgacgataccttgtgggggttgggaaaattcaatttcatggtgggtagaaatcagctcccacagacctggcacctggtgagcactccggactctggaaacattacattgtccttcttacattttaatctggtagcaacgcagcacctttttttttttttttttttttttcctagagacaaggtctcattctgtcacccaggctgaagtgcagtggtgcaatcatagctcactgtaaactctaactcctgggctcaagcaatcctcctgcctcagcatcccaagtagctaggagtatagacacatgctaattttttaattttttcgtagagacaaggtcttgctattttgccaggctggtcttgaactcctagtctcaagtgatcctccctcctcagcctcccaaagtgctgggactgcgttagtgagcgaccatgccaggccctgctcctttttaagtcaaactatggaggggaaccgaggcctgcggcccccactgcccacacaagcaggtacacacacgttgtccaaatggtcttgttcccttgctcacctgatgatacggctgtgatggaagcactcgcggatccctagctccacagccaggtgggccactgaccagctggggtggttacggatgaggtcggtcaggtgctgcaggacctcagtgtgcaggacctgaggggagctctcatagaagggtagcagctgggaagaatactgatggaaattcactagggcgtcagcctccaactccagctggaagagtctgtagagccaggacagaggagcaagacccgaaatgagtaaggcgggaccctcggcccacatccctgctggaatcagaaggtccccaggctgcggcctggccagctccagcccgactcccctcccaagcaaacacacacacacacacacacacacacacacacacacacacacacacacacccctatacacatgtaaatgacataatggcgtttaggttagactttctttgttttttagagacaaggtcttgctctgtaacccaggctggggtgcggtggtgtgatcatgactcactgcatcttcgaattcctgggctgaagggatcctcctaccttagttcctgagtagctgggattacaggcatgcaccaccatgcccagctaattttttttttttttgagatagagtctcattttgtcacccaggctggagtgcagtgttgtaatctcacctcactgcgaccttcacctcccgggttcaagcaattctcctacctcagtctccagagtagctgggattaaaggcgtgtgctgccacacctggctaattttttgtgtttttagtagagatggggtttggccatgttgcccaggctggtctcgaactcctgagctcaggcaatccacccccctcagcctctcaaagtgctaggatttcaggcactagccaccgtgagccactgtgcctggcctaatttttttttatttttgttgacagggggtcttgctatgttgcccaggctggtcttgaactcctggcctcaagtgttcctcctgcctcagcctccaaaagtactgggattacaggtgtgagccactatgcttgtctagattttcctttattttgaaaaactttccttttctttggtaatatcatttattatttttatattttattttaccacagccctgccatatccactttctaatttcattgccacatgtgagagctccagcctcgagtacttggcccctcttcatagtaggaactaagtaagtattgtttaacctaaatgtacagcaacaaaatattatataaattatggtataactatgtaataaactattatgcagtcattaaaatgagatatttaaaaaaagggaaacttttctttttcttttcttttcttttttttttttttgagatggagtttcattcttgttgcccaggctggagtacaatggcacgatctcggctcactgcagcctccatctcccaggttcaagtgattctcctgcctcagcctcctgagtagctgggattacaggcacccgccaccatgcccggctaattttttgtatttttagaagagacagagttttgtcatgttggccaggctgatcttaaactcctggcctcaggtgacctgcctgcctgggcctcccaaagtgctaggattacaggcatgagccactgcgcccggccagctttgttcatttttaagtgttgaggttgagtccaagttttgctactaaggtgctgtgtgatcttgggaaatccttttccctctctgagccccatttgaaacatgagactaactgtacctgtcctacctacctcccagaggtgctgtgaggacagatgaaaaaccactataaaagcactttcaaaaccataaccattatatgtcagtgatggttacttaaagttctgaccagggcttttaacataccaaaaggttttgtcttgcatacctctacaagcgcagcagccagccagagtctagtgaaggcagtgcccagagagtgttggctcaacgggaccagcctgttgttccacagagagtgcgttgattaacagttaactactgggcatgtgatctgtgccaaatggaggggtcaattaatgaacaattgcataaaatgctctgccctcctgaagccttttttttttttttttttttgagacagagtctcactctgttacccaggctggagtgcagtggcgcgatctcagctcactgcaacctctgccccctgggttcaagtgattctcctgcaattctcctgcttcagcctccctagtagctgggattacaggcgcttgctaccacgcccagctaatttttgtatttttagtaggcacagggtttcgccatgttggccaggctggtctcgaactcctcacctcaagtgatccacccatcttggtctcccaaagtgctgggattacaggcgtgagccactgtgcttggcccgagcctatgttattatggaggagatcaacaaaatgactaaagtaaaaacatagaataaggaagtacattaaataaactataacgtaatcagtgttacagaaacaacaaaaaccacaacaaagatagggaaggaggaggcggaaggaagccattcctcattgcccttggctgggtttttccttcatctcaccagcctctcaacatcagggtactccacatcaagtgttgccgatatgtcagagaatgacaactgaaaactcatcactggaattagcatcacggaggcatgcacgaccttgacaacattacttttagtggaatggagggaaccaaggcctgattaaagtgggtttaaggacacaatgtgagaatctgaagattgcaaagatagatatttttgaggagttttgctgtggtgaggagcaaataaaggaaaggatagcgaatggggaaagtgtaatcaggcatttgaatgctgacgggaacgatgattctctctcagaacttccactttccattaacagcagactagggaatgtgaaacagaccacctactgaggacagccagaaatgctggacaaattattaaaaaacatctgctggcaggcactggatacctcaaaagacactgatgactcaccaggctggaaggaatgatggaaacccaggaattgcagtgttcaggtggctgttactggagaggatgggcagacgagcagcaccagtaacagcctcatggggctcaggacacagggactggagcccaggcgtctgccaagaggagagccctgatgaacatctcttactttgggttagggtcctaaagaactacgtagcctaggaataagggtgagccatacacagacacgctctcacagagaccacagttcagcctcaagtgatttcagttccagaaactagactgaggttatcctagttgcaatgggagaagcaaaaataaattcattctttgtaaggaaacatcaaactaggctctagattatttctttttttttttttttttttttttttgagacggagtctcgctctgtcacccaggctggagtgcagtggcgtgatctcggctcactgcaacctctgcctcctggttcaagtgattctcctgcctcagcctcccgagtagcagggattacaggaacgtgccaccatgctcagctaattttttgtatttttagtagagatggggtttcaccatgttagccaggatggtcttgatctcctgatctcgtgatccacctgcctcagcctcccaaagtgctgggattacaggcatgagccactgcgcccggccattccagattatttctacgagcatacttgcaaatacaatgaccaacacataatcaaaactcaccaggcatatgtggagataagacatgaaagaaaaccaacagaaacaatatacaaaagaaacatatctgtgaggggactgtaaatatttaagttatccaaaatagactttaaagtaactgtgataacattcgagaggttaaaaaaggaaatttagaattttggtgaagagttttgaatgatcaaaaaagcatcaaatggaaattacaaaattaaaaaatataatcaggaaagagtaaacagaataaagcatggagagacagaagaatacaaaatatagtagagtacataagagacacagactatctaataaaagatctagcatacatacataagtggaggatcagaggcagagtagaaaaagaatcaaatggaagctacatttgaaaagttaatgtctgcaaactttccaaaactgatttttaaaaaacattataggtcaggcacagtggctcatacctgtaatcccaccactttgggaggccaaggtgggtggatcacctgaggtcaggaattccagactagccatggcgaaaccccatgtctactaaaaatataaaaattagccgggcgtggcggtgggtgcctataatcccagctacttgggaggctaaggcaggggaattgcttgaaccagcggggcggaggttgcagtgagccgagatcacgctacttcactccagcttaggcaaaagagtgaaactccatctctgatcacgctacttcactccagcttaggcaaaagagtgaaactccatctccaaataaataaataaaattattctgctgatttaacataccctataagccctccctgaccccaccaccaaaaaaaaaaaaaaaaacacatagaaaaaaacaaaaaacaagaaagccccagaaatccacgcttagcaccttgtaggggttttaaaacagggccccctaaaatcactgatattccttgcactgagcagtgggaatttgtatctctttaccctttaatctggcgatgtaactgcgttaccaacagaatatggcaaaagtgatgccgtcccagcttccagaccaatgccttaagagactggaagtttctatttctcttctcttgggacccagccatcatgcctcaaggaggctgaagcaagccatggtgacgactcttggtcctgggccctgagccctgaatgaactaccagccaacagccagcaccaacttgccagttgcgagttaccttatatggtgccatataaagtaaagctgaggctttcccactgagctctgctcaaattgcagatttaaggactaaataaatgattccttttataagccactgtgttctggagtagtttgttacacagcaataactgataatgatacatatgttgcacaatatgtattgtatgtaacataacaattgctgatatatgtgccacattacacctgttgaaaataaaatacaaggaggaaatatttaaaatagcagagggaaaaaagttatcttcaaagggcaaccattagaatgacagctggcttctcaacaatggaacccagagataatggaatgacttccttaaagagctgaaaagaaaataaatgctggccaggcacggcggctcatgcctataatcccagcactttgggaggccaaggcaggcaaatcacttgagctcaggagtttgagatcagcctgggcaacacggtgaaaccccgtctctactaaaaatacaaaaattagtcaggtgtagtggtgcatgcctgtagccccagctactcaggaggttgagggaggagaatcgcttgaacctgggaggcggagatcgtgccactgtactctagcctgggccacagagcaagactctgtctctaaataaataaatgccaatgagaattctgtacttagcacacaaaacaaaatgaaaacaaaaacaaaaccttcaagaataaggttaaaattaaaacatttctctagtcaaacaaaaaacccagagactttgtcattagcagacctacacgaaaggaaatacaaaagctttttctttccttcttttttttttttggagacatggtctcactcctgtcacccacgctggagtgcagtggtgcaatcaacgctcactgcagcctcaacctcccaggtttaagtaatcctcccacctcagcctcccgagtagcagggacgtgaaccaccacacctggctaattttttgtattttcagtagagacagggttttgccacgtagcccaggctggtctggaaatcctgggctcaagcgatcctcccgcctaggcttcccaaagtgctgggattacaggtgtgagccatcgtgctgggccaaaagctttctcttcatgtggaatgaacacgatcctagatggatgcttaaagaggcatgaaagaatgaagcaccatggcaagttaaatatgtggggggatctaaataagtattgatggtatagcgtcttgttgggtttaaaataaaaactaaataaaacaacagcacacagcatcgaagcctggaagggaatacatagctaaaggattctaagaccaacttattgttctggaagatactaatggaccttgagtaaggcagagataaatctcgtaatctctaaggttctgtcaagatgtgcaaaaggtttcagactttgccccgcttgttgttgtcaaagttttgctccagaagaagacacaatcttgattatgctgaaaagtaagcaaacttaccctgtgctctacaaggagaccctaactctattttccaaggctgtttgctgtataaacatcctttgaaggtagcctggaacaaaggtagtgctataatttggatttctgccccccaaacctcatgttaaattttgattccaatgttggaggtggggggctaatgggaggtgtttgggtcataggggtggatccctcatgaatgaatgccctccctgtggggtgggggtgagtgagttttcactctattagttcctgtaagaactggttgttaaaaagagcctggcactttttttttctttgagacagagtttcgctcttgtcgcccaggtgatcttggctcactgcaacctccacctcctggattcaagaaattctcctgcctcagcctcccgagtagctaggattacaggcatgcaccaccatgcccagctaatttttttgtattttttttagtagagacagggtttctccatgttggtcaggctggtctcaaaactcccgacctcaggtgatccactcgccttggccacccaaagtgctgggattacaggcacgagccactgtgcctggcccgtgcctggcactttttaacaaccagttaacaacttattttctcttcctcacttcctttcttgccatgtgacactggtaagatgctggcaccatgtttcttgtatggcctgaggagccatgagacaaataaaacctcttttctatgtataatactcagacttaggtattcctttatagcaacactaaacagacaaaaacaggtagtcaatgtctctgctagcaggatgtatggaaatatgagagagactcttggagaacgatctcccaacagttactactaaaaagtgtataacttccaagctaagagacagaaaaaacagaatcatatgaaaacgctcaatcacaaattgcaaaagcattatgctaagtgaaaaagtcagactcataagactacacgctatatgattaaaagcagcagtgatggaatgcacataggtataggaagacgtcctcctgcggggaaaaaaaaaaaggaagcacataggtgttgcccagggatggggtgggtgccatggactataaaggagggtgaaggaaatttggagaataacagaaatgtcttatatcttgattgtggtggtggttacatgggggtgttctgttatcaaatgaaggtggaggcaaagcaagatggccaaatagggctgggcgcggtggctcatgcctgtaatcccagcactttgggaggccgaggtgcgtggatcacctgaagtcaggagtttgagaccagcctggccaacacggagaatccccgtccctactaaaaatacaaaaattagccaggcatgtggccgccgccccgtctggcaagtgaggagcgcctctgcccggcccccgccctgtctgggaagtgaggagtgcctctcctggccgccgtgcaaccttccaagtgtgaagcgacagccttgtgtgtgatctttctgccttccccaagtttgcattttcgacattaaagtttactttttaattgaaaaaaaaagtagccaagcatggtggcaggcacctgtaatcccagctactggggaggctgaggctggagaatcgcttgaacccaggaggcagaggttgcagtgagccgagatcgcgccactgcactccagcctgggtgaaagagcaaaactccgtctcaaaaaaaaaaaaaaaagatgcccaaatagaaacctccaccaattgtcctccctggaggaaaaccaaattgaactatacacacaaaaaagtaccttcataaaaagcaaaaatcagcctaggtaccagctcagctacagtgtggcagagcaccaagagggctcttggggtcccagattctaagtgttggctgtggggtggcagttctggacctgccctgggtcagaggggagcccactaccctaaagggagagtcccaggcctggcagtgttcagttgcttcaagagcccttaggccctgaatgaacgttggcagtggcctggcagcactgccacagggctggggcagtggtggccatggagagagacttctctgcttgtggaaaggggagggaagagcaggaaggactttgccttatggcttgggtatcagccaggctgtaatagaatagagcactggggagattactaaggtttctgactgcaggccctgcctcccagatggcatctaaggaccttcccaggatgggggtagggggaacttgctgccttgaagggaaggacataatctcactggcttcaccacctgctgactgtagagccctagtgccttaagcaaacgtaggcagtagccaggcagtggagactgtaggccttgggtgagacccagtgctgtgctggcttcaggtctgagccagcatagtcctagtgatagtggccacagaggtgcctgtgtcacccctctcctagctccaggcggcccagcacagagagagagactccacttttaggggagaaagtaagggaagagaacaagagcctctgcctggtaatccagagaattcttccagatcttatccaagaccacccaagtggtacctttacgagtctgcaagagccatagtattagtaggcttggggtgccccctaatgcagatatggctgcagtgaccaaaaacttagatcacaatacccaagtcccttttattacctggaaagtcttcctaagaagaacagatacaaacaagcccagactgcaaagactacaataaatacctaacttcaatgcccagacactgacgaacatcacaagcatcaagaccatacaggaaaacatgacctcaccaaatgaactaattaaggtaccagtggccaattctggagagacagagatatgtgacctttcagacagagaattcaaaatagctgttttgagggaactcagtgaaattcaagctaacacagagaaggaattcagaatcctaacagataaacttagcaaagagattgaaataatttaaaagaatcaagcaggctgggcacagtggctcacgcctgtaatcccagcacttcggaaggccaaggcaggcggatcacaaggtcaggagatcgagactatcctggctaacatggtgaaatcccatctctactaaaaatacaaaaaattagccaggcgtggtggcgggcgcctgtaatcccagctactcgggaggctgaggcagaagaatggtgtgaacccgggaggcagagcttgcagtgagcggaaatcgcgccactgcactccagcctgggcgacagagcaagactccatctcaaaaaaaaaaaaaagaatcaagcagaaattctggacttgaaaaatgcagttcacatactgctaaatgctaaagggagtttttcaatctgaaagaaaaggacattaatgagcaataagaaatcacttgaaagtacagaacttaatggtaatagcaagtacacagaaacatatagaatattataacactgtcatatgtagaccactcatatcttgagtagaaagactaaaagaggaaccaatcaaaaataataactacaacttttcagacataaacagtacaataagttaaaaagtggggggacaaagttaaaatgtagagtttttattagttttctctttgcttgtttgtctgtttatgcaatcagtgttaaggtgtcatcagtttaaaatattaggttataagatattatttgcaagcctcatgttaacctcaaatcaaaaaacatacagcagatacacacaaaaaaataaaaagcaagaaattaaaacataccaccagagaaaatcaccttcactaaaaggagaacaggaaggaaagaaagaagatcacaaagcaacaagaaaataattaataaagtggcaggagtaagtccttacttgtcagtaataacattgaacataaatggactaaactctccaatcaaaagacacagagtggcagaacggatagaaaaacaagacccagtgatctgttgcctacatgaaacacactttacctgtaaagacacacatagactgaaactaaagggatggagaaagatattccatgcaaatggaaaccaaataagagcaggaatagctatgctattctatgaggcaaaacagacttcaagacaaaaactataaaaagagacaaagaaggtcattatataaaagggtcaattcagcaagataatgtaacaattttaaatacatatgcactcaacactggaacacccagatatataaaggaagtattcttagagctaaagagagagatagacctcaatacaataatagctggagacttcaatactccactttcagcattagacagttcatccagacagaaaatcaacaaagaaacaccagccttagtctgcagtatagatcagatgaacctattagatatttacagaacatttcatccaacggctgcagaatacacattcttctcctcagcatatggatcattctcaaggatagaccatatggtaggccacaaaacaagtcttaaattattattattgttattattttttttttgagacagagtcttgctctgtcacccaggctggagtgcagcggcgcgatctcggctcactaccagctctgcctcccgggttcacaccattctcctgcctcagcctcctgagtagctgggactacaggcacctgccaccatgcctggctaattttttgtatttttagtagagacggggtttcactgtgttagccaggatggtctcgatctcctgacctcgtgatctgcctgcctcggcctcccaaagcgctgggattacaagcatgagccacttctcccagccaaattactttttaaatttgaaatcatatcaagtatcttctgtgatcacaatgaaataaaactacaaatcaaaaacaaggtattttgcacaccatacgaacacatggaaatgaaataatatgctcttgaatggtcaatgaagaaattaagaaggaaatttaaaaacatcctgaaacaaatgataatggaaacacaacatatcaaaacctgtgagatacagggaaagaagtactaagaggaaagttgtacctataagcacctacatcaagtaagtagaaaaacttcaaaataatctaatgatgtctcttaaagaactagaaaagagcaaaccaaacccaaaattagtagaagaaaagaaataataaagatcatagcagaaataaatgaaattgaaacaaaacaatacaaaagatcaacaaaataaagttttttgaaaagataaacaaaatcaataaatctttaactagactaacaaaaaaagagagaaaacccaaacaaaaaaatcagaaatgacaaaagagatattacaaccaatatcacagaaactcaaaggattattagaggttactgtgaacaattatatgccaataaattgaaaaccctagaagaaatggataaattcctaggcatacacaacctaccaagatggaaccgtgaagaaatccaaaacctaaatagaccaataacaagtaatgagatcaaagctgtaatgaaaagtctcccagcaaagaaaagcctgggacccagtggcttcactgcttaattttaccaaacatttaaacaaaaactaataccaaccctactcaaactattatgaaaaacagaggagagaaaacttccaaactcattctatgaggccagtattgccctgacaccaaaaccagacaaagacatataaaaaaagaaaactacaggccagtatccctgatggatattgatgcaaaacttctcaacaaaataccagcaaatcaaattcaacaacacattaaaaaggtcactcacggccaggcgcagtggctcacacctgtaatcccggcactttgggaggcaggggcaggtggatcacctgaggtcaggtgtcgagaccagcctggccaacatggtgaaaccccgtctctactaaaaatataaaaaactagctgggtgtggtggtgggcgcctgtaattccagctacttggaaggctgggacaggagaattacttgaactcaggaggtggaggttgcagtgagctgagattgcaccaccgcactccagcctgggcaacagagcgacaccccatctcaaaaataaatatataaataggaaggctagtctgatacaggctcctctgtcatggccagaagtggaagttcatcctacaagtttgatacgtagtatttgcatcatcattgggtcaagatattttctttttcttttcttttttttttttttttgagatgaagtttcactcatgttgcccaggctggagtgcagtggtgcaatctcggctcactgcaacctctgcctcccgggttcaagtgattctcccgcttcagcctcccaagtagctgtgaccacaggtgcccaccaccacgcctggctaatgttttgtatttttagtagagacagggtttcaccatgttggccaggctggtctcaaactccttacctcaggtgatccacccgccttggcctcccacagtgctgggattacaggcgtgagccactgcaacccgccacgtcaagatattttctaaatttcactgtgacttcttttttgaaccatagataatttacatatatcttgcttaaaattcaaacatacgggctcatttatagttacatttttgctattgatttctagcttaattgcactgtagttggagaacatagtctaaatctcttcaggtatctgaaatttgttcatatttgctttatggccagcataggtcagtgtctataatttttatataggtgttcttgaaaagaatgtgtattctgttagttggtaggacaactgttttatatatgttccatggtctgaatgtttgtgtcttcctaaaattcttatgttaaaacttaattctcagtgtgatagtattaagaaatggggccattaggaggtaattcgatcatcagggctctgccctcatgaatgggattggtgccatttaaaaagcggcttgccaggcacactggctcacacttgtaatcccagcactttgggaggccgaggcgggtggatcatctgaggtcaggagttcgagaccagcctggccaatatggtgaaaccccacctctactaaaaataaaaaaattagccgggtgtggtggtgggcgcctgtaatcccagctactcaggttttcaaaaaataaacaaagccaaaagttggttctttggaaagattttttaaattggcaaatcactagcaaaaccaaacaagaaatagagacaacacaaagtaccatcccttcagatcctccatacattaaaaaggaaataaggggacctgcagacaaatttgacaacttcgataaaatagaaaaattccttgaaaacacaacatacccaaaccgacatgagatgaaaatctcatagtcctatatttgttaaagaaatcgaatccatgttttaaaagcttcccacaaataaactccagggtcacatggttttacccatgaattcttccaaacatttaagaaagaaagaatacaggctagacatgtgactcatgcctgtaatcccagcactttgggaggctgaggtgggaggattgtttgagcccaggagttcaagaccagcctgggtaacttgatgagaccgtgtctctacaaaaaatttttaaaattagccaggtatggtggtgcgtgcctgtagtcctggctactcaggaggctgaggcaggaggatcacttgagcctgggaagttgaggctgcagtgagccatgatcatgccactgaagtttggcctgggtgagagagagatagatgaaaggaaggaaggaaggaaggaaggaaggaaggaaggagatcttcaacaatttttagaaaataggagaaagaaggaatgcttctcaaagctttaagatagagaaggacttccttaaacaagacacaaaaagtacaccgtaaagaagatgaacaaatttgacttcattaaaactaagaactcatgtttatcaatagataccattaaaagaataaaaaggcaaaacaccgtgtgtgcagctgaacacgtatcactgacaaaaggtgtgtatttggactgcacatgtaccaaaaaactcctcctaaaactctgtaagaaaaagataaacaactttattttttaaatagtcaagagaattgagctgatacttcactgaagaggatatccaaatggttaatcactgtatcaaaaagtgctcaacttcatttgcaatcaggcaaatgcaaaataaaaccacaataacatactactagacacccgacagaatgactaaaattttaaaacctgacagtaccaagtaacagaagatatgaagtaacagaaagtgccatttactgctgcttggaaaacagacgggcggtattatttactaacgttgaagacaagttatggcccataatgcagccagttcacttctaggtatgtctaccagaaatgtatgcatgtatgcaccaaaaaaactagaaataacccaaattttcatcagtagtagaatgagtaactgtgatatagtagacaatggaattctattgcaatgaaaatgacagacagctgcacacaaaacgtatcaatctcgccaacaaaatgctaacaaagaagccagatagaaaagcctttatcttggccgggggcggtggctcacgcctgtaatcccagcactttgggaggctgaggcaggtggatcacgaggtcaggagatcaagaccatcctggctaacacggtgaaacctcgtctctactaaaatacaaaaaattagccgggcgtggtggcgggcacctgtagtcccagctactcaggaggctgaggcaggagaatggcgtgaacccaggaggcagagcttgcagtaagcagagattgcgccaccgcactccaacctgggcaacacagtgagactccatctcaaaaaaaaaaagcctttatcataaaaggcaagttattggttacccttctttgggaagaggggacaaaaggagggcttctggggtgctgtaatgtcctatctctagattcgagtggtggttacacaggtgtttgtgataaatcactgagctgtatatcattttctctatatgtgttatattttgctatttttgaaaagtttaaagagagaaaacaggaggagaagaatgaagacagtggaatataagcagtctctggaggaaaaagtagagtcaagaaataatttttttttaaagaaaaaaataacccattgtatagcgatggaaaataacttaggtcaggacattataacagaaaactacagactgggaggcttaaacaacctttatttctcacagttctagaggctaggaagtctatgatcaaggtgctggctgatagagttcctgatgagggttcacttcctggtttgcagatggctatcttctcgttgtgccctcacatggcagagacagatcatctctttcttgcctcttcgtctaagggcactaatcccattcatgagggctccatcctcatgacctaatcacccccatagtgctctacctcctaataccatcacacgagggattggggcttcaacatatgatttcggggggatactttcaatccatagcaaaaaatatatagtagaaaaggggaaagtgttatgtaggaaagaggggagataattgttcaaatggtgtcaagaagtagatgacaggagatgatggccttgaatggggggaccaccctcagctaaacacatcggtgctgacaacagggaatgtggagtaggcggggacagaggtgtgtgcatggggtagagggaattctcctctggctatttctattttctcagcgagacagcagcagggctatcagctgagagtaagcgtggaggggaaggggctgcaggctgaggggagggaaggaggcatgccttctgggagaggggtgaacagagaaatgcagaaagacgtcaaaccacatcataggctcactgtggctcatgtcgtgatttcaaagtgagagcaatagggccgggcagggtggttcatgcctgtaatcccagcactttgggaggccaaggcaggcatatcacctgaggtcaggagttcaagaccagcctggccaccatggcaaaaccctgtctgtactaaaaaaaatacaaaaattagccgggtgtggtggcgggtgcctataataccagctactcaggaggctgaggcagagagaactgcttgaaccccggaggtggaggttgcagtgagctgagagtgtgccactgcactccagcctgggcaacagagcgagactctgtgtcaaaaaaaaaaaaaagaaaaaaaaaaaaaaagaaagtgagagcagtcagcaaaaaggtatgttcccctagccatggtggagaactgaaaccaagcagttctggggtggtgatgccaggatgacgaagagagagagaagcaaggaggcaggaagtataggtgaaggagtgacaatgacaggccatggagtccatgctgggtacaaagcaaggcacatgaacgggatggggctgggaaaagcggccaggagcaattccctgtcaatggggaaaagcactgtgtgggtggaggactagagggaatgaactggaaagacagaaggcagagactggaaagtggggtgcttgaaacttgtatttacgggagagctgctgtcactggcgatgataaaggccagcgcgtggtcatgtgaatgtggagggtcaggaaccagaggcaacgctgagtcaggggctcacatctttgaggatgtgggggagcaccccaggctcgtagatacctatcaccggggtgacagcaagtggtattgtagggtgacagaagattcaaggctgggggcaaggaggaccctaccccacctccaggcccagtgggagagggactgggagagaaaactctcaggaggctgcggggcaagcgggtccttcaaggagagccaggtgtgggttacagtgaggaggcaaaggggagattcagggagaaggctgaggctctggaggacacacgggggtgtgtctcttccctcccttctagaaccccaggctgaagccacctggcctccactcagaagcctctgctgtgtctctgctggggtgggaggggtctgtggctaagcctcaggggacctgcaaacctcttgaaagtggctgtgtgagcctgttctcattccccagggacctcagggggtcctggaccaaaaaaaatgccaaggaccctcacgctagagcagtacctgagtccccagtttcaaagcccagcacaggcccttcctgcccacaggctccccacagggcccctcctctgtcctctgggcctttcctagtaccttgtctctgtagggcctttccctccagctggtggagtcttctggaccccttaaggtctatctctaccccagccaccccagtggagcctttcccacgccctctggtcaacacacttggccttcagcaaccatggatacatctagccactcggcagatatttaccgtgcacccacggagagcgtggcacaccaccaggcatcaggaacgcagaggagacttggccccaggccctgtccctcaggagccctgcagtctggaggggaaacagatgtggaaacagacccacggcaacctaaggcaagaggggctgtgtcttggccacatggggggtgctgaggctctgagtgggaacaggacaggcccacagagcaggagccgtgtgtccagccaaggagttgggaaggagcattcttagcagaaggagaagcaagggcaaagaggccgtgtcggggacaaggcctgtgtagggaatacaaggccccactctaaagttatctcactgaaggctgggtacagagcctccttttctcgcagagacctgccgctttccactctgcttggtgaagatgggatgtgggaggactgaatggatggaggagctggccccagagtacgtggccaggacacagggcactccacttatctgaggtttctgataagcagttttatggcaaagtcccagtccagagagcctcaaaagtcagctcccggtagggaagcacagatcacacacttctatcatccttcccaggatgcctgggaggtacagccctgtttctgctgagataccagtgagaggctggttgatttcatcaaatgtcatctgttacaagtcaatgccagccgtaaatgattaatctgtaccaggaacagaagtatctatgctatcatagtgtacacaggcatattacaagtgacccctgggggctcacacggggagagccagggcccccgcaccataggtcaggcaggaagggccaggatcagcccaggcgggtggagctccactcagctcgccacactacaaagcagccctgatgtaagaaaggtaaacgagtgggttctggagccaggtgacagggtctgaataatcgctacgctgaccagctgtgtgatctcaaattctgcaagcctctgtttcctcatctgtaataggaggtcagtaatgaccccacctcgtgggactgtcgtgaggataacatgagttactacttagactagtgccaagcccaggcatgcaggacctgctgggaaactgcagatgctcctgctgctgtcgctgtctgtatcagcagggtccagtctctccgcccagcagcagtgctgtgggactctccggccttaggttatacaacccaagaattcagaagctcctaattccatcccccaggtccatccagaagctcagcctggcagctcactgcagcaacagcagcaaaagaacaacagaaactcctccacctggagcggaaggctagcagcccatgctcactctaacacgcgtcaagtactcaggacagtccagaggcctctagggcaacacaggaggaagatcgtttagaaggcagaaactcagccctggccagaggcaagtccagtgcaccaggcctgctctccacagaccgcagggtgttgagaggagctgggagaacactgcaatgaccacccccggccctggagaaccccagggctccagcagtgccctgatgaccctcctccacagcctcgaccccaccccaccccatcgcagccctcactccaggtcacagcctaggccttggcattactgcttctgggacccctgataacctcaaaccctgcatcccagtccccatcctccacctcccacttcccagctcactccttcaactgccctcaatgcaacagtcctccaccctccacccaggtggcacagagggcctggcacacagcagccctcaatgaatactctaaagctaaattaatatatcacattcatttgttccacaaacctgatctacgccaggcacctgctgggggctgggcacactgtcatgaacccaacagacacagtccctcccctcacaaggtctgtggcctaccaggaaagcaggatccccagtgcagggacgggtgccatgggatgcccagcagaaactcctaatccagcctgcaggtcaggggagggcaagaggaaggaaggcaggcaaagaaaggggagtattccaggccacagcaagagcctgggcaaaggccaggagcacaaggcggcatgagctgagaacacagaggcagaaacttgatcacactgggcccttttaagtcattaagcacctgatgtgttaagaaaacaggaagctggccgggcgcggtggctcactcctgtaatcccagcactttgggaggctgaggcgggcagatcacaaggtcaggagatcgagaccatcctggctaagagtagatggtgaaaccccgtctctactaaaaatacaaaaaaaattaactgggcgtggtggcgggcgcctgtagtcccagctacttgggaggctgaggcaggagaatggcatgaacccaggaggcagatcttgcagtgagctgacattgtgccactgcactccagcctgagcgacagagcgagactccatctcaaaaaatgaaaataaaaataaaaataaaagaaaacaggaagcccttggggagtaaagcaggggagtgaccaatcagatttgccctctggaaacagcgctgtgacagcagcttggaagaggatgagaggagtgcaggccacagccggagcagcaggagacacgtgcacaatgactgtggtctggagaagcgagccagcagcaagacggagggagaaagaacctctgattttcgactggcacgtggctgtctgcaacacaggcaacacttcccagcatcctttgcagttagctgtggccatgtgaccgggttctggccaatgcgtgcaacttccatgaaatgtccctgaggagggggagattgaccttctgcatcctgcccttccaccctccctttggctggaaaggtggatgtgatggctggatctggcacagcccgttgcaatgatgctatctgctgaaatggaaaggttcgggtgggagcaggttagaggggagaagataaaaaagactccagagctatgactgtgaaaataaataaatcaataaaatttagaaataagacaaacaaagccgggcatggtgactcatgcctgtaatcccagcactttgggaggccaaggcaggcagatcacgaggtcaggagttcaagaccatcctggctaacacagtgaaaccctgtctctactaaaaaacacaaaaattagccaggtatggtggcacgcacctgtagtctcagctactcgggaggctgaggcagaagaatagcttgaacccaggaggcagaggttgctgtaagccaagatcatgccactgcactccagcctgggcaacagagcaagacttaacgtctcaaaaaaataaatacatacatacatacatggaaacaacacagcagcacagagaaatgaattgggaaccagaagacactgattctgtttcttcactgcttcctgtgtataagtgggatgaatcacttatcatcccaaggctattttctcatgcataaaatggaatactgccttccttgcccacctccacggattggcagagaatgtgctaacccaacatacttaaaaacatcctgtaaaattgtaatcccagcactttgggaggccgaggcaggcggatcacgaggtcaggagattgagaccatcctggctaacatggtgaaaccccatctctactaaaaatacaaaatattagccaggcgtggtggcgggtgcctgtagtcccagctacttgggaggctgaggcaggagaatggcgtgaacctgggaggcggagcttgcagtaagccgagatcgcgtcactgtactccagcctgggtgacagagcgagactctgtctcaaaaaaaaaaaaaaaagaaaacaaaaaatcctgtaaactataaagtaccacagaatagcttacgtgtagctaagaagctgctgacaaaggactaaatcctcctgggatggaggtctgcccacactggggcttaagctggctgagacaaatctggaatcctgtcaagggattttacaactgacagaacttggtgattattggtacgtggagattagtggtatccccagggccgtgtacctcaaaagtggggctgtccagctctccaaggagtggacccgctgccctggtcagctgtgcctgcagtggagctctgaagctacaagtgcaagcctgccccgtccagggtcagtcctgatcgagtccagctggaaggcggtctgctcagccccatctgcactcagaatctggaatggccccactgtattaaaactggtgcctgcactggccactgagctgcatttagcccaagcacctgctgtgggtgcctctgcctcaggttccttgtggagccaggctctgaattctcacctgattggatggggccctgatacctgccttgctcttctgttggtggcagcccctggcccccagcctgacactttcagagacccctcctgccatgcctctttagtcagaatgagtccccagctgcttccttcagcctcactctcaccaaagccctgcatgcacctgggatccaaccagagccacctgcctgcaggctcacacctccacacttctgcacggctggaacgaccttatccattttgttctgccacacaggctcctcctcactcttccagacgcagagtagctctcaatcacctccttgtgatccacactgtttcctaggctctccctctgtcacagcactcctcaaggggtgctatgacgcctgtttgcaccggacctcccccaccagactgtacgttccttaaagacacaggacatgtttgtcatctcacaggccagccaggactggcccgaagcccaggactctggagacactggaggtgcttggtgcatgttgaatggatggctgacaggacagccagatggataggtgagcggaaacagggatatctgtctgagcccaactagatgccagtctgccaagcactgctggggcctgcatttggaaccttggctgcttctccccttttcccaaccagctctgccgttggcccggttccctcaggcctgtcctggcttttgagccttctcttcaggcccaggggagtcccagcatgccccaagaggcaacagctctgtccagccttcctaagcaaaccctgggcagcccctatgagaacggccatgcccttaaagagccagggctaggccaggtgcagtggctcacgcctgcaatcccagcactttgggaggccaaggtgggcagatcacctgaggtcaggagtttgagaccagcctggccaatatgatgaaaccccgtctctgctaaaaatacaaaaatcagctgggcgtggtggtgggtgcctgtaatcccagctactcaggaggctgaggcaggagaatcgcttgaacctgggaggcagaggttgcagtgagccgagattgcgccactgcactccagcctgggcaacagagcaagactgtctcaaaaaacaaaaaccaaaaccaaaaataaagagccagggctaaaggttctccccatgggccttatctgatgtggacactctcagtctccctgtccttccttcttccctttgtccatataggtcgagcctccaggccagaaacaacccaggcttccatcctcagcctcgtgctgggacactgatgggccagaagtgtggagtctcggaagcccttccctctggtccaagagtacagtctcccctctctcccacccctctccagacccctcagacagagactcaaagaaactgcttctcggccaataagacctccaatccgagacgtgggggagtgaaaggagagaagtatgttcccgctgagcatcacccaccggaatccactctgtgagttcctggggttgaccaggacgcagtcccaggtgcggttgggagtgttctggaacagaatcagctgcccttcctcccgaactcggtcactcgaggtgtagtcggccacagccacctccttcacccggaatgggttagagaacaagttggtgacgccactgaaggtattgaccaggcggccaaagaactgcatcttctgcggggcaggtggggaggccccaccgtcttccccctctgtctggaagaaaacgaggtctctggtcagccaggcacagtctcccatgcccatctcacccagtgcagcggtttcctgcacagacacccagatcactccccaccagcgttgtccccagatcctgggcctggagggatcttaaaaggaggggaaagaaagagaaacaacactgagtgggaggtaaaagtgacagaaccctcaggccaggctggctacctagaaggctgtccccctgtgctgccactgtgcacaggtgaccttaactgcctgcttcctgacccagtgtcccagcagagactcagtttcctcacctgtagtgtgtggtattgaccaaaggagatagcacatgtgaacatacattataggcagtaatgccctgggcaaatggagggttctcactaaataagttacagagataacctttcagcactcaaagaggctagtatggaccagacacagtggctcaggcatgtaatcccagcacttcgagaggctgaggcgggcggatcatttgaggtcagaaattcgagaccagcctggccaacatggcgaaaccctgcctctactaaaaatacaaaaattagccagatgtggtggcaggcgcctgtagtcccagctgcccgggaagctgaggcaggagaatcacttgaacccgggaggcagaggttgcagtgagctgagatcgcgccactgcactccagcctgggcgatagggtgactctgtctcaaaaaaaaaaaaaaaaaaagaggccagcatggatcatttcacttccgcaaacaaaatcaatgtcccccctcctagataccaaaaggtgaccagcatcatgtcacactctatcggagcaaggggatcatcggcattggtctaaatcctttgtttcctgctaccacaggtttcccaaagagctccgagagacagcacacaaaagcaagctccttggaaatgaacgaactgcaccttctgcaggggcaggtgggggagcccctgcagaagatgccattcgagactcaggagcagcagtgtctgggtggtaactttacgctgcatattcagagtcatagtttctgccatggaaattgtccccagtgttgatgatggaattagataccttgttatttcctaggttcccagaaaatacactgccttcctaaggtactgtcaccaaagccaggcgccaatcagacggaggccgccctctgcctctgtgccaagatgtcaccagacaaaagacactaaggacagagtatgggtgccctgggggagagaggacatctgagtggacactgggtcacagccacattcttccctggcctatgtgctgagcacaggatcaaccctggggacagaaggaagacaaaagcaaggggcccactaagaggcacatgaaaaggaaaaaagatcaatactaataattataccaacaaggcacggtggttcacgcctgtaatcccagcactttgggaggccgactcgggcggatcacctgaggtcaggagtttgagaccagcctgaccaacatggagaaaccccgtctctactaaaaatacaaaaaattagccaggcatggtggcgcatgcctgtaatcccagctacttgggaggctgaggcagaagaatcgcttgaacctgggaggcggaggttgcggtgagctgagatggcgccattgcactccagcctgggcaacaagagcgaaactccgtctcaaaaaaaaaaaaaaaaagatcataacaactgaagaaaagttcgcagtgtcccattacaaggctcagtgccatctctcaatgatgtctatctggaatgttcttcctctccttttctgtctgagaaagccctgatccttcttcaaatccaagcttggttctcgtggttctcagcctcctccttaaaaatgtttttgttgttgttgttttgaaacagggtctggctctgttgcccaggctggagtacagtggctcaatcatggctcactgcagcctctacctccttccacctcagcctcctgagtagctaggactacaggtgtgtatcaccaggcctaggtaatttcttccaaacaatttttatagaggccaggcatggtggctcatgcccgtaatcccagcactctgggaggctgaggagggcagatcacttgaggtcaggaatttgagaccagcctgaccaacatggtgaaactccgtctctactaaaaatataaaaaaattagctgggcatggtggtgggcacctataatcccagctacttgggagactgaggcaggagaatcacttgagcccgggaggtggaggttgcagtgagccaagatagcaccaccgcactccagcctaggtgacagagtgaagactccgtctcagaaaaaaaaaaaaaaaaattataaagacagggtcttaccacgttgctcaggctggtctcgaacgcccgggttcaagcgatctgcctgcctcagcctctcaaagtgctgggattacaggtgtgagtcaccgtgtctggcctaaaatgttcttgatacaccatcaccagatgccaggttctctctccttgctctgggctctccctcactttaaacacatctgtactatcacagcccagcatgttacaactgcccctcctgccagacggtaagcttcgtcatcctcctaccaaacactcctgtgcatcttgctggcaccatcctgaaagctttacgtacattaatcattctgtctgacaaccactctatgaactggttactattattatcctcattttacatatgagaacaccaaagaacagaggggtaaagtcacgggcccagggtcacccagctagtgggtggagcagtgaaagctggcacccagatgggctggcccagagtctgagtttctcaaaggcagctgctcgtcttttcatctccgtccacaagcttggctcacagaaagtttgtcaaaacaaaaatttaactgagtaaatattatgcatagaaaaaacaaagcctgatagaaaacaaaccaagatagactgacagaaaacatgccattgagtagatgagggtgctgggtttatgggcttttgttttttccttttccctattttccagatgctatgtaaagcgattatagttttcaaaggaagtagcagtataggctgagcctctgggggctgcagccgggaagatggggacctgtgggactcaggcctggcctggaagagcgcagagaggctaccccgaggacgggcccacagggacgcggaggggtgcgcccaggaagggcagagagtcaagagcatccagcacccatgagcctcagattgagggagaaagtcaccaggggtgcagtgaaatcaaagaaagattccacacaccccttcgtcaatggcccagcctgtgtaccccccaccagagcctggggctaggggatgccccccacacacccacgacagcatggccacagaaacgacaggcttggctggcatccagccttcagggtaggcaggaggacgagatgacgcaatggagggaaggtgtctgggacacaggccgactgtgggcacacaaacagtggccattgttatcactaggtggaagaaaggaaatgacagccacggggccacatcctggaacactcacggcattgccaaccaggaaggcgggccagcagggagaaagtgctcacacgtgcttccttctgtccctgccaccttggaccctggagcctaggctcttcccagcacagctgcaagagggggatggtggatgagggccccccgcatcatgcctcacttcatctctccccctggcttctcacagcgtcctacccttgaccttcccgtggggtagacaatcacttttccccactgatgaccggcccctcctcctccttacctgggcttctccctgcacccccaggatgcccaggtcacctgacacagaccgcacctcggctgtgtcaagcagctctctcaaacaccacaagcagaaagacaaagacccaagacctttggtggtgggggttgacagtgacaattctgcctgtccaagccaggcaatttccaggtaccaattttggtgcccctgctgagggaagccagatatttctggccgttttccttatctctgctcacccatcctctgtcaaaaccaagcttgcctgctgggttcattgagggaagactgacagagagtgtgctggtgtgagggtcccctggaggagctgaaggacgggaggaacaagtattattatcccatcttcccatctcagagatcaagaaactgaggcccagagaggccctgaattgtacatgttcaaagggcaaattaaggccgggcacagtggctcgtgcctgtaattccagcattttgggaggctgaggcagacggattgcttgagcccaggaatttgagaccagcctggggaacatggcaaaaccctgtctctacaaaatataaaataaaattagctgggcatggtggtgtgcgcctgtggtcccagctactcgggaggctaaggcaagaggattgcttgatcctcttgaggtcgagactgcagtgagccaagattgcactactgcactccagcctgggagacagagcaagaccctgcctcaaaaacaaaacaaaacaaagggcaaattaaagttgatgtccaccaaaaaacaaaaacaaacgggctgggcgcagtggctcacgcctgtaatcccagcactttgggaggttaaggcgggcggatcacgaaatcaggagattgagaccatcctggctaacatggtgaaaccccgtctctactaaaaatacaaaaaaaattagctgggcgtggtggcgggtgcctgtagtcccagctattcgggaggctgaggcaggagaatggcgtgaacccgggaggcggagcttgcagtgagccgagatcatgtcactgcactccagcctgggcgagagcgagactctgtctcaaaaaaaaagaaagaaagaaaaacaaacgaagaaacaaaaaacctcgagtgggaacagagggagattggagccaatggtagcatctctgatgagttccctggaagtgactacctgggttcataaaacagtcaacagagagacccaagaccagtccctgtctcgccaagtgcacggtcccctgagggaaggacccctaaaggggatgactttttagctgaactttccaggaagaacaggagtttgccagcgggggaaatggcgagaggccttcacagcagatgaagcagatcagaacacggaggaaggcagagatcaggggcttgctcagcccacccatgaacggtgagcattttcactgggactggacggctcgagaggggaaggtgctgagaggaggggccgtggttagtgctgtgatcaacgtgaacacaggtcacctggagccacttgtccagggctgctatgtcagtcacgcccctcgccatgcccagggaagctcctctcatgacgaggagccaagccccggaagaagtgcagtagaggacaagggaccaagagggtggctcagagcgggtggtgagggagaactcagtcccaaaaatctggttcctcctcagctacgaattccctgaaggaccctgggcaggtctcaggcacgggaggagcggtccctgccctctgattgctgctacctgccgcagctgccaggcccaggcagtcccctctcctcccctttggaaggtctgtgtgaaaactgcttttctgtagtgaaaggggcctgcacttgcgtcctccctggaatgcgctctccagttcctgctggagcccctgctcatccttcaaggcccagctgccccctctgaatgctcagagcaccagagtgcccttccagcctgcacggttcccaacccagcctgacacccctccatgcccactgtacgatgcaaatccagctgcaggtctccctgctgaccctggccagtggcgccccatgacctcccagggaaagcccagactccagcatccatgagagctggcccaactcacccctccaactcatccctcacctctactccagccacgccgcaccatcgatcttcccagaacacgtcaaactcgtgtctcagtgcacttggggataccacacatacgctccatcagcgtagcccatcctccccactttcttaacctgaatgtgtgctccacaaaggacaaatgaacaaatctcttcttatccatgaagatacagctcaggtgccatctcctctgaaaattcatacccgcacctccgccctgcagcctggtgtgccttcctcttctccccagcaccccacaccacccagggcccagcccacaggaacacacaccatgtgagaatgggggtgcatctgttggcttgggctgctcacccaacccgctttgatttgtttccctaagcacctggcatgatgttcctgactcacagtgggtgtttaataagtttggtgaatgaatgaatgagaatgaatgaatgaaccacctataagcccatggggccagcacctctgaagcccccagacacactttattcccttgaaggtgataacagggaccacacactgttcccacccactctgagctgccatgctcctctccacaacggatagggaaataccatgctcaaatcccaccagtagctaacggcccacaaggggttcgctcctccaccgggagaacctgtatctagcacctgcactccttcaggagcggccctaagtgatcggactgatccatccccaggcttcggtctggaaagttcagctttatatatagtcagggcacttaggctgagctcactcctagtccaagcaggaaagactccaagccttctgcttccttcttgactaagccgagagcagaggagccggacagctgcccgagaggtgcgtgacaggaacccacaggcagcaggccaggaagcagacctcacaggcttggccacgtgggggattccaggagcacacacagaactgcccgaggtggaaatcaggcctcacgagccccagctgctgacgacaggatgtcccatgattggaacaactgttggatggtcctggcagcagaacctggcagcagtgacaccctcctgagcaccctcctcccacccagtcaagacagagcaggctggaaactcagggtccactcagagtgccaagctgccccaacttccttcctgtagctccgtctgtgccacacagcacgggagcatgccaccacacaccggcctccgtcctctcacaaggccaccatgcctcacggttggcaaagggtttcacacttgtgatccacctccaagctcacaaagaaacagggaaggcgcagccgggcgcggtggctcacacctgtaatcccagcactttgggagggtgagatgggcagatcacctgaggtcagaagttcaagaccagcctggccaacgtgtgagaaaaaaaccccatctctactaaaactacaaaaaaaattagcctggcgtgatggtgggtgcctataatcacagctacttgggaggctgaagcaggagaatctttgaacccgagaggcagaggctgcagtgagccgagatcatgccactgcactaaagcttggatgacaaagtgagactgtctcaaaaaaaaaaaaaaagaaacaaggaaggtgcaatcattctccctgtttggcatgtggagaaatcaaggccccaagagaggaaatggggtggcaggttgtggtgggggattgcctgcctatgtcctctgactcttgaacagcactaggcaaagggctggccacacagcaggtgctcaatctgtgggtgagaaaacactgaatgaacacaggggtcatctgagcctctgaacctccaaggcagcctcccggcaaaatgtccccgcaaatgttccctctgaccccagctcattccaacctctttcctaagttagtgggaaagggcttgatcccatcccctcacaccccatcagcacccactgctgcccagcacccacagggcgccagacgcttcaccacagtttcgggtaaattgccactttttttttttttttttttttgagacagagtttcactcttgttgcccaagctggagtgcaatggcgtgatcttggctcactgcaacctctgcctcccgggttcaagcgattctcctgcctcagtctccagactagctgggattacaggcgcgcaccaccacactcggctaattttttgtatttttagtagaaacggggtttcaccatgttaaccaggctggtcttgaactcctgacctccggtgatccgcccacctccacctcccaaagtgctggggttacaggcatgagccactgcgcccggccgaattgccacatttaaccctccaaacacctgtaagaaaaggtccaggtctctccacattacacaggaaactggggcacaggttacacagtttgccaggatctgaacccaattaggtggaatccagagcatcaggctcttaatcctcaaactgccttcaggagaaagctgaaagaaggtggctgagcgaggcttgctcaacaggctcttagattccaaaagccaaggccctcgtctcaaaatgcactgctgctcacgtgagccagagcaaaacgtcctttcacaaaaggaaaaagcatctctttcattcactccgcttggctggaccacagctggaagcaaactgccccgaaactgtcactggagctcccaagcacatgagacaggggtgactttaagagatctttgggctggtggcacggtacagtgtggcccatgttatgactcactccacaaatatttactgagatggattgtggcaggcattgttctaaccgctgaggatacaatcgtaaacaaaacagactggtcaggcacggcagttcactcctgtaatcccagcactttaggaggccaaggaaggaggatcacttaagctcaggactttgagaccagcctgggtaatatagtgagacctcacctctacaaaaacttaacaattacccaggcatggtatctctcatgcctgtaagtcccagctactaaggtggctgaggtggggggattgcttaagtctagcaggtcgaggctgcagtgagctgtgattgtgccactgcaatccagcctgagcgacagtgagaccctgtcttaaaacaaaacaaggccgggcgcggtggctcacaccagtaatcccagaactttgggaggccgaggcgggtggatcacttgaggtcaagagttcaagaccggcctggccaacatagtgaaaccccatctctaccaaaaaatacaaaaattagctgggtgtggtggcgtgcacctgtaattccagcttcctgggagactgaggtgggagaatcactcaaacccaggaggcggaggctgcagtgagctgagatcgcaccactgcgctccagcctgggcaacagagtgagaccctgtctcaaaaccaaaacaaccaaccaaccaaaaaaaaccccacaaaatccctgacatcctggaacttatattttagacagagctactaataataaagaagataaacaggtaaatatttacaaaggttttagatgacaattaactactgaggagaaaaaccagagaatggggataggaagtgctgaggtggagagtgaaattttagattgggtgaggagagaagtcttcaccaagaaattgatcttaaataaatacctgatggagagagatgaaagtcatatgaatagctaggcaaagagagcgtgtgcaaaggccatggggctggaacatgtttagcgagttccaggaaaagcaaggaagccagtgacatcagagaggcaacagggggccaggcatgtgccatgagaggagaggccactgcaaagaaacaacattttaacaagatcactctggctgggtgtggggtaagaaacagagaggcatcatagataatctcacagctttgacctgagcaactgaatgaacaatactcctatgtcctaagatgagaaagagagtgggagggacatgttttggtgaagagtggggtcagggatggagggcagaactaacaggagctcaattctaaactcttaagtttgaggcctggcgcggtggctcacacctgtaatcccaccactttgggaggccaaggcaggtggatcacttgagatcaggagttcgagaccagcctggccaacacggtgaaaccccgcctctacaaaaatacaaaaattagttgggcatgatggcgcatgcttgtaatcccagctacttgggaggctgaggcaggagaatcaggaggtggaggttgcagtgagccgagatcgtgccattgcattccagcctgggtgacagagtgagactctgtctcaaaaaataaataaatcaataaataaatacttcaagtttgaaaagcctaagtttgaggtgctgagtaagcaactagatttgagtatgtcattccagggaaaggtctggactggactggggatataaatttgtgggctgacagaatagagacggcacttaaagaaataagactggatgagatcaccatccgaaaacgagaagaggcatttaagacatgaccctatcaaaatccactgtgaaagacacagaacatattctcccagggagccaccctctacaaagtgaagtttgtaacacactcttcactacggccccttactccttgcctacctacttcccccagcacacacacccaatagatgtctgcagacacacacacacacacacacacacacacacacacacacacacagagtatttaaatttctcctttctgtatctcttagtgatgtcattctgctgagtaagagggaaactcccttttggggagtctctcatgtaacaagaaagtaatccacggaaggaacaagaagtgtcctaaacagtagcaaaccttacacatcaggacaatcacacaggctctggtgtcagattccagcttcaacctcatcggtgtgacctcaagcaactcatgcgccctctttttctcatgtgaagtgagaatatcattggccacaccaagggtagcctagaacatcagacagtccgtaaatatttgttagataaacgatgactgaatgaatggtgaagagaacatatacagaagagcctgactcacaagaggtgatgaacaaacactgccaaatgatacactgaaagacaagggacctcctgctcatccttctctccttgtcttctcattctagccctttccctttccactcctttcaattctgcctatgacccaacagtaaaatcatgtatttgtacagggccatactggttataaagctttaccttctacattttctcattcaaattttgaacctcatggcagacttacgagggcaggaggtacagttcccctgtcacagatgaggaaactgagacttggacagaaaacaggttccaaactccaggcagaaactctaacaaaaacaatgcattcaaaaacaatgcattcagcccaagggtgcagcctcaacgttgccaaaccgaacctgcctgacatcctgttgggcgggtaagaggcaggtgagggaaagacccagaagctagggggaggtattcgttggggtcatgtgggtagcccattaaaaatacggccacaggtccccttgccctgtgccctccctgtcccacacccacaggcttgccccgacccagtcccatgatcaccctggtcacatgctccctgtcaccagcttccaagtcatctgtgggagcaggaggtggacacaggattaggggtgggagactctggggtggccaggctgaggggaaggagggagcatgtcgggggcaggtctggaggcacgcgagagaggaaaggcaaggaaaaaaagcagggaggaaaggcaggagaagcagggagtgagaaatgagtagaggcaccacgaaaggtggagacggacgtgaagtggggaatcaagtgagcacttagaggagcacaggaaggaaaattaggacggccaatggggcctaaagaggcactgagggtcggggaaagagaagagatggattgactcgggaagttagggatactgagggagacacacggaggagactggggttcaggggagaaactcagggtcgaagctggggtccctggggtccacaagttcgagatgagacacgggcggtctcgggatgggaattggggacgcagggggatgaaaagatggaaggtgggggcactcagggagtcacataagggttaatggaggacatgcctcagaatcggagacacgaggaatatccaaaggagggtccggcggagacttgggagtccggagcgccgaggaagttggggaacggaccccc

SEQ ID NO: 396 - DNA, 70260 bp, Homo sapiens; identical to SEQ ID NO: 395

SEQ ID NO: 397 - DNA, 70335 bp, Homo sapiens
tgaacttgaatccaaatgatttatttcagttttggctcttaagccacttccattgggaagaagaaactcccaggagtgacctttgagagctgagggttctcggggtggggcagtgtgaggggctgggccagtgtgaggggcaaagtccaacgggcatcccactcctgcggcctgggctttcccagctgatggggtgggggacacccatttctttagtcccagcccccagggaacggagcagagggcagagggagtgggctgcacccaccaggaagcctgggagtgcccttgctgggggctggggcagaggcagcccggcaggccctcagggaggctggggctgggggcaggggtacggttgtgcccgggtacccttaatgtttgagctgatgggggagtcagttgtccttgacagtcagggaaaggggccaaagggggctctagactttcccagcctggaatgacagaaagtgctggaaggcggggttagtgggagacaggccttcaggaccagcctcgggcaggcagcttggcattctcccaggcctggtctatggactcagaggtgcctgggcccagatctgcccgggagggcagtggctgggcttggcctggcaggggctgaatggacgaggtcagctggggccggtgagaggctggggaccctcagggtgagagcagcagctggatgagcttctggaactcctcgcggtgctcatagatgtagacctcggtctcccagagggcgttgaccagcactgtgtcactgacctcatccagcatgatgtccgtccccagctgggggttcaatctgttcgggccagggaggagggggtcaccctaggatgctcaggctgggcaggggacgccagctaggaccagggtgggcttggggaacagagcagacccttggggaagggaaagtccacactagggctgggaggggaaggtcggtgagtccgaccacgccagggcacggggccaagggctggggcggctgagccctcacctgaagtactggatgccgaccatctcgcaccaggcccgtgcccggtccacagcccgcccgtctggatccgtgcactggtgagaagcagccttggtgagtgccgggcccacaccccgcccggcccgcaccccgcccggccctgccctgcactctcggagccccagcctggggagccccaggctctttcgagtcaggctgagccacacagcagcagagcggctcgggcaaaaccccttcctgggactgcagggactgtcccagctgtgcaatcagaggggcagaggtctcagcagtgccctttcagggatgatgagtgggggaaagggtagcggctgagtcgacaggcctccatgtcccctctccctgaagtttccctccctccctcctctctctctctctctctctttctttctttctttttgagacaaggtctccttctgttgctcaggctggagtgcagtggcatgatcacagctcactgcagcctctgcctcttgggcttaagcaatcctcccacctcagcctcctgagtagctgggaccacaggcacacaccaccatgtccagctagtttttaattttttggtagagacaaagtctcattatattgctcaggctggtctcaaactgctgtgctcaagtggtccgcctgccttggcctcccaaagtgctgggattacagggtgagcgcccagcccgctctggagcctttgtccattctgggcttctacactgcgctatgtttgcagaaagggatccgcagctaaaaagcgtttgaaaacccccctgctggtggtcactgagggtccctgccccgcactgagactctgaactgtggactctctctccctccagctggctaaaggcgatggacagagccctgctgtctcctccaacaccaaaggccccacaggatgaggggaagccatcgacctgggctacagaccctgagggaagtggcctgggggaggggcccacactcacacagtccaccaccatcttgcccagttccttggccccaaaaacagtcttggccagctcccaggggttgctgggacggaagacatccacacaggtcacaggcacttgtggggacctccctgtccccagggagacaacgatggagagtttcttcaccttgttggcctgaccctgttgggaacaggacaggggcagtcagaagagaccttccacaggtagggggcacgaaggggagcgtcaaggggaggcccaagactgggctctggggcacatgagaacagggcaagaggtctctggtggcaagagcatgcctggcatgatttccagccagcctcttgcacgtgaccccagaacggctggtgcgggcatcacatgccatctgctcaggacagcatctgtgtaccaacaggaccacacatacaccagctgcaagaaggatcccgcccaccccatctgatgctggcccaagtcaagtcgtggccaggggaggaaaggcagacggtgttccttggtgttggtgatttgccaggtatttgcatcattacttcatttaatctccagccagtctgtggagagggcactgatcacccagtttgcaaatgagggctctcagcgaagctcaggccgggaagcagctgcaggggccacgtggtagggaagtaggggctaaggcttgaacctgagccctgggtgctgcctttttttttttttttttgagacggagtctcgctctgtctcccagtctggagtgcagtggcgcgatctcggctcactgcaagctccgcctcctgggttcacaccattctcctgcctcagcatcccgagtagctgggactacaggctcctgccactatgcccgcctggctaatttttttgtatttttagtagagacagggtttcaccgtgttagccaggatggtctcgatctcctgacctcatgatccacttgcctcggcctcccaaagtgctgggattacaggcgtgagccgctgcgcccggccgctgcctctcttatttgcttccgaacaagctctgctgccgatttgctggatgatcttgggtgatgcctcccactctgggtcccaggctccccatccgcacgcaataggagagttagactggctagtgtctgacagtctgacggtctctgccgcctgcaggaagcccgccctgcccgatctggcccctagagggcgcttctctgtctgcccagagcctctgctgcgctgcccaggacgccctggggcttcgggaaaccacagcagcaaggatgcagctcaggctcccggcagtgctgtgaacatttcacagacaacagcatgccaaggcctcgcagcctccccaggcaggcgctatgatggccccattaggtagctgcagtgagtgcaggcagaacggggacccccagaggcgccctggctccagggtctgagctcagccaccgcgctcgcccaccccggtcacccaccgcccgccacgccacagggcctcccctagcatgctgggtcctgccagcctctgctgtacctctgcagagagagggctgctgctcttcctccagatcactgattctgcactgctctgtccccaagggcctcaggatgggtcccctgttccatggagccctttccgagcccccaggccttttagcagaggcctcacggtcctccaccacagcaccggcaacccgtggggacaggcattcctgtgggactgtctatccacagaggtgagctcaagggcaagcatgtgtcctgtccccaggctggctcgagtggcacgttcatggtatgcatgccgccctccccactcatgcacacttagagcacagtggtcctcagatcccccttagcacagtgcttcaggcagatcccacccatggaacaggttccagtgagatcaatttgccctgtgtgcacatatgaatgagtgcgtgtgtaaaagccacctgctgtcctgggggtcggtccctagcatggtttgctgacacaggattggctccagggagcagtgggtccaggccctctggcctacggcactcaccttgcggatcaggtcctgattgtactcatggatctcggtcatggcatccagcgtggggttgttggccagcagcccaccgtccaggaagcgcccattgggtcggaagtaagtaggagctgccccgctgcttcgggccgcccgccacaccagctggtctaggggcggggaaggagggcggcccagtggcacaagggactggcataaaacccatgcactccagatctcagggtgtgcgtgttgggggctgggggtgcgggaagaggggaggctgggaactcttcagaagcaggacccacgaagccacactctctggctagttcgtcctggtggaaggcaggtacagctgaggactttccagggacttttctaacctgccaggggcctgacagctcccccgcaatccctgtcctcagccaataaagaccagtgcagcgggtgggctggtggcacggtgagggtgcctgatggcaagtgcacgactcccacccaccaccccacagcctctcgggccagtcgcttcccatggatgcatcaaacatggtttaaacctgagggctgagctggaggcctgaggttaacgttctggttgaaacgaggctcccggacagtttctggagcatcgtagttccggaagaggtggagttcagccggctgccggtcagacagtgtccctgtcagcatcaccctggagagaaatgaggcaggaggacggctgagccacccgcccatccacctttccctttccccacaattcacaccccagggccttgggtagcagagtgcccactccaacctctgttcgggataggtgggcttctccccgcaccatccccgcaaaacaggctctctccggcagtgctggaggagtgtcagattggtccaaccttgggggcacaattcagcaaaagttggtttttttgaaaggctaatccaatggaaaaacctgttgcaagactgataaaacatggctgttatctgttatcaaaatcaggaaagaaaagggggccgcaccaacacacactgcagacgttagaaaaaggagaatcggctgggcatggtggctcatgtctgtaatcccagcactttgggaggccgaggcaggtggatcacctgaggtcaggagttcgagaccagcctggccaacatggggaaaccccgtctctactaataatacaaaaattaggtgtggttgcgcatgcctgtaatcccagctacttgggaggctgaagcaagagaattgcttgaacccaggaggcagaggttgcagtgagccgagatcacgtcattgcactccagcctgggcgataagagtgaaactccgtctcaaaaaaaaaaaaaaaaaaaaaaaaacagaatattttgaacaactctaagccaataagcttaaagatttagatgaaatggacacattcctagaaaaacctcacttaaccaaaactaactcaaaaaggtatttagaaaccccgagtggtcagtctcacaaccactatagaaattaattccatcatcaaaaatcctcccaccaagcaaactccaggcctagaagaatttactatcaagttctaccataaattcaaaataaactattatactaactcttccaagaaaaataaaaagaggaaatatttcctcaaaacccaaaataggaaaaaacgggtcaagttcgcccacgagcgtggacacaaaaatcttttttttgagacggagtctcactctgttgcccaggctgtagtacagtggcgcaatctcggctcactgcaagatctgcctcccgggttcacgccattctcctgcctcagcctctctgagtagctgggactacaggcgcccgccaccacgcccggctaattttttgtatttttagtagagatggggtttcactgtggtcttgatctcctgacctcatgatccgcccacctcggcctcccaaagtgctgggattacaagcgtgagccactgcgcctggccaaaaatcttaaacaaaatatgatcaaactgaacccatcagaattctctctagagaaggcaccagtaagagagagtaggcctcaaacaggtatttgcacatccgacattgacagcagtcaatttacaactaaaatatccatcaatggatgaatggagaagcaaaacgtgtatccaacagacaatggagtttttcagccttaaaaaggaaggaaattctgacacacgctacaacatggatgccaagtgaaataagccagtcatggccgggcacggtggctcacccctgtaatcccagcactttgggaggccgaggtgggtggatcacgaggttaggagtttgagactggcctggccaacatggtgaaaccctgtctctactaaaatacaaaaaattagccgggcatggtggtgcacgcctataatcccagctactccggaggctgaggcaggagaatcacttgaacctgggaagcagaaattgcagtgagccgagatcgcgccactgcactccagcctgggtgatagagcaagactccatctcaaaaaaaaaaaaaaagaaagaaataagccagtcacaaaaagacaaatactgtatgattccacttacataaggtacggtcaaagataaaattgcaacaaatttaaagatgttaattggcttttattgatgaactgagagtcaggcaggccacaaaaccagaataggttcaaagaactctggcctgcaacgtggtcaggcagtgttgatgggctgaaaaccaaagtgaggtgtggagcttaattggtttgccttgtttgaatcaggtggccatctatgattgattaaagcttagctgttgtagctaaccagaactcagctatttgttacatgggtatacgcctaagctaactaggttcacttggcatgaatgactccatattcgtttcttctgttgggcctggtacagaatcctggtccaaatcaattatcccctaaaaattttacttaacagtacctggagcagttaaactcataggaagagaaagtaaaatggtggttactattttgagcatttctgaatgatcttttcatattttgaaaatgagtcctttgatggatgtatggattcgaaatcttttctcccactctgtggcttgtctttttactccctttatggtgtttttgttttatttatttatttggatggacccatgttcttaatggagtagaatttataaatattttttctttttatagtttgtgagtttgtttgtttttgtttttttttttttgtcttaagacagggtctcactctattgcccaggctggagtgcagtgatgggatcacagcccactgtagcctcagcctccggggctcaagtgatcctcccacctcagcctctcaattagctgggactacagccatagtgccaccatgcccagctaattgttagttttaaattttttgtagagatgagggtctcactatgttgcccaggctggtctcgacctcctggcctcaagtgatcctcctgcctcagcctcccaaagagctgggattacaggcttgagccaccatgcctggcatattcctatttttgagaagaggtagaaacttcagggtctatgcttgtatccacttctctctactgcccccaagaatagccatgatgtttttgaagaaggccaaggtggaggatctgccacccagacaccaggactcaccacacagcggtagttttttatgctctgtggtccgggcacagagacagctttccaaccagtggaacaaaacacagcctggagcagatccaagagcagagggatgcttgacccactgctgaggaagcggagggaaggacagacttcacagatggggctgggaaaaattggccaatcacgtggaaaacattaaattggatcttggatttcaccctcatacaaaaatcaattccaggttgataaaagacctcaatgtaaaaggcagatctagagagctttccagctcgacacaggagaatcgtgtgctgcttgggggcagcaaaggggtttatgaacgagaaataaaaagcacaaactaggctgggcatggtggctgatgcctgtaatgggaaaccaaggcgggaggatcgcctcagctcaggagttcaagactagcctggacaacatggtgaaaccccatctctacaaaaaatacatgtgttggcacatgctagtagtcccaggcactcaggcggctgagatgggaggactgcttgaacccaggaggtcgaggctgcagtaagccgtgttcacagcaatatactccagcatgggccccacagcaagaccctgtttcaaaaaaaagaaagaaagaaaggaaaaaatcacaaactacaagaagaaaaatatttataaatattatctacctcattaagaacatgggccaccaaaaccaaaaccaaaacaaaaaacaaaaaacaaaaacctagaaacaccacagagcagaaagacaagccacagagtgggaaaaaagattgaaggtccctggccttggaccctagggaagaccgcagaggggatgccgggcccctaagactgggggacactcactttcaaaatatgaaaaaatcactcagaaatgctcaaaacactcctcttggaacacaccattcatccagccccgaacgggatgcattgcttagtcctaggatttgggcttcccaaacaaatgtttcctggaaatgtgactttctccttcagtctgacttaaattagttcaagtcttgtaggccttaaattaaaggtaagactgaagccctctgattataacctagtagtccgatcctgggagcgagtgctgtctgaaatgtgagaaaatgtttagccgtgtcatttgaaaggccagtgggttccttttgcctgggcagcaaaaacccagcctctgcccaggtggtctcagagaagggtggcccaggctctctccaggcaagccccagacccctggccgggcagggcagagccaggcagggcagagccggcagggcagagccgggcagggcagagccaggcagggcagagccaggcccaccaggccacgcccctcctgcgctcagcaggtgtctgcatgcccaagtgagagccacaccccagccctctgcctccctgggaagggggttccctctgctcccctcaagcgtggggcgctcttccccctccctcagcaggacagggagccctctgtccccagggaacagccacagtgggcacagctgcggccacggccccagtgcgccagggcttacttgggtttcctgacgtccgtcatcttggtgtgctccccaaactcccgcttcaggaactcctccaggggccccgactcgtagggcctggagccccggaacacctcatccttcatgcgaaagtacatgccgcgcatgtaggccatggacttacctaggaacaaaggggtcagaggcggggagatgcagcggccacacgcagggctcccgtagaacagcctgcagagcgcctgaacgcaggaggtggcaggaggaagcgggtttaccgaggcctaagcaaacccaaattctgggcccttcctttgcaacctcccagacagacagagagaaacctccttccggctggacatggtggctcgcgcctgtaatcccagcactttgggaggctgaggcaggtggatcacttgaggtcaggagtttgagaccagcctgcccaacatggtgaaaccccgtctattaaaaatacaaaaattcgccaggtgtggtggcgggcgcctgtagtcccagctactcgggaggctgagaggcaggagaatcgcttgaacccgggagcggaggttgcagtgagccaagatgcaccactgcactccagcctgggcaacggagagactcaaaaaccactgaagccccacggctctgcacttcatcttgtattcatgattttgtattattttccttaaagaagagcccctcaagagtaaaagcttataaaagctagacccacgttgtttgtcacagaaaacaaggaatagccctgtcctttgagccttcagaacagacagggccaaggggccggctgcacctccaggaaggagaagctgccccacttcccccgtgaggcagtgagttccccagggccagggatgtacaagcagagggtagctgaaaggaggccatctgcccacaccggaggatcagccaggagacctctcaaatcccctccatggcccctgggagtctcaagaccccggatggggaagaaatggtccctgaagaaggacgtggcccttttggagaagaagctaggactctgcccagtctgcctgctcagacctcgtgcccgcccttggaccctgtggaagaccagagaggggatgctgggaccctgaggctggggtagagagctgggcacactgctggagacccagtcctgactgcccaattcactggctgatcctctctggttctcagtttccccatctgctcaccccgcagggctatggtgagaatcatcaaaaggaaatgaaataccagtcaataaaccgccgtggacactaacgtcccggcaacttgacagatgactctcctcctccgcccatgggactctgtccccagcacctcctggactggctgagccccctgctcctgaggctggggtatgcctggctcagctctgcatccccagcatccaacacaggcctggcccacaggccctgatacccaccctagggtggggagtcctccccgggcacctccaagactttgcatgaccaggatccagatgtgggggcgctctggagaaaatggaatctgaccagcacaggggcaggggcaccagtcagacatgttgagtcccaggacaatgtccagggggttggggggagctgaggaccctgatctggcagtgcccctccccacctgtcagcacctagaagctcagacagctccacagaggagccgtcacaacactgaccacccggctatctgtccagcaagccaggcgccttcgcaaagcggcagtgaaaggagactacacagtgccctgtggcctaggaggtgccaggctgggagtctaggggactgtgctccagcccagcgaccccatggatgagctatgtgacttcacgtcatccctccccacctgggaacttaatttcccagtaaaatttcccagtaaaatgaagtgtgcaggcgagggctctggcatcctgaggctcagtggctcctcattcctgagactgcctgctgcgtgcaccctgggaatgggattccttatgtgcagcaggctgtgtggcccctggtgcctgctttgcaggggtgaggggaggaggggttaaggcagtcgataggaaacgcttcctatgccaaaatttcacacagccagctctaccctctgtggccagagggcgggggatccccaaacccaagcccatgggcccagcccttctccttccagcctgggacctcagcacctgcagccccgcccctgcctcctcaaagtgcttatagccctcctctactcctccactctctttttgcaaagccctgaagacaaactcggccccttgaggacacaggtctcagccccgcctggccccatccccaggggccgccctcactgtgcagaatggccagggccaggatgcctccagtgctggtgcccgccacccagtcaaacaggtccttggtggccacacccgaggccttctcgatggcgatgaggagctggatgatgatgaggcctttcactcctcctccatccaggcacagcaggtggtcgtggctgcagtgggaacagcagtgggagagaggagggtcctgccacagcccagtactttacatccaccctcatagcccttgtcccctgcagctgtgtcctggcagacagacccagacggacccgaggaacttctgtcctatgcaggacagcgagggtgggggtgagggcagtaaaggaacaaatgtctagtatttcaggggctggagagtgcaacagagaaagggaaaggaaggtcgggggatagcatcactgaccaggcgccatcccagcaggatctcggccagtctccccaacttgggacacctgattttggtcagtatcaggcctgatccaaagcaggtgcctgataaagtctgttggaattaaataaggctggggaaggaggggcggggaccctacagccaggccaggaatgggcagtgacagagtatcagggcctccacacaaggtggaagaagcaggggaggagggggcagggaggaagggagaggttcatgccaggggctatgggaggggtgctaccagcattagctcatgtcattgtcccaaacgcctctgaggcagaccctccctgacatccctgtgcttatttatttagagacggagtttcactcttgttgcccaggctggagtgcaataacgcgatctcggctcaccgcaacctctgcctcccgggttcaaacgattctcctgcctcaacctcccgagtagctgggatcacaggtgcccgccaccacacccagctaattttgtatttttaatagagacggggtttctccatgttggccaggctggtcttgaactcccgacctcatgtgatccgcctgtctcggcctcccaaagtgctgggattacaggcacgagccaccgtgcccagccttatttatttatttatttatttatagagacagggtctcactctgtcacccaggctggtgtgtggtggtgcaatcacagttcacggcagcctcaaccttctgagctcaagtgatcctcccgagtagctgggactacaggcaggagccactgcgcctactctctgtgcatatttttgagtgacggagggagtgtagctcagaggttaggtgacgggaaccaagtcatatggatgcggactggacctggacccaggtctgccgcctcctgagtcacatgctctccagcgcgccctgacacgtctccccacatcctgcctgtcctcattggccatgccctgggggaatgcctttgtggttggttcagtctggaaccttcctctgatcttctcatcttcccatctcagcttgatgaagctgagagaagcctgccctgatgccatcgagaccctccctcacagcccgcctgctgctccacctgcttcctggtggaggctgcttccattccattcgcaatctttcttttactctctcctgcgctgacctggaagctccaccagggcagaagccgcctctgctctgggcagcgctgtgtgtcaaggggatgcaggaggtgcccaagagggctgataaatggaggaggcccgggtcccacctctaggggtcttttcctggaccaggtacccagccccacagcaagcctagaggtggcaggggagagactacactgttgctggaggccaaagcaaactcccgaagatgcggggctggcgacagagatcaacccagagggcgcagggctctgtagcttggaaggcccaagtggggagctaccgaggggtctcctgactcttgcctcagccccgctccaggcagggttctgaggctccagaatctggggaatctgcttttcctcccttgggaaatgtgggtccccccttcaggtgcagctgcctcacctcagcccctgcacaggtgtgtgtatgtacatgcatgtgtgtacatgtgtgtgcatgtgtgtgggtgtccatgtgcatgcatgcatgtgtatgtgtgcgcatgtgtatgtgtgtgcatgcacgtgtgtttgcatgtgtgcatgtgtgtgcgtgtccatgtgtttgcatgtgggcaacacatgcatgtgggcaacccgcaggcatgtgcatgtgggtgtgtgtgcgtgcatgtgtgcgtgtgtgtgtgcgtgtgcccgcgtgcaagagcatgcagggggcacaggggagggaatgctgatggggcaggggaacctccagggcacacaacagggtagcatggaagtgagtgcgaagtgagaggacccacagagctgcacgatcactgcctggccctgggagtggagctgcctctgattctgagaagagagctttccctgcagagggctggcactaggtatagagtccacagagaacccagagagagcctgcggtagcacaaaggacgtgggttcggaagacccggctgtgagttgccaccctgacactcactccgtgtgaccttgagcaagtcacttcacctctcaggggctcaggttctgcatctgtaaaacaaggttacaaattcctccctgggaaggctattaggaacatgagagactaataaagaataaatgaatcaactgcagcaatcaagggaggtggcgacagcacagtggctggaaacgcatttgtcctggtaccttgccgtgccagctggcactgagttcaagcacccgggattatgcctgaagggcaaggcctgggcgtcttctctttgcatcctgtcacccaggcccgcctcttacaatgggactaggtatacagcaggtgctggggaaggcagcccacgccactattctgcagtgggaggtggttaaggaagccagtaggagcagtgggaagcagctgctgagatctccccaggggggacccaggcatctccccctcttctagccataaggagatcagggagggaggccagaacactgcgccagccccaccaagtccaagaagcctggcaccctgggctggtctccagagcctgcaccgcccagcattaatgaacgagcgacacaggctctccatgttctgtctctgctgagaactataagactaggagcagagccacttcgccggctgtgagggtgcagagagtaaagccctgagcccacaacagggggtgggtgaggggcaggaaagcgcacacgttccccgctctgcccccgatctcgatccacttacgtccgcttctcgtccctcatggagcccaggatgaacgctggcttccgggcccgtgagatgtgcatgagatcctgtagttctgtgaggcacagagcagggcatgctgtggtcaggtgggtccccaagccctgctaccccagaggtccctagatcaaacctgggctgtgcctcgcccacggccacgccctcatccccccactccccctgtcatctgtcccttccccacaggaaggactctgtcccaggagaaagctgagccacaggccacaggagagaaatgggctggagtggaaaggggggcccactgctctgggaagggctccccaccctgcccagccagctcccaggttcccctcaatctcttcctcttgaaaccccaaggcatgaatacccttgcgtgtcctcttcagacaaagtgcttcttcttgcatcggagccgatgctgcaataaccacctggggcctaagaattcttattccctattgacaggtgaggctctaagagggtccataattcacccaaggtcatttagtcaaaaggctgagtcaggacgttcctcggggtttaagtccatggatgaaaggagacatccctcgtcctgatcccaggtctggaaatcccagtggcctccgggatcaggcccaccatccactctgtccatgtcttcctttgtgtccaaggcctgcctgacgtccacccaactgactagctgcccctcctgacaagcagcccagtccccaggtgcctggtgcagcagcccgcgtgaccccaactctgacagccccccaccactgtgcagagtctagaagcagcaaagcagaaccgagggctgcgaagcggtgtctccccctccccagggcacacggctccacagtgaacaagggaagcagaagagtggctgagagaggccggggacagggtgcaggggagggggcgtgtggtgtgtgcgcagctaagaaggacggattagggagtgagagctagagctaatgccgcatggctaggctcggtggcctctccaggcccagggcgttacccatctgacgccgcaccccaggcccaccatccggcctggcttgggtgactgcctgcaaaattgagagataaagatgggaggtggagggggagttcctgggaggggagagagaggtggagccaggactagaagccacagtcacggtgcctctccagagttccaggcttggtcgggctaccctggctgaaggtgctgccgcctccacagtgaagtctggctcaccaaggactggctcctggctgccctctgttcaggggaccccgctcccaaacaatggaggtccctgagtgggccagcccacagaaagtccagagaagggtcctgtctagtctggggatgtctccctgggcaccaaggaatgcaccggggcagatgctggctgcctggccacattcaacgtctgaaagtcaccacggggccaggaagggggcacacaggtctcaggcccaaccgagattcaaacagtgtgatagaggtgaagccagagggacaggtgaagccagagggcccgggcccccagtcccccgacagcactcctcactgcccaccctgaacgccctggggacaggagggcagtaacagcagccacctcatgggtgccactggaaatgcccaggcctgagactgtgtgcaggacacatcctctcaggggcaacggagcatgggacatcagccagggacaccctaggcctctgggatctgtgggttgctggctgcctagaggctgacaactccggccccatcctccccggcttcctttagtgacttccgtcctagggatcctgttgctttggtggggcctgctgtgatccaggggcctgggaaccagctggagaagagggagtcgggaggcgaggcctacctaggttgtttaggctgatcggtgggggctgagctctttccagggagaagggatgatgtggcgctgcagagccctgctccgcggggaccccgtggatgggtgggaagcagtattcggcccccacggttctcagcagagtcaagatcgccttcctggtgacaacttgtcatggtttggggaaggggagatggcacaggatcagaaatgatgtcaacatgcaaaggagaggcccctcctttccacactccgtcccctgtcccagctcccaggccctgggcacgtgggctgctccagaggcctcagcccaccctgacagggagtgctgcccccaggctggtacatcccaagcagcttcctaaggccagggaaggaggatatgggaggaggaggtcagtgtcaccctgcccgatgcctgtgggaaccccttctttccttctactccagccaagaaagcaggaatcccatggccacattcagtgattctcaaaaatgctaagtgatagttcagggttccaaagggactaatgagccagccagggggcacctactccatttgatggatgggattgctgaaaaggaggtcatagatgcggtgcatgcagacacacacgtgtgcactggcacacacacactgctgccatcaggtacctgcccacagtgacccccacagctgctgaaaccctccagagcgggctccaggcctctggtgaggaggatctgctctgtccagctctgaagctaaggctcactgtgcgagcgtgcagcacatggccatgcactctgcccacacaggcatgcccagagctcgtgcagtgtagtgcatgcacccttggtcattctagccagtggttccatcagtgaattccccaacggtggggaaagaaggctgctgctggctctcctgtccccacccctgctgggaatcttagctccctgaggtggggggcgctgcacgggagaggatgctggtatagcaagccccgtggtgggcctgcatctactgctcagggcccttgtgcttgggtaaggaagccccctctctgagtacgaggtgctcctggcagctctgagcagggcgggtcagcacaggatgctggcacctgatgcctgggacttccctcctcctcggtccctgtatccacccaaccctcaccccactccagccccagagtgcagagcacatacgtctgccgattttggaggctaggaatgtaggagtctccccaaagtcattcggggtgtccacttctgctccgaacacgatgagggccttgatcatctccacgttgtctttctgttggagatggagagaggataagacgtgcaactgccggggaagtgaagaacaaaggggcccctggctgccagccccaacctgtcaactcacccagcgggcctctcctcagcacggggagacactggaaccctcctcacccccacccaagtcaatctggtagtccaaagtctgccatttgatggctggggacctgacaaacaggcttaaaagcacccacaggggagggtgtaagaacccaggcagaaactagaagtgactcgcccctgctctgccagctccgcctccaaagatgcagtgcatctgtgaccccgacccaggagccatggggacacagtaggtcagctgctgatggctttcaggagtagcaaggagagggtgggtgagggcagggaaggccatcttgcccacccagtccagggtgtcatccctgaggggtaaccgaacacacgtgcccctaatggcagccttcgggggagtgtccccacgaagaacgtcacacatttccacacctggaggccgggcaggggcgcagagcatggcatggtttcagaggacacactggccacctggaactgtgggctctggccttgtcaccttcctcttcttgggacccgatttccctgcctagagaatgaagctgtgggtctagaatggggttttccaaacagttcttcacattctattaggacttctatggctacagatatgtgtgtgttttcagcattaactgtgattttttgttgttgttactgttttgttttgttttttttgagacggagtctcactctgtcacccaggctggagtgcagtggcgtgatctcagctcactgcaacctctacctaccgagttcaagcaattctcctgcctcagcctccagagtagctggtattacaggtgcccaccactacgcccagctaattttttgtatttttagtagagacagggtttcaccatgttggccaggctggtcttgaactcctgacctcgtgattcgcccacctcggcctcccaaaatgctgggattacaggcgtgagccaccgcgccctgcattggttaccttttatggttggcactggatggatggatggccatttatggtagtgatgcaacatttctctcaaaataaatttaagtcagtttaaaagtaagccaggccgggcacggtggctcacgcttgtaatcccagcagtttgggaggctgaggcaggtggaacacctgaggtcaggagttcaagaccagcctgaccaacatggagaaaccccgtctctactaaaaatacaaaattagccaggtgtggtggcgcatgaacgtaatcccagctactcgggaagctgaggcaggagaatcgcttgaacccaggaggcagaggttgcggtgagccaagatcgtgccattgcactccagcctgggcaacaaaagcgaaactctgtctcaaaataaataaataaaagtaagccaatttgaagaggtgattaagtacataattgtaaaggtggttgatgaatatgccaaaaactgtgaagatgggatgaagatgaccaaagtctatcagcagttcttaaagtaagacctggggacccctgtgaacacgtgataccctttcagaggtctcacacccagctaattttgcatttttagtagagatgggctttcgccatgttggccaggctggtctcgaactcctggcctcaggtgatctgaccatcttggcctcccaaagtgctggtgtacacgagccactgcagctggccagttattttttaagttttttaaaaaatttttaattttaatttttgtgggtacatagtaggcatatatatttattattgttatttttaaatgaattaatattttgaaattttcacactttaaatttctaaaatggtaaatatagataaagaaaatccagatgattaaaaaatctttgtgatcctcaataatttttcagagtataaagggatcaaataggccaaaaaacttgagaactgctgagttagatcattccaagggcccacccagtgctaaaaatgtccacagtttcaaaaatgaaactatttatagtttcagccttttgggcaacaacatctcttccaagttttgacctttggtataaaacaggatgtctctgaatgtgtcctgaatcagcttttagagtcccgggggtctctcatgttctgtcactgagactcagtaaacagacttctgtacatacggtattgctatagaaaacgtgcacacggtggggcgcggtggctcacgcctgtaatcccagcactttggggtgccaaggcgggtggatcatgaggtcaggagtttgagaccagcctggccaacacaggagttcgagaccagcctggccaacgtggtgaaaccccgtctctactaaaaatacaaaaattagctgggcatggtggcacgtgcctgcagtcccagctacttgggaggctgaggcaggagaatcgcttgaacctgggaggcggaggttgtggtgagccgagatcgcgccactgcactccagcctgggcgacagtgcgagactccatctcgaaaaaaaagaatacatgcacacacatatgtctgtaacacagtaacgtcctcctctgctaggtttaatatgttcatactctagatgtgtaaccagacagtaagggctttgagggcaggaactgtgttctataataaaccaacgaatatgcctggcacctgccacaggctgctgggctgcacactcaggctttgcctgccaggatcttacagcctcccagggaagatgagagcaacacgcggaccagtgaagggaagcaggatgctcactcgggccaggtactgcgtgtgtcacttagacattctgtagagggtgaccaagtgtccaccataacttttccacaactcttccagataagtattgacaccaccattttccagatgaggaaatcgaggctgacaggtgacatggcttgctcagggccagtctatggccagagctgtcatttttccctctcgtgccatgcaagtgccaaatgggggcacaggtggaaaaggtaccacagcacacaggaggtggtgttattttgggctgagagggggacttggaaggcttcctgagggaggagtcagggtctgaactgagctttgggtgggaagatgatttggagcagctgacgataggagggagacagtggggaggagggctccagtccggacagccctcctgcattcccaccggggccccacagggcaggacacgcggtcctgggctcaccgacatggccaggtgcagcggggtgttgccgtgctctccgcgggcatccgcgttggccccgtgggtcagcagcactatggcacagtcgaagcggttgcgcatcaccgccacgtgcagggccgtgttccccgcggagctggtgctgttcacgttgcagccccgtttcagcagcatgcgggccatctgcgggagacggtcaggctgagttagcacaggcactcggggagctgccgcaccccgggacacgtgggcactgccacttctgctctgagaggcctacaggtactgggatgttggaaagcgctagcaagaggattccaggggcaggccccagttctaggggggcctagactgcctcccatcccatcagcatcccaagactagggacaaaaagccaaagatgtgctgactgttttaagaggcttctggtcctttcctagtgccaacagaacccactctccttgcaaaggctcctctggggcctgtcctgaagcaccccgctccctgcatccctccctggaaccctgcaaaggtatcacctctcactgggccttggcaatgcacatccctggcagagccttgggaacagggaggggagcctggctttggagtcacagacctgagcccaaagcccagcttcactcatcccagctgcctgcgcttggatgggtcactgtagccatgtgcacttcagggcttctgtgaagatgggaatgcaagtccccacctcacagcatgtgatgacaatgagtgaccaaacctacacggaagggcctgactcggtgtccggctcctggaatgcagaggtaccctgaggctggcagtgccctccctcctggcccatcacattgagaagtaggccatgaactctggggcatcccattctctgtcaagctgtgcttcctggtgatgagaccagaggcctccatcctcccaggaggacagagcttagcttaggggaagaactcagaggagatgcccagccaggctccctgtgtgtgcagctaggcccagcaccaccaccaccaccatcatcatccatcatcatcatcatcatcttgatggttaataatgagtgtcaacttgattggattgaaggatgtaaagtattgaccctgggtgtgtctgagagggtgctgctaacggagattaacatttgagtcagtaggggaaggcagacctacccttaatctgggtgggcaccatctaatcagctgccagcacggccagaatataaagcaggcagaaaaaaatgtgaaaaggctagactggcttagcctcccagcctacatctttctcccgtgctggatgcttcctgccctcaaacatcagactccaagtccttcagctctgggacttggactggcttccttgctcctcagcttgcgatggcctattgtgggaccttgtgatcgtgtgagttaatgctccttaataaatccccctttaggccaggcacggtggctcacgcctataatcccagcactttgggaggccaaggcaggcagatcacgaggtcaggagatcgagaccatcctggctaacacggtgaaacctcgtctctactaaaaatacaaaaaaattagccgggtgtggtggcgggcgcctgtagtcccagctactcaggaggctgaggcaggagaatggcatgaacctgggaggcagagcttgcagtgagccaagattgtgccactgcactccagcctgggcgacagagcgagactccgtctcaaaaaaaataaaataaaaaaataaacccccctctctctctatatatatatctcctgttagttctggccctctagagaatcctgactaataatacaatcatcatcacgccaccttctatttgggaagcactttacaatttgtgccgagttttgtcacacactgccttgctgacttcatcacatcgccaaagcagaattcatggatgaggaaactgaggcacagggcggatccccccgcccagccagagagcagcagagccctgccaggatcccagctcttcatggacttctctgcctgcacacccactgcaaggtcagcccccaagtgctagcctcagggtcctctcgggaacctgcttcctgagggccctgaggacctgcggggcccggccccctgccccacccacccacctcaggatccactcacctctgcgttcttggcccagtggagggggctggctccgtaacgggggtctttgctgtggatctggctgctgtccatgctgatgatcatctccgcacacctggtgagagaggggccccggttggtgagcagaagctagggtctgcgtggcgtgggatgaagccaggacttggagcttcatctactgcttacagagagcatcactgcaaacaaagttcagcaaacccaaccagcacactcaccatggttaaggctgtactgagcccctcaaggcacaactaaccccctcctccaggaagccttcctgatgctgccaccagcaatgatcaccctccctggtactggctttagagtcagatgggcttgaagtcaagccccagcttcctcactggtggcctccagaagctgagcaacatggagagagtgctgagaggagtggctggggtgtaaggaagaccaggcatttcagagcccagttctgtgcctggcacacagccaccctccacctccttaccacactgtcagtgagtcacacagtgacctgcatgctataggaagcagtatgacagagtgggaaagagcacaattgctttctactcggtgcctgaggcaagcagtgtccaccagagatcttagcatctccagcctcagagcagaggccccgggttcacaagcctcattaggccccgcctggcccaaagaaagtgctccatcattgtatcatgggtaggaatctcggttcacaagttcagctgtgcaaggagaagactttaaaatttttctggctgggcgcggtgtctcacgcctgtaatcccaacactttgggaggctgaggcaggcggatcacctgaggtcggaagtatcaaaggacggaatgcagggacttgaatggacatttgcagacccatgtacacagcagcattcttcacaacagacaaaaggtggaaacaacccaggcgtctatcagtgaaggactgaatggataaacaaaatagtattctgccttaaaaagaaaggaaattctgatacgtgctgcaacatggatgagccttgaagacatcatgctaagtgaaataagccaggcacaaaaggacaaacgctgtatgatttcactgatacgaggttctagaacaggcaagttctgagagacagagaggatatgggacttatcgggggctgtggggaggggagaatcgggagttattaatggttacagtttctgtttgaggtgataagaaaagttttagaaaggggtaatggttggacaacattgtaaatgtgattaaaaccaccgaattgtacacttaaaagtggttaaaatgggccgggtgtggtggctcacgcctgtaatcccagcactttgggaggccaaggtgggtggatcacctgaggtcgggagttcgagaccagcctgaccaacatggagaaaccctgtctctactaaaaaatacaaaattaactgggcatggtggtgcatgcctgtaatcccagctactactcgggaggctgaggcaggagaatcacttgaacccgggaggtggaggtaacggtaagccgagatcacaccattgcactccagcctgagcaacgagagcgaaactctgtctcaaaaacaaaaaacaaaagtggttaaaatggcaaattttatgttatatataatctatcacagttggaaaaaataaacataatatatcagaatcattgtatactttcaataggtggattgtatggaataggaactatatctcaataaagcttttttttttttttttttttagtgcaattactaggacagcccacatgggtttaattcccaggtctggcacttactgactgcctgactttgagcaaattacttaatctctctaagccctggtttcctcatctgttttttgtttgtttgtttgagacaggatttccctttgtcacccaggctggagggcaatggcatgatcatagctcactgtagcctcaaactcctaggctcaagcgatcctcctgcctcagcctcccaaagtgctgggattagaggcatgagccaccacacttggccctcagctttagagggggaataaaatacatcagctctctgggctatagtgaaatagcccacatgaaggctaagccggtggctgggacagcgttagtgttcagctgctgttctctattattaggggtgcccagcacaggcccaggatttatgctgcccagctccctacagcccttatgccagcgcttggtgctcagcactaggcacatggagtcaggcccagcttctttccctgggccctctggagccccccaagtcttcacccgagtggccagctccggctagtgtccatggcttggctcgggctctgctgcccccaaaccttccctgaactccagctgcctgatgccgtctctgagctcctagtgcagcccccaggcatcctcagtctcagcctccatctcactgtctgggattatctgtttcccttcctcagcaggggcttaaccatctgagaaccgcaggcacaaaccgagctttgtgggaaaggtcagctgcattgaaaaacagcagaggtggccaggcgcggtggctcacgcctgtaatcccagcatgttgggagggcgaggcaagtagatcacctgaggtcaggagttcaagactagcctggtcaacatgatgaaaccccatctctactaaaaatacaaaaattagctgggcatagtggcgcacacctgtaatcccagctccttgggaggctgaggcaggagaatcagttgaacctgggaggcagaggttgcagtgagccaagatcatgccattgcactccagcctgggtgacagagtgaaactctgtctcaaaaacaaaacaaagaaaagaaaagaaaaagaaaaacagcgagggagctcctagtctgagctgtgagggaaccacttgtcagtaacactgaggccgtgggattcttggagtagggctgtgctggctgccaagtcgataagggatctccctgctccactcaaggtaggagcctcttcctttgtcttctgtgcaaagatcctcttatgtgatgggacgctggacccacccaggatggcctgtgtggggacagagggaccggtgagggctgaggttgtttgaagagagagaaaactggtcaattacagctcctgcccagtacagctcagggtggctggagacaagcaagagtggggccatgtgccagccctctgggtagagaagagcatcacctggtgtccactcaggtcacaacctgcaaatggggaacctgactgcggggctgggggtgttggtatcttctctgtttggtcaagtatttctgaaagctctagctcattctggctgtgcttgggagattcaaggaaaggagggtttgtccaggcttggtccagcccttagaagggctagcaatgccccatggggctagcaaggtggatgcagctcccagaggaaggaacaacctgaggacaggcacaagtgccagcctccctgcctgagtgctgcccgtccatgccttctcactgcttgtctggcactgcgctatgagattctgggtggctggggtgtctcctgtcctggagtggcttattcatttcggtgaggctggtgctttagcacagtgccaggatcgaaggactcattggctcattcattcattctagatgttgttcctgttagatagtattttttttcttgagatggagtcttgttctgtcgccctggctggagtgctgtggcacaatctcaaatcactgcaacctctgcctcccagtttcaaacaattctcctgtctcagcctcctgagtagctgggactacaggcacacaccaccacacctggctaatttttgtatttttagtagagacagggtttcaccatattggtcaggctggtctcgaactcctgacttcaggtgatccacccaccttggcctcccaaactgctgggattacaggtgtgagccaccgcgcctggcctagatagtattttgagatttgagatattcatttatctttttatctcatcccctacccctttgaagacaattttcctgacaccaggggttcccaggctcccaaaacatgagcctgtacctgcctcccaacgtgccaccagccagaaaggaaagaggcatctaggtggacgggcactcggccaccttaccaagcatttcccaggctttgagctgggcacacaagaaaccaaggagcactgaagccatcggggggctgttcagatcaggctgggctgggttagaggaggggccaggtgggccttggggttgcatcagactccagaactggagcaccacctggaggggagctggaaagaggagaccccaaagagggctaagattggttgtctccagttttatagagggagattcactcctaggaattaaggtacattaaataaatttatttttatttatttatttatttatttatttatttattttttgagacagtttcgctcttattgcccaggctggagtgcaacggtgcgatctcggctcactgcaacctccgcctcccgggttcaaccgattctcctgcctcagccttccaagtagctgggattacaggcatgtgtcaccacgcccagctaattttgtattttttagtagagatggggtttcttcatgttggtcaggctggtctcgaactcccgacctcaggtgatctgcccacctcagcctcccaaagtgttgggattacaggcgtgagacaccgcgcccagccagaaaaattttaaagtctcctccttgcacagctgaacttgtgaaccgagattcctacccatgatacaatgatggagcaccttctttgggccaggcggggcctaatgaggcttgtgaacccggggcctctgctctgaggctggagatgctaagatctatggtggatactgcttgcctcaggcacgggacaggtgacaggagagctggagcccagcaggccagcagatggggaggggaggaggtcttaccccttctgagagaacttcatggccgagtggatggggtagccgttggggcccatgatgttgcaccgagcattgcacagcagcagcacgcggaccatctcctgcttccccagctggcaggccaggtgcagcggggtcagcccttggttattcacctggttcaggccagccactgcgttccttccaaggagctgatgaaagaggaagggaagtttgactccataggatgctgataagaacgtaaagaggccgggcgcagtggctcatgcctgtaatcctagcactttgggaggccaaggtgggtggatcacctgaggtcaagagtttgagaccagcctggccaacatggtgaaatgtcgtctcttctaacgatacaaaaattagccgggcatggtggcaggcacctgtaatcccagctactcaggaacctgaggaaagagaatcgcttgaacccaggaggcagaggttgcagtgagctgagattgcatcattgcactctagcctgggcaatagagcaaaaactctgtctaaaaaaaaagaacgtaaagagaagcaccaggaaagccaagtgccagtgtggatgggagggaaggggtcgacctggcatgactgtggctcacatgaaacatttctgagtcaaggaacttaaaaggtagctgtatctcaggatgggcactgggggtccaggtgggaatgattcttgcttttcattctgtcctgactgatttttttctacatgcaggtactatgttttcaatgaaagaacagcagtattaaaaagagagccaggggccaggcgcagtggctcatgcttgtaattccaacacactgggaggtgagaggatcacttgagaccaagagtgtgataccagcctcggcaacatagggagaccccatctttaccaaaaaaattttaaaaattagctggcgtggcctgggtgtggtggctcacgcctgtaatcccagcactttgggaggccgaggcaggcggatcacaaggtcaggagaccaagaccatcctggcgaacacggtgaaaccctgtctctactaaaaatacaaaaaaaattagccgggtgtggtggcgggcgcctgtagtcccagctactctggaggctgaggcaggaggatggcatgaacccgggaggcagagcttgcagtgagccaagatcgcgccactgcactccagcctgggcgacagagcaagactccgtctcaaaaaaaaaaaaaattagcccatgtggtggcacgagcctgtagtcccagctgctcaggaggctgaggtgggaggatcacctgagtccaggaggttgaggctgcagtgagccacaatcacaccactgcactccagcctgggcgacagagctagatgctgtctcaaaaaaaagaaagtgctaggagggttttactgtctcacttttggctcagtgctgtccccatgaggttcattacaaccacagtgtacccatgtgacaccagggtcacctcacagcagtcccactggacctgaaggcaggccagagacacagcaggaagagcaaagggctggcatcgaggccaatgtaaggtcaagccccactctctcagctttgtggccctccctgggcacgcttcttaattaacaacactgaacctcagtttcttcggagaggaaaggggaataatgacctccaccccatgagtgtattctaagaattaactggaacacatacaacactcagttcaaggtcaggcaccaatcagcaccggataaaggacagctgcagtcgtgcatgactatcgagaagcgggtgtgcacacccccgcatggaggcagggtctgcgcggcaccatgctgggtgcgcagaggattctcggtgaaagtggagttcaacagtgggtggagaattcccttccctgagagcaagaagcataagatatgaatccacattttctgggccgggcacagtggctcacacctgtaatcccggcattttgggaggctgaggcaggtggatcacttaaggccaggagttggagaccagcctgggcaacatggcaaaaccccatccctactaaaaatacggaaactacccaggcatggtggcacatgcctgtaatcccagctactcaggaagctgaggcacgagcatcacttcaacccaggaggtggaggttgcagtgagccgagatcgcaccactgcactctagcctgggagacatagggaaactctgtctcaaaaaaaaaaaaaaaaaaaaaaaaaaaggaatccacattttctggtataacgtagttgcattctgatgccaaggcagagagaacatgatctttagaagaattttctaattctagacaataaaacataatccaacatcctgccttttctgttcaatctaatatatgaaatagctatttaatagtatcaccccatctgcttgcccacaattaaaaaatcacatcttttgcccaggtaatcaaaaacgttaacaggagggcctctggcacaaatgcctacaggaactggagacagtttggtttgcttggtttgaattcctgtaaaatagggttgtccaatattttggcctccctgggccacatcagaagaattgtcttgggtcacacataaaatacatgaacgctaacaacagctgatctaaaaaaaaggtccatgcatggatctcataatgttttaagaaagtttgtgaatttgtgttgggccacattcaaagccgtcctgggctgcatgcagcctgcagggccacagattggacaagcttgcaaaaggttaagcccaggtcccgctggcccacgagcccctccaggcaggcatctggctcacagtttgtgctcaggaaaagtggaactgaactaactgactggagctgggccttttttggggtttattttgctgggttggaggccgtccccaggtttatcaagcaaagagactgaggacgtggctcctggaaaagggctgggagggaagagccagggaggggtctgcaccctccatgaaggagctcaggcctcaaggaccaatgggggacagtgagaggcctgagagtgacacctgagcctaggggcccaaagggaaccgtggacaccgggaggtatcagtaccagtcaccctgcccctccccctgctcacctgcagcacctgagaattgtcaccctggacagcataatggaagacggtctctcccttgtagtcggtgacatccatctgagtgtggcagtactgcaccagctccaccaggatctccccatcacccttgcggcaggccaggtgcaggggtgtgcagccctcctcgttctccgcgcaattggcacagctgcaggagagggccagggtgagcagaggtgagcaggtgtggtacaaggtggcagggggacctaagtgcacatgcagggaagtgcactcggaaactcggactttctggtttatttgagctcaagagcattcccgccactcagctagttgggctgatttgaatgtaattatatctgatgtgacctgtatcaggtttctgttcagtttgctcactcgtacaagagatgggccccagggccacaccagcaggaagtgggcagggtggtggcacaggaaagggtcacagaacacggatatctcactagcctcaggcaattcacttaacctttctgggcgtcaatatccttatcgacacaagctgctgtgcctgccccaggaaatggacagagtgatggtgagatgagacagtgctgtccaaaagcacgcctggaaactaaagtgcagtgagggtttttgttttgttttgtttttttgaggtggagtttcactcttgttgcccaggctgtaatgcagtgacacaatctcggctcactgcaacctccgcctctgggttcaagcaattctcctgcctcagcctcccgagtagctgggattacaggcgtgcgccaccacgccttgctaattttttgtatttttagtagagacggggtttcaccacgttggccaggctggtctcaaactcctgacctcaagtgatacacccgcctcggcctcacaaagtgctgggattacaggtgtgagccaccacgcccggccagcagtgaggttttgagttctgggcctgggagcttaactgagctatctaggatagagactcagaggaggtgtggctacctctgcacaagatggccaactggtgccctgtgcaagggtggggacagtgccctcaccaggggcaacagctgctccatctgctggctgaatggattcacaaaaggaggccttcagcttccagaagagcagcctgggcagacaccaaggatccaagcccctctttcaccctctctggctgagtgacctgcacaagtcctgttagctctctctagaatgatgatacctgggccgggcatggtggctcacgcctgtaatcccggcactttgggaggccaaggagggcagatcacctgaggttaggagttcgagaccaacctggccaacatggtgaaaccccgtctctactaaaaaacacaaaaaaattagccgggcgtggtggcgggcgcctgtagtcccagctacgcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaattacccgggcatgatggcacattactgtaatcccagctattccggaggctgaggcaggagaatcacctgaacccaggaggcagagggtgcagtgagccaagatcgcgccactgcactccagcctgggtgacagaataagactccgtctcaaaataaaataacataacgtaacataaaataaaataaaataaaataaaataaaataaaataaaataaagtaaaataaaatgacgataccttgtgggggttgggaaaattcaatttcatggtgggtagaaatcagctcccacagacctggcacctggtgagcactccggactctggaaacattacattgtccttcttacattttaatctggtagcaacgcagcacctttttttttttttttttttttttcctagagacaaggtctcattctgtcacccaggctgaagtgcagtggtgcaatcatagctcactgtaaactctaactcctgggctcaagcaatcctcctgcctcagcatcccaagtagctaggagtatagacacatgctaattttttaattttttcgtagagacaaggtcttgctattttgccaggctggtcttgaactcctagtctcaagtgatcctccctcctcagcctcccaaagtgctgggactgcgttagtgagcgaccatgccaggccctgctcctttttaagtcaaactatggaggggaaccgaggcctgcggcccccactgcccacacaagcaggtacacacacgttgtccaaatggtcttgttcccttgctcacctgatgatacggctgtgatggaagcactcgcggatccctagctccacagccaggtgggccactgaccagctggggtggttacggatgaggtcggtcaggtgctgcaggacctcagtgtgcaggacctgaggggagctctcatagaagggtagcagctgggaagaatactgatggaaattcactagggcgtcagcctccaactccagctggaagagtctgtagagccaggacagaggagcaagacccgaaatgagtaaggcgggaccctcggcccacatccctgctggaatcagaaggtccccaggctgcggcctggccagctccagcccgactcccctcccaagcaaacacacacacacacacacacacacacacacacacacacacacacacacacccctatacacatgtaaatgacataatggcgtttaggttagactttctttgttttttagagacaaggtcttgctctgtaacccaggctggggtgcggtggtgtgatcatgactcactgcatcttcgaattcctgggctgaagggatcctcctaccttagttcctgagtagctgggattacaggcatgcaccaccatgcccagctaattttttttttttttgagatagagtctcattttgtcacccaggctggagtgcagtgttgtaatctcacctcactgcgaccttcacctcccgggttcaagcaattctcctacctcagtctccagagtagctgggattaaaggcgtgtgctgccacacctggctaattttttgtgtttttagtagagatggggtttggccatgttgcccaggctggtctcgaactcctgagctcaggcaatccacccccctcagcctctcaaagtgctaggatttcaggcactagccaccgtgagccactgtgcctggcctaatttttttttatttttgttgacagggggtcttgctatgttgcccaggctggtcttgaactcctggcctcaagtgttcctcctgcctcagcctccaaaagtactgggattacaggtgtgagccactatgcttgtctagattttcctttattttgaaaaactttccttttctttggtaatatcatttattatttttatattttattttaccacagccctgccatatccactttctaatttcattgccacatgtgagagctccagcctcgagtacttggcccctcttcatagtaggaactaagtaagtattgtttaacctaaatgtacagcaacaaaatattatataaattatggtataactatgtaataaactattatgcagtcattaaaatgagatatttaaaaaaagggaaacttttctttttcttttcttttcttttttttttttttgagatggagtttcattcttgttgcccaggctggagtacaatggcacgatctcggctcactgcagcctccatctcccaggttcaagtgattctcctgcctcagcctcctgagtagctgggattacaggcacccgccaccatgcccggctaattttttgtatttttagaagagacagagttttgtcatgttggccaggctgatcttaaactcctggcctcaggtgacctgcctgcctgggcctcccaaagtgctaggattacaggcatgagccactgcgcccggccagctttgttcatttttaagtgttgaggttgagtccaagttttgctactaaggtgctgtgtgatcttgggaaatccttttccctctctgagccccatttgaaacatgagactaactgtacctgtcctacctacctcccagaggtgctgtgaggacagatgaaaaaccactataaaagcactttcaaaaccataaccattatatgtcagtgatggttacttaaagttctgaccagggcttttaacataccaaaaggttttgtcttgcatacctctacaagcgcagcagccagccagagtctagtgaaggcagtgcccagagagtgttggctcaacgggaccagcctgttgttccacagagagtgcgttgattaacagttaactactgggcatgtgatctgtgccaaatggaggggtcaattaatgaacaattgcataaaatgctctgccctcctgaagccttttttttttttttttttttgagacagagtctcactctgttacccaggctggagtgcagtggcgcgatctcagctcactgcaacctctgccccctgggttcaagtgattctcctgcaattctcctgcttcagcctccctagtagctgggattacaggcgcttgctaccacgcccagctaatttttgtatttttagtaggcacagggtttcgccatgttggccaggctggtctcgaactcctcacctcaagtgatccacccatcttggtctcccaaagtgctgggattacaggcgtgagccactgtgcttggcccgagcctatgttattatggaggagatcaacaaaatgactaaagtaaaaacatagaataaggaagtacattaaataaactataacgtaatcagtgttacagaaacaacaaaaaccacaacaaagatagggaaggaggaggcggaaggaagccattcctcattgcccttggctgggtttttccttcatctcaccagcctctcaacatcagggtactccacatcaagtgttgccgatatgtcagagaatgacaactgaaaactcatcactggaattagcatcacggaggcatgcacgaccttgacaacattacttttagtggaatggagggaaccaaggcctgattaaagtgggtttaaggacacaatgtgagaatctgaagattgcaaagatagatatttttgaggagttttgctgtggtgaggagcaaataaaggaaaggatagcgaatggggaaagtgtaatcaggcatttgaatgctgacgggaacgatgattctctctcagaacttccactttccattaacagcagactagggaatgtgaaacagaccacctactgaggacagccagaaatgctggacaaattattaaaaaacatctgctggcaggcactggatacctcaaaagacactgatgactcaccaggctggaaggaatgatggaaacccaggaattgcagtgttcaggtggctgttactggagaggatgggcagacgagcagcaccagtaacagcctcatggggctcaggacacagggactggagcccaggcgtctgccaagaggagagccctgatgaacatctcttactttgggttagggtcctaaagaactacgtagcctaggaataagggtgagccatacacagacacgctctcacagagaccacagttcagcctcaagtgatttcagttccagaaactagactgaggttatcctagttgcaatgggagaagcaaaaataaattcattctttgtaaggaaacatcaaactaggctctagattatttctttttttttttttttttttttttttgagacggagtctcgctctgtcacccaggctggagtgcagtggcgtgatctcggctcactgcaacctctgcctcctggttcaagtgattctcctgcctcagcctcccgagtagcagggattacaggaacgtgccaccatgctcagctaattttttgtatttttagtagagatggggtttcaccatgttagccaggatggtcttgatctcctgatctcgtgatccacctgcctcagcctcccaaagtgctgggattacaggcatgagccactgcgcccggccattccagattatttctacgagcatacttgcaaatacaatgaccaacacataatcaaaactcaccaggcatatgtggagataagacatgaaagaaaaccaacagaaacaatatacaaaagaaacatatctgtgaggggactgtaaatatttaagttatccaaaatagactttaaagtaactgtgataacattcgagaggttaaaaaaggaaatttagaattttggtgaagagttttgaatgatcaaaaaagcatcaaatggaaattacaaaattaaaaaatataatcaggaaagagtaaacagaataaagcatggagagacagaagaatacaaaatatagtagagtacataagagacacagactatctaataaaagatctagcatacatacataagtggaggatcagaggcagagtagaaaaagaatcaaatggaagctacatttgaaaagttaatgtctgcaaactttccaaaactgatttttaaaaaacattataggtcaggcacagtggctcatacctgtaatcccaccactttgggaggccaaggtgggtggatcacctgaggtcaggaattccagactagccatggcgaaaccccatgtctactaaaaatataaaaattagccgggcgtggcggtgggtgcctataatcccagctacttgggaggctaaggcaggggaattgcttgaaccagcggggcggaggttgcagtgagccgagatcacgctacttcactccagcttaggcaaaagagtgaaactccatctctgatcacgctacttcactccagcttaggcaaaagagtgaaactccatctccaaataaataaataaaattattctgctgatttaacataccctataagccctccctgaccccaccaccaaaaaaaaaaaaaaaaacacatagaaaaaaacaaaaaacaagaaagccccagaaatccacgcttagcaccttgtaggggttttaaaacagggccccctaaaatcactgatattccttgcactgagcagtgggaatttgtatctctttaccctttaatctggcgatgtaactgcgttaccaacagaatatggcaaaagtgatgccgtcccagcttccagaccaatgccttaagagactggaagtttctatttctcttctcttgggacccagccatcatgcctcaaggaggctgaagcaagccatggtgacgactcttggtcctgggccctgagccctgaatgaactaccagccaacagccagcaccaacttgccagttgcgagttaccttatatggtgccatataaagtaaagctgaggctttcccactgagctctgctcaaattgcagatttaaggactaaataaatgattccttttataagccactgtgttctggagtagtttgttacacagcaataactgataatgatacatatgttgcacaatatgtattgtatgtaacataacaattgctgatatatgtgccacattacacctgttgaaaataaaatacaaggaggaaatatttaaaatagcagagggaaaaaagttatcttcaaagggcaaccattagaatgacagctggcttctcaacaatggaacccagagataatggaatgacttccttaaagagctgaaaagaaaataaatgctggccaggcacggcggctcatgcctataatcccagcactttgggaggccaaggcaggcaaatcacttgagctcaggagtttgagatcagcctgggcaacacggtgaaaccccgtctctactaaaaatacaaaaattagtcaggtgtagtggtgcatgcctgtagccccagctactcaggaggttgagggaggagaatcgcttgaacctgggaggcggagatcgtgccactgtactctagcctgggccacagagcaagactctgtctctaaataaataaatgccaatgagaattctgtacttagcacacaaaacaaaatgaaaacaaaaacaaaaccttcaagaataaggttaaaattaaaacatttctctagtcaaacaaaaaacccagagactttgtcattagcagacctacacgaaaggaaatacaaaagctttttctttccttcttttttttttttggagacatggtctcactcctgtcacccacgctggagtgcagtggtgcaatcaacgctcactgcagcctcaacctcccaggtttaagtaatcctcccacctcagcctcccgagtagcagggacgtgaaccaccacacctggctaattttttgtattttcagtagagacagggttttgccacgtagcccaggctggtctggaaatcctgggctcaagcgatcctcccgcctaggcttcccaaagtgctgggattacaggtgtgagccatcgtgctgggccaaaagctttctcttcatgtggaatgaacacgatcctagatggatgcttaaagaggcatgaaagaatgaagcaccatggcaagttaaatatgtggggggatctaaataagtattgatggtatagcgtcttgttgggtttaaaataaaaactaaataaaacaacagcacacagcatcgaagcctggaagggaatacatagctaaaggattctaagaccaacttattgttctggaagatactaatggaccttgagtaaggcagagataaatctcgtaatctctaaggttctgtcaagatgtgcaaaaggtttcagactttgccccgcttgttgttgtcaaagttttgctccagaagaagacacaatcttgattatgctgaaaagtaagcaaacttaccctgtgctctacaaggagaccctaactctattttccaaggctgtttgctgtataaacatcctttgaaggtagcctggaacaaaggtagtgctataatttggatttctgccccccaaacctcatgttaaattttgattccaatgttggaggtggggggctaatgggaggtgtttgggtcataggggtggatccctcatgaatgaatgccctccctgtggggtgggggtgagtgagttttcactctattagttcctgtaagaactggttgttaaaaagagcctggcactttttttttctttgagacagagtttcgctcttgtcgcccaggtgatcttggctcactgcaacctccacctcctggattcaagaaattctcctgcctcagcctcccgagtagctaggattacaggcatgcaccaccatgcccagctaatttttttgtattttttttagtagagacagggtttctccatgttggtcaggctggtctcaaaactcccgacctcaggtgatccactcgccttggccacccaaagtgctgggattacaggcacgagccactgtgcctggcccgtgcctggcactttttaacaaccagttaacaacttattttctcttcctcacttcctttcttgccatgtgacactggtaagatgctggcaccatgtttcttgtatggcctgaggagccatgagacaaataaaacctcttttctatgtataatactcagacttaggtattcctttatagcaacactaaacagacaaaaacaggtagtcaatgtctctgctagcaggatgtatggaaatatgagagagactcttggagaacgatctcccaacagttactactaaaaagtgtataacttccaagctaagagacagaaaaaacagaatcatatgaaaacgctcaatcacaaattgcaaaagcattatgctaagtgaaaaagtcagactcataagactacacgctatatgattaaaagcagcagtgatggaatgcacataggtataggaagacgtcctcctgcggggaaaaaaaaaaaggaagcacataggtgttgcccagggatggggtgggtgccatggactataaaggagggtgaaggaaatttggagaataacagaaatgtcttatatcttgattgtggtggtggttacatgggggtgttctgttatcaaatgaaggtggaggcaaagcaagatggccaaatagggctgggcgcggtggctcatgcctgtaatcccagcactttgggaggccgaggtgcgtggatcacctgaagtcaggagtttgagaccagcctggccaacacggagaatccccgtccctactaaaaatacaaaaattagccaggcatgtggccgccgccccgtctggcaagtgaggagcgcctctgcccggcccccgccctgtctgggaagtgaggagtgcctctcctggccgccgtgcaaccttccaagtgtgaagcgacagccttgtgtgtgatctttctgccttccccaagtttgcattttcgacattaaagtttactttttaattgaaaaaaaaagtagccaagcatggtggcaggcacctgtaatcccagctactggggaggctgaggctggagaatcgcttgaacccaggaggcagaggttgcagtgagccgagatcgcgccactgcactccagcctgggtgaaagagcaaaactccgtctcaaaaaaaaaaaaaaaagatgcccaaatagaaacctccaccaattgtcctccctggaggaaaaccaaattgaactatacacacaaaaaagtaccttcataaaaagcaaaaatcagcctaggtaccagctcagctacagtgtggcagagcaccaagagggctcttggggtcccagattctaagtgttggctgtggggtggcagttctggacctgccctgggtcagaggggagcccactaccctaaagggagagtcccaggcctggcagtgttcagttgcttcaagagcccttaggccctgaatgaacgttggcagtggcctggcagcactgccacagggctggggcagtggtggccatggagagagacttctctgcttgtggaaaggggagggaagagcaggaaggactttgccttatggcttgggtatcagccaggctgtaatagaatagagcactggggagattactaaggtttctgactgcaggccctgcctcccagatggcatctaaggaccttcccaggatgggggtagggggaacttgctgccttgaagggaaggacataatctcactggcttcaccacctgctgactgtagagccctagtgccttaagcaaacgtaggcagtagccaggcagtggagactgtaggccttgggtgagacccagtgctgtgctggcttcaggtctgagccagcatagtcctagtgatagtggccacagaggtgcctgtgtcacccctctcctagctccaggcggcccagcacagagagagagactccacttttaggggagaaagtaagggaagagaacaagagcctctgcctggtaatccagagaattcttccagatcttatccaagaccacccaagtggtacctttacgagtctgcaagagccatagtattagtaggcttggggtgccccctaatgcagatatggctgcagtgaccaaaaacttagatcacaatacccaagtcccttttattacctggaaagtcttcctaagaagaacagatacaaacaagcccagactgcaaagactacaataaatacctaacttcaatgcccagacactgacgaacatcacaagcatcaagaccatacaggaaaacatgacctcaccaaatgaactaattaaggtaccagtggccaattctggagagacagagatatgtgacctttcagacagagaattcaaaatagctgttttgagggaactcagtgaaattcaagctaacacagagaaggaattcagaatcctaacagataaacttagcaaagagattgaaataatttaaaagaatcaagcaggctgggcacagtggctcacgcctgtaatcccagcacttcggaaggccaaggcaggcggatcacaaggtcaggagatcgagactatcctggctaacatggtgaaatcccatctctactaaaaatacaaaaaattagccaggcgtggtggcgggcgcctgtaatcccagctactcgggaggctgaggcagaagaatggtgtgaacccgggaggcagagcttgcagtgagcggaaatcgcgccactgcactccagcctgggcgacagagcaagactccatctcaaaaaaaaaaaaaagaatcaagcagaaattctggacttgaaaaatgcagttcacatactgctaaatgctaaagggagtttttcaatctgaaagaaaaggacattaatgagcaataagaaatcacttgaaagtacagaacttaatggtaatagcaagtacacagaaacatatagaatattataacactgtcatatgtagaccactcatatcttgagtagaaagactaaaagaggaaccaatcaaaaataataactacaacttttcagacataaacagtacaataagttaaaaagtggggggacaaagttaaaatgtagagtttttattagttttctctttgcttgtttgtctgtttatgcaatcagtgttaaggtgtcatcagtttaaaatattaggttataagatattatttgcaagcctcatgttaacctcaaatcaaaaaacatacagcagatacacacaaaaaaataaaaagcaagaaattaaaacataccaccagagaaaatcaccttcactaaaaggagaacaggaaggaaagaaagaagatcacaaagcaacaagaaaataattaataaagtggcaggagtaagtccttacttgtcagtaataacattgaacataaatggactaaactctccaatcaaaagacacagagtggcagaacggatagaaaaacaagacccagtgatctgttgcctacatgaaacacactttacctgtaaagacacacatagactgaaactaaagggatggagaaagatattccatgcaaatggaaaccaaataagagcaggaatagctatgctattctatgaggcaaaacagacttcaagacaaaaactataaaaagagacaaagaaggtcattatataaaagggtcaattcagcaagataatgtaacaattttaaatacatatgcactcaacactggaacacccagatatataaaggaagtattcttagagctaaagagagagatagacctcaatacaataatagctggagacttcaatactccactttcagcattagacagttcatccagacagaaaatcaacaaagaaacaccagccttagtctgcagtatagatcagatgaacctattagatatttacagaacatttcatccaacggctgcagaatacacattcttctcctcagcatatggatcattctcaaggatagaccatatggtaggccacaaaacaagtcttaaattattattattgttattattttttttttgagacagagtcttgctctgtcacccaggctggagtgcagcggcgcgatctcggctcactaccagctctgcctcccgggttcacaccattctcctgcctcagcctcctgagtagctgggactacaggcacctgccaccatgcctggctaattttttgtatttttagtagagacggggtttcactgtgttagccaggatggtctcgatctcctgacctcgtgatctgcctgcctcggcctcccaaagcgctgggattacaagcatgagccacttctcccagccaaattactttttaaatttgaaatcatatcaagtatcttctgtgatcacaatgaaataaaactacaaatcaaaaacaaggtattttgcacaccatacgaacacatggaaatgaaataatatgctcttgaatggtcaatgaagaaattaagaaggaaatttaaaaacatcctgaaacaaatgataatggaaacacaacatatcaaaacctgtgagatacagggaaagaagtactaagaggaaagttgtacctataagcacctacatcaagtaagtagaaaaacttcaaaataatctaatgatgtctcttaaagaactagaaaagagcaaaccaaacccaaaattagtagaagaaaagaaataataaagatcatagcagaaataaatgaaattgaaacaaaacaatacaaaagatcaacaaaataaagttttttgaaaagataaacaaaatcaataaatctttaactagactaacaaaaaaagagagaaaacccaaacaaaaaaatcagaaatgacaaaagagatattacaaccaatatcacagaaactcaaaggattattagaggttactgtgaacaattatatgccaataaattgaaaaccctagaagaaatggataaattcctaggcatacacaacctaccaagatggaaccgtgaagaaatccaaaacctaaatagaccaataacaagtaatgagatcaaagctgtaatgaaaagtctcccagcaaagaaaagcctgggacccagtggcttcactgcttaattttaccaaacatttaaacaaaaactaataccaaccctactcaaactattatgaaaaacagaggagagaaaacttccaaactcattctatgaggccagtattgccctgacaccaaaaccagacaaagacatataaaaaaagaaaactacaggccagtatccctgatggatattgatgcaaaacttctcaacaaaataccagcaaatcaaattcaacaacacattaaaaaggtcactcacggccaggcgcagtggctcacacctgtaatcccggcactttgggaggcaggggcaggtggatcacctgaggtcaggtgtcgagaccagcctggccaacatggtgaaaccccgtctctactaaaaatataaaaaactagctgggtgtggtggtgggcgcctgtaattccagctacttggaaggctgggacaggagaattacttgaactcaggaggtggaggttgcagtgagctgagattgcaccaccgcactccagcctgggcaacagagcgacaccccatctcaaaaataaatatataaataggaaggctagtctgatacaggctcctctgtcatggccagaagtggaagttcatcctacaagtttgatacgtagtatttgcatcatcattgggtcaagatattttctttttcttttcttttttttttttttttgagatgaagtttcactcatgttgcccaggctggagtgcagtggtgcaatctcggctcactgcaacctctgcctcccgggttcaagtgattctcccgcttcagcctcccaagtagctgtgaccacaggtgcccaccaccacgcctggctaatgttttgtatttttagtagagacagggtttcaccatgttggccaggctggtctcaaactccttacctcaggtgatccacccgccttggcctcccacagtgctgggattacaggcgtgagccactgcaacccgccacgtcaagatattttctaaatttcactgtgacttcttttttgaaccatagataatttacatatatcttgcttaaaattcaaacatacgggctcatttatagttacatttttgctattgatttctagcttaattgcactgtagttggagaacatagtctaaatctcttcaggtatctgaaatttgttcatatttgctttatggccagcataggtcagtgtctataatttttatataggtgttcttgaaaagaatgtgtattctgttagttggtaggacaactgttttatatatgttccatggtctgaatgtttgtgtcttcctaaaattcttatgttaaaacttaattctcagtgtgatagtattaagaaatggggccattaggaggtaattcgatcatcagggctctgccctcatgaatgggattggtgccatttaaaaagcggcttgccaggcacactggctcacacttgtaatcccagcactttgggaggccgaggcgggtggatcatctgaggtcaggagttcgagaccagcctggccaatatggtgaaaccccacctctactaaaaataaaaaaattagccgggtgtggtggtgggcgcctgtaatcccagctactcaggttttcaaaaaataaacaaagccaaaagttggttctttggaaagattttttaaattggcaaatcactagcaaaaccaaacaagaaatagagacaacacaaagtaccatcccttcagatcctccatacattaaaaaggaaataaggggacctgcagacaaatttgacaacttcgataaaatagaaaaattccttgaaaacacaacatacccaaaccgacatgagatgaaaatctcatagtcctatatttgttaaagaaatcgaatccatgttttaaaagcttcccacaaataaactccagggtcacatggttttacccatgaattcttccaaacatttaagaaagaaagaatacaggctagacatgtgactcatgcctgtaatcccagcactttgggaggctgaggtgggaggattgtttgagcccaggagttcaagaccagcctgggtaacttgatgagaccgtgtctctacaaaaaatttttaaaattagccaggtatggtggtgcgtgcctgtagtcctggctactcaggaggctgaggcaggaggatcacttgagcctgggaagttgaggctgcagtgagccatgatcatgccactgaagtttggcctgggtgagagagagatagatgaaaggaaggaaggaaggaaggaaggaaggaaggaaggagatcttcaacaatttttagaaaataggagaaagaaggaatgcttctcaaagctttaagatagagaaggacttccttaaacaagacacaaaaagtacaccgtaaagaagatgaacaaatttgacttcattaaaactaagaactcatgtttatcaatagataccattaaaagaataaaaaggcaaaacaccgtgtgtgcagctgaacacgtatcactgacaaaaggtgtgtatttggactgcacatgtaccaaaaaactcctcctaaaactctgtaagaaaaagataaacaactttattttttaaatagtcaagagaattgagctgatacttcactgaagaggatatccaaatggttaatcactgtatcaaaaagtgctcaacttcatttgcaatcaggcaaatgcaaaataaaaccacaataacatactactagacacccgacagaatgactaaaattttaaaacctgacagtaccaagtaacagaagatatgaagtaacagaaagtgccatttactgctgcttggaaaacagacgggcggtattatttactaacgttgaagacaagttatggcccataatgcagccagttcacttctaggtatgtctaccagaaatgtatgcatgtatgcaccaaaaaaactagaaataacccaaattttcatcagtagtagaatgagtaactgtgatatagtagacaatggaattctattgcaatgaaaatgacagacagctgcacacaaaacgtatcaatctcgccaacaaaatgctaacaaagaagccagatagaaaagcctttatcttggccgggggcggtggctcacgcctgtaatcccagcactttgggaggctgaggcaggtggatcacgaggtcaggagatcaagaccatcctggctaacacggtgaaacctcgtctctactaaaatacaaaaaattagccgggcgtggtggcgggcacctgtagtcccagctactcaggaggctgaggcaggagaatggcgtgaacccaggaggcagagcttgcagtaagcagagattgcgccaccgcactccaacctgggcaacacagtgagactccatctcaaaaaaaaaaagcctttatcataaaaggcaagttattggttacccttctttgggaagaggggacaaaaggagggcttctggggtgctgtaatgtcctatctctagattcgagtggtggttacacaggtgtttgtgataaatcactgagctgtatatcattttctctatatgtgttatattttgctatttttgaaaagtttaaagagagaaaacaggaggagaagaatgaagacagtggaatataagcagtctctggaggaaaaagtagagtcaagaaataatttttttttaaagaaaaaaataacccattgtatagcgatggaaaataacttaggtcaggacattataacagaaaactacagactgggaggcttaaacaacctttatttctcacagttctagaggctaggaagtctatgatcaaggtgctggctgatagagttcctgatgagggttcacttcctggtttgcagatggctatcttctcgttgtgccctcacatggcagagacagatcatctctttcttgcctcttcgtctaagggcactaatcccattcatgagggctccatcctcatgacctaatcacccccatagtgctctacctcctaataccatcacacgagggattggggcttcaacatatgatttcggggggatactttcaatccatagcaaaaaatatatagtagaaaaggggaaagtgttatgtaggaaagaggggagataattgttcaaatggtgtcaagaagtagatgacaggagatgatggccttgaatggggggaccaccctcagctaaacacatcggtgctgacaacagggaatgtggagtaggcggggacagaggtgtgtgcatggggtagagggaattctcctctggctatttctattttctcagcgagacagcagcagggctatcagctgagagtaagcgtggaggggaaggggctgcaggctgaggggagggaaggaggcatgccttctgggagaggggtgaacagagaaatgcagaaagacgtcaaaccacatcataggctcactgtggctcatgtcgtgatttcaaagtgagagcaatagggccgggcagggtggttcatgcctgtaatcccagcactttgggaggccaaggcaggcatatcacctgaggtcaggagttcaagaccagcctggccaccatggcaaaaccctgtctgtactaaaaaaaatacaaaaattagccgggtgtggtggcgggtgcctataataccagctactcaggaggctgaggcagagagaactgcttgaaccccggaggtggaggttgcagtgagctgagagtgtgccactgcactccagcctgggcaacagagcgagactctgtgtcaaaaaaaaaaaaaagaaaaaaaaaaaaaaagaaagtgagagcagtcagcaaaaaggtatgttcccctagccatggtggagaactgaaaccaagcagttctggggtggtgatgccaggatgacgaagagagagagaagcaaggaggcaggaagtataggtgaaggagtgacaatgacaggccatggagtccatgctgggtacaaagcaaggcacatgaacgggatggggctgggaaaagcggccaggagcaattccctgtcaatggggaaaagcactgtgtgggtggaggactagagggaatgaactggaaagacagaaggcagagactggaaagtggggtgcttgaaacttgtatttacgggagagctgctgtcactggcgatgataaaggccagcgcgtggtcatgtgaatgtggagggtcaggaaccagaggcaacgctgagtcaggggctcacatctttgaggatgtgggggagcaccccaggctcgtagatacctatcaccggggtgacagcaagtggtattgtagggtgacagaagattcaaggctgggggcaaggaggaccctaccccacctccaggcccagtgggagagggactgggagagaaaactctcaggaggctgcggggcaagcgggtccttcaaggagagccaggtgtgggttacagtgaggaggcaaaggggagattcagggagaaggctgaggctctggaggacacacgggggtgtgtctcttccctcccttctagaaccccaggctgaagccacctggcctccactcagaagcctctgctgtgtctctgctggggtgggaggggtctgtggctaagcctcaggggacctgcaaacctcttgaaagtggctgtgtgagcctgttctcattccccagggacctcagggggtcctggaccaaaaaaaatgccaaggaccctcacgctagagcagtacctgagtccccagtttcaaagcccagcacaggcccttcctgcccacaggctccccacagggcccctcctctgtcctctgggcctttcctagtaccttgtctctgtagggcctttccctccagctggtggagtcttctggaccccttaaggtctatctctaccccagccaccccagtggagcctttcccacgccctctggtcaacacacttggccttcagcaaccatggatacatctagccactcggcagatatttaccgtgcacccacggagagcgtggcacaccaccaggcatcaggaacgcagaggagacttggccccaggccctgtccctcaggagccctgcagtctggaggggaaacagatgtggaaacagacccacggcaacctaaggcaagaggggctgtgtcttggccacatggggggtgctgaggctctgagtgggaacaggacaggcccacagagcaggagccgtgtgtccagccaaggagttgggaaggagcattcttagcagaaggagaagcaagggcaaagaggccgtgtcggggacaaggcctgtgtagggaatacaaggccccactctaaagttatctcactgaaggctgggtacagagcctccttttctcgcagagacctgccgctttccactctgcttggtgaagatgggatgtgggaggactgaatggatggaggagctggccccagagtacgtggccaggacacagggcactccacttatctgaggtttctgataagcagttttatggcaaagtcccagtccagagagcctcaaaagtcagctcccggtagggaagcacagatcacacacttctatcatccttcccaggatgcctgggaggtacagccctgtttctgctgagataccagtgagaggctggttgatttcatcaaatgtcatctgttacaagtcaatgccagccgtaaatgattaatctgtaccaggaacagaagtatctatgctatcatagtgtacacaggcatattacaagtgacccctgggggctcacacggggagagccagggcccccgcaccataggtcaggcaggaagggccaggatcagcccaggcgggtggagctccactcagctcgccacactacaaagcagccctgatgtaagaaaggtaaacgagtgggttctggagccaggtgacagggtctgaataatcgctacgctgaccagctgtgtgatctcaaattctgcaagcctctgtttcctcatctgtaataggaggtcagtaatgaccccacctcgtgggactgtcgtgaggataacatgagttactacttagactagtgccaagcccaggcatgcaggacctgctgggaaactgcagatgctcctgctgctgtcgctgtctgtatcagcagggtccagtctctccgcccagcagcagtgctgtgggactctccggccttaggttatacaacccaagaattcagaagctcctaattccatcccccaggtccatccagaagctcagcctggcagctcactgcagcaacagcagcaaaagaacaacagaaactcctccacctggagcggaaggctagcagcccatgctcactctaacacgcgtcaagtactcaggacagtccagaggcctctagggcaacacaggaggaagatcgtttagaaggcagaaactcagccctggccagaggcaagtccagtgcaccaggcctgctctccacagaccgcagggtgttgagaggagctgggagaacactgcaatgaccacccccggccctggagaaccccagggctccagcagtgccctgatgaccctcctccacagcctcgaccccaccccaccccatcgcagccctcactccaggtcacagcctaggccttggcattactgcttctgggacccctgataacctcaaaccctgcatcccagtccccatcctccacctcccacttcccagctcactccttcaactgccctcaatgcaacagtcctccaccctccacccaggtggcacagagggcctggcacacagcagccctcaatgaatactctaaagctaaattaatatatcacattcatttgttccacaaacctgatctacgccaggcacctgctgggggctgggcacactgtcatgaacccaacagacacagtccctcccctcacaaggtctgtggcctaccaggaaagcaggatccccagtgcagggacgggtgccatgggatgcccagcagaaactcctaatccagcctgcaggtcaggggagggcaagaggaaggaaggcaggcaaagaaaggggagtattccaggccacagcaagagcctgggcaaaggccaggagcacaaggcggcatgagctgagaacacagaggcagaaacttgatcacactgggcccttttaagtcattaagcacctgatgtgttaagaaaacaggaagctggccgggcgcggtggctcactcctgtaatcccagcactttgggaggctgaggcgggcagatcacaaggtcaggagatcgagaccatcctggctaagagtagatggtgaaaccccgtctctactaaaaatacaaaaaaaattaactgggcgtggtggcgggcgcctgtagtcccagctacttgggaggctgaggcaggagaatggcatgaacccaggaggcagatcttgcagtgagctgacattgtgccactgcactccagcctgagcgacagagcgagactccatctcaaaaaatgaaaataaaaataaaaataaaagaaaacaggaagcccttggggagtaaagcaggggagtgaccaatcagatttgccctctggaaacagcgctgtgacagcagcttggaagaggatgagaggagtgcaggccacagccggagcagcaggagacacgtgcacaatgactgtggtctggagaagcgagccagcagcaagacggagggagaaagaacctctgattttcgactggcacgtggctgtctgcaacacaggcaacacttcccagcatcctttgcagttagctgtggccatgtgaccgggttctggccaatgcgtgcaacttccatgaaatgtccctgaggagggggagattgaccttctgcatcctgcccttccaccctccctttggctggaaaggtggatgtgatggctggatctggcacagcccgttgcaatgatgctatctgctgaaatggaaaggttcgggtgggagcaggttagaggggagaagataaaaaagactccagagctatgactgtgaaaataaataaatcaataaaatttagaaataagacaaacaaagccgggcatggtgactcatgcctgtaatcccagcactttgggaggccaaggcaggcagatcacgaggtcaggagttcaagaccatcctggctaacacagtgaaaccctgtctctactaaaaaacacaaaaattagccaggtatggtggcacgcacctgtagtctcagctactcgggaggctgaggcagaagaatagcttgaacccaggaggcagaggttgctgtaagccaagatcatgccactgcactccagcctgggcaacagagcaagacttaacgtctcaaaaaaataaatacatacatacatacatggaaacaacacagcagcacagagaaatgaattgggaaccagaagacactgattctgtttcttcactgcttcctgtgtataagtgggatgaatcacttatcatcccaaggctattttctcatgcataaaatggaatactgccttccttgcccacctccacggattggcagagaatgtgctaacccaacatacttaaaaacatcctgtaaaattgtaatcccagcactttgggaggccgaggcaggcggatcacgaggtcaggagattgagaccatcctggctaacatggtgaaaccccatctctactaaaaatacaaaatattagccaggcgtggtggcgggtgcctgtagtcccagctacttgggaggctgaggcaggagaatggcgtgaacctgggaggcggagcttgcagtaagccgagatcgcgtcactgtactccagcctgggtgacagagcgagactctgtctcaaaaaaaaaaaaaaaagaaaacaaaaaatcctgtaaactataaagtaccacagaatagcttacgtgtagctaagaagctgctgacaaaggactaaatcctcctgggatggaggtctgcccacactggggcttaagctggctgagacaaatctggaatcctgtcaagggattttacaactgacagaacttggtgattattggtacgtggagattagtggtatccccagggccgtgtacctcaaaagtggggctgtccagctctccaaggagtggacccgctgccctggtcagctgtgcctgcagtggagctctgaagctacaagtgcaagcctgccccgtccagggtcagtcctgatcgagtccagctggaaggcggtctgctcagccccatctgcactcagaatctggaatggccccactgtattaaaactggtgcctgcactggccactgagctgcatttagcccaagcacctgctgtgggtgcctctgcctcaggttccttgtggagccaggctctgaattctcacctgattggatggggccctgatacctgccttgctcttctgttggtggcagcccctggcccccagcctgacactttcagagacccctcctgccatgcctctttagtcagaatgagtccccagctgcttccttcagcctcactctcaccaaagccctgcatgcacctgggatccaaccagagccacctgcctgcaggctcacacctccacacttctgcacggctggaacgaccttatccattttgttctgccacacaggctcctcctcactcttccagacgcagagtagctctcaatcacctccttgtgatccacactgtttcctaggctctccctctgtcacagcactcctcaaggggtgctatgacgcctgtttgcaccggacctcccccaccagactgtacgttccttaaagacacaggacatgtttgtcatctcacaggccagccaggactggcccgaagcccaggactctggagacactggaggtgcttggtgcatgttgaatggatggctgacaggacagccagatggataggtgagcggaaacagggatatctgtctgagcccaactagatgccagtctgccaagcactgctggggcctgcatttggaaccttggctgcttctccccttttcccaaccagctctgccgttggcccggttccctcaggcctgtcctggcttttgagccttctcttcaggcccaggggagtcccagcatgccccaagaggcaacagctctgtccagccttcctaagcaaaccctgggcagcccctatgagaacggccatgcccttaaagagccagggctaggccaggtgcagtggctcacgcctgcaatcccagcactttgggaggccaaggtgggcagatcacctgaggtcaggagtttgagaccagcctggccaatatgatgaaaccccgtctctgctaaaaatacaaaaatcagctgggcgtggtggtgggtgcctgtaatcccagctactcaggaggctgaggcaggagaatcgcttgaacctgggaggcagaggttgcagtgagccgagattgcgccactgcactccagcctgggcaacagagcaagactgtctcaaaaaacaaaaaccaaaaccaaaaataaagagccagggctaaaggttctccccatgggccttatctgatgtggacactctcagtctccctgtccttccttcttccctttgtccatataggtcgagcctccaggccagaaacaacccaggcttccatcctcagcctcgtgctgggacactgatgggccagaagtgtggagtctcggaagcccttccctctggtccaagagtacagtctcccctctctcccacccctctccagacccctcagacagagactcaaagaaactgcttctcggccaataagacctccaatccgagacgtgggggagtgaaaggagagaagtatgttcccgctgagcatcacccaccggaatccactctgtgagttcctggggttgaccaggacgcagtcccaggtgcggttgggagtgttctggaacagaatcagctgcccttcctcccgaactcggtcactcgaggtgtagtcggccacagccacctccttcacccggaatgggttagagaacaagttggtgacgccactgaaggtattgaccaggcggccaaagaactgcatcttctgcggggcaggtggggaggccccaccgtcttccccctctgtctggaagaaaacgaggtctctggtcagccaggcacagtctcccatgcccatctcacccagtgcagcggtttcctgcacagacacccagatcactccccaccagcgttgtccccagatcctgggcctggagggatcttaaaaggaggggaaagaaagagaaacaacactgagtgggaggtaaaagtgacagaaccctcaggccaggctggctacctagaaggctgtccccctgtgctgccactgtgcacaggtgaccttaactgcctgcttcctgacccagtgtcccagcagagactcagtttcctcacctgtagtgtgtggtattgaccaaaggagatagcacatgtgaacatacattataggcagtaatgccctgggcaaatggagggttctcactaaataagttacagagataacctttcagcactcaaagaggctagtatggaccagacacagtggctcaggcatgtaatcccagcacttcgagaggctgaggcgggcggatcatttgaggtcagaaattcgagaccagcctggccaacatggcgaaaccctgcctctactaaaaatacaaaaattagccagatgtggtggcaggcgcctgtagtcccagctgcccgggaagctgaggcaggagaatcacttgaacccgggaggcagaggttgcagtgagctgagatcgcgccactgcactccagcctgggcgatagggtgactctgtctcaaaaaaaaaaaaaaaaaaagaggccagcatggatcatttcacttccgcaaacaaaatcaatgtcccccctcctagataccaaaaggtgaccagcatcatgtcacactctatcggagcaaggggatcatcggcattggtctaaatcctttgtttcctgctaccacaggtttcccaaagagctccgagagacagcacacaaaagcaagctccttggaaatgaacgaactgcaccttctgcaggggcaggtgggggagcccctgcagaagatgccattcgagactcaggagcagcagtgtctgggtggtaactttacgctgcatattcagagtcatagtttctgccatggaaattgtccccagtgttgatgatggaattagataccttgttatttcctaggttcccagaaaatacactgccttcctaaggtactgtcaccaaagccaggcgccaatcagacggaggccgccctctgcctctgtgccaagatgtcaccagacaaaagacactaaggacagagtatgggtgccctgggggagagaggacatctgagtggacactgggtcacagccacattcttccctggcctatgtgctgagcacaggatcaaccctggggacagaaggaagacaaaagcaaggggcccactaagaggcacatgaaaaggaaaaaagatcaatactaataattataccaacaaggcacggtggttcacgcctgtaatcccagcactttgggaggccgactcgggcggatcacctgaggtcaggagtttgagaccagcctgaccaacatggagaaaccccgtctctactaaaaatacaaaaaattagccaggcatggtggcgcatgcctgtaatcccagctacttgggaggctgaggcagaagaatcgcttgaacctgggaggcggaggttgcggtgagctgagatggcgccattgcactccagcctgggcaacaagagcgaaactccgtctcaaaaaaaaaaaaaaaaagatcataacaactgaagaaaagttcgcagtgtcccattacaaggctcagtgccatctctcaatgatgtctatctggaatgttcttcctctccttttctgtctgagaaagccctgatccttcttcaaatccaagcttggttctcgtggttctcagcctcctccttaaaaatgtttttgttgttgttgttttgaaacagggtctggctctgttgcccaggctggagtacagtggctcaatcatggctcactgcagcctctacctccttccacctcagcctcctgagtagctaggactacaggtgtgtatcaccaggcctaggtaatttcttccaaacaatttttatagaggccaggcatggtggctcatgcccgtaatcccagcactctgggaggctgaggagggcagatcacttgaggtcaggaatttgagaccagcctgaccaacatggtgaaactccgtctctactaaaaatataaaaaaattagctgggcatggtggtgggcacctataatcccagctacttgggagactgaggcaggagaatcacttgagcccgggaggtggaggttgcagtgagccaagatagcaccaccgcactccagcctaggtgacagagtgaagactccgtctcagaaaaaaaaaaaaaaaaattataaagacagggtcttaccacgttgctcaggctggtctcgaacgcccgggttcaagcgatctgcctgcctcagcctctcaaagtgctgggattacaggtgtgagtcaccgtgtctggcctaaaatgttcttgatacaccatcaccagatgccaggttctctctccttgctctgggctctccctcactttaaacacatctgtactatcacagcccagcatgttacaactgcccctcctgccagacggtaagcttcgtcatcctcctaccaaacactcctgtgcatcttgctggcaccatcctgaaagctttacgtacattaatcattctgtctgacaaccactctatgaactggttactattattatcctcattttacatatgagaacaccaaagaacagaggggtaaagtcacgggcccagggtcacccagctagtgggtggagcagtgaaagctggcacccagatgggctggcccagagtctgagtttctcaaaggcagctgctcgtcttttcatctccgtccacaagcttggctcacagaaagtttgtcaaaacaaaaatttaactgagtaaatattatgcatagaaaaaacaaagcctgatagaaaacaaaccaagatagactgacagaaaacatgccattgagtagatgagggtgctgggtttatgggcttttgttttttccttttccctattttccagatgctatgtaaagcgattatagttttcaaaggaagtagcagtataggctgagcctctgggggctgcagccgggaagatggggacctgtgggactcaggcctggcctggaagagcgcagagaggctaccccgaggacgggcccacagggacgcggaggggtgcgcccaggaagggcagagagtcaagagcatccagcacccatgagcctcagattgagggagaaagtcaccaggggtgcagtgaaatcaaagaaagattccacacaccccttcgtcaatggcccagcctgtgtaccccccaccagagcctggggctaggggatgccccccacacacccacgacagcatggccacagaaacgacaggcttggctggcatccagccttcagggtaggcaggaggacgagatgacgcaatggagggaaggtgtctgggacacaggccgactgtgggcacacaaacagtggccattgttatcactaggtggaagaaaggaaatgacagccacggggccacatcctggaacactcacggcattgccaaccaggaaggcgggccagcagggagaaagtgctcacacgtgcttccttctgtccctgccaccttggaccctggagcctaggctcttcccagcacagctgcaagagggggatggtggatgagggccccccgcatcatgcctcacttcatctctccccctggcttctcacagcgtcctacccttgaccttcccgtggggtagacaatcacttttccccactgatgaccggcccctcctcctccttacctgggcttctccctgcacccccaggatgcccaggtcacctgacacagaccgcacctcggctgtgtcaagcagctctctcaaacaccacaagcagaaagacaaagacccaagacctttggtggtgggggttgacagtgacaattctgcctgtccaagccaggcaatttccaggtaccaattttggtgcccctgctgagggaagccagatatttctggccgttttccttatctctgctcacccatcctctgtcaaaaccaagcttgcctgctgggttcattgagggaagactgacagagagtgtgctggtgtgagggtcccctggaggagctgaaggacgggaggaacaagtattattatcccatcttcccatctcagagatcaagaaactgaggcccagagaggccctgaattgtacatgttcaaagggcaaattaaggccgggcacagtggctcgtgcctgtaattccagcattttgggaggctgaggcagacggattgcttgagcccaggaatttgagaccagcctggggaacatggcaaaaccctgtctctacaaaatataaaataaaattagctgggcatggtggtgtgcgcctgtggtcccagctactcgggaggctaaggcaagaggattgcttgatcctcttgaggtcgagactgcagtgagccaagattgcactactgcactccagcctgggagacagagcaagaccctgcctcaaaaacaaaacaaaacaaagggcaaattaaagttgatgtccaccaaaaaacaaaaacaaacgggctgggcgcagtggctcacgcctgtaatcccagcactttgggaggttaaggcgggcggatcacgaaatcaggagattgagaccatcctggctaacatggtgaaaccccgtctctactaaaaatacaaaaaaaattagctgggcgtggtggcgggtgcctgtagtcccagctattcgggaggctgaggcaggagaatggcgtgaacccgggaggcggagcttgcagtgagccgagatcatgtcactgcactccagcctgggcgagagcgagactctgtctcaaaaaaaaagaaagaaagaaaaacaaacgaagaaacaaaaaacctcgagtgggaacagagggagattggagccaatggtagcatctctgatgagttccctggaagtgactacctgggttcataaaacagtcaacagagagacccaagaccagtccctgtctcgccaagtgcacggtcccctgagggaaggacccctaaaggggatgactttttagctgaactttccaggaagaacaggagtttgccagcgggggaaatggcgagaggccttcacagcagatgaagcagatcagaacacggaggaaggcagagatcaggggcttgctcagcccacccatgaacggtgagcattttcactgggactggacggctcgagaggggaaggtgctgagaggaggggccgtggttagtgctgtgatcaacgtgaacacaggtcacctggagccacttgtccagggctgctatgtcagtcacgcccctcgccatgcccagggaagctcctctcatgacgaggagccaagccccggaagaagtgcagtagaggacaagggaccaagagggtggctcagagcgggtggtgagggagaactcagtcccaaaaatctggttcctcctcagctacgaattccctgaaggaccctgggcaggtctcaggcacgggaggagcggtccctgccctctgattgctgctacctgccgcagctgccaggcccaggcagtcccctctcctcccctttggaaggtctgtgtgaaaactgcttttctgtagtgaaaggggcctgcacttgcgtcctccctggaatgcgctctccagttcctgctggagcccctgctcatccttcaaggcccagctgccccctctgaatgctcagagcaccagagtgcccttccagcctgcacggttcccaacccagcctgacacccctccatgcccactgtacgatgcaaatccagctgcaggtctccctgctgaccctggccagtggcgccccatgacctcccagggaaagcccagactccagcatccatgagagctggcccaactcacccctccaactcatccctcacctctactccagccacgccgcaccatcgatcttcccagaacacgtcaaactcgtgtctcagtgcacttggggataccacacatacgctccatcagcgtagcccatcctccccactttcttaacctgaatgtgtgctccacaaaggacaaatgaacaaatctcttcttatccatgaagatacagctcaggtgccatctcctctgaaaattcatacccgcacctccgccctgcagcctggtgtgccttcctcttctccccagcaccccacaccacccagggcccagcccacaggaacacacaccatgtgagaatgggggtgcatctgttggcttgggctgctcacccaacccgctttgatttgtttccctaagcacctggcatgatgttcctgactcacagtgggtgtttaataagtttggtgaatgaatgaatgagaatgaatgaatgaaccacctataagcccatggggccagcacctctgaagcccccagacacactttattcccttgaaggtgataacagggaccacacactgttcccacccactctgagctgccatgctcctctccacaacggatagggaaataccatgctcaaatcccaccagtagctaacggcccacaaggggttcgctcctccaccgggagaacctgtatctagcacctgcactccttcaggagcggccctaagtgatcggactgatccatccccaggcttcggtctggaaagttcagctttatatatagtcagggcacttaggctgagctcactcctagtccaagcaggaaagactccaagccttctgcttccttcttgactaagccgagagcagaggagccggacagctgcccgagaggtgcgtgacaggaacccacaggcagcaggccaggaagcagacctcacaggcttggccacgtgggggattccaggagcacacacagaactgcccgaggtggaaatcaggcctcacgagccccagctgctgacgacaggatgtcccatgattggaacaactgttggatggtcctggcagcagaacctggcagcagtgacaccctcctgagcaccctcctcccacccagtcaagacagagcaggctggaaactcagggtccactcagagtgccaagctgccccaacttccttcctgtagctccgtctgtgccacacagcacgggagcatgccaccacacaccggcctccgtcctctcacaaggccaccatgcctcacggttggcaaagggtttcacacttgtgatccacctccaagctcacaaagaaacagggaaggcgcagccgggcgcggtggctcacacctgtaatcccagcactttgggagggtgagatgggcagatcacctgaggtcagaagttcaagaccagcctggccaacgtgtgagaaaaaaaccccatctctactaaaactacaaaaaaaattagcctggcgtgatggtgggtgcctataatcacagctacttgggaggctgaagcaggagaatctttgaacccgagaggcagaggctgcagtgagccgagatcatgccactgcactaaagcttggatgacaaagtgagactgtctcaaaaaaaaaaaaaaagaaacaaggaaggtgcaatcattctccctgtttggcatgtggagaaatcaaggccccaagagaggaaatggggtggcaggttgtggtgggggattgcctgcctatgtcctctgactcttgaacagcactaggcaaagggctggccacacagcaggtgctcaatctgtgggtgagaaaacactgaatgaacacaggggtcatctgagcctctgaacctccaaggcagcctcccggcaaaatgtccccgcaaatgttccctctgaccccagctcattccaacctctttcctaagttagtgggaaagggcttgatcccatcccctcacaccccatcagcacccactgctgcccagcacccacagggcgccagacgcttcaccacagtttcgggtaaattgccactttttttttttttttttttttgagacagagtttcactcttgttgcccaagctggagtgcaatggcgtgatcttggctcactgcaacctctgcctcccgggttcaagcgattctcctgcctcagtctccagactagctgggattacaggcgcgcaccaccacactcggctaattttttgtatttttagtagaaacggggtttcaccatgttaaccaggctggtcttgaactcctgacctccggtgatccgcccacctccacctcccaaagtgctggggttacaggcatgagccactgcgcccggccgaattgccacatttaaccctccaaacacctgtaagaaaaggtccaggtctctccacattacacaggaaactggggcacaggttacacagtttgccaggatctgaacccaattaggtggaatccagagcatcaggctcttaatcctcaaactgccttcaggagaaagctgaaagaaggtggctgagcgaggcttgctcaacaggctcttagattccaaaagccaaggccctcgtctcaaaatgcactgctgctcacgtgagccagagcaaaacgtcctttcacaaaaggaaaaagcatctctttcattcactccgcttggctggaccacagctggaagcaaactgccccgaaactgtcactggagctcccaagcacatgagacaggggtgactttaagagatctttgggctggtggcacggtacagtgtggcccatgttatgactcactccacaaatatttactgagatggattgtggcaggcattgttctaaccgctgaggatacaatcgtaaacaaaacagactggtcaggcacggcagttcactcctgtaatcccagcactttaggaggccaaggaaggaggatcacttaagctcaggactttgagaccagcctgggtaatatagtgagacctcacctctacaaaaacttaacaattacccaggcatggtatctctcatgcctgtaagtcccagctactaaggtggctgaggtggggggattgcttaagtctagcaggtcgaggctgcagtgagctgtgattgtgccactgcaatccagcctgagcgacagtgagaccctgtcttaaaacaaaacaaggccgggcgcggtggctcacaccagtaatcccagaactttgggaggccgaggcgggtggatcacttgaggtcaagagttcaagaccggcctggccaacatagtgaaaccccatctctaccaaaaaatacaaaaattagctgggtgtggtggcgtgcacctgtaattccagcttcctgggagactgaggtgggagaatcactcaaacccaggaggcggaggctgcagtgagctgagatcgcaccactgcgctccagcctgggcaacagagtgagaccctgtctcaaaaccaaaacaaccaaccaaccaaaaaaaaccccacaaaatccctgacatcctggaacttatattttagacagagctactaataataaagaagataaacaggtaaatatttacaaaggttttagatgacaattaactactgaggagaaaaaccagagaatggggataggaagtgctgaggtggagagtgaaattttagattgggtgaggagagaagtcttcaccaagaaattgatcttaaataaatacctgatggagagagatgaaagtcatatgaatagctaggcaaagagagcgtgtgcaaaggccatggggctggaacatgtttagcgagttccaggaaaagcaaggaagccagtgacatcagagaggcaacagggggccaggcatgtgccatgagaggagaggccactgcaaagaaacaacattttaacaagatcactctggctgggtgtggggtaagaaacagagaggcatcatagataatctcacagctttgacctgagcaactgaatgaacaatactcctatgtcctaagatgagaaagagagtgggagggacatgttttggtgaagagtggggtcagggatggagggcagaactaacaggagctcaattctaaactcttaagtttgaggcctggcgcggtggctcacacctgtaatcccaccactttgggaggccaaggcaggtggatcacttgagatcaggagttcgagaccagcctggccaacacggtgaaaccccgcctctacaaaaatacaaaaattagttgggcatgatggcgcatgcttgtaatcccagctacttgggaggctgaggcaggagaatcaggaggtggaggttgcagtgagccgagatcgtgccattgcattccagcctgggtgacagagtgagactctgtctcaaaaaataaataaatcaataaataaatacttcaagtttgaaaagcctaagtttgaggtgctgagtaagcaactagatttgagtatgtcattccagggaaaggtctggactggactggggatataaatttgtgggctgacagaatagagacggcacttaaagaaataagactggatgagatcaccatccgaaaacgagaagaggcatttaagacatgaccctatcaaaatccactgtgaaagacacagaacatattctcccagggagccaccctctacaaagtgaagtttgtaacacactcttcactacggccccttactccttgcctacctacttcccccagcacacacacccaatagatgtctgcagacacacacacacacacacacacacacacacacacacacacacagagtatttaaatttctcctttctgtatctcttagtgatgtcattctgctgagtaagagggaaactcccttttggggagtctctcatgtaacaagaaagtaatccacggaaggaacaagaagtgtcctaaacagtagcaaaccttacacatcaggacaatcacacaggctctggtgtcagattccagcttcaacctcatcggtgtgacctcaagcaactcatgcgccctctttttctcatgtgaagtgagaatatcattggccacaccaagggtagcctagaacatcagacagtccgtaaatatttgttagataaacgatgactgaatgaatggtgaagagaacatatacagaagagcctgactcacaagaggtgatgaacaaacactgccaaatgatacactgaaagacaagggacctcctgctcatccttctctccttgtcttctcattctagccctttccctttccactcctttcaattctgcctatgacccaacagtaaaatcatgtatttgtacagggccatactggttataaagctttaccttctacattttctcattcaaattttgaacctcatggcagacttacgagggcaggaggtacagttcccctgtcacagatgaggaaactgagacttggacagaaaacaggttccaaactccaggcagaaactctaacaaaaacaatgcattcaaaaacaatgcattcagcccaagggtgcagcctcaacgttgccaaaccgaacctgcctgacatcctgttgggcgggtaagaggcaggtgagggaaagacccagaagctagggggaggtattcgttggggtcatgtgggtagcccattaaaaatacggccacaggtccccttgccctgtgccctccctgtcccacacccacaggcttgccccgacccagtcccatgatcaccctggtcacatgctccctgtcaccagcttccaagtcatctgtgggagcaggaggtggacacaggattaggggtgggagactctggggtggccaggctgaggggaaggagggagcatgtcgggggcaggtctggaggcacgcgagagaggaaaggcaaggaaaaaaagcagggaggaaaggcaggagaagcagggagtgagaaatgagtagaggcaccacgaaaggtggagacggacgtgaagtggggaatcaagtgagcacttagaggagcacaggaaggaaaattaggacggccaatggggcctaaagaggcactgagggtcggggaaagagaagagatggattgactcgggaagttagggatactgagggagacacacggaggagactggggttcaggggagaaactcagggtcgaagctggggtccctggggtccacaagttcgagatgagacacgggcggtctcgggatgggaattggggacgcagggggatgaaaagatggaaggtgggggcactcagggagtcacataagggttaatggaggacatgcctcagaatcggagacacgaggaatatccaaaggagggtccggcggagacttgggagtccggagcgccgaggaagttggggaacggacccccaggccccgcccacccgcgaggtcactcacctcggcttactcagcacttctacttcctcctacttccgcaaacaaa

SEQ ID NO: 398 - DNA, 55130 bp, Homo sapiens
cgtcacttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaaggtagggtcagcgggaaaaccgggcactttccacccccataccgaacacggccgacatggacccttcctaggcgggacagacacctctccccggacactgactcttcccagccctgatcaccaccgttccctctgtctcgggcccacattccggggctggcatttcctaccccgggatctgggcaccgacccccgaccagggtatgataccttccccaataggaacttgcttctgctcccgacccggaccctgacacttccctccctgtgcatcatgccgcggctgggaacgctgtcagcccgtcccccactgcgactcgggcactgattgttctgagcctgttgggcccaggcagatcagccccatcatgtatacctgatggatactggtcctcacaacttactgaatggtacaatttcgtgtcattccctgttaggaaccctgcctcagcccaccgcagggccctttctaccatccagacccatccctagactctgactcctgtctcactggaatctatggcaccttatgtgctcacctagatcccccacacctggcccttgcccctgcctcaaaaacaatgatctcttagagcccagtttttcacatcactttctggaaccatcccagtcagctggctcctcagaagctggcatcttggtgcctctactttccaactaggcatggacgtcttattttcctggtttcctctcttaactaccatccaaccttggacatggcctagtcaaaacctagaccttgttcctaacctgtaacccttttcccacccagcctttgaccctatctcaaagtagcccttctccccatacccccaagacaatccccccaccaaactgggcctgtctgctgggccactgttggcccctcttgtgagactgggccagactccatccctggccttcctcaacatctgtcctattggataactaggaggactccagcacatttcaccttctgcttctccctcccccttccctgccccacttcttccctatattaagccctttctagcccgttgtaccaatgacttttcacttcctggcaccctctcccttcctccacaacctcttaatctgcaccttcccgatgctcctcccccacccagacctgaggatggacctaagtggaagtcttgcccaaagagggcaggcccacaaagcagctgccacttttgaaactgctgaagctgaggttctcaaaacactacccaacttgagcagtagctgaggcctgccatcttccttccccaggagcagagaactcactactggctctgtatgcgatcagatgcaaaggaaagtagttaggcggggcttaggctgagagactcaaacatgactccattttcctttttatttggctttttctaagctgagttcaggtgatattaagcctctctactatgcctgtcaggtagacacttagtgtagagagcagttctgagataacccaggacagaggaggcgaaggacagctggcataaggctaggcagcttgatctgagctgctctccaaactgagtaattctccctggcaccttctgtacatggatcactaatctctgcagaaaacaccttccaggcaacagtatttcctgaacttccaccactgtcaggggtaagggaggattgctgcaaagatgagtaggtcagagccctgtcaccaaggaattcgggagcgtaggtgaaagaataataactagattgtgattatactacaagcaatgctacaaggtttagggagaaagattgagcacatctgggacaatgcagggaggctttgtgctagaggtaggcctgagccttgacgtagaggtagaatttcagccaggagaaggcattctaagcaaaagaaaccaggtaagcagagagaggtacggaggcaggaggctacgaggcagttcaggaaatagtggaaggtttggtgtggctggaacagagggtatggataggagaaagccttagcctctgaatacctctcccaagcatctcctgcagggcagcagggtgtggaggactgtatgaatttacaaacaggacctgaccattaagagcctgccaccaccaatgacccagatgcggtaaagcttgcaaaaccttgacgccctttgatgctcacagcaactgaggtggcaggcagagccagtttcattatcctcattgtacaggaaaagaaactgagagtcaaagaaatgacttctgaagatcactctgccatttaggggcagaatcaggtatgcctagtcctcatccagggctctctcctaacacaggtacctttaaagacaagcagcattgacctagggaaaggacagggcaaatgactccccttctaccctgagtcgtttccctggtcatgtgaaaaggagagagaagagttagtgtggggacccagttttgatttcccaccagtgttggaccccaaaaccagttgggagagagggaatgtgaggacagaatccccaagggtcaaggtgtccataacaggcagggaaaattgtgaaatcatggagagaaagaaggtagagcctccaggagtatgttgtgaagaagtagccttgggaggagcagtctcagagcagcacccatcactgtcagagtcctatatcccagacagaagcgaatatgacccaggcagtagctgcacattaaacattggtttaaagggccctcagcgaacaggactgggtgcctgctgtgggctaggctctgggctgggtaccaggagttccgggacaaagaaggccaagccctgccctcactgagcccagtcaccaaggagaaacagacatgtgactagtcaagtaaatagagctctgataggcctcctggagggggcagcagttgtctctgcatggattgggagagtccaacaggcagagcaggagaaggtggggcaggggaccacaagatgtgttcagggaggcagtgaagagtgtggtgtgagcccaggagaggggcttggatgtagtgacaagatgttcaggaagcccgtggcctttctggggaagagaatcctgaaagcaatgcagcggttaatcgtattgttacaaaaatactatacacttgttaaaaaaaaaaaaaatcaagcagtgcagaagtataaaggaaaagcctcctgggcactattccttggaagtaacccaactggctgttgagtatataacctttgagagttttttctgtgtttacacattcattgtatatgtgtctgtgtatatagacatgtaaatttatttttataaaaattggattatatagtacatatttctctacaacttgatttttttttttttttgagatggagtttcactcttgttgcccgggctggagtgcaatggcgtgatcttggctcattgcaacttctgcctcccaggttcaagcaattctcctgcctcagcctcccatgtagctgggattacaggctggcaccaccacgcctggctaattttgtatttttagtagagacgggatttctccatgttggtcaggctggtctcaaactcccgacctcaggtgatccaccctcctcggcctcccaaagtgctgggactacaggcatgagccaccgcgcccagcaattttttttttttctttaacaatatgttggccaggcacagtggctcatgcctgtaatcccagcacttttgggaggccgaggcaggtggatcacttgaagtcaggagttcaagaccagcctggccaacatggtgaagccccatctctactaaaaatacaaaaattagctttgtgtggtggggcacgcctgtaatcccagctactcgggaggctgaggcacaagaatcgcttgaacccgggaggcacaggttgcaatgagccgagatcatgccactgcactccagcctggtcgacagagtgagactccatctcaaaaataataataataataatatgtttcattatttttctatgtcagtacatatagacctaaagttaaccagacatgatggcatgcacctgtagtcctagctactctggaggttgaggcgagaggataacttgagcccaggagttcaaggctgcagtgagccctgattgcaccactgggcaacagtgagaccctgtctcaaaaaatatatacatatatatatagagagagagagagagagatctacctcatcttttatggtggggagggtaggtaatacatgcccatggtacagaattcaaaaggtacaaaggggtgcacagtgaaagtctccctgctaccccaagctgccctatttccctcctcagaggcagcccctctcctgtgtttcttagatatccatccagaaagattctgtgtctttacaaataaataggcatatacttttccctgattttttttgttgttgttttaatgagaccgagtctcactctgtcacccaggctggagtgcaatggcataacctcagctcactgcacgctccatctcttgggttcaagcgattcttctgcctcagcctcccgagtagctgggattgcaggcacctgccatcatgcctggctaatttttgtatttttgcagagatggggtttcaccaggttgtccaggctggtcctgaactcctgacctcaggtgatccacccgccttggcctcccaaagtgctgggattacaggcgtgagccaccacgcctggccagtacactcttccttgcaccttgcttttttcacctaatgtgtgttgcagatccaatcatgtcagtacatagggggtgggtgtgttctttaacagctgtatggtatcccacttgtactccagtttgcttagaatgctagttctctagtatctggtccctgggccagcagtgtcagcatcaccccagaacttgttagaaatgcacattctgaatcagaagctcaaggtgggcccagcaatgtgtgttttaacaagcccacctggtgattctgatgcatgctcaaatttgagaatttgagtccccaactggtcatttaggttgtttcagtcttttgctattacaaaccatgctgaaattaataacattatacatttttatttcacacttgtctgtgtatttgtgggataaatttctcaaaattggtgggtcgaaggctatgcacactttttttttttttttttttgagacagtctcgctctgttgcccaggctgagtgtgagtgcggtggtgccatctcagctcactgcaacctctgcctcctgggttcaagcaattctcccacctcagcctcttgagtagctgggattacaggattacaggcgcgcacccaccacacctggctaatttttatgtttttcatacagatggggttttaccatgttggccaggctggtctcaaactcctgacctcaggtgatctgcccgccttggcctcctaaagtgctgggattacaggcgtgagccactgttcccagcccacactttttatttagatagattttaccatatgatccactatagaggttgtatcagtttactttcccaccagcaatgacctcaattcttgtttaatggctgtggagtagtctgttctccagaggttttgtttttttgttgttgtttttgtttgtttgtttgttcatttgttagagtctcactctttggccaggctggagtgcagtggtgtgatcttggctcactgcaacctccgcctgccaggtacaaacaattctcatgcctcagcctcccaagtagctggaattacaggcgcgtgccactacgcctggctaatttttatatttttagtagtgacagggtttcaccatgttggccaggctggtctcgaactcttgacctcaagtgatccgcccacctcggcctcccatagtgctgggattacaggtgtgagccactgtgcctggcttctccagaggtttttaagcagatacgtgatacaatcaggtgtaggctttagaaagagctcatggcagggtgggtgataggcaggagggagaagtgtaatgttggtgcaggggttgtgaagacagcaatgcagcaatgagggccaaaggattggggtgggaagttaggaaaggtaaccttggagagctgagtgactggatgttgtggtaaagaatggagactctggagtctccagctgggtcaacagtaacagaatggcccatgaatttcagatcatttccagggcatggcgtagaagcagtgctccgagagcttgaaccgtgccaatggcttgaagcaggcatctgtcctctcttacagcttttgtttccgctctgataacaacatccagaatgtcactggaagctacatttacttctgctgtttgtgtcaggtttttcccccactttctaattgtgttttatgttgcaggatctattgtatttacatacacaaatctggttaaaaaatcgcaattggattggtaaagaatcctagcaactttttagtatttttgtaactacaaagattagctgttcagttaccttcaggattctgttcctcagaaaggttgcaggcttcccaagtatcttcctgttaaaactttccaaccgaaatttccagataggaaagatagaaatcttctaggaaacagctcccaagagtttggggtctggaactggactgcctcagtttcagtcctggctctgccactcaccagctgtgtgacactaagcaagttacttcacctctctagacctccgcttcctcatctgtaaaagagctattaaaagtacctgctggccaggcgtgatggctcacgcctgtaatcccagcacttcgggaggccaaggcaggcagatcacaaggtcaggatcttgtgacagaccatcctgactaacatggtgaaaccctgtctctactaaaaatacaaaaaattagctgggcgtggtggtacatgcctgtagtcccagctactcgggaggctgagacatgagaattgcttgaacccaagaggcggaggttgcagtgagccaagattgcaccactgcattccagcctgggcaacagagcgagactccatctcaaaaaaaaaaaaaaaaagtacctgctttgtggggtttttgtgaggatgaaaacatgtaaagtacctagaacagtgcagtaatgttattgttattactattatcgtcagatttcaggtctcccattctttttttttttttttttttaatggaggcagagtatctccatgttgcccatgctggtctcaaactcctgggctcaaccgatctgcccaccttgacctcccaaagtgctgggattacagtccagtctcccattctgactcagcattgcagcatgggatatttataagtcacccgcaaaggagaccagagtcctctgtgtaatggagaggatctgtccaaccttggtttgtcactgaataagattaggcctcttcccacccagggtgctgagctgaattgaaaggaatatgtggaaatgagccataatgctggtttgtaggtgaagccacagagtcctgcgtgtcctttgacagccctgagcctctgcatgtgcatatctttctgcctgataagcacttcctttccttgtacacaaagcacactcctcaagccgggcatggtggctcacacctgtaatcccagcactttgggaggccaaggcaggcagatcatctgaggtcaggagtttgagaccagcctggccaacatggtgaaaccccatctctactaaaaatacaaaattagctgggtgtggtggcaggtgcctataatcccagctactcaggaggccgaggcagagaatcacttgatttgtagtgagctgagattgtgccattgcactccagcctgtgcaaaaagagcaaaactccactaaaaaaaaacaaaaaaaaaaaactgacaagctgactcctaaacccagtcagcatttgtctggctccagactaccagacactgtgcttgaccatcaaggccttgcttaagtggtacctgctcttgccacctctgactcccttacttctctgcagaaatagtgtcttgttggctgtgtcgtgattccgttttgcataataatgatacaaatggtgtatacggtttaaatgatgactcgagatacaatgctgagtacttccaaagcagaaatcagaatcctcacaacttgttttacagctgaggaaattgaggcttagagaaaaaaaaaatcactttcccaaggtcccacagctgggaagtagagctgggagtccaaatggacttcctgatctcagagtcccttcataactgctgatgttcatactgtgtgtcacagtgatatacatgtctattgcatcatgtgtcacactacattataatagcctgtttggggttttttttgggaggggggcttttttttttttatgagacagagtctcgctctgttgccgaggctggagttcagtggcacgatccccactcactacggcctccacctcccgggttcaagcaattctcctgcctcaacctcctgagtagctgggaccataggcgcacaatatcacacccggctaatttttgtatttttagtagagacggggtttcaccatgttggccaggctggtctttttttttttttgagacagagtctcgctgtccacccaggctggagttcagtggctcagtctcggctcactgcaacctccacctcccaggttcaagctattctcctccctcagcctcccaagtagctgggattacagatgcacaccagcacgcccagctaatttttgtatttttagtagagacaaggtttcaccatgttggccaggctgatctcgaaatcctgacctcaggtgatccgcccgcctccatctcccaaagtgctgggattacaggcatgagccaccacgcccagccagttttgctgtgcattccataaaatagaatacgtgttccctgtaatatgtatcatgtcacagtattaacctacctgcctgtgagtgtttcaagatcaggaactcatttttgtacccatactactgctacacaggaaatgtattgaatgtgtggagatgctcagaggggatgaggaacttgcccaagtcccacagcacactgctggcaaaagcagaagccaagggttgggagagaatagggaaggaaggaaactgggcctctcatgtgggtattgttcacccaccccactcccacctcctagcaaagctgtccaagtgactcacatggagctgcctccagtggctccagaggggagggtctcccttccagcccagagcctgggctgcctcagccatgcataggcaagggtgtggttaggggcctcctcactcacctctccctgatagtcacaacccccaatacaggcacagtactttagtttgccaggctgtttcgcatcccatatcttatttgctttaagactcctatggggctgggtgtggtggttcacgcctataatctcagcattttgggaggccaaggcaggaggatcacttgatgccaggagttcaaggctgcagtgagctatgatcctgccactgcactccagcttgggcaacagagagagaccctgtcacttttctttaaaaaaaaaagaaggctcttggaccttttttgaagtgaggctagagattgtcctcctgtttgacagagaagtaaacccagtcactcagcaagccgttaacagagcaaggaataccttggatacactttatgtgtagcattttacttatttatgaactatatctgtagggagaattcccacagatggaattgcttggtcaaagggtatgtgcatttgtaattttttgtgtattgcctagttgctttctacaggaagacagattgactcccataggcagtgtgggagactacatctttccccgtagccccaccgactcagtatgttacccagtgtgtggattcttacctttccgatagacaaaaaacagaatctcagtgtgctttagtttgagctcttattaagagtgagaataaagactttttttattattattaagagccatttgtagttcttgttgtgtggcttttttttttttttttttttttagatggagtctcgctctgtcgcccaggctggaatgcagtggcacaatcttggctcactgcacgctccgcctcccgggttcatgccattctgctgcctcagcctcccgagtagctgggactacaggcgcccgccaccacatctggctaattttttctatttttagtagagatggggtttcaccacgttagccaggatggtcttgatctcctgacctcacgatccgcctgcctcggcctcccaaagtgctgggattacaagcgtgagccattgtgcccggcctctgtggctcctctttttgtatctttgggcatgtggaaatttcagtctaatgcatcctgccaaattaccctcccgaaaaggctggacaggtttatactttaggccagtgctgtctatgtatttcctttagccaggcacagtggtgcatgcctgtaatcccagctacttgggaggctgaggcaagaggattacttaaacccaggatttcgaatctagcccacacctccctctcctagtagtcattttgtgggcttactgccctctgccccatctccttccctctttgcaaccttccacctgggacactagggcctctctgagccagtcttaccttctccagacaccctctctcttagcaggttttttattgttggtttttgtcagccaaaatatttgtgagtctccataactgaatgtgatcccttcttctagggatgctggtgctttacttgcaagatggatatggtgatagtagaatctcaggcactgtaatgagcctggctactatggaaagaacttcagcatgagcaggagtctaatctggcattgctaggacttttggtagccatgatataaaacagttgcagagtaggcttgtcccagcggggaaatctggaagggcttcgtggcagtgacatttactaggcccttgaggactgtgaggattttgcctagcagagagagggcaggtagagaccactgtgatcctggaagcttttgaccctgtttggaatacaaatttataccaaaaaaaaaagaaaaaaagaaaagaaagaaaagaaatttataccagtactatatatcattgataaattttcattagaaagttctggccaggtacaatggctcacacctataagtccagcactttgtgaggctaaggcgggtaaatcacctgaggccaggagtttgagaccagcctggccgacattgtgaaaccccctctctgcaaaaaacacaaaaattagccaggtatggtggcatgtgcctgtagtcccagctacttgagaggctgaggcgggagaattgattgaaccaggaggcagaggttgccgtgagccaagattgcaccactgcactccagcctaggtgacagagctcatgagactccatctcaaaaaacaaaaaagaaagttcgtcataaatcctttttttttttttttagacggagtcttgctgtgtctcccaggctagagtgttcagttgtgcgatctcagctgactgcaacctccacctcctgggttcaagcgattctcctgactcagcctcctgagtagctgggattataggtgcccgccactgcgcccggctaatttttgtatttttagtagagacggggtttcaccatgttggccaggctggtctcaaactcctgaccttgtgatccacccgcctcggcctcccaaagtgctgggattacaggcgtgagccactgcgcctggccttctttggcataaattctatgaagctaatctattcctatgttgatctgttactccattttcaattcttttccatttttataatactgaaattattttgattgcattcagttctttttcatgtaaatatttatccttcatcagttctttacccacatcacattcttgccaactatagcatctgccattataaatttaattgtggcttttatttttaccattttcaagtctgccagtcaaatttcttaaatttaagttttgtcaagatttgcttctcctcacagttggtgtctccctatgtgcagtttcagccattgtctgtcttgtttgttgttaatttcaactcataatattcattacctactggatgacagaatagtcatttttccctcttggctgatccattagaaaactgaaaacaattttcttcgagaggtctgaaactgctgtggcatcactggtgtccaggttttcttctctcagttattccatactggaatggcctctgccatagcccttctccccagatgtgtcacacatgccctgggttctccttggtctcttgatcagggtccagatctcctcatggtagaatggcaggatcagccaggcatggtggttcatacctgtaatcccagcactttgggaggccgaagcaggtggatcacttgaggtcagttcgagaccagcctagccaacatggtaaaactccatctctgctaaaaatacaaaaattagctgtgcatggttgtgcatgcctatagtcccagctactcgggaggctgaggcaggagaatcgcctgaacccaggaagcggaggctgtagtgagccaagattgtgccacttcattccagcctgggtgatagagcaagactccatctcaaaaaaaaaaaaatggcaagatcagagcatcttgccccaggatgaggcaggcagcatccctagccaagggaatagcattagcagagccttgcaggaacatatgggaaccagccgtgctgagccattgtcattcttctctcctctagaatgcttcagacatgcctgaaacaatcaccagccgggatgccgcccgcttccccatcatcgccagctgcacactcttggggctctacctctttttcaaagtaagtcttttgccacctgttgtgtcatttgatctaaatgactttatcttattttgttttatttttcccatcacaagaaccatgcatgttcatttatagaaaataaagaagaaagaaaaattaataattcacccatagacctacccaaagacaacaactgttagtgtttgggaccctttctcactagtccgtatttcttttctccatgtagctttttgttttgtttttgtgatatcagtttggtttcattgtactgtttatgttgggatggggtatagcttgtgctcagacatacctctaccatactaatggccttttttttttttttaatttatcgaggtttattttcccaataaaagttatgcaggctcagtgttgaaaacctggaaaacacagaaaagtaaaaagggaaaaacagcagtcatccaaaaccccactaccagagacagtcacagtttcccttcggaggtgtgtccttccactgtttctccctgtgcatggtttctccgtagctgtgaccacatggtgtattcagtttgtagctgcttttttcacttcacattaataacatcataaacattttctcatgttactgcaaaccttccttagttgtactattttctggattataaaaatatattcagaaaaactaaagaaagtatatcaatagagggaaaaataaataccacaacacagaagtagtcattaacattttggcatatctcatttcgggctttttatttatttattttaggacagagtctcactccgtcccccaggctggagtgcaatggcgccatcacagttcactgcagcctcaacctcttaggctcaagagatcctcctgcctcagcctcccaagtagctgggattataggcacgcaccaccacaccctgctaatgttttcttttttgagacggagtctcgctctgtcacccaggctggagtgcagtggcgcaatttcggctcactacaacatccacctcccaggttcaagtggttctcctgcctcagccagctgagtagctaggattacagacgcgcgccaccacgcccagctaatttttgtatttttagtagagacagggtttcactgtgttggtcaggctggtctcaaactcctgacctcatgatccacccgccttggcctcccaaagtgctgggattacaggcgttagccactgcacccggccaactttttcttttagtagaaacaagatttcgctttgttgcccagtctggtctcaaactcctgggctcaagtgatcctcccacctctccctcccaaagtgctgggattacaggcgtaagccactgcatccatccctttcagccttttaataagtgtatgtttagcattattataatcataactgtagtgttagatcttctttttgttgtttatgttaggtttttctttgtttattggtttgtttagagacagggtctcactcttgcccagcctggagtgcactggtgcaatcatggctcactgcaacctcaattcctggactcaagtggaaaaccgactgattttgttttattgtattttatttttagagacagggttttactatgttgcccaggctggtaacaaactccttggcctcctgaagcactaagattacagatgtaagccactatgccaggcccttgttttgtttgttttgttttgtttttgagacaaggtcttgctctgtcacctaggctggagtgccatagtgcaatcatggctcactacagcctcaacctcctgggctcaagcgatcctcccaccctgcctccagagtagctgggactacaaggcgtgcaccaccacacctagctaattttcatatttttagtggagatggggttttgcatgttgcccaggctggtctcgaactcctgggctcaagctgtccaccctccttggccttgtaaagtgctggtattacaagcatgagccaccacacctggcccctttttgttctttttaatagtacgtcagcttttttcctggtcattgaaaattcctcaaggatgtctttaatttacatcttaaaatgtaggctggacgcagtggcccacacctgtgatcccagcactttgggaagccgaggtgggtggatcatctgaggtcaggaattcaagaccaccctggccaacaatggtgaaaccctgtctctacaaaaactacaaaaatccatcctggccaacgtggtgaaacccggtctctactaaaaatacaaaaattaactgggcatggtggcatgtgcctgtagtcccagctactcgggagtctgaggcaggggaatcgcttgaacccgggaggcagaggttgcagtgagctgagatggtgccactgcacttcagcctggcgacacagcgagactctgtctcaattaaaaaaaaaaagtatcaattaaaaaaaatatgtacatgtaggcctggtgcagtggctcacctgttatcccagtactttgggaggctaaggtgggaggatcacttgagctcaggagttagaggccagtgtgggcaacatagtgagaccccatctcattcataggtaaataaataaaccgattcatcaataatgtacatcatttaaaaaaatttgttgccagcctaggcaacagagcaaaactccgtctcaaaaaaagaaatatttttttcaacctaaagtacaaatgaaccataatcctctccccaatacagtttcctgtgattctgtcatgcataaatctatacttatgttaaattatatatatttttatatgtatcaaatacatgattcttaccacggaggtatttttatatcaacacagtcaaattaccccattctttcattctttttttttttttgagacagagtctttctctgtcgccaggctggagtgcagtggcgtgcgatctcagctcaatgcaacctccgcctccctagttcaagcgattctcctgcctcagcctcccgagttgctgggactacaggtgcatgccaccacacccagctaatttttgtaattttagtagagatggggtttcaccatgttggccaggatggtcttgatctcttgaccttgtgatccgccttccttagcctcccaaagtgctgggattacaggcatgagccatcgtgcccagcctctttcattctttttaacagctgctcatggttctgttttacagtgtaccctgagggtatttaggtctgtccagtgttggggtatcatagcagtattgtcgtgaacacttcatacacataatttgtgcacttattttcttcaagtctatctgcagtaggtctaccaggtcaaatgcatctccatttgtaattagatagtgccaaatcaccctccaaaaagattgtgccattttacattcccactgacagttacaagtgtgctggcctacccaggcgctcacctgcattggataacaccaaaatttttagttttttccagtctgtgagtgaattaaaaagattttttttcttttttgagatggagtctcactctgttgcccaggctggagtgcagtggcacattctcggctcactgcaacctccacctcccaggttcaaacgattctcctgcctcagcctcccaagtagctaggattacaggtgtgtgccaccatgcccagctaatttttgtatttttagtagagacggggtttcaccttgttggtcaggctggactcctggccttaggtaatccacctgccttggcctcccaaagtgctgggattacaggtgtgagccactgcgcccagccaaaaacataattttttaacacctgtttcctatttcatagctccctcattttggatcggaatttttttttttttttagagatgaggtcttgctctgttgcccaggctggaatgcagtcacataatcgtagcttactgaagacttgttctcctgagctcagatgatcctcccgtctcagcctcctaagtatttgggactatagacgtatgtcattacatccagctataaatcctctttttttgttgttttttgttgttgttattgttttgttttgttttttgagacggagtctgtcacccaggctggagtgcagtggcatgatcttggctcactgcaatctctgcctcccaggttcaagcaattctcctgcctcagcctcctgagaaatgctctttttaatggttacagggtatccccacaagcaaccagcctgggcaacatagcaagaccccatctctagaaaacatttaaaaattagccagacatggtggtgcaggcttatattcccagctactcaggagattgaggctgaaggatgacttgagcacaggagttcaaggctatggtgagctatgatcacaccactgaactccagcctggacacgaatgttaccctgacaataaaagcagaaaaacatccctataagcagatacagcacagttgacttaaagcatccccctcactttaaacagaaaatgtcattctgatttttactctaagaaataagagtgcactaaataacattggctattcacagattttttttttttctttttttctggacctcaggtaaagagctgaatttaggccgggcgcggtggctcaagcctgtaatcccagcactttgggaggccaaggagggtgtatcacgaggtcaggagatcgagaccatcctggccaacatggtgaaaccccgtctctactgaaaatacaaaaactatcagggtgtggtggcacacgcctgtaatcccagctacttgggaggctgaggcaggagaatcgcttgaaccagggagtcggaggttgcagtgagccgagatcgtgcccctgcactccagcctggtgacagagagagactccatctcaaaacaaaacaaacaaacaaacagctgaatttatcaaatgccttggttcatagcataccatccttggtccatgccaggcccccctacttttttttttttcccacttcactccaatatccacctccatttcccaccttcatttctctctctgccagaggcagctgctttaatgcatttgacttctgtccttagatgtgtatgtttcttataaaatatgtagtgttggtatatctgtgtgtatgagtgggaattgcatttccataaatagaactgtgcattgatctccctctgtttccttttccgctctctgtaccttaagatctctccgtggctctgtgtacatccagccattgcttctgcctttgcttttggcagatatttctgaagtcttgagagaccttctaacatttttagtatttaggattctttccttagaccagatgctcccaaaaggaatttctggcagcaatgggtgtgagcatttttatttaaggcactggcttcctgttgctcagtctttcctcctctctgggcaggtaagcctcagtctgcctcgtgccagaagcacagagtataccccatgcctctagagtgtccccagtaagatttctgaaaggcagctgcctggacagcacagccactgggctcctcctggcctcccccctgacatctggctggttggtttgcttaacagaaaaacagcccaccacagcggctctccctcagcccttttcctcccctcctcctggttggggcactggagtttgtaactgcattgaacatttttaaaacttcagggctgagtgtagtggctcacgcctgtaatcccaacgctttgggaggccgaggcgggcagatcacctgaggtcaggagatcaagaccagcctagccaacatggtaaaaccccgtctctactaaaaatacaaaaaagttaaccgagcgtggtggcccatgcctgtagtcccagctacttgggaggctgaggcaggagaatcgcttgaacccaggaggcagaggttgtggtgagccgagaacatgccactgcactccagcctgggtgacagagtgagacttcgtctcaaaaaaaacaacaacaaaaaaacttcatattttcctgatgcctcaacatcccacaaataggccatgaacactttgcccaggtgaacaggtgccagtgtgataaggctggtccctgcgacaagttccctttcttgccctcctctactctgacctagtgacattcagacacatcagtgagatccccttttgcttgtgtctttcaccctgagccccaaagaaggcacttggccgtgggtctccttctgtaggacctgtgagtataataaatcctttcatttcatatgcctctctctcaaggactttcacactgagtttagaatgatcccatcctcatcaccaattgtgttgtaaaaaagatgttccccttgtgaggtttttttgtccttgtttttacaggcagggtcttactctttcacccaggctggagtgcagtggtgcgattgtagttcacaataactttaaactcccaggctcagttaatcttcccacctcagccccctgggtagctgggactacaggcatgcaccaccacgcccgcctaatttttttttattttgtagagatggggtcttgccatgttgcctatgcttcttgaactcctggcctcatgcaatcctcccgccttggcctcctaaagtgctgggattacaggcgcaagccactgcacccagcccactttatgaagtctttaaggatcactcgcacacagccacagaaactatgctcagagaggcttatgaaattacaggatttactatactcacatgttctagagaaggaggcatgcatgccacacagggggccatatgggaggagctccaaggaagccactcaaccaagcaggtagggagaagggggagaggacagaaggaaggaaggagaggggaggacccctgggcaagtgcctttgttagggctcagggtagtacaagcaaagggcatgaggggatttaccatgtgtttgaatggtattaggtcatagaagaagaagaccagaggctgggcaccgtggctcacgcctgtaatcccagcactttgggaggccaaggcagcagatcgtttgagcccaggagttaaagatcagcctggccaacatggtgaaaccctgtctctacaaaaaatacaaaaattagccaggcgtggtggcacacacctgtagtcccaactacttgggggctgaggcaggaggatcacttgaaccctggaggtcgaggctgcagtgagccaaaatcaggccactgcactccagcctaggcaacaaagtgagaccctgtttcgaaagaaaaaaaagaagaaatgggccgggtgcagtggctcacgcctgtaatcccagcactttgggaggccgaggcgggcagatcacgtggtcaggagatcgagaccatcctggtaacatggtgataccccgtctctactaaacaaaatacaaaaattagccgggcgtggtggcaggcgcctgtagtcccagctactcaggaggctgaggcaggagagtggcgtgaacccgggaggcacagttttcagtgagccaagatcgtgccactgcactccagccttggtgacagagcaagactccgtctcaaaaaaaaaaaaagaagaagaggagggccagaaggagaacctgggcagaatgttcatatcctatttgtggggatgttgaggcatctgtaaagtaagtttttaaaataagttttaaatttgcacaatatagtaatatttcacaaaatcatagtatttactttatcccaccttatttaaaattgattcctttgaggcaactcaaaaaattaaatccaacagcataagaaaaacagaagaaatagagttaaaggagaaaattaaaataagataaaacaaggcttgggtgaggaccacacccataccccatgctctaaagcctgtactcttgctagaaatgggcttagttgtggctctggctttttagcagccaaaacacaaaggaaagtgagacctggtgcccaatccacatgggtcacagtgaaaccaacaagaagctcagaggtgtggcctgagagtgatttgtcccaagggctcagactgaaagaatgcaatgtgagaggtatgccacatcttcataaataaagcacaatccatatgcctacaaagtctgctcataggtctttttcttgtagcactaacatggaccaccaatttgcccttccattcagtcattctgcatttattgagagcctgctacatcaggccctggctgggtactggggatactgaagtgagaaaaacagctgaccatccctgtcctcaagaagcatcttgttaagtggtagagacagacaccaatcacacagatagatgtgaagttacagctgtacaaagtgctgttaaggcgaggtccatagcaccaggaaagcatggaagaaccagctcagggtgaacctacacccaaggtgaactgcccaagccccttatccacaacagcacctgcattgacctagctcagccgaaactccaggagtcatccttctccctgtccccccaagcccttgtatccagccccttcacacgtcttgcagctccaattccagaacggatctggaggctgggtgcggtgggtcacgcctgtaatcccagcacttttgggaggccgaggcagttggatcacctgaggtcaggagttcaagaccagcctgaccaacatggtgaaaccccatctctactaaaaatacaaaattagccgggcatggtggtgcatgcttgtaatcccagccacttgggaggctgaggcaggaaaatcacttgaacccaggaggtggaggttgcagtgagccaagatcgcaccattgccctccagcctgggcaacaagagcgaaactccatctcggggagggtgggggtcaggggagcagaacagatctagaatccttccactgctcatcacttcccctccatccccccaagccagggcaccgtccccctctcctgctccctgcttccactctagccctgcagggtcttctacacagcagcagagaagtcctctcatgctgtctgatcatgtcaaaccctgccatcagcactccagtaccagcctgtctcatgcaggcaaatctaaagactttcccatggcactgcagggtctggctcccttttcccgcccagcctactttcctgacactgtccccatgctcccttagctctgggctcacaggccctctgtagtccctgcacacatgaacattcacccacctcaggacctttgcacctgctcccttcgtttatgacgctcctcctatgtcctctcctccagaaccttccctgaccacctgtctaaaatagcagctctgccctttcattctctatctccctgccctggtttgcttttcttagtgcccattaccacctaacaatacatgtaactgtttctttcgagattctttctccctcactggcccatgacctctaggagagcagcgactttgcctgattccttgctgaatcactggtgtctaggacaatgccttgcacgtagtaggcaatcaatcagtatgggctgaattactgaggggttattgtctcatagaaactatgtgagcaaagcttccctgatctgggagctaaagaaggttgagtaagggtggcctcagtgaagagagaagagaggagaacatctcaggcagcaggagagcttgtacacagctgcctgtgggtgggcatgtagcacacacatcatactgcaaaaaggccagtgtggctgcagtgtgtagagcaagagcatgtgtgagccaaggctcaggagacttgtggtggccaccacgagggcaagaggccaacaggtggatgtgagctttcggcttatgagagcagaggttagctgcggagaggcttccagtaagggagtgacatgatctgacagatgttcagcagattccaaaacagccctgcttgagagtggccaggttccctataccccacacaacagcacattattcccttattccctccaggttagagaccacgatagtaacaaattcatcagggatgcagcaaacatggtgtaccatggcatagcctttccaaagtctagaattaacatgtgaccattgactggagcattgtgacagaatatttctcaagtttcacctaacgacgaaaagaccaagaagcagctgtcagggatgctgtcatagcttcagccatcactgcaggaggagtcatcacaaagcagaatgtggagaatggagtgggacagatgtcttgtaactagcatgcttgcggcctgggtggccactctgtaggggatccctggatgattaaacagggagaaggaaatgtggaagagcgagttctgaggttccaacagctctcctggggctctatactgaagactcccttatcccttcagaacccctgtgcagcactttgagcacaaacataattgcctccctccagataatggagccactaaatgtaaacttacaaacccctttgcgaggtacagctgggggcttgaggtttctcacctttcccccacagctgcagaaactagaatgccactagtattgtctgagactcttcctgactgtcccccgactcaagaagggtgagaccaacctccagaagagacgcagggactctggtttcctcacagccactggcaaccctaacttcctgtttctctttgtatttctgcctcagatattctcccaggagtacatcaacctcctgctgtccatgtatttcttcgtgctgggaatcctggccctgtcccacaccatcaggtcagaaggcatctctctgcaacatttgaagcagctttctcgggaaccagtacagggtcttggatgagaacatgacttttggcatcattcagagccaggtttgaatcctggctataaaactcaagggactctttcccctgcacactgtagatgactaggacaagaacaatgacctctctgggccacagtttccttatagacatgatgaggatctggtgggtgtttccaccaccacagctgttgggaaagtgatttgtgagcagtaatgtcatgttagttgtgacagtactcaggtgagtaacaccagtaccacctgccgggtgttgtggcctagctgtgtgctaagtgccatgttgggctcctcacacatgatcgtgtttcgtaaggagccagaggcagcatagtgaaaagttaggagcgtgggctctggcatttgactaccttactttgagtccagactctgccacttaatagctctgtgatcttgggcaagttacttaatctctctggcctcaatttcctggtgaatgtggagaaaaataatagtgcccttcccatggggtcatgtggaaagcttttagcacagtatctggtgatttaaagtgttcagtaactattagctgttactgtcattatctgtgttaacctgccagacaaccttatatgggttgcttttgctttcacacctgtatgatagtcatggaaactgaagcccagagaggttaagaaatttgctaggatcacaccactaataagcaacagagccaggattcaaacccaggtgtggctccagagcccatcctcttcccactgctaccctaactcaaactgccacatgctcgtgtcctttcagtggggagagtggttcattagagggggttgctacttttattttggacaggccagttctccattctgcaggactatcccatgtattacaaacagttggcaaccttgccctgctcaccaaatgggagttgcataccagtattccccagcttgtgactacagagatgtcccagtatgtttctttctgccccgttgaagaggtgcagcctcaggctgagaaacactgatagaccaagaggtggccagggttcccagaaggaaggaactcaccttgaacttagctttctttgaagggtaggaaacctggaagacgtacaaaggagggagaggtcaggtgctagaaagtttgtgcacattgagggcatgggcagaatctgctcccaaaagcattgaaagccaatatgaggccaggtggtggctcatgcctgtaatcccagcactttgggaggccaaggcaggcggatcacaaggtcaggagattgagaccatcctggccaacatggtgaaaccccgtctctactaaaaatacaaaaaaattagctgggcatggtggtgcatgcctgtagtcccagctactcaggaggctgaggtaggagaatcattgaacctgggaggcggaggttgcagtgagccgagattgcaccactgcattccagcctggcgacagagtgagactccatctcaaaaaaaaaaaaaaagccaatatgaatgtggcttcattcttctaggcacactggcaggacagtgtggtagtcaggagcacagggtcaagaggcaggcagccttgggacaaacacctggtgctgccagctctaatatgtgtaaattactcaagctctgagcatagttcttctacctataaaatggagagactacaggtacctcctcagaggtgtggggagggtctagtgagccccaggctgtaacatccctagagcacagtgccaagcacacagtgagcctagtggctggcccagggttacacagctgagacttcacctctggtcttcccactgaggtcattgttgtcctcacctgcactgactcttcacccacaaaattctattctagctagcttgggagaattctagtccagccccgcatcctgaaaaatggaggcccagggaacctgagtgacttggacccaaccaagataatggcaggcccagtcgcccttgctcacaggacaaaccattcctttcgtggtggacctggggtggggtgggggcagtcacttgcagacattgggtgtcctcctttcccatgctgattaggatcctccccaactgtagcccatcctaccccagcatctgtgagacgcttgagacccccaagtctccccacagcccagcctccacctcagagagcccagtgggttttgaaagccactgttaggctgtgtgctgaggaactgattatttaatgttatagcaacaaccctacaatgaagatcttatctctacccagctgcctaggcagggtattttgaacctttatcatcttgacaccaaagactttttttcccttttagaataataactaagggacattgtcccaaatttctcatagatgagtaatctatgtcaagaaataattgagggtgggcacggtggctcacacctgtaatcgcagcactttgtgaggccaaggcaggtggatcacctgaggtcaggagttcaagaccagcctgggcaacatggtgaaaccttgtctactaaaaatacaaaaaagtagccgggtgtgatgacgcacccagctactcgggaggctgaggcaggagaatcacttgaacccaggaggtggaggtcgcaatgagtcaagatcgcaccactgcactccagcctgggtgacagagggagactccatctcaaaaaaaaaaaaaagaaataattgtctatctgtcttttagccacttcataatttttagagatagatattatcaacagaaaataaaaccaacagcagctaaaactgcacatggtaaaatgtatgagtgactagaaactaacagaagaataattttcttaatgaaatttagagcaacaaaatttgacctgggaaaaccataccttttaaaaataatggatcacctgggcatggtggttcacacctgtcatcccagcactttgggaaccctaggctgttggatcacctgagctcaggagttcaagaccagcctgggcaacatgttgagaccctgtctccacaaaaaatacaaaaattagccgggtatggtggtgcgtgcctgtggtcccaactgctcggtaggctgaggtgggatgatcgcgtgaacctgggaggcagagaggttgcagtgagctgtgatcatgccactgcactccagcctgggtaacagagtaagaccccatctgaaaaatataaaaaaaaaaaaaaaagaataatggatggccataggcagaaggtatgcttaccatatggggttaaagctggtccactaaaaaatttgatggggaccaaaaactgtcagatgaaggaaatcattattgtaaaattaacatgaaaaagaactgaatccagtgaaaataattttagtaagtaggggatgatttgatcatgctttttagaaagttggtctaccaattaaatggatgtttcaattaaatcgagttttcttaaatattttctcaaggaaagtctacagtgttgttagaattttgatcagctgcctgtatccacaaacttagaccttcctcaggatccaaacaacagatccaaaggtttaagacagggaaattgggctcagaggggttatgtaaccaccaggattcacagctggtaagggcaaagtgaggttttgagctcaggtctgtctgactccaaaacccctattctttacagttttggcaaaagtgaagtggggggagcttaaagagggtgggctggccacctcctgccattgagcctgtggtctcccaaggactggcagaggagaggcctgctgaaaggctgcagagagctgcacccgagctgtgacagcacaggctgaggttctcaggattccctccacctccaccaccacttcctagcccacattaagcctctttggaacaaaccccagcctgggggattggaggaaggcaggggccgcagcctgccttaccttgtgtagtcaccaagattcaaacccaagacatccttcctgcaaagggaacctcggcttacttcatcatctgtgtctgagctcgtgccccacccagctgaccttagagggaaaaaatgcccagaaggaccagatctgccaccccagaggaggaagccacatcaccagtttcactgaccctgccttccacccccaggggagaagggcaccaggatgtggcttgtcagtgggaagcaatgacctttacgtttgacatgagccatcaagggccaggaagaatctctgcctgctacaaaagtctgcattcagagtcattcagcaagcattttagcagatgtctagcaggcaccaggtatcttcaccccagggtagggtgaagatgatgagacggggcctctattctcaagtccacaggctcgcgctagccaggttgcttgactcctcccctgtgtagtgctaagcagcctctcttttcttggaataacaaagatatcaatctagagacttgctacttgaagttgaagctgcagttaagtttatagggtgccaagtgctcatttaatcctctcaatagccctacaagaaaggtgttgtagcattccagatgaggaacagttgcacagagcagttaagtaagtttcccaagatcagaccactaataagtggcagagttaggatttgagcccaggaagtctggctccggagtccatgtctttaactgtcacactctgctggttgagaagctgagcaccaagctcctaaggaagaggccggctaagatgggcagagttcttatccatacctgcactcacaccctggcttcagactcccccaaaactgattcagcaaactaatctgaaagtagcttcctgtcacccacccagcttctgcctcccaccgcctcagaaccctgctgtgggagcccatttccgattctggccttgcacctgctgcgcttctcttcacaaagccctcccatcattcataccacagccctacaggctaggagggatcggctctttgacaagtggagaaatagaggcccagagatggttttttgtttttgtttttagagacggagtctcgctgtgtcgcccaggctggagtgcaatggcacaatctcagctcactgcaacctctgccccccgggttcaagcaattctcctgcctcaggctcctgagtagctgggattacaggcacctgccaccacgccgggctaatttttgtatttttttaagtagagatgaggttttgccatgttggccaggctggtctcgaactcctgacctcaagtgatccgccacctcagcctcccaaatgttgggattacaggcgtgagccactgcacctggccagagagggttcttgaatctacatcttgctccatgccaccagggtctttaaagagagttcccttggccgggcgcggtggcttacgcctgtaatcccagcattttgggaggccgaggtgggcgaatcacgaggtcaggagatcgagaccatcctggctaacacagtgaaaccccttctctactaaaaatacaaaaaaaaattagtcgggcatggtggcgggtgcctatagtcccagctactcgggaggctgaggcaggagaatggcatgaacccaggaggcggagcttgccgtgagccgagatcgcgccactgcattccagcctgggcgacagagtgagactccatctcaaaaaaaaaaagagttcccttttccctccctttatcactgtgacctgggtacctcctggcctgcctcatccctgctaaagactccatgccaggcaaagcattcatcctgccttctttcatatcttcatagcaatgctctgagacagatggtattgttagccctgtatacagatgagaagattgaggtccagggagacagagccactgaaatggctctcccacagccacatggcagagcaggcctcagtgctgggccacccaggcatgtagccactccacagtactgccaccaggctgggtcaagaggccttggtttgctaatcttgctctgaaaaaagtccagaaaaggtctctgcttccttcctggctgggaggtggggcatgctgggtaatcagagagaatgcttctagagacgaggccaagctggtcttaaacaactgaggccttgtggaaggagtgaatgtgatggtgatcctgcccaggggctatgattcatctggctgattgattccagctgagtctgtaaaaatctcagtcctgctgttggaaagcagaatgtcaagtcatggagtggggtgggggtgactgtcaggtcatctaacttgataggtttggaagggagtccacaaatatgcttcttgacaagggactcatataggtggcatgtgggccagactttgggatcctctgctctcccaaaaatggtattttgccttcagtctatctgcttctgctttgcatttctttgatgttaacaaaaaggcagtagagaaatcactatgagtgcaaaaacctaggtttgagtcttagctgagatataggacccctgtgtgactctgggcaaatcacttaccttttgagggcctctgttttcacatctgtagagtgggaacagtaacacctacctatcaggacagctgtaagggtgccagctgtaaatggggcaggggtgtgttaaggctgactgcccatgggggctctgtttgccgacttgctttgtctttccttccagccccttcatgaataagttttttccagccagctttccaaatcgacagtaccagctgctcttcacacagggttctggggaaaacaaggaaggtcagtgctaaccactttcccctgtagtgtgccttgggtgtcttcctccaccattccctttgtctctccaatattggggttctccaatagagcaactgatgaagtgggctctggaattccatggcctggattcacattccaactctgctattgtctagacatgggaccctgggtgaacgccttacctctctgagcattgggtgtttttgtttttgttttttttcccatctgtaaaatgaaagtgttaatctagtacctccttcacagtcatgttgttaagatggcgagtcaataagtggaaagcattcagcatggtgcctggctcatagtaagcactcaaagtcggccttcatgattattttattcgtatatatttttagtgtgatcactgcctcacctaaggtttgaaaagggggttccacagctcttttttcaaaaataaaaactggccagaaacagtgtctcatgcctgtaatcacagcaatttgggaggccaagacaggatgatcacttgaggccaggaatttgagaccagcctaggcaacatagtgagacctcatctctacaaaaaaattgtaaaaaaatgcaaactatggggaagtgtggagatcctgggatttgtaggttagttagggtatggattcaaatgctgtaacaagattatcaatgcttgaccaaacagcaggtatttctttgttttttgttttttgagacagagtcttgttctgtcacccagggtggagtgcagtggtgcgatctcagctcactgaaacctcagccaactgagtaattgagattacaggcgtgtgctaccacacccagctaatttttttgtatttttagtagagatggagttttgccatgctagccaggctggtctcaaactcctgacctcaagtgatctgcccacctcagcctcccaaagcgctagaattacaggcgtgagtgagccaccacgcccagcaggtatttctcttgtatacaatactgagcatgtgaaatctagcacttttttttttttttttttttttcgagacagggtctcgctctgtcgcccaggctggagtgcagcggcacaatcttggctcactgcaagctccaccccctgggttcacgccattctcctgcctcagcctcccgagtagctgggactacaggcgcccgccactacgcccggctaatttttttgtatttttagtagagacggggtttcaccgtgttaggatggtctccatcccctgacctcttgattcgcctcccaaagtgctaggattacaggcgtgagccaccgcgcccggccgtagcactctctcttactggtgcctagcacatgctgccttgtccctaatcggcagcaattttatgtgattgctttgtgcatctctaaggaacctctgttaaacaattgttgattttttttttttaaagactgagcttgggccaggtgagatggctcacgcctcccagcactttgggaggctgaggcaggcggatgacttgagatcaggagttccagaccagcctggccatcacggcgaaaccccgtctctactaaaaacacaaaaaaaattagccaggcatggtggcgtgtacctgtaatcctagctactcgggaggctgaggcaggagaatcgctttaacctgggaaggcggaggttgcagtgagccgaaatcgcgccactgcactccagccagggcgacagagtgagaccctgtctcaaaaaaaaaaaaaaaagactaagcttggccaggcgcggtggctcatgcctgtaatcccaacactttgggaggctgatgcaggagggtcacttgagccctggagttcgaggctgcagtaagccacggtcagtgcactccagcctgggcgacagagcaagaccccgtctaaaaaaataaataaataaaacagtaaaaaggctaggcttataccacagtcttcaaggtcccaggccctctctatctcatgctccgccatatacagcactggccctcgggtcaggatagtgtcatcactccactgtccagccagaaggaaggagaggcatccatattccctgtccatttagctataagagaagctggaaaatggccgtgagtcggtctcgtgtccagttagaactaactcatcagggtgcgcatctgcagtcttctgttccggcaaggagaaagcattcgtatcatttctagcttgtcaagccctactgtttcagcgatcctcattggagaggaatcagcagtcgaaggaacagcgggccaagcgcagtcgtgacgtggcgttcagagagcggaagttgtcagatttcaccgggccgtaaagcgcgctggctgtgtcatcttccggttagcgacaacggctctgaccgtctggcaggccgcgtggcgcccgcgccggccttcctgcaggggactccaccggagccttgccaattccgtttgtttccctgttgtcgcccgcttcaccctggatcatgttcaagaagtttgatgaaaaggaaagtgtgtccaactgcatccagttgaaaacgtcagttattaagggcattaagagccaactggtagagcaatttccaggtattgaaccatggcttaatcaaatcatgcctaagaaagatcctgtcaaaatagtccgatgccacgaacatacagaaatccttaccgtaagtggggaattattgttttttagacaaagaaaggggcctttttgtccaactctaaggttgcttcacaaatacccttttatcctgccacaccagcaggttgataaaggagctatcaaatttgtactcagtggcgcaaatattatgtgtccaggtttaacttctcctggagctaagctgtaccctgctgcagtagatacgattgtagcagtcacagcggaaggaaaacagcatgctctgtgtgttggggtcatgaagatgtctgcagaagatattgagaaagtcaacaaaggaattggcattgaaaatatccattatttaaatgatgggctgtggcacatgaagacatataaatgagcctcagaaggaatgcatttggggggctaaatgtggatattgattgtgtcgtatgtgtgtttgtgtctgtgtgtgacagcgtgaatacaatgcctctgtggttatgctaaataagtttaacagatactttatagaaaacaaatcagggtgctcttaccacagatgaaaaaacaaattaggggacaagcagcaagcagtctgctaacactctggaatgtgaaaggagtgtctggactctgtgactcccggcaaactccacagcctctagttgtcttcttaggaagcttggaagcaattgagaatggtctaacatcaagatgtctaccacagggccccccacaaaagcagcctcggggactccggcctttccttgagacctgcatctcttcccttcttcatcgcctgctagtgaactgaggctgccgctaaccttcttcatcctttggtggcaaagtagaaagattccagaattaactcgacctttctaaagacctgggctcagaggcagctggcactgactgagcacccactatgtgccaggcactgtgctgaatgcattgtaaggactgtcttacttattcccccacagcagccctaagaaggggtgctgttatcccctttttacagataagaaaactgaagctcagagagggcactgccttccccaaggtcacccagctacaagtaacaaagcctgtgcttctaacaccaaagaccacttcccgctgacactgtgccaggcttgtaagtctctctctgggcctccattccctcctgtaggaaattggaggggttggggtggctccagtgagctctccccttctgaaactcatactaatctggggcagccaaggcttagccccgccagcctgtgaacctctcacagtgcccacagccatgccctcctccgtccaggggctgacaggtgggaggggtagccctgcctcagggagtggacttacctggcctctctgctcagagatcatcaattatgaatttgacaccaaggacctggtgtgcctgggcctgagcagcatcgttggcgtctggtacctgctgaggaaggtgagtagtcaggacctgggcagaaggggaggatggggttgacagggcagggtgggtcacagcaagctggtctcactccccgctttcctcagcactggattgccaacaacctttttggcctggccttctcccttaatggagtagagctcctgcacctcaacaatgtcagcactggctgcatcctgctgggcggactcttcatctacgatgtcttctgggtgagtcaggcagggatgccaaggatgtctggctccggggccatctcatctcatcaccctgcctctctggcccaagttgcagtcatctgacggagaagagctgttttgggctgaagttccggaccgcagagcaagtcctctctgggcccatctgtgagatggagccagagagagcagattctacctctttctgagagcacactcatgcccggtgccttccgaccacctgcctctcttccttgctagcaggggtgttacctaatcccatgtctccttggcaagggagttgagactcaaagaagttcaggtaggggtggaagaatgttgatgaatgggcccagcaagggcattcacattcactctgagaggcatcacagagggactgacgtcagcctgactcaggtacccttttcctggccccaggcagcctcttcccctctcaagtgggtagcgctgggggactttatcacttgggaggaacagaactgtgaacaaacataggctgcctggcttgggccatcagaggtcttttctatactccctcgaatttcccctttgttgcccagaaccagtatcagtggccacctcacctcagcttcagatctgcactggagcccctcccagctcccctcagatcccaggcagcagcacatctagaagcccagggacagccattcttccccccacagcccctcacttcccttcatactgctctttttttctccttctaggtatttggcaccaatgtgatggtgacagtggccaagtccttcgaggcaccaataaaatgtaagtgaccaccctgccacagggaaccccttcccccacccctgccgggccatgcccccacagcccgtttcagtcagtgcatctccctatctcttccccatgtacctcttcctcctgtggctccccagcctggtttccttatcctcaattgattcatctggctgtgttcatcctgcccaggtcccggcccctggccacttggtcgtggtgcagcatggcgtgaaatgagccaaaatgggagcgagcatggaggggaagtgtttaacccagcccggggggcacgcgcaggggctttccaggagagaaaacctctaagccgagacccctcactggggtccccttggcacctgagtgtcgggtgctgtctatcccgtgcctctcaaactgccttggttttgttcttcagtgtatccactgtttataagtaatagaaaatccacctacaggttgagcatctctaatccgaaaatctgaaatccagaatgttccaagacccaaaagtttttgagcactgacatgacaccacaagtggaaaattccacacataaggacttaacacatgtgaactgtgtttcatgcaggaaatagcattttaagattgtataaaactctttaggaggctgaggcgggaggatcacttgaggccagcagttcaagaccagcctgggtaacagcaagaccctatctctacaaaaaattaaaatattagctaggagtggtaacacacatctgtagtcctagctacttgggaggatctgaagcaggaggatcacttgagcctgggagttccaggctgaagtgagctatgatcatgtccctgcattccagcctggatgacagaatgaggccctgtctttaaaatttatatatgtataaatatatatgtgtgtgtacatatataaaactaccttcaagctattatgtataatgtgaatttcatatttaaacttaggttttatccccaaaacatttcattatgtatatgcaaatattccagaattcaaacaaagtttgaaacatttctggttgaaccatttcagatatgggatactcaacctgtataactgtctttaaacaagggggaaattttgtcatctcacactacagcaagcccaggggtagaaggctcagagtgagttaatgaccctctcttcaccaagagccaaggttacttcaggactcccaccccagcattctcagcatgtccacctgccccttaggtcatcccttcatggtcccaagatggctgccacagctcccagcactgactcctcacatagctgtgtccagaaaaagaaaggggaaattatgtctcagggagggatggtttttcccaagtctcctgtgcagtctccctcatactttattggccaaaactgtgtcacaggcccaagtctaaaccattcaccagtgagggggataggaaacatgattggcttagagtttaagctttagactagtggagaatcacctgctggtattacaaggctcagagaggggaacagaatccgtcaggcatgctagcaaggaagagaggaagatgctgccgggagggcaggcaacagtgagtgcatgccatggaagcactggctcgtggcgacaggcagtcgttgggggagactgggggagattccactcaggggatcaagaaacagctgtctttctcgtgactcactctaccactgcggacagcctttctccctgcgttgaggagagcttcatggccacaaacagctcctgaattctgtggtcccagcttagtgaccccagaggaaaacaggtttctcccagctttggcctgaataaacctacaagacctggcctggcccatgagccagacactcccactggagagatggaggatcgtgatggacaggccagggtcactgccctctccagggcctgggggcagagtattggaattggcagcccccgagaaccaagtgtacacggggagggcatttctccagagcaagggaacagatgctgggccagccagagcaacagctattccccagtgccttgatggttgagcctgggggtgtgtaagcccagagaacccagccagggtgtcaggaaaatcttttctgggtcatgaaggatgaatacacatttcccaagcatacaggggcaatatgggcatttgaaagataatgtacagcttcagcaaagggctggaggcaggaaggtgcatggaggggcctgggagcagagaatcagggagtgggcatagctgagttcagggaaaagaggctggaaagaggtgggcagaggccagatttgggaagccaaggatgccactctaaggagcttggacactgccccgtaggccactggaagactccgagcagggaagtggtgctgtcatatttggtttctgatacttagggtctggttttctgggctagggagaagacccactgccttctactgctaggactagtgctcagtggcagaaaggcagaacagtgaagtgctcatatgctgacatcaggctgcctggacttgaatctcagctctgccacttgctgaccgtgtggccttggggagaagacttgtcctctctgagccctggtttctagaactgtaaaatggtgacaatagtctctgccactcaaaattgaatggtaccaggattgagagagaaaatctgtaaatcactgcgttgtacattcaaggcaggaagaggcaggcagggcaagggtacctatccatgtattagggaagcacaagcttattcagaatccctgtgcacgcacctctgtgtacctgttgttggccagatgaaggttgcagtgagccaagatcacaccactgcactccagcctgggtgacagagtaagactccgtctcaaatatatatgtatatatgtataaagaaataaaaattaaatggccaggcgtggtggcttacgcctgtaatcccagcactttgggaagctgaggtgggcagatcacaaggtcaggaattcgagaccagcctgaccaacatggtgaaaccctgtctctactaaaaatacaaaaattagccaggcatggtggcgcatgcctgtaatttcagctactcagggggctgaggcaggagaatcacttgaacccgggaggcagaggttgcagtgagccgatattgcgccactggactccagcctgggcaacagagcgagactccatctcaaaaaaaaaaaaaaaaaaatgttggccagagctgaccccctacctgcaagtaaggaattcaaggaacaggattttcctgattggcttagtcttgcaccacacttatcacctgggaaggctgcctaacacaaaaccaggactggattagtaaagaaggcatgaggtagcagttaactgtgtacaaatcatctaatcttcactatcaccctgaggggtcagttctgttgtctacccgtttcacaggtgacaaaactaaggcaggtaagtaacctgtgcagagcacagaactaggattcagacctacagacccacaagtcagcctctaaggcccacttataactgctcttctgcttgcaaggccctatggatgaaatccagttataacctccttttgctataactagacacagagggaggcgtttctccctaatctgtatttatccagacaagctgtccagcaagatttctgagtgaggggctttaaggaagcaatctgcgggtgtgtagccttttctccctcagcaaatacagaaggagcttatagcccgggctcaccctgcttcagaacaagggccaacatctgtccatacccctgttatagtgagatgggaaaccttgtagatgttggcactgtgtggctcttttcttttatatactgggctttagggtcaatcccatttaaccaaagggttcaatagctataaaaaggcgttgaaattgtatggttatttgagttatagctcagtaaaggcattaaatcttcagcctagatgaccctattcctccccactctaaccagctgtgactccagatggagacattgccctgcatcctctcacgtccccatcccccacatcccacccagaaacaaatgtgtgagtttcatacaacaagaatggggggttaggagtcaaagtaagctgggaatacaaaaatggggcgggcgtctaaaatcccagctactcaggaggcaggagaatcacttgagcctaggagacagaggttgcagtgagccaagatcgtgccactgcactcccgattacagtcctcattgccctgggcaatagagcaagccccgtctcaaaaaaaaaaaaaatacaaagtaggccgggagcggtggctcacgcctgtaactccagcactttgggaggtcgaggcgggaggatcacgaggtcaggagatcaagaccatcctggctaacacggtgaaaccccgtctctactaaaaatacaaaaaattagctgggtgcggtggtgggcgcctgtagttccagctacttgggaggctgaggcgggagaatggcatgaacccaggagatggagcttgcagtgagccgagattgcgccactgcactccagcctgggtgacagtgcgagactccgtctcaaaaaaaaaaaaaaatgtaaactgggctccagctgactcctcacattcccgcctcccgcttcagtggtgtttccccaggatctgctggagaaaggcctcgaagcaaacaactttgccatgctgggacttggagatgtcgtcattccaggtgagcctgctggtgtgggggctatgtgaaaggggtggagagggtattccccggagcaaggggattactgctaaacagacaggcttaccagctgagaaagagaaaaggtaaggctggatcaggccagggattggtgaagggttcccccttaacatccgtttacggagggccagtcaggtgccatgccccaagctgggtcctggtcaggtgtcagtgaacaagactgtcttcacagagcctctggtctaggtgagcagatgttgctcaagaactacaaaagtaaaagtctaatgacagattgaggtacactctgaaaaagcacgtttcatgacaatcttaacagactggacccctgtcacacacacccacacatacacataccccttcccagcatctgcaagcatcacagatgtaccagaattgccctagcccccttgctcctcctccctgtgccaagacatctccagggagaacacacacatgggctcctgtctgcactctcagcagaggagcatgtgcgtgcacacctgcttatctgcagaggctggcctttgagcccctggatctgcgtgtgggttctagtcagtgtgtctgtgggtatggacacgggccctgtccacaatccaagcaggatagcacatcctgcgcaaccacagcctggcctcactttggggcaggagcagctcaaactaccagtcaggaaagagactaagggcaaagctgagctgctgaagtggctgaggctcgggtgtgtctgcttatctgggcccagttgtgggggcagtgaacccaagggacatacttgtcttcctagcctcagagtgagagggttagaagcttgcttaaaagaaggttttagctgggcacagtggctcacacctgtaattccaacactttgggaagctgcgtggggaagatcacttgatgccaggagttcaagaccagtctggacaacatagcaagacctcatctctacaaaaaaaaaaaaaaattagccagtcgtggtggctcatgcctgtagtcccagctactctggaggctgaggtaggaggatcgtttgagcccaggagttcaaggctgcagtgagctatgattgtgccactgcacttcagcttgggtgacagagtgagaccctgtctcttaaagaaggaggtctggcctgggcaaattgtgagaccatatatatatataaaattattatttctcctttttttttttttttgagacggagttttgctcttgcccaggctggagtgcaataacgcgatctcggctcactgcaacctctgcctccctggttcaagcgattctcgattctcctgcctcagcctcccaagtagctgggattataggcatgcaccaccacgcccggctgattttgtatatttagtagagatggagtttcttcatgttggtcaggctggtctcaaactcccgacctcaggtgatccacctacctcggcccccacaaagtgctgagattacaggcatgagccaccacgcctggccgaccccgtctatattttttaaaagaagaggaattattttaaagcagcagattaaaggctgacttactttccagggtaggatattatagcaattctgatcacctagggtgatacaggcacttctatttgtgacagttgcattttgtgacacatggaggtgacacagaggctttccctgttttaccagtgaggaaactgaagctcagaagtaaagggaatgatacaaattcacacactagtaagcaacagggccaggactcagaccagcactgtccaactgcaaaaaaggctacgctgtcagaactgctccttacagcagcactagcagtaataagacggtaatcacaacagctaccatttatcaagcacctgtcgtgtaccaagaatggtgctaggtggccggccgggcacggtggcttaagcctgtaatcccagcactttgggaggctgaggcgggtggatcatgaggtcaggagatcgagaccatcctggctaacatggtgaaaccccgtctctactaaaaatacaaaaattagccaggcgtagtggcgggcgcgtgtagtcccagctactcgggaggctgaggcaggagaatggcatgaacccgggaggtggagcttgcagtgagccaagattgcaccactgcactccagcctgggccacacagccagactccatctcaaaaaaaaaaaaaaaaagaatggtgctaggtactttttatatgtcatctttacttctcccagcagtccagtgagatagagggcatttccattttacagataaggaaactgaggtttgacttgcctgaggccacgagggtatgggcttgcacccatgtgtcttcataatttgcagtgctgtgaggcagggagacttgcttccccagtagaaggcatctctgtcagacaaaagaaatggagtcctgtaaagcatctggctcactcttaagggcacggtctgtcattcacccacacaaacttcccctgtgtccttgtcataagttccaggcttgagacaggcacaggacatctcggcatatctgtcctttccccaccctctatatatatccccagtagtcccgcaatcacaataaatgtaagttgatcacagtggagcgttgtttggaaggccagatgcactttaggagtgaaaatccctggcagagctctgacccctggattagttggagaacactcgtagaaatcagccgccagggggcactgagttcccagcttgattccagaataactgcagttgtctgctctatccccaaccaactccctactcctacagagtattcattgagaactaattcatttccctctttaaaattaatcatatgttgacagttgacaggcagtgcttcttttttttttttttttttttttttgagatggagttttgctcttgttgcccaggcagtgcaatggcacaatctaagctcactgcaacctccacctcccaggttcaagtgattctcctgcctcaacctcccaagtagctgggattacaggcatgtgccaccatacccagctaattttgtatttttagtagagacggggttgcaccattttagtcaggctggtcttggaactcctgacctcaggtgatccgcctgcctcggcctcccaaagtgctgggattgcaggcgtgagccaccgcacccggccaggcagtgcttctcagcgccttccttcaagtaaatgagactcagagcccagagcccagtaagggaggcgacacacagggtgtgcgtatagcacagggacaggactggttggctgtgttttggggttgcttaggcttccgggatgtctctttctttttcttttttcttttttagcagaaccattgcttacaattggcttggttttcaagtttcagagtgcagtgggtggaccgaggtaaccctctcctgtgctcctgtggagccttcaaatagcccactgcttgcccctcctcctcccccctccagccacgcactgccacaggggcctttttcaaaatgtgtttaggttgttctgctcagaactcctccagtgcgtctcttcactcaggataaagacccaactcctccccatggtcctcggggccctgcagggctggtctatctcctcatctcctgccagtaggcaagctgccttagtgacccctcagtccctgccacatctcctgagcactctttctccaggacctttgcacatgctgttctctcctcctggcgtgtggcatttccaagaagccttccttctttcccctccttcacccctgcccagcctaggtctcatcctgttacaccttcttacaacatgggaagcacaattctcctgcctcagcctcccaatagctagaattgcaggcgtgcactgccatgcccagctcattttggggttttttgtattttgagacagagtctcactctgtcgtccaggctggagtgcagtggcgtgatctcggctcactgcaacctctgcctcctgggttcaagcgattctcctgcctcagcctcccgagtagctgggactacaggtgcctgccaccacgtctggctaatttttgcttttgttttttgttgttgttttgttttgttttgtttttttgagacagagtctcgctgtgtcaccaggctggaatgcagtggcgcgatcttggctcactgcaacctccacttcctgggttcaagtgattcttgtgcctcagcctcccgagtagctgggactacgggcacatgccactatgtctggctaatttttgtatttttagtgagacgaggtttcgccatgttggccaggatggtctggaactcctgacctcgtgatccacccacctctgccttccaaagtggaagcactctttaacagtcacaatctcacaatgatttccgtgactatttgaggtatgtcatagtgtggctaccctgtccccctggctgagctctgtgggagcagcgattttgcctactcctacatttcccatagtgcctggtacataggcacttgataagcatttgggcagacacggtgtgacatagtatgatgcggtgaggtgctgggtcattgtagtcccaggccaaagcaaaatcctgggcccctctcattgttctaggtagagaaatgggactttctgctgtcacttgagagtattggccacacccttggtctccaatgattgctccaagatggaacaccaggttggggaccaggacccagtctcctgttagttcactgccctgctgcttccctgccactctctaaccccagctttctcccacagggatcttcattgccttgctgctgcgctttgacatcaggtgagtgagtgagggcctgccccagcatgggcttctccagggattctccagtggccttcaggagcccagagaaggtacctcaggagaccagaccctccacccccacagcagccagagcaattctgattttatctgcattttgcatcttgaagttctaagtatttgaagagcctgtggtcaaaaaattgttttaagaatcataggccaagagatttaaacccacaagggcctggtggtactcacagtgctttctcactgtgtgaccttgacaagtggcctgaccttcctgagcctctggtttctcatcttgagttaataacaagagttcctaccatgaaaatctggagagagtgctgagcacacactgacctcagtcgctcttggttgaatcctggttgcagtcatcatcatcatcttttatcagcctagcgtcaggtcaccatgtctcagctgctctagctgttccctgccctctctttactcagacatttttcagtctgttgtagacagtgagcacgagggggagaaggtgggcaacttaggtcagcgtttaaaacacaagaaaggtcttatccaagttaatgcacctatgcaatgggacttgccgtcagcagggggcgccagcaacagctccatcattttatgccccgtcatccctgtgagggctggcaatgttgcacttaactttgaggtggtttgtgaacttctcttgatttcctcatgcctgatagttgcaaaagcagtaataacagtgacagtggtaatgagaaacttactaccagcatcattgaaatccagtttccatgtgaaacttaggtttttcccactcacatacacctgggttatttgtgtagtgccacttcaaaccttaggagcatatgggctcacagtcacctttggaagagacctggccagtctgtaagtagagggatgtctgtgccagccgtctctactcctggctgttcagaggtaatacaaagtgaaacccataagaagcccccaggctatttgctggagacagattcaactgccagcaccctcagagacagagtctcattttttagcctgggctcacagcataagcagctcctcagctgatttccagaatcagtgcaacattcccaaagggagtcacttgtatcccagttctcaagataggtgagttctcaaggtacttgcagccgaaggcttagaagcacccaggacaaggagagaagggggtcagaagcactcattcattccacaaatgttaattgagtccatagtactggctgggcacatcccaggtgctggggacatgcagaggttacggagctggcattggagagggaagtcacgtaatggcaatgccgggctgtatatgattcatctgttctgaagctgatcttggatgaatcacctccaggaagccactggcatttattcatgcagccagcatctagttagtaccacaaataggctattgaactattacgtccactgcacttaaaagtagtaacttatctttgcagtttctgtatctgtgtttctcaaagcatgatccaacggtatgagattcacctcagatgtttttttcaaaatgcagattcctgggccctgctctagagctattagatcagactccctgggggtgggacctagaatcctgcattttttcacaagctttccagatgatttttatgctgactaaagtcttacagccactgttataagttgcagcatttgatattcataactaccaaggagatgagctcattttcccattttgcagatgagtaaactgaggctaagagaaggaaagcaacttgtccagagacacatagctgggggcagtatcagcgtgcacacccacctccagactcccagcccagagctcagtcacccccccacaacctctagggtcttccccagctccctcagaaggggtattactagttcagtccctatatctaaccctcctcctctttcttcacaccttccctgcagcttgaagaagaatacccacacctacttctacaccagctttgcagcctacatcttcggcctgggccttaccatcttcatcatgcacatcttcaagcatgctcaggtgggcaggacggtatcagagtgtcaggaatgcctcactgcaaatagagggacttacagagggatttatttgtaaatgcaagcagtccagagataggcactccccactggtgttggagcagtcatgtctgtgattctcttggccttccatttgtggttgcaagatggctgccactgctctaggcagcatgggcacgttagaggcaagaaggagggaaaagcgtaacagccatgcctgctgccttcatcaggaaggcaggaactttcccagaaccctttcagcatctcatgggccagactggggtcctaaagccaccctggctacaggagagtccaggaaagaggatttggcttctcagccttggtagtgggaagcaggcagagaagaacaggattggagtgggtgttgggtattggggcgtccctccccctactccctagtagaccaggctctgcctccttctcccaccaagatgaggatggagtactgagctgccacagaatgaagcaacatagcacaaagactgggagccctcagtgtggcctggagaggggaagattcaggggaaagtgagcagacaggattgccctactttctactggaaataataagagctcctgtttgttaagcacttccacatgtcaggctctgcactcatgaggatccttgtgaacaggtggggaaactggagttcaggtgacacactgcaagtatgtggtaaagccaggattcaaacctgggtcagcatggaaaccacacccaggctctcaagccctggccatgggaaacgcagcattgaacaggggctaagggagccctgttgtgaatcccagcaccacccagtaaccatggaactctgggcttgctgcttctgtcccctttccccttccccagggcccaaatacagacgagccatctttgaattaatcacaaaagctggggtttttttaatcactctgtgccaggcactgtgctaaactcttttgctaataactcatttagtcctagtacagtattactttatagaaggtcaaaaggcccctagcccataattagaaaaaccaagaacaaccattgtggaactgcctctcacttctgctcaagggcttcaatggcgtgtaaggtgagagtaacatgcgtatggcaagggtcacagagagtgactggacctggtttggaggactagttaagagaccttttggaggtctctgcagctcccggccccttattggagtccaagcccagagccaattcccccagtggccataaggtggcagcctcaccctctgcctggctggactgagaagaggctcccattcagagctctggcacacaggagtcctctcctttatcggaaaactgcagcgctgagagaacgcgaacactacatcaggctgggccctgggtggcgatctggactccagactaatgaactcctgaaccctgccccaaggcctgtgttactccccagcagcagcccagcccttctccccagtcatccaagtgggtacctctctgaaaatccttggaaaggggatccaggacatgaggggaccctgtcccatggggtcccctgctctccaacacacaggtagtcccagtgctagcattggtctaggtaagggtcacctctgcctttgtgcagtggtgtgatctcagctcattggagctccgcctcctgggctcaagcaattctcctgcctcagcctcccaagtagctgggattacaggcgtgcaccaccacacccagctgatttttatatttttagtagagacagggtatcaccatgttggccagtctggtttcaaactcctgacctcaactgacctgcccacctcagcctcccaaagtgctgggattacaagcgtgagccaccacacccatcctacttagggattgttagattcaataatttaatatacataaagcagtattgatcacagcccacctatgacagatggcaagaaataagtctgaatgttaggatcaagggcatgcgggaaagacttctttgttctctggccaagggctggctttacgttaagaatgaagtctccggccaggcgtggtggctcacacctgtaatcccagcactttgggaggccaaggtgggtggatcacctgaggtcgggagtttgagaccagcctgacctacatggagaaaccccatctctactaaaaacacaaaattagccgggcttggtggagaatgcctgtaatcccagctacttgggaggctgaggcaggagaatcgcttgaactgagaggcggaggttgcagtgagccgagatcgcaccactgcactccagcctgggcaacaagaaggaaactctgtctcagaaaaaaaaaaaaaaagaatgaagtttcctcaccctctccaggacaatctcttcacttcatgagcacccatgaagacgcaccatgaaggagccattcactgagtatttaccaggccctcttcagtatgcagggcacactacggtgagcaagacagctgtgggcccgccctcactgaactcaccacctatggggatgttccattacaaattgctggggaggccaggcacgatggctcacacccataatcccagcacgttgggaggcaaaagcaggtggatcacttgagctcaggagttcaagaccagcctggggaaaatggtgacaaccagtctctacaaaaaatacaaaaattagccaggcatggaggcgcacacctgtaggcccagcaacttgtaggactgaggcgagaggatcacttgagcccaggaggtcaaggctacagtgagccatgttcatatcactgcacttccgtctgggagacaaagtgagaccctgtctcaaaaaaaaaaaaattgctgaggaatgctgtgagggaaattagagggacttacagagcacgtagcaagggacctgactccatgtgaaagaactcaagtgcaccagcctggccaacatggtgaaaccgcatctctactgaaaaatacaaatattagccgggcatggtggcgcatgcctgtaatcccagttactcaggaggcggaggttgcaatgagccaagatcgcaccattgcactccagtctgggagacagagcaagactctatctcaaaatcacaaaaaaaaaaaaaaagaaaagaaaagaaactcggccaggcgcggtgtctcacgcttgtaatcccagcactttgggaggccaaggcaggcagatcacaaggtcaagagatcgagaccatcctggccaacacggtgaaaccctgtctctactaaaaatacaaaaaaattagccgggcatggtggcaggcacctgtagtcccagctactccggaggctaaggcagaagaatggtgtgaacctgggaggcagagcttgcagtgagccaagatcacaccactgcactccagcctgggtgacagagccagactccatctcaaaaaaaaaaaaaaaagaaagaaactctttgggctgggcgtggtgcctcaggcctataatcccagcaatttgggaggccgaggcaggtggatcacctgaggtcaggagttcgagaccaccatggcgaacgtggtgaaaccccatctctagtaaaaatacaaaaattagccaggcgtggtggcaggcacctgtagtcccagctactcaggaggctgaggcaggagaatcgcttgaaccctggaggcggaggttgcagtgagccaagattgcaccattgcactccagcctgggcaacaagagtcagagactctgtctcaaaaaaaaaaaaaaaaaaagatttgggtctctgagtcctgggctattttccctctccttgtgaagcattggtcttcctcctctgcaaaaggataaccatcatgggatgtggcagtgggctgacttcctgggaaggctaagctcagtgcctgcacagtagatgttcatgaacagggtcttagtataaccgtccttttctccaaacccagctttaccaggagtctcagcacagacatgccaaattgcttgggtgtgaatcctgggggagccagtgaccagctaggtcaccttaatacaggctgcaacaagtagttattacatagcagctgtggtgtcatcatcactataatagcatctcctggagcatttgctaaaatgcaggtgtgagccccagacctcaggaagcagagtctctgggagtaggaccaaaccaggaagttgctttttgaacctggtgacctaggtgattcagatgctgccagccaaacccctgggaacccttgaagccctgcctacttgagtttcttagttttcttgcattccctctcgggaggagcaacccttgtctgggagttaggagccctgggttcaggcccagccactgacttgctatggtcctggaccagtcactgtccttcagtccagcccagaaggggtttggggtgctgggcacggccctgaggcagtgccgtgcccagcatggcttcaccagcctgtgtcctctcatagcctgccctcctatacctggtccccgcctgcatcggttttcctgtcctggtggcgctggccaagggagaagtgacagagatgttcaggtaaggcagagtggggggcagatgtcctcatgggcaccagtgtgcctgctggcagtcagtggaacctgctgggggtatctttacacctctccaggggaacattgttcctgccaccagccccaccccttgcctttttcagcagtacatgggtacctggcctgtggacaccagtgggaaccttaccctgggccaggagccaggggagcgcaaggcatcagagccctctaggcatcccccatccaaatgttagctggatcttaagaatagctgttgtggatttttctctgcctactgtcagaagtcctaggtgactctgcccccaggtgacttcaggcatgtcttcccctcccatggcctcagttttcacatgtgagtaatagaacagggggcgtgtgggatgccctagtgtggtagaaagtgccccgagtagaaggcaggtgtcagtccctgttcattcacctctgtggctttaacccacagctcactgctttctctatatctgtatctcacacagataccccttccccagggccatatccacacctaccacaccctgcacacagccccacccataccgcaaggcctgcgtgactccaacaggtgtctgcccccagcactgccgaccctgcctgccagggacctagaaatagctgtcagttgcgattaaagctgcctactcgggtgccttccgcccagttccacctgcctggcctccaagctgtccctagagcgcttgccagggcctcctgtgcacctggctccccgcaggggagcctgtgactcacccctcccccggacctgcctctgccctccctgtcctgtctagaatccccagccccccgcctgcctgcccacattgcctcgcccagcaaagctctgtggtctgaggcaagtgggggctaggggtgaacttggggacaggtctcagggagctttgggagcaggcatggcacccgatccctgagcttagcacccatccttcaccctccctctgcttcccatccagcccaggtttccctgcccctccccttggggtaaccacccaatgctattgtgccctcatcaggcaaagctctgaatacacaaggcagagggtgcccctggcctttacctgcttggtgctaaatgctctgccatacaggtaccctgcccccactgtttgccctccactcccaccctggacattcttagattggggtaaaaagcaagtgatctctctctctctctctctccctcctttctccccatttctctcccaattctccacctttttacttttcccttctattctcctcctttttttattgatttacttatttttatattggtaccacattcacatagttaaaaattccaaagctgtaacagagagagcaccctcatgctccagctaccccacagaggccagcagtgttacacagacattcagacacctgtgcactgatgtgtgtatactttttcttgcacagacggtggcattcttggagcattctgcacattgggtttctacggtatttcttagaggtgtttccacagcagcacatacacttctagagcatgcttgttcttctgcacagtggcctgatgtgcctttgtctaggtgcatctttcttttttcattctccaaataatatcagcttctttccataaaatctggaagtgcaaaaataggtaaaaacaagacagttctgctctctgctccttggaaaggaagtctctgtcctcccttagtctttccctatccatctctttttttctgtctcttctctctctctcacacagctacgagtcctcggcggaaatcctgcctcataccccgaggctcacccacttccccacagtctcgggctccccagccagcctggccgactccatgcagcagaagctagctggccctcgccgccggcgcccgcagaatcccagcgccatgtaatgcccagcgggtgcccacctgcccgcttccccctactgccccggggcccaaggtagggcagacactgcagctccagtgcatagggcagggaccattgccaggagtaggccgcaagagcagctcctccacaaccaccaggcagtggttgcaccgagccatagggctgggaagcaggacaaccccgaagcttcctgccctcaccagtaatgcggggcccacatcatagtggatggaaatggcccttgtcatgcagtagtagatactgttaccattcaaggtatatgtataaccttaggcaagttactttcttcatctgtaagtgggcacattcctgcctcacggggtttatctggtgaggaaagatttgtattatctttggcatgaactcagttgcttgaaaaatgaagcccatagaagaagctaagccagggtgtctgtcttcagagcagcaccttgccgcttgccagtacagcagtgccctcacctctggggctgagctgtttgattcatgctgtgtgccctgggaggcagcctatctccatctcttgtagccttgtcatggccacccctttttccacgctacagcagaaggttcaggaagcttgaaatcagcccacacaagcccaggcccaacctctcttccattggctgctgcccttgctgcctcctggtacccccaggctcagagaaagcagagcagcctgcctgaggagggcatgtggtagggctggggccaggcgctgttaggtgctgggcagtggacacagggctgacgctctgcatgtgaccaggcgctttcctaggatgggggtgggggaaggggacaaccaaggttctgctcaccctctcctctaaatgaatttttattgttgtttttttttttttggtcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgtgctcctggaa

SEQ ID NO: 399 - DNA, 55130 bp, Homo sapiens; identical to SEQ ID NO: 398

SEQ ID NO: 400 - DNA, 55130 bp, Homo sapiens; identical to SEQ ID NO: 398

SEQ ID NO: 401 - DNA, 5557 bp, Homo sapiens
tgttacacagacattcagacacctgtgcactgatgtgtgtatactttttcttgcacagacggtggcattcttggagcattctgcacattgggtttctacggtatttcttagaggtgtttccacagcagcacatacacttctagagcatgcttgttcttctgcacagtggcctgatgtgcctttgtctaggtgcatctttcttttttcattctccaaataatatcagcttctttccataaaatctggaagtgcaaaaataggtaaaaacaagacagttctgctctctgctccttggaaaggaagtctctgtcctcccttagtctttccctatccatctctttttttctgtctcttctctctctctcacacagctacgagtcctcggcggaaatcctgcctcataccccgaggctcacccacttccccacagtctcgggctccccagccagcctggccgactccatgcagcagaagctagctggccctcgccgccggcgcccgcagaatcccagcgccatgtaatgcccagcgggtgcccacctgcccgcttccccctactgccccggggcccaaggtagggcagacactgcagctccagtgcatagggcagggaccattgccaggagtaggccgcaagagcagctcctccacaaccaccaggcagtggttgcaccgagccatagggctgggaagcaggacaaccccgaagcttcctgccctcaccagtaatgcggggcccacatcatagtggatggaaatggcccttgtcatgcagtagtagatactgttaccattcaaggtatatgtataaccttaggcaagttactttcttcatctgtaagtgggcacattcctgcctcacggggtttatctggtgaggaaagatttgtattatctttggcatgaactcagttgcttgaaaaatgaagcccatagaagaagctaagccagggtgtctgtcttcagagcagcaccttgccgcttgccagtacagcagtgccctcacctctggggctgagctgtttgattcatgctgtgtgccctgggaggcagcctatctccatctcttgtagccttgtcatggccacccctttttccacgctacagcagaaggttcaggaagcttgaaatcagcccacacaagcccaggcccaacctctcttccattggctgctgcccttgctgcctcctggtacccccaggctcagagaaagcagagcagcctgcctgaggagggcatgtggtagggctggggccaggcgctgttaggtgctgggcagtggacacagggctgacgctctgcatgtgaccaggcgctttcctaggatgggggtgggggaaggggacaaccaaggttctgctcaccctctcctctaaatgaatttttattgttgtttttttttttttggtcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgtgctcctggaagattctctgtttaagcacccagtgtcttgccctgggttttctaggtctcacctgcccacccaaaatcttttctgcaagccccttaagggtgcccaccccagtgcctggccagccctgcacccgtaaaacaccttttagccagtagagggggcccacgagccctctctcaccagctagcacttttctcaccaccttcctcgaaatacttgggggcagcaagggtgttggcagatgagagtctcccactcaccatggtgagagtggtggggagtacccagggctgacctgactcacaagggaagcagtaactgtagaacctgccagcctccctggtccctgtgcccatatggcttcggctgatgagggctcagactctaggttgccctgaagatcaaggctttgtctcccattctgcccattcctgggtttcttcccaaaatgactactgtggggccagtcatggcacaagggccaggacctctagaggctggggtggggaaggactgagctagtgattcttagaggccttctggggcctaagagctgaaatctcagcgcccgggtttccctaaagtttgctgaagacagcagccccggccagcaggagaccgaccgggcaccaccccaaaccaggcaaacggtggccacaaccctcatccacccacctggtatgaggtcactgagtggggaaacagacaggagcgggtggccaccatactgacagacccggggctctcccttgcccaagcttcaggttcaaaggctgaaaataacagtggcttccagtttggaagtggccaaaggacaatcatgaccagagactcaggagtatgactgtaataccctcactaggtattgacatgcactaagcaccttgatataggatttcacttccttctgagtcttgggctgtatgtgctattattcgctccgctgtgcagatgagggaattgaggcagcttgcccatggacatcgatttgaccttagccaagccaaacaattccaggttcctaaggaccgcagctcctccccagacccctgggaccaagtcactggctggtgtgctgggcatccctgagccccagccacccaattttactggctccagggttctataggaaggaaaaggggtagaaaatttcaaaaggcttcttcctttcagggaggggggttccctttcaggggcttctggaatctctacccactccagccaactctgaggccatgtggtcctggaacaaggcccctctgaggcagatggggcaggcggcccaggcacatagcatggttggctctgcggcccagggcgcacaaaggccttattgagtcaccaccagcccccggcagaggctgaggtggcagtggcgccgagcgcctgccacctaatgactgtcctggtccagccagatgttccacagacctccggagcagcggactagggcccgcccggccagccggcaccgcagaggccactgtaattccaattaaccagcttcagctgagcaaacagcgggcagtggtggcccagcccaggcggtaggcctggcccgcagagcctgcgagtctagactccagatgtgaaccgccaccatcagagtcccatggaaaaatggcaccaggccgggcaaggattgggcctgcatgctggggagggggtgtgggtggttgggcagggccccgagtgggctagatgccagcctcacctggtttggggtggattattaggaaactgctctagaacccaagttctaccctgctttattagattctgtttctgtgcctcagtctcccatgactgcgacaagagagagggttccaaggggaaaaccagccctgctgagaccccagtgtgcactgactgtatttcacgtgactagcattatgctagtgcaactgacccttgaacaacacagggattaggggcaccaacccatcatggtcgaaaatctgtataacttttcagtcccgcaaaacaactaatagtctgctgttgaccagaagccttacctgataacataaacagtcaaaacatcttgtatgttatacgtactacactgtctaccatagagtaagctagagaaaatgtaattaagaaaatcctaagagccaggcatggtggctcatgcctgtaatcccagcattttgggaggccaagatgggcagatcaggaggtcaggagatcgagaccatcctggctaacatggtgaaacccccgtttctactaaaaatacaaaaaattagccgggcatgatggcaggcgcctgtagtctcagctactcgggaggctgaggcaggagaatggcctgaacccgggaggcagagcttgcagtaagccgagagaggcaggcggatcacaaagtcaggagttcgagaccagcctggccaatatggtgaaaccccgactctactaaaaatacaaaaattagcctggcatggtggcaggcgactgtagtcccagctactcaggaggctgaggtgggagaatcacttgaacccaagaggcggaggttgcagtgagccaagattgcaccaccgcactccagcctgggggacagagtgagactccgtctcaaaaaaaaaaaaattattcagtgaaagtggatcatcataaataaagatcttcatcctggtctctgtgttgaggaagaggagggggttggtcttggtgtctcaggggtggcagaggtagaaaaaaagtccacgtttaagtgcacctgcacaattgaaacccgtgttcaagtttcaaatgtatcttaagatttacttaatcgttgtaacaacactttgaggtacctacatcattcttacgatggggaaactgaggcagagaccgtaagggcgggcccagggggcatgtgaacccagagtgtctggcttccaagactcgtattcaccgtggtgccgtttgacatgatcaggataatggatccctggttccttttgggggcagcattggagaagggggtttggcaccgtcagtctgacagcagggctggctcctgcagtgtgaatgaagcggtcttgtgctcgactgtgaaggggggttaggacctgcttcccagggcgggtccagctttctgagggaaagccttcagagcctccatcaggccggcaccaggtaccagttaagcactgggcagggaacagaagtggtcaaacgccgcttgccgcgacttgaaactgctgaataaatggataatgtcaagcgctatggcttagggcagtagtacctccggttcctacgatcgtgtctggggtccctgaggagcaaggcaagagtcggccattcaggaggtcagagttcagctgttcttgcacaagcagggaagctgagtcaccccaaacacgggcaagactagcggtggtatcaaatggctatcaggggcggggcctcaggggcctgcccctgcctccccgccctgcgtttggattccctccagcattccgggccagggcgcgggaggcggaggccgaggagaggacgggaggaggctgcatcctgccctggtgcgtcaggaagggccgagcgagcgggaaggaaagcaccaccccccacccccgccgcggccacacctgggttctccaggcgggcaggggggcccccgggccggcgcctggctccagcaagtctgggccgcctccccgcgccgccccgcgggggccgccagatgggctgcccgcccgccagctcagcg

SEQ ID NO: 402 - DNA, 1232 bp, Homo sapiens
actctcattccacgttcttaactgttccattttccgtatctgcttcgggcttccacctcatttttttcgctttgcccattctgtttcagccagtcgccaagaatcatgaaagtcgccagtggcagcaccgccaccgccgccgcgggccccagctgcgcgctgaaggccggcaagacagcgagcggtgcgggcgaggtggtgcgctgtctgtctgagcagagcgtggccatctcgcgctgcgccgggggcgccggggcgcgcctgcctgccctgctggacgagcagcaggtaaacgtgctgctctacgacatgaacggctgttactcacgcctcaaggagctggtgcccaccctgccccagaaccgcaaggtgagcaaggtggagattctccagcacgtcatcgactacatcagggaccttcagttggagctgaactcggaatccgaagttggaacccccgggggccgagggctgccggtccgggctccgctcagcaccctcaacggcgagatcagcgccctgacggccgaggtgagatccagatccgaccactagatcatccttataccgacggggaaacggaggccagagagggcgtgggcgcttgcaccacttccgtcccatccttgcgggtacctggctatgcgggggtgcctaaggagcctggaaaaagcgctcccccgtcgtgcttcctggggaagggggcgttcgctgcgctcggagcggcgtcccttccaacccgccggtctcatttcttctcgttttcacaggcggcatgcgttcctgcggacgatcgcatcttgtgtcgctgaagcgcctcccccagggaccggcggaccccagccatccagggggcaagaggaattacgtgctctgtgggtctcccccaacgcgcctcgccggatctgagggagaacaagaccgatcggcggccactgcgcccttaactgcatccagcctggggctgaggctgaggcactggcgaggagagggcgctcctctctgcacacctactagtcaccagagactttagggggtgggattccactcgtgtgtttctattttttgaaaagcagacattttaaaaaatggtcacgtttggtgcttctcagatttctgaggaaattgctttgtattgtatattacaatgatcaccgactgaaaatattgttttacaatagttctgtggggctgtttttttgttattaaacaaataatttagatggtggtaa

SEQ ID NO: 403 - DNA, 1232 bp, Homo sapiens; identical to SEQ ID NO: 402

SEQ ID NO: 404 - DNA, 55 bp, Homo sapiens
tcctgcgtaggatctgaggagtggacgagtctcattacccagctcctgagcagga

SEQ ID NO: 405 - DNA, 7110 bp, Homo sapiens
caggtccctccgcagcgggttctcagttgctcgctgggcagacccaggtcgcgctcccactgccgagcccgcgaggtgagtgagttgggggaggaccccgccacccaagcccgcgcgggtcaggggcgcggctcggtctcctgccttcgccgctgggtcacgccccagtggtccctgtcttagagggttggggggcttcttgtaggttagagttgaagactcctggggagtctgcatatgtgtgccatctctttccccaaatatagattacatcctccctctcttgatatgtggagctctcccacccactaatcataatcactggccggagcccctcttttccagaagtgtgggccgccccctcccacttatcacctgtagtgtgccccctccctcactctatttgttgggtgcccctctctctccctagatgtgggactccccttcttttccccagatgtgtgtctccctccctctgacccagttaagtccccatcctctaaagcccctccccaccaccatggatgccaaaccctgagtcttccctgggggtgggagactgggctcagccagactggctaagcccagtccccaccccaaccagatccagcagagcaggcctgtgtgcacgtaggcagccaattaggggggaaggggtgggggccagaccgtctgtctgttctgccggtgcaggggcctctggcccctgcagggaagagagactcaagaactgctccctctccacctggaccccacccagcttcctctggggagcaaacaagtgagcggggttctccaatctggccagactgagctggggctggcaccagaacccaagccctcagcctcaaactcttcagaccctggcccaagacttaggcctcctcccacttctcagatggtgaattgaggtcccaaaaaggggcttcaaaggtctaggacccccattggccccccgctggggatatcagacaaaattagaagggtcaagggcatgagggtgaccttgaaacactgggacacccctaccactaccataccagtggaaaaggatttttccatctggccctgcggtttgggggcagagggtgatgtgggggcagaactcatctataccttcacgcccccagatgctccccagagctgcctggagcttggtgctgaggaaaggtggaggtggaagacgagggatgcacagctcagaaggcaccagtgagacctggactccttcctccctgcctaactccagagataggggcaggggtcccctctgcaggctgccccctttgcccttccatgccaccctgggcctgttcctaccacacttcccatgttcccatgatcccactccttggtccaaggtcaagtttctccaggaaatggagtgcgcggggtgagcagacagtggtcatctccattccaagcttccttaggagccagcccccaagcctcaggcccctagaccttttgttctgaggtggaggatgctgacagaaccttggaccctgattcctcctttccagaccctagtttcaatgctagtaagaagaaagagacctaaagtaggagagacttcagccagatagcagaagggccttgctgacccatggagaataacaaagataacatttattgagcccttactagtaccccaagctattataaacctcctttttttttttttttgagatagagtcttgctctgtcgctcaggctagagtgttcagtggcgcaatgtcggctcactgcaacctccgcctcctgggttcaaacaattctcctgactcagcctcccgagtagctgggattataggtgcccaccactgcgcccggctaatttttgtatttttagtagaggagaggttttactgtcttggccaggctggtctcgaactcctgacctcgtgatccacccgcctcagcctcccaaaatgctaggattacaggcatgagccaccaagcccggccaccttctttattaatatagttagagatagggtgtcccaagggcagcctggactcagctccctccattgtgtctgcagcccgtggtggggggaagatgtccccctacaccaactgctatgcccagcgctactaccccatgccagaagagcccttctgcacagaactcaacgctgaggagcaggccctgaaggagaaggagaagggaagctggacccagctgacccacgccgaaaaggtggcctgtaagtgtcagggtggggctggctggagagagtgggttgggggctgactttggaaagaatggcctgtcagggatcagagggcagagagaggcccccaagacagccagaaacctccaaacacctgaggggtgaagttcatgcctttgttcgtttctttattcactcacctgtttgtgcatagcctgatgctaggcaatgctggggacatgaggtgaatcacctggatagttcctgcccccatggtgcccccggtcccgtggggaaaaccaatacagactccaataattgtaatacagaacatgtggctagggtgaggtgtgttcaaggactgtgagatgaaatcttggtggacctcccagaggagggcacattccagctggcctttaagggtgaagaggagggcactgccagggagtgggaactgcatggggaagggtgtcagagcaggagactgtggagggccctggaattgagtgatgtgggggagatgggacagagagaggcaggtgaggcggttggggaggagccctctgaccctgggaggctggagggatgtgtggtcccttgtcatgtccaccagagcatccctgagctgaccctttgaaatttggagcaccttattttcattccatgaatgggaacactcagcctgacctccaagatttcaagggattcctagtggggaaaggttcatgcttctcacattcattcattcagtcaacatcttatttggcacctactacaataccatgcactgggaatgcagctgtgagccagccaggctccgttcctgcctgtgagcttgcatttccagccctctctcagcacctttaccccttctctctctctctctttctacacacacacacacacacacacacacacacacacacacacatcttggttttttcttcatccatttcagaaattgacactcttggggggagaggggaggaatagcattaggagatatacctaattctaaatgatgagttaatgggtgtagcacaccaacatggcacatgtatacatatgtaacaaaccacatgtaccctaaaacttaaagtataataataataaaatttaaaaaaaaaagagaaattgacactctttatctgagcatggtggcacatgcctgtcgtcccagctatttgggaggctgaggcaggaggatcacttgagcccaggggagctgaggctagagtgagctgtgattgtgctacggcattgcactccagcctgggtaacaaagtgagaccctgtctgaaaaaaaaaaaaaaaaagagagagagagaaagaaatgatggacattccccaagcaagatgataatgagcaccatccctaatatgtcctgcacgcttacatgtagcaggcaccgctgtggcgttaggttgctctcgttagctcacatttgagagactgaggctcagtggcgtgcagtcacttacagtggttgcacagctagagagtggtggaggcaagatttgaaaccacatagacaggcaccaggggtttcacccttagctgctacaccacattagctacaatgaaggtttggtgggatgcttggggagtttcagtgtaacctcacagctcaaacaactttttttttttccttttctttgagacagggtctctgtcacccaggctggagtgcagtggccccatctcggctcactgaaatctctgcctcctgggctcaagcgatcctcccactttggcctcctgagtagctgggactacaggcgggcgccaccacacctggctatttttttttttgtattttttttgtagagacagggtttcaccatgttggccagactggtctcgaactcctgatctcatgatccacccacctcagcctcccaaagtgctgggattacaggggtgagctaccatgcccggctatttatttatttatttatatttctgtagagacagagcagtctcactatggttgctcaggctggtcttgaactcctgggctcaagcaattctcctgcctcggcctcccaaagcactgggattacaggcatgagccatcatgccaggccaaatgccttgagtcttgtcagacctcttccagggcaggcaggcgtggcagcactggagtgcatggcctgtgtctatgcatggctctaccacagccacactgagtggcctccactggttgatttcattgtctcagcctgaaccgcccacccaagtatcttcccaaaacctaagacagttcccttttcccaaggaattctgctgccagctttgattttcctttagatatttattttcatatttatttaatgtactgagaaaggattacacacgtagggtaattttttttttttttttttttttttttgagacagagtctcgctctgtcgcctaggctggagtgcagtggcatgatctcggctcactgcaacctccgcctcccgggttcacgccattctcctgcctcagcctctcgagtagctgggactacaggtgcccgccaccactcctggctaatttttgtatttttagtagagacggggtttcactgtgttagccaggatggtctcgatctcctgacctcgtgatccaccacctcggcctcccaaagtgctgggattacaggcgtgagccactgcgcccggacttacctggctaatttttaaattttttctagagacagggtctcgctttattgcctaggatggtcttgaactcttggactgaagcaatccacccgtcttggtctcccaaaattctaggattacaggcatgagccaccaagcctggccccctccctaattctgttagaatgaaatccaaactcttctccatggattctaacaaggtcctgtgtgaaccggctctgcctctcatttgagagagccagcctctcatttgctaaattctctctcttttgctcatttcactccagctacagtggtcctcacttcacactttccctacccacttcctgcttcagggtttttgcacttccttccagttttcaccaactttctcccattgatttttcaaacctcagctccaatgtcacctcctctgagacaccttccctggccagccaactgtttgcctgaagcatttgccattgtctccccctctaaactccacaagggcagggattttcatctggctcattcactgctgtcacctgttcctggtcatgctgtgcatatagtacgtgctcagtaagaatttgctgaatgaacagcatctgctgcagggagggggaagccgggatcacttagagtggacgcacctgaggccccttccccacacccaactgcctccagtgtaccggctccagttcaatgagacctttgcggagatgaaccgtcgctccaatgagtggaagacagtgatgggttgtgtcttcttcttcattggattcgcagctctggtgatttggtggcagcgggtctacggtgagtggcaacacctcatctggctgcagtcctgggccatgcccttgtggtcacggccaccagacagtttcttaaaggaaccatgctggcactcatctgaagagctgaaaatttctgaagaggtgtagggtgaaggacagagcatggctgtctaggtttgaatgcaggaactttacctctctgggcctcagtttcgtcatctctaaaatgggaatagtaatgttccatctcagggtacttaagaggattttaatgagagagggctgtaggccagtgtttggctcatagtcatgaatggtgttgtaactgattgttgtgtatgaactgtgtgtttttcagtgtatatatatactgaacttctgcctccccagttcaaatgattcccctgcctcagcctcccgagtagctgggactacaagagtgtgccaccacgcccggctaatttttgtatttttagtagagacagggtttcgccatgttggccaggctggtctcaaactcctgacctcaagtgatccgcctgcctcgtcctcccaaagtgctgggattacaggcatgagccactgtgcccggtggcctgtccccatatttttaaagtgaacactcttacctacttcctactttcaaccctcttagaaagtaaaaggaattatttcatcctggaccctgcccagcaagtgggaacaaactcagtaattatataattatagtaggtaacatgtatcaggtgcttaatatttgtctaacattgtgccaacagctttggaaatactcagtccccacaatcctagtggataggacctcttttgacaggtaaggaaactgaggctcagagagatgaagtgacttgttgaaggtcgcagggcaagggagtggtagagccaggatttggattcaggcagtcttcaaatcagtgatcttattaccacagaccacagaggtaggtgaggtgactgagttgtgaaggaccttggcccagctcccacagtccttggggtctaaggcaaagctggggtcagaacccagaggtgcctgggacgatgctctaggagaaagtctggggtgcggggctagacagggtggagtgagctcctcagtgcaagatacttcaaccctggagtatcttgtaccgtcagccttgcgagtggctgggaggctacagggtggctggagaccctggctggtgtaggaagactggcaggatcctgatccaccccatgtactccctgcagtatttcctccaaagccgatcaccttgacggacgagcggaaagcccagcagctgcagcgcatgctggacatgaaggtgaatcctgtgcagggcctggcctcccgctgggactatgagaagaagcagtggaagaagtgacttgcatccccagctgtctccctgaggctccgccctggctgggagcctctggcggcccctcccctcccctgcccttaaccccagtaaagctcc

SEQ ID NO: 406 - DNA, 58396 bp, Homo sapiens
ttcactgagtaaacacagtttattactgaactgcactttcaccttcacacagactatttcaaagagctggaacaagtgtggggtgggggttgggggaggggcagatgcccctcaggagccaggaccctcggccagcttccctggaccagggcaggggagggagcatcaggccgtccaatctccgggcaccagctctccacgtgcacgcgcactgcaagccagcagctcctcacacataaatacagacacgcttaacaaaaatagtatatcatcttcacaaggaataaaaactagtctcaaatatgtacagcagagagcccggggtggctgggacccctggggatgagacaggccaagggtggagcagaagagagagggaggcctgaagagctcctggccaggccactctggccttggcagcctggctgcccaggctggacaggcatggggcacagatctgcctggccaggcaggactggcccttctagtcagccctaccccaccccatgcagcaggctctccttcctgcccttcctgcctgaggtagggaagaccctggggctcccatagctgttcctgatagctccctttcacctcagggctgagtcccctgaacccaccatgaggagcagcccaaggcaaagatgccacaggctgctcttgtaggaagtgaggcagctgaggccataaacagctctggggcatctgtcttgggcccagttggtccctcagtatggtcatgggagccagggaggggaagggactagggtggtgctgaactgcaagggccaccctagctttggcatggggtgcttcctgtagctatagccccctccctcctgggtggggctggcctctagccagaggcttctggaggacatttggactgggagtgaggactctagccagtccagaggtgaggagggagtcctggtccttgcatctttatcccaagcagcctgaatccctagtcaaaagtggcccctaaatggctcttagggggtagggatggaaggaaagggaacccaggttagtgtggggagagtggggggaaaatgatcaattctgaggccacaaacatcaaaacaaaggcaatctagtctcctttctggggaagaggttctgaaaactttcaagctccctggcagaaaaacattttcagggaggctaaggggtaagggttgcaccaatcaggtagggccctcctgcccccagccacaaacccttccatacctgccagcctcctttggacagattttgtggaaattttgtgaattctgaggccaagggaactgaggtgtgggggtctcacagaagtgtgataaattctagaaaactagctgcaagggaccagatctgggcccaaccctgtgatgggcaggtgggcatgggctgcatgtagtggttctcctggtggcaatggcggctggacggaggatgtggtggagcagagaagggggtgggagggtagagtggatggtcagtgtctggtcatttccgactgaagagtgagcccagcagaaccacgccggccacagtcatgcccgtcaggaaccagcggttgaagcgttcctggccctttcggctctcggctgctgcattgttcccatagagttccacaaaagtatcctgcagggagagagaaggaaggtgcagttttagtcctcagagagtgatgtaggtgggtggggaaaggggccatctgcatgctatggccttggtgatgtgaaaaactgtagccatctgtgcccactctgggccaggtaaagggctaagggtggtcctctttcttgaccctccattggtgataatcaaaccatgttactgctgagaaacaggtagagaggaggaaagtgccctgtctgaggtaagtcaagaagtagcacttactccagaatccaaggtgggaacgagatgggcagggtcagggaactgatggaagccaggtggctggagcagagtgcaggagaggagggcatgggggagatgatggtgcaggggtgagcaagagccagaccatacgtggcctggaagccgcaaggagcctagagttgagtctgagggtagtgtggagtgtggagccactaggcctcagattttctactgctgcaccagagggagggataaggaagcccagggctaaatccccagggtcatttgaggccaattcaggggtagaatgggtcctgggacttcagccagaggctcctccctctggagggagcctctggtgggcaggttggtgacaagaagagcagggcagaggagagagggtaacaatgatgcaggactgacaggcctccatcacggggtctgtgaggccttgtcccggacatcctccactgcagggggtgtgactctgggcccaggaggttgtgatcaacagccctctgccctgaatctaagtcagaagggaagcacatgacagggggaaggaggagctgtgggctaaattacccagcccagggtgcagcagcctgtggggcagggagaaggacgcttagaacataacttttatgagtaagcgtagtacccaatttgtcctttaatcctcccaacaattctgcaatgcaggctgtctctccccatttacaggccaagaagctgtgcctctgagggtccagggactggatcaaggtcacccagctgtgtcagtggtggagccagaatctaaaactggcatctggcacctagaaatatgtaagaaagaagtaagttccaggctgggtgcggtggctcatgcctataatcccagcactttgggaggctgaggtgggtggattgcctgaggtcaggagttcgagaccagcctggccaacatggtgaaaccctgtctctactaaaaatacaaaaattagccgggtgtggtggcacgcacctgtaatcccagttactcaggaggctgaggcacgagaattgtttgaacccgggagacggaggttgcagtgagcagaaatcgcaccacagcactccagtctgggtgacagagactccgttcaaaaaaaaaaaaggaagtaccatagtaccgtgtgtgtgtgtgtgtgtgtgtgtgtgtgtaaaatgaatgagttactggctggttcttgcctctctaccaagacctctgccacactgggcctacatttccaaccagtcccaaatggccgagtggctgctccctcaagacaggcatgccatctccagttggcctcaggtctcacctatcaatttgctcacttgtgacccctgccgtggcccacttccagtcttgacaaccccctcagtccatgctccacacagagctttctaagaacactggaagccctccagcagcattctcctgcacttagaagggcagcatcatttatttttgtatccctggtacctagcaaaatgccatgtgcactgagctgctaatttgactgaaggaatcctcaacattaaggcagtagagagcagtgacccatgaatctcagcccttgcagaagcacactccattcagtcactccaagttctcaaccttcccagggcttccatcacacctgaaataaagtccccactccttactctggccagcaaggtctagtgggatctggctccaacactttctggcctcctccccacccctgtcccctgaacttcactccagtcccactggcctccttgctgttcctccaacgtctcctgccgcaggagtctgctgttcctgcttgcctggagcacctgaccccaggtcgtcgcctgcctcactccctcatttcacaaccatgactcccctcaaatgtcacctcctaggggaggccttccctgactgccttgtctaaaacagtacaccacccccgtctctctctgcctgtccccttaccttccttgatttttcttctcagttttttttttttttgagacacagttttattctgtcccccaggctggagtgcagtggcacaaactgggctcacagcaacctttgcttcctgggtacaagcgattctcctgagtagctgggattacagacatgtgccaccatgcccagctaatttttatatttttagtagagataaggttttgccatattggccaggctggtctcaaactcctgacctcaagtgatccgcccacggcctcccaaagtgctgggattacaggcacgagccaccatatctggcctttttttttttttttttggagacagagttttacccttgttgcccaggctggagtacaatggcgcgatctcagctcactgcaacctccgcctcccaggttcaagcgattctcctgcctcagcctcccaagtagctgggattacaggcgcgtgccaccacacctggctaattttgtatttttagtagagacggggtttctccacgttgggtcaggctggtttcaaactcctgacctcaggtgatctgctcacctcggcctcccaaagtgctgggattacaggcatgagccaccatgcccagccaccattttttttttcttgtttttaaaagatgtgcccagactgactttgaactcctggactcaagcaatcttcctgcctcagcctcctgattacaggaactacactacacagaatgaccaccatgccagcttttcttctcagtgctttattttttaatttttaaatttttgtgacagtgtctcactctgttactcaggttagactgtagtggcgcaatcatggctcactgcagccttgacctcctgggctcagatgatcctcctgccccagcctcctgagtagctgccacactacaggcacacaccaccatgcctggctaatatttctaaattttttgtagagacagggtctcactttgttgcctaggctggtctcaaactcctgggctcaagggatccttctgcctcagcctcccaagtgctgagattacaggcgtgagccaccatgcccggcctcaccacctcaccacatttttcccccattaagctgtacttctcataactagattctgtactttgtttttgttgtgatgtgtcttccatactagatgtgtctttttttttttttagacgaagacttgctctgtcacctaggctggagtgcagtggtgcaatcttggctcactgcaacctccgcctcccgggttcaagccattctcctgcctcagccccccgagtagcgcctgccaccacgcctagctaatttttgtatttttagtagagatggggtttcaccatgttaaccaggctggtctcaaactcctgacctcaagtgatctgccctcttcagccccaaagtgctgggattataggcgtgagccactgccctcggcctatactagatgtgtcttgatgagggcagaggtcctgtctcgttcctatacacccagtgctcagaacagtgtcttgctctgtaaatacatgagaatacatgagttaacaaatgtattgcatgtctactacatgtcaggcattggtatcccatttcatcttcatcagaatcctgagatgtagatttgagccacatttcacaaataagatgcctgatatttaaagcagggaacactcagcaaacagatagcagagtcgggatcaaactgcaagactgcctagcttcaaagggagggctgctatgtcaggacacttccctgaagttggaggctggagggacctgtcctgtcagtagtgctgaaaggatggatttccaggagaaggaatgtgggagcagggttgaggtggaggatctggggaaaggagggcactagggccgtggctatgcttccctgtctccctctccatcctagctagcctctgcgggtcttggcagacaaaaatattcttacaggaggtttgattttgttgctcccaagtacacccaggtggagtcacaaaataggcttatctgtgatgggggagagttccacactatgaagagcataggagaaggccctggttatcccaagaggccaaatgtctctcaagaaaccagggacactggggttgcagccaaaatgggagaggcctggctcccttgatgggaactttcctgaagtagacggctggcagccacaggaaattttcagctctggggctgggttggagtaaacaggcgctgtccccacaagggcacaaagcattcactgtccagaaacagtcattcctgggtggagggaacattctcatttcagtgccatagaaacattctcatttcacctgccccagcttccactcatgtgttcctggtcatgacaaccttcatttccatttcagcttcttttcctggggaaggggagtagtatttccaaggggtgtggattctaaggattgcttttgcggagacagcatgagcaaaatggggcgtgctgttccagggcgggtgctggagaggcggtggcgtgggtatatttagcccatggttcacacgacacacttggaaataaacagagccattttctcagcaggcggctgctctggataaataaacaggattgcagagcagccctggtctggaaaagcagagataagcccctactgcaccttgggtggctcccactggttttaaccaggctggcatggtaggcaggggatgaggtttaagagtgggttgtagggaggtctctgatgtcacaaaggtttctaggagacccaggcccaagggcctgtctgcatcctctgcttgagttaagaggaaagtggggtagctgacttccatgtgggggtttgtagggccactggcgacaggcaatggctaatgacctccacaggagagtcatggattcctagccaggtaggcccatgaagtcagcaaggccaacccacctgcccattctacgtttccactgctggtttgtagtagagcctacactagaaaactgggtctcctgacttggcccctaggagatgcccaggctagtatcactttcaaggtccttcttccaatacttcaagaggcttcaacagtcctggccacccacttggaatggccccacactacatactcctgagtgcttcaggccctggtgcctttgccaacactgtcctttaactggtcactccatatcttcctcagttaaccaacccctactaagcctataggactccattttggagtcccctcttccctgctcatccctccccaacctctgggatgaatgtctcctttctgttcccagactccttggacttctgtttataccaggggtatgcactgaggctggcattggagactcagccgtgagcaaggcttccatggagcttatgttctagtccattctcaatggtggtaagatcacctccaatggcgtgaagtgaagcattcttagacattacagtgatttgtggctctccacagggccacagcacataaggagatatagagtatatagtatatatagtatataggtattgccctcccatgaaatttgaatacctcagctatactatactatatataccatatatatacacacaatatgtagtatatatagtactgtatatactatatatatactttacatatactatatattatatattatacatatctatatctatatatactatatatagtatagtatagctgaggtattcaaatttcatgggagggcaattaggacaaaaaaatctgaaaaagactccttgcaggggtggatgataaaaaaaaaaggttgagaaaccctgtcttactgggaagcagagaggataacaagaaaaaaaaaagataattttagagatgatagggttttaagtcctggggaggtgacagagaatatctgggggagccgggcacaatgactcatacctgtaatcccagcactttgggaggccgaggcaggcagatcacctgaggtcaggagttcaagaccagcctgaccaacatggtgaaaccctgtctctaccaaaaatacaaaattagctgggtgtggtggcaggcatctgtaatcccagctacctgggaggctgaggcaggaggactgcttgaacccaggagatggaggttgcagtgagccaagatcacattattgtactccagtctgggcaacaagagcaaaaccctgtctcaaaaaaaaaaaaaagcctgttttagcagaggtaataagtgcaaaggccctgaggtgggagggagaggaggggtgttcctgggttgatggcctctgtgtgcctggtttcccccaacagtctgggggctcagtgcaggcagggaccaagtctggcccaggacctactcagacaggcacagactgacttcagctagatctctgcccagaggcagccaactgaacgatgcaggtcaccttgtaggtgcctgtgaccctgtagaagtcaggtgaaaaggttggcatgatgccctgaggaaaggggcccaagtgccagaggaccagccagaggctgaagtatagtccctacttgaatctgatcttttagttcccatcctggcttcactgcccacatttccttctttttttttttcttgtaaatttttggagagatggagtctcactacattgcccagggtggtttcaaactcctggcctcatcctcctaccttggtcttccaaagtactgggattataggcatgagcaactgtgcccacccttcccacttcttccaagtagtgtgactttgagcaggttacttcacctctctggtccatggtgtccttgctttttttttttttttttttttgagatagcctctcactctgttgcccaggctggagtgcagtggcatgatcttggctcactgcaacctcagcctcccaggttcaagcaattcttctgccttagtctcccaagttgcctgggattacaggcacccgccaccacacctggctaattttttgtaattttagtagaggtggggttccactatgttggccaggctggtctggaactcctgacctcaggtgatccaccttccttggcctcccaaagtgctaggattaaagacatgagccaccgcacccagcccttacttgttaacagtaataaaatactttaggagctgaggcaggaggattgcttgagcccaggagtctgagaccagcctgggcaacacaggaggaccctgtctctacaaaaaaattaaaaaaaaaaaaaaaattagctgggtgtggtggtatgcatctatggtctcagcaactcaggatgctgaggaggatctttgagcctgggaggtcagggctgcattgaatcatgtttggggccactgtactccagcctgggcaacagagtgagaccctgtctcaaaaaaacaaaagataaaagcaaagaaacaaaaaactattattatgacagctgaccattaccaaacatttcagtgtttcacctgtgctgggcactgagctataaagcagtctatgcacactaggccatatttcccaattacatgtacaatcatcatattcacttgagagattattttttgtcctgtctcccccacttgactgtgtgtggctctgtcacctgtatctctagaacctggtgtgctatacttggaacacagcagatgccattctaaataaatctattttagaagaacaaatgaatgctttcatttgatcctcataacatttatcaatagccccattttacatatgtgaaaatggaggctccagaatttacccaagatccctatctaggaagtggcaagagtaggatctgtctgagttctggcctcacaccattctttttcttttaatctatccaagatagtacttcattcacactcattctgatgtccaatcttgccatcttagaccctgctatctctacccacagaaaacctgacttccttagtgacttcagcagcagcgcacacttcctgagcacatactctgtaaggtactcttcttggtttttttgtagattagttcattagttgtctctacactctgtcagtgggtactaccattaacccatatagctgatggatatgtggcccacagatgatctgtgaattgctcaaggccatgtagtgagctggtgacctaactgggatgcctacaccagcaatctggttcagtgcctttactcctaacgttgatgcagtactctgctcagtttctaaaggacaatcatgggccaggtccatgtacttctgtggctgaggaaggccttcattctaagtccaggtaacctgaggctcagagatactgagacctagctaaagtggataagtggcagctagctgtgatggctcacacctgtaatcccagcatctttgagagttcaaggtgggcagactgtttgagctcaggagttcgagaccagccagggcaatatggtgggacccccatctctataagaaaaatcttagaaatttagctgagtgtgttggcatgcacctatagtcccagctactcaggagactgaagtgggagaattgcttgaggctgggaggttgaaactgcagtgagctgtgacagcaccactgcactccagccagggcgacagaatgagaccccgtctcaaaaaaaaaaaaaaaaaaagggaagccatttttaagccccagtatgtttggcagcaaaccccatattctgagccagggccatggccctgggtctgtcaaggagggtaaagtagcctgaggccatcagctgaatgaataagcactggctcctgccagctgaggggaactggtgccacaggaaaaggatgtgacgaagaccaggagggaaagtgaaacccttccgtcctggcttcagtgaggaacaagcatgcctgtgccagacgaacccttccttcctcttgggtgactctggagggcccaggcccattgcttccttcctgcttggttatttcaggaaagaggtaggtggagaagaggaagaggctactagcagccaggaaaagtgccagggacaccagaactgtaccttgttctgtccttctcacatccctgcattggcaggctgtgagtcacctgcagagtcaccttatgctcctggcctcagtttccctgagggagaggctgataaatgtgtgctgaatagacaaacatggccttgctagaagatcgctgggagatggtaggaagggggtagggcaaacggagaggccttatcactcttttggcagggagttgcaggcggagactcggaagaagtgaggtttgtggttggaatccacttcctctggttttcccaggggagctgttggctcccgagatgtgagaagaacatggcctttctcctctcccccacggaaacataggcctggaggtgggcaacttggagaagcagctcagtggaggcagggcaaagagaggggtggcaagactgtgttggggtcaacacctcagtccagccggcccaggtatgggtgggtgccacagcaagccttttggcttctgagcctcagtttctcctgccttgacctccctagcagtagtggtgagatcagggggtgtcatagagggctcaagccatctgggctatagggaatatttggtggtatcctcacaacaaacttcatgtttatcttcctccaactctgacctgttcaattcagctgccagcctctcctcctccacctcctcccccaccattagttctaagaagctgtgcctgacagatgcacttgcatttctcagaaaaggaagcggttgtgccgggaggagataacacctccgctggggaatcgagaaagctatcaggcctagcagtgcgagtgtgggctctccatctctctggctcagaaccagggtgatgggcttgggggcaaagagagagaattcagaaaagcatttactgggggcagagatgctcatttgggggctcataacctccttccctggaaccgatggagataaaacagctgatgtttactaagtaccaggcatggtgctaagtgcttcgtgtgtaaagaatttgcttaatcctcacaataatcccaccgagtacatgctgttattactctccagcttacagatgaggaaacagaggcagagaggataaatcaccctcccaaggtcacagaggccacaagtggtagagttgggatttgaatacaggcagtctgtctccagagtccaaacatttaactgttcctgggtggctgctatgtgctcatataggctcatcccctgggattccgatgcctcccgtcatctcaactctctcatttcaaccctggtgactccctattctttcgtaagtagatggccacagccctccattcttctcccagtgtccagggtgagaaaaaccaatactcacccttggaacagagtcggagactccagggaccttacagcatgcccatccaaccttccatgtaatactcaagctcaccacgaacacccccatttcacagacagggttcagaagggtggagtgctgaagtcccacagtgggtctgtttcattctgatggtccacacccatgggagttggtagtcatctcgagggcattctctccttatgcacttatggagagctccctccttcctgggtgggacatttcatcttcggacagccccgttggaaaactcttccctgtcagggagctgatgctcgtctccctctgtctcccttgactggctggtcttagttctgctctctctccgctgctgctctcctgctctcctccaagtatcagttgtctcatttgtgaaatggaagtgctatctggataaaggcaattaatttctacttctctaccaagctgggctgccagagcacagagcaggcagagaaccaataagtcttgcaaactagattaagatattttgcttttgacctcatctgtaaaatgcggattaaaaaaatccttatttaatttttttttttttttttgagacagagtctcactctgtcgcccaggctggagtgcagtggcacaatcttggctcactgcaacctctgcctcccacgttcaagtgattcttctgcctcagcctcccaagtaattgggactacaggcatgcaccaccatgcctggctaatttttttgtatttttagtagagactggatttcaccatgttggtcaggctggtctcaaactcctgacctcaaatgatccacccacctcggccccccaaagtgctgagattacaggcgtcagccactgcatctggcccaaaatgtccttatttcaaaagaataccatgaggattcaaattaatacatgtaaaggtcttagaattgtgcatggcacatagttaactttgagtaaatgtctggtttattgttcttactagtagaccatggctcagcttgtgtctcggagccttctctatggcttacaagggcctgcagggttttctcagcttcacctagggccaggctgcttcattcctcacatgccatgttctgttcagactcaggacctttgcccacactggtgcttctaccaagctctgtcccacttatctctgaggtcttaatccacaggtcactttctcaaggagcctagctgctcacttcttcccccatctgaccatgggctctgtcccctaggccttgcccagtgctgggtccagagaaggtgctgaagagtctggctgagtgttggacagagaggagggaagagaagaaaggccagttcccactctcttcatccctttcctcactgcctggcaaaactagaaagaggccccaatatagcaggtgattatgcaaggtgtccagtattctccagacactttctctcaggataaggaaaggggacaggaagcttatgggaaagttctagaaaaggcatcttttgcactgtgctgaggcaacaggcaggaatggggtagcaatctccaaaaactaggacttctttctgaggtctttgaccccaagtgctccatagtccaaagcagcttctccttcctcctctccacccaaagctatggcgactcccttgtctgatgcagatcagtgctggatgctgtggggaagagagtactgggctgacagtcagtggatgtggattttgtttcccagttccatcgctgatttgcaggtgagtcctttcccctgcctgagactctgggaaagtatgggcctttccccaactgtcaaatgaagtgggaatcatctcaaagggctccgtctagggctacagcataaggagaatgaaagtaactcatgcagacagatgagtgactaccagggttctctctctcaggggtatccaaaagatccagtaattagtgtgtaaattgagaagcaacattctgaagtaggagaacttgttgccacaaaggagtctgatccttctccacctcaaagcccgctgggcattgctctgaacctgcaggattccaggggaagagagcaataggcacatctatgaccaggcagactcctgggcaaggctagatctttccacgctctagctcctgtggcctcgacctcttcaccccagcaccgcctccaactagtccagacaagtcccaagtattttcagccacctttatctgatcagaaatgtttggaattccacagcagaaggcaacagctctggaggatttggggaagggagcaaatccctgcaacacccttctctccccactgtacagatgaatgctcacaccccatgtaaccaaaaactcagggctgaaggcacccacggtgttgcatttccttctattctgtgatgtgatggaactgggaaacaaaacccacatccactgactgtcagcctcatactcttctctgcagcatccaacattgatctgcaccagacaagggagtgggttccttcttgttttctaccctattcatttctgccccagtccattacccctttaaggtgcagaacagtaagatgcctgagatggtgagaagagggctagggtactttgcctgatgtcgagggagggggcacccagaggtgtgctgttcacagtcaatacccagagcaccaccaccaggaggcctggaagcaactcactgtcccacttgatgtggcctgtggaccaccagaaatttcagagcgtcacagagatgtgtggttcgatcctgagcaggtaagaaactgaggcccagaggaagtgaagggatacctccaaggcttcatacagggacagagcacagcctggtctcaggcctccctaccctggagtgagacagtgtggcttccaaccctagttctgtgactacctggttgcaggacctggagcaagacactttccccctccaagcctggtgttccggctgcaaaatgaaaacagctgtacttacttcacaggcctagcagcagagttcaatggtccatggtaagcgttctgtaaatgttagctgctgctgctgctgttgttattattatcgttattaattgagacgaagtctcactctgtctctgtcgcccaggctggagtgcagtggtgtgatctctgctcactgcaacctctgcctcctgggttcaagcgattcttgtgcctcagcctcctgagtagctgggattataggcatgtgccaccacactaatttttgtatttttgcaggctaatttttgtatttttagtggaaatggggtttcgctatgttggccaggctggtctcgtactcctggcctcaagtgatctgcctgcctcagcctcccaaagtgctgggattataggcatgagccactgcacccagcctgtttttttatagctaaaaaatcagtggctccatttgtgcttctcatagtgtctctcttatttgtagctataaacaaacaaaaagtaacagctagtatttgctgaactaatatttactgtttgaattctcaaaatcttgcaagtaggtgctgttcccattttaccaatgaggaaactaaaattcagcgaagtgatgagactttgcctgaggcccctggttactagtgagggcattcaacttcacagcatgttaaatttaccagtgcaacaggatacatgaagagattttactaagaccttctttccttcaccctttcacctacccaatatttactgagaatctgctattcttaggccttcgaagtcagagatgactttaagtacatggaagtagcattcccccctggttccctgggtgccttgaggggtgagaaagggaagagtgtgctgaggctactcagtgatgaacccactttcccctaagccagatctgcaaggacagtacttgcagagagagttcctccctctgtctgatctttatcttggaaacaaaagtgatgccacgtagctttggtgaagctattagatgagttttctaagatgggacatgacctatttgtaagccaggctgacctatggagttgtaggaaggcccagacaggctgccttccctagctttggacactcagtcattcaacaaatcttcattaagtgcccactaagagtcaggcactgtactaagcgctggggataaagcagtgactaaatagaatgaaaattcgtacctgtatgagtttataatcaaatgggaagagacaggcaataaacatgtcagacggtgatgcattaagaaagaataaatgtgagaaagggggtacagagaaacatggaagaaggtaagattagaatccatggtcagggacaacttcttaaggaggtgaatttgatcagagacctgaatgaaatgaggaaacaggcactgcaaagatctgagaaaaggctgtgggaacaagtgcaaaggcccagaggcaggaacacgcttgaggtgctccaggaacaggaaaaatgccagtgtggctgaagtccagtgaatgtgaggagactggtggtgatgagatctggaggtagccaagggcccgattgtgtggggcctggtaggccatttaaagacttgggcttgtcctgggaaagcactgtagggttttgagcaggggaaggacatgacctgaccttggtgttaaatagcgtccgtctggctgctgggtggagatctccaggggtctggtgagataatcaggaaaatatgacagtggcttagccacaatggtgccagggaagttggtgagaagcagtcagtttcagaatttattttttaaagtaaggctgggccaggtgtagcggctcatgtctacaatcccagcacttgggaggccgaggtgagaggactgcttgagtccaaaagtttcagaccagtctgggcaacatgggaaaatcctatttttacaaaaaaatgacacaaagtagccaggcgtgatggcatgttccagctattccggaggctgaggtgggaggactgctggagcccaggaggctgaggctgcagtgagccatgactgcgccactgcacttcagcctggaagacacagcaagatactgttcttaatcaatcaatcaatcaataaaagtagagctgaaaggatttgctgatgaattagatgtggactgtgggagttgcctgccctcttggccctctgtttcccatctataaaaggcgagagaagaggcccttggggatttctttccagtttgataactatgaggacctatatgaagaaagagataaagcaactatttctgctgctctcatggaagcaaaatcatttgctcaccaggcctcaaagtgtggatggcaataagatgaggaaggcagagatggacagagacagtgcagcaaagggagggcagggctctgcctaggctgtggctattccactttcagcacacacattaccgccaggcatatgccaggccacagagtagacaggctccagtgggagcgggggtcagggtagcttgctttatattaggagagaagaagcatcagagctgccgttgtccagggcctactaggcagaaggtgctcagtgactgactgactgactgagtgaatgaatgaataaataaataaggtaatgccagaaggccagtatatgtgcaagaacttcccaagtccttccaaattaacaggaggtaggcctggtccaaaggattgctctcctgtcactttatctgcttattctaggctgagcttcaagttcttgttctctgtgaatgggagactatgtggtctgaatcactgaagcaggattttagagctggaaggcagcacagacacatttggtccactctatccacaatttcagccatcactgctttgaccttatatgtgattctgttattatttacttaacatttttcttttcaagacagggtctcactctgttgcccaggctagagtgcaatcgtgtgatcaaggctcactgaggcctcaacctcccaggctcaagcaatcctcctgcctcagcctcccgactaggtgggactacaggtgtgcatcaccatgcctggctaatttttttttctttttctttttttgtagagataaggtctcactatgttgcccagtctggtcctgaactactgagctcaagctattctctcgccttggccccccaaagtgctgggattatagctgtgagccactgtgcctggcctacttaacattattctatcaatttacttactttttataaatttaaatacatgtactgaaaattctcaatttattccctaaacctgttctttctgcatctttctcatccttaaatcccctctaacactcatctgtcaatatatcctgatgaatctgtattccaaatttatctagagtcccaccatttcccaccacctccactgctattatttggtccaagccagtatcatttcttgcctgtattgtcctaacagcctccttactggtctcccagcttcttatcgactccatggttccttcaccacatggcagccagaggggtcagcaaagtcagtttcctgtctgctcaaaaccctccactgccttcccatctcacccagaggaagaaccaaaatgtctcaccactgctcacacaaactttcctttccaatcacttctcctctgcttactctgttctagccacactgatctcccgtgctcttcctcaaacatgccaggcacaccattcccaccctttggcctctgcacttgttccttatgtctggaatgttttttccatagactgttacatggtttcctccctcagacagatcatgcagatctctgctcatatgcctgctcctcagaggccttccttaattatcctttattaaaaaggcaaacacataccaaaagctgcctaccaccggccacctaatcactctctgtcctcttagaatgtaaacttcatgatggcccggcgcagtggctcacgcctgtaatcccagcactctgggagaacgaggcaggtggatcacctgagatcaggagttcaagaccagcctggccaacacagtgaaaccccgtctctactaaaaatacaaaaattagctgggtgtggtggcgggcacctgtaatcccagctactcaagaggctgaggcaaaagaatcgcttgaacccgggagtcagaggttgcagtgagccgaggctgcgccactgcactccagcctgggcaacaagagtgaaactccatctcaaaaaaaaaaaaaaaaaaaaaaaaaaaaaaaaaaaaaagaatgtgaacttcatgaaggcaggtatccccagtagctagaatagtggttgacagatagtagacacttagcaaatatttgctaaataaataaatgcaatgaaaaggcaacttattattcttcctataaagagtatcatttgccccagatggaaatcaacataaaatacactgactattaaaacagaaaatgtccatctgcatatcacctctaagttaccttgaagatcctggtctaacacctttacagaggagatatttgagacccagggcagagtcagccagctgaccggaagccagtccagaatggcccacaggtaccccccaacatgccttggaaccacagccctgtcccccagggtgtggacaaagagactgaatctcaggaaaggtatagctaggttggaccaaaagaacctatctgaggggccagaaaagccctccctagcaaggcatagagctagcagttttcctgaagagaacaaaggccaaagaggcatgagtgtgccaggctgggagagcctcatggggctgcaccgtgggtgacaggcacgtacaaacctgtaagtgaggtccacagagaccagagagctgagagcagaaatgaaaacaggataggtcccaaagggtggcagcttcaatccgtaaacaccagacaggcgtggggttcaggtgtaggtctggggacccagctgagcccaggggaaggatgggacctccccagtctcctccgtcagtgatgattactctaaggtgagctgagcagaagcaccaccaatccagctatagtaacaccagacatcagacattaaggagggaagagccagatctacccttctcatctccacattccggatggtctgtctcctcccaaacccactccacccatatgagccctcggggatccaaaccctattaagaagggaccatccatttcccatctttgaggggcttagtgaacacggctacaggtgcaggggtgaagctagagatgttgtaactgccaagccagcaatgcctgacctacatctccacggttggttgcatacaaagaaaaataccagggatttccgttggtgttcaccacatgcagctgccaagggaaggctgggccttctgaaggcctgttgtgaatagggcaagacaagtgataagcttgctgggataggcgagaaggctggcctctaaatttactggctctggggacctccctagattttagagactctatataatttttacctgctttctaccaaggtcctccattaaagctttttcttcttctagtatatttttattaagaattgagaaagacagccaggcgtggtggctcacgcctgtaatcccagcactttgggaagccgaggtgggtggatcacgaagtcaggagatcaagaccatcctggctaacacggtgaaaccccgtctactaaaaatacaaaaaattagccaggcgtggtggcgggtgtctgtagtcccacctactcgggaggcttaggcaggagaatggcgtgaacccaggaggcggagcttgcagtgagctgagatcgtgccactgcactccagcctgagtgacagagcaagactccatctcaaaaaaaaaaaaagaattgagaaagagagaaaaagaagattctatttggaaaaatgttccccaaactaaacagctgttcttattgtaaaccactggtattttcagtgaggctctagttccgcacagaaaaaaggcaatttgaaagttccacatggtcaggttcaagaaacgtgagcttactcctgctttgtggtggctctatttggctatggtcctgtcaattaagcaccacgggcctcacttttctcatctgaaaagtgtggaggatggatcagatgatctctaaggctttctctccagttccaaagcactaagatcctatctccgggccctttttttttcccctcaagggagcagtggagtgtaagggaaaagtaagctttcttggcagacaaaagactgagttctaatctcagcaatgccatttattaacttactgtgtaacaatggcaacccacttcccctctgggggcacctcattttcttcatatataaaccaaagacccaaaagtgcagtgaacaggtactctaggaggcctttggcattattattatgcctcccttacattgttcacccattagcatatcctggcctcccaaagaacctgttctttacttgacattgctctgacttgcaaacccctgtccttgaaaattaacacgttccaagagctatgccataggagcccaaatagcctctgggtccccaacccccttctgatgtcaataaaaagatcactgctatttattcaatgttttgtatatgccaggccctcatgtgtgtttaaaattcttattttatgaagacatggatggtcacaaaggtgaattcacttgctcaagatccaacacacacaaaatggaggtggttcaaacccaggtgtgtctgactgcagagcctgtgttcttcccagtagagatgtggatgcagcacaaatggtagaaaggacctgagacttagtcagaagacctcagttcacccaaggtaagaggaaaaccctatttacctcctcctagcatcgtcagaggttcaatgagataatgtgtgaacacaaggaagcactagacaaactttagttaatgatcctatgctattattttatgactccagcctgggtttcaccacatttgcaaagagagtggaagtagcaagctgtaatatcttagagatgttacagccccacttctctgttttgtgtcctactcaggctttcttttgttcacatctggtccatccttctagattcctgttacttggaccctccaggccacccagcatgatacccacagtgttctccctgaaaggccatggagcggagggagtaaggggtaaatggaaaccacaagtcttctctaaaacagtgtgaagtagataatccagacttaccttccagaaagggcctcaagcaataagaaaaaataaaaaaaggcagagagagccaagggaagcccatggagaccatagttaagtgagggcttttgagtccaatatattggacttgtattctgtctttattagcattcaaccttaggactataatttaacttactttacactcagttttctaatctggacaatgaggacaataacatgtttcccaagaaggattattgtgaagattaaaaatactacactggccgagtctggtggctcacacctgtaatcccagaactttgggaggtccaggagggaggatcatatgaagtcaggagtttgagaccaacctggtcaagacaacaagacctccatctctacaaaaacaaaacaaaacaaaacaaactacactgtaccttacagcatcttgcacatggcaggcactcaataaatagcagcaactatactgtcattagtaaattaagcacagatgggtcatccctaaaggaccctctgatggccaatagatgcacactgagaaccagtgacttgaggctctctatagcaagtgaagctctgaacggagaaaattctcggtcgggcgcggtggctcacgcctgtaatcccagcactttgggaggcgtcggcctcccaaaggaaggaggataacgcaggaggataacgaggtcaggagatcgagaccattctggcaaacacggtgaaaccccttctctactaaaaatacaaaaaaaaatagccgggtgtggtggcacgcgcctgtaatcccagctactcaggaggctgaggcaggagaatcgcttgaacccgggagtcggaggttgcagtgagccaagattgccactccactcctccagcttggcgacagaaagagactctgtctcaaaaaaaaaaaaaaaaaaaagaaaattctcaaactctttccccgggagggaggcaggcagctcagtgtagaccagagacctctgatcagacatatgtgggttcctcatagcttccaggctggctgttttgtggccagttaccctctctgagcctgattccttatctgtattagacaataagaccatatgttcttcctcctgagaggcaggtaaaggtgtactgtaagagcacaggcatcagaggattgaaacctgggcttaatcctagctctgccacttaatagctggaccatgaccatggcaccctatttaacccttctgagcttcacttatctcatctaaaagccttcctctttgagtagttatgaggattatcagataatgtgctggtgcctggcaaatagtaacaatttcacttgatacatgaaagtgtttatcttatatccagggccaggtacaggaaggcactcaagaaatgtgctgatggccggcgcggtggctcacacctgtaaatcccagcaatttgataggctgaggtgggtggatcacctgaagtctggagtttgagaccagcctggcgaacatagcaaaaccctgtctctactaaaaatacaaaaattagcccagcaaggtggtgggcacctgtagtcccagctacttgggaggctgaggcagaagaactgcttaaacccaggaggtggaggttgcagtgagccaagatcgtgccactgcattccagcctgggtgacagagcaagactctgtctccaaaaaaaaaaaaaaaagaaagaaaagaaaaagaaaagaaaagaaaagaaagaaaaagaaaaagaaatgtgctgaaccaaactctccacttgggtggaagggtgttaagaaaaaagattctcctgtaaactggtacccactgctgtgggcccaggctaactaaccctattaaaatcccaagtacacatacccttggccccagtaattccacttttagggattcatcccccccagatatactgtattcatatatgggccaaatgacaaatatacagggctattcattgagtgtcactattataactgcaaaagactggaaaaaaatgtgtctaccaatgggaactggttaaagtatagaatagtgccctgtgtagaatactatgcagcattaaaaagactgagaaagcttttatgtactgacacagaaagatcttaagagatacaactttgatatttgcatcctatgacaacaaaataacaccactactgtgtaatcaaccacactagggttgctaccatctctgaccctttgtctttggatgctgttaagctaaaagcggaccaggatccatgatgaggttcctctatcctctgggttaagtctgtccaggtaaaataatagggaaagaagaataccattaaaataaaaattggctggacacagtggctcatgcctgtaatctcagcactttgggaagccgaggcaggaggactgcttgaggccaggagttcaggactagcctgggcaacgtggcaagaccctgtctctataattaaagaagaaaaggaaaggaagaaaggggaagggaaagggagggaaggggagggggagggcaggggaggggagggaaggaagaaagacagctgggtgcagtggcttatgcctgtaatcctactaacacttcaggaggctgaggcgggtggattgcttgagaccaggagttcgaaaccagcctgggagacatagtgagatcccgtctctacaaaaaaaagaaaaaaaaaaagaaagaaagaaaataaaaattatcccatggtggtcctggaagaaacaagggaaggtaggaaacttaatcctagaggcagtagtagtcaggctctaggagaagggctggcaaccgcctgaaaatcccctccccagtctttccttaccactccctctcctgttttctttaaaatcagtctcttccatgcctgctaagaccactttatcaggaactcctgaaagtagatggagactaaattggctctgaagaatacaaatggctaacaaaacgttaagaaaagatgttctgccaggcgcggtggcgcacgcctgtaatcccagcactttgggaggctgaggcgggcggatcacttgaggttgggagttcaagaccaccctgaccaacatggagaaatcctgtctctgctaaaaatacaaaaaattagctgggtgtggtggcacatgcctgtaatcccagctgctcgggaggctgaggcaggagaattgcttgaacccaggaggcggaggttgcggtgagctggagatcgcgctattgcactccagcctgggcaacaagagcgaaactctgtctcaaaaaagaaaaaaagaaaagatgtgctacctcacaagtagccctggaaatagtccttggatatttttaactttttttttccccctgtgacagggtctcactctcatccaggctggagtgcagtggcataatcatgactcagtgcagcttcaacctcccggactgaagagattctcctattttagcttcccaagtagctaggaagctaggactacaggtgtgtaccactgcaaatgactaattttttttttttgagagacacagggtctcactatgttgtccaggctggtctccaactcctgggctcaagccatccttccacctcagcctcccaaactgctgggattacaggtgtgagtcactgcacctggccaattttaaacttattcttatgataatatttaatcatgtacaaaagtagacagaataaaacgaacccatcattcaacttcaacaagtaccaacttggtgccaatctgatttcatctgttccccaaccactatctctcactccagtagtattttgaagcaaatcccacacacaggtcagtatgtattttttttttttttgcagacagagtctcactctgttgcccaggctggaatgcaatggcatgatctcagctcactgcaacctccgtctcctgggttcaagcaattctcatgtctcagcttcccaaggagctgggattacaggcgtgcgccatgatgcctggctgttttgataaactctctcccacatgctggctttgagaatcaattgaaaagttaaaaaagaaaaaaggaaaaaaagccccaactttttcccaaagagggtacctttgttcattatgagatattaatacagtaggccaggcacggtggctcaggcctgtaatcccagcactttgggaggccgaggtgggtggctcacctgaggtcaggcatttgagaccagcctggccaacatggtgaaaccccgtctctactaaaaatataaaaaaaattagccaggcatggtgacatatgcctgtaatcccagctaacttgggaggctgaggcaggagaatcgcttgaacccgggaggcagaggttgcagtgagccgagatcatgccattgcactccagcctgggcaacagggcgagactctgtctcaaaaaaaaaaaaaaaaaaaaaaaaaaaaaaaaaaaagaaatattaatacagtatatacaataagctctaggtataacttaagtcataaataattcaaatttacagcctttaacaccctatggaggccaggcatggaggctcacttgaggtcaggagttggagaccagcctggccaacatgttgaaactccgtctctactaaaaatacaaaaattagctgggtgtggtagtgcatgcctgtaattccagcttcttgaaaggctgaggcaggagaatcatttgaacctgggaggcggaggttgcaatgagccaagaccgtgccactgtactccagcctgggcgacagagcgagactctatctcaaaataaaaaataaaataaaataaaataaaataaaataaaataaaataaaataaacaggctgggtgtggtggcgcccggcgaacaaattaatcccagctactcaagaggctgaggcagaagaactgaaagactatatttgtaacatgcatagacaaagtattagtattcaaaatacattttaaaagcctacaaacccataagaaaaagtcaaatcaaaaggaaatggagcaaggacttgaacattttacaaagaggaaacatgaatggccaacagatgtaagaaaagattcacagccccacttgtaatctgagaaatgcaaattaaaaccgcaagataccatctcacacccaccagctccataaaaatttaagtctgaccatatcaagtattaacaaagaggtaaagtaatggaaaacccatatgctgttggtggctgtgtaaattcacacaaacacaggaaaacaatctgccattaccttctgatcaagcaattccacttctgtgtaaaccctacaacaatgattctcagtgaggtcccaggaccaagagtggcagcatcagctgagaagttgttagaagtgcaaattctgagggccccaaccctgacatacacaatcaaacactttgggggtggagcccagcaatctgaggtttaacaaaccttccaggtgattctgatgggcagctaaagtttgggaaccactgcctgggagaaactcttgaacatgtgcatgtgcaggagacacaaacagttttcataacagcattgtctgaaacagcaaaaacaaggggacaacccaaataaccactgacagcagaatggatacacagcttgagacatgatcatataaatggatacgaaaatgaacaaattatgctatgcaagtaacatggatggatctcaaccttgaatgaaaaaaggaaactgcagatgataaacacagcataatacctaaatgaagtttaaaagaatgcacaggctgggcgcagtggctcacgcctgtaatcccagcactttgggaggctgaggcaggcagatcacgaggtcaggagtttgagaccagcctggccaatgtggtgaaaccccatctctactaataatacaaaacttagggctgggcgccgtggctcacagctgtaatctcagcactttgggaggccgaggctggtggatcacgaggtcaggagttcaagaccagcctggccaagatggtgaaaccccatctctactaaaactacaaaaattagccaggcgcagtggcaggtgcctgtaatcccatctactagggagtctgaggcaagagaatcactttaacccgggtggcagaggttgcagtaagccaagatcgcaccacactgcactacagcctgggcgacagagtgagactcggtcttaaaaaaaaaaaattagtcaggtgtggtggcgtgcgcctgtagtccagctactcgggagactgaggcagaagaaccgcttgaacccaggaggcggaggttgcagtgagctgaggtcgcaccatagcactccagcctgggcgagaaagtgggaccgtctcaaaaaaaaaaaacaaaaacaaaaacaaaaaaaagcatgtagaagaatatcctatattgtttaggaatatatacctatatatatatagtaaaacttaaaaaaaaaaaaaaaaaaaggtagccaggtgtggtggctcacacctgtaatcccagtgctttgagaagctgaggtaggaggatcgcttgaagccaggagttctagaccagcccaggcaacatagtgagatcccatctctaaaaaaaataataataataattaaaaaattagctacttggcaggctgaggcaggaggatcacttgagcccagaggtttgaggctgaagtgaggtatgatcatgccactgcactctagcctggttgacatggtaagatatcacaaaagaaaacacagaactcaggagtatggatggtggggtagctgtgattggggagggggtacacagggggctctaaggtactcacgtttatttttgtttgtttttagagacaaggtctccctctgttgcccacactggagaacagtggcgcgatcatagcttactgcagccttaaactcctgggctcaggtgatccccgactcaaccttctgagtagctggagttataggcgtgcaccaccacgcccagctattttttaattttagtttttgtagagatggtggtctcactatgttgcccaggctagtctcaaacttctggcctcaagcattcctcctacctcagcctcccaagtgctgggattacaggcataagccatcatgcaaggcaaacatatgtttgattattaattaatctgggtgatgagtttacaagtgatgattttcctatttttaaaattgtacatatgcattagatattctctgttgtatttatgataaatttctttaaaaaaaaaaagtgtactgaaacagtgcaatactctgagccagaactgtaacaactaactcaacatatgcagtgtccgaagggttaagcctgtttctctgcctgtgggtgggagggcaggcagcagctggggcacagtgggagttcctggctccagctggctccagcctggatcaagcaccacgcccaggaactggcacctgtagggggggcttctggacaggtggcacctgtagcccttggtgacctgatacatgtgagaggctgggcccagtcagatgggtggtgggcttctgtcagagcccctccatctggtaaggaagtttgctggtggcagcttggagctggtgagaaggggaagagggtctaggacacaggatgggggtggggaaggaagtgggtgggctgggctcagataccaagggagggtggtgggattagcacctgctgagaatgagattaggtttcttgggaagggctcatctatctaatgctccccgaaagctgtctccctgtggcttttctctgctggacagatggtgtctgagctgcctcttggagggcgggctccttgagggggtggtggaggtggagtgtgacctgctgcctgctttccagaggaccttgaggccctgggacttcttgtcttccaacaatagtaataaggattagagctaactcttactgaaggtttaccatatgccaggcattgtcctaagcccttcatacaaattaccctcatttagttttcacagcacccaactgcctatcatctagacagtaggcttacattgaaggaaactaaggcttggcaaagtcaaacacttgctcaaagtcaaacagtaagcagggcctggtggcgtacctataatcccaggaagatagaggcgggaggatcacttgagcccaggagttcgagacaagcacaggcaacatagtgagacctcatctcaaaacaacaacaaaaacaaaacagtaagcaaactaggacttgaatgcaggcagttcaactccacagccctagcaggaaatcactatcagccaaggcatcttccccttattaaatggcagtaaggactttccagtttcttaagccaaaaacctggactcctttctctctcacctcttatccagcaaacatcagcaaatccagttggtccaaccttcaaattgtattgaagctctgaccactgctcgccacttccaccacccatccaccctggtataaactgctgttatcacccacctggcttctcactggtctcctgctcccgctcttacccatagagtttgttctccacatcagagagatccttctaaaacctgtcacttctttgcttaaaaatcctccatgcctttccactgcccttaaagcaaggtcccatgtggccctacaagacctggcccctggtgacgtctcagacctgattcctaccactggcttactctactctggccatactggccaacttgctgtactttaaatatgttggagagtctttttttgtacttgctttattttttaatttttttgaaacaaggtcttgctctgtcagccagactagagtggagggacaggatcatagctcactgcagcctcaaactcctggatttaagccatcttcctgcctcagtgtcccgagtagctagctaggactacagacatgcaccactatgcccaactaaactctggctttgtcgctctggctgatctcaaactctcagcatcaagtgatcctcctgccttggcctcccaaagtgttgggattataggcgtgagccactgcatctggcttttttttgttttacggcttgctgttctctatgcctacaacactattcccccatatatccgcacagctcatgccctcactgcattcagatccaatgtcactttatcagagaggccttcctaactaccctacccttccttttcccatccctaatcccttttctctgctttatttttccctatatcactaaatactacctcacatgttatttattttttagaggtgggttgtcactatgttgcccaggttggtctcgaactcctgggctcaagcaatactcccacttcagcttcccaaagtgctagaattaaaggcgagagccaccatgcctagccctgacatgttaatttacttaaaatctgtcacccaccttggaatgtccactgggtgagaatagggactttggttcgttcagactgtatgtccaacctttagctcagtccctgatatatgacaggaatgcaataaatacttgttaatgaacaaatgaatgaatgaccaatatccctcaggaaatgactcagactcaaaggggagtaaggctgcctgagtgtccttggctttcacagccctgatgacctttggtaccccatggcagcggtcaacgtccttccctattatgaaatgtcctgggtgcatagcatcaccactgtgtcatctacttgtgcctgcacccatgcaaacacacagggacacaaagctggaaaagggctggttttgagaaggagtaagcctgggcagttgaaacccaggttcggtgtactctagggcacttacttctaggtgactgtccttgccactgctggcgtaccaaggtctcccagtcatatgcccatgcactgtatacattttggcatttattctcatgaataaagtgtcattagaggccagacactgctggctaacgcctgtaatcgcagcactttgggacgtcaaggtgggaggactgcttgagcccaggagttagagaccagtctggacaacacagtgagaccttgtctctactaaaaatttaaaaataagctagtcggccgggtgtggtggctcacacctgtaatcctagcactttgggaagccgaggcgggtggatcatctgaggtcaggagttcgagacgagcctggccaacgtggtcaaactctgtctctaccaaaaatacaaaaattagctgggcatggtggtgggtgactgtaatcccagctactcgggaggctgaggcaggagaatcacttgaatccaggaggcggaggctgcagtgagccgagatcaagccactccagcctgggcaacagagcaagactctatctcaaaaaaaaaaaaaaaaaaaaaattagctaggcatgatggcatgtgcctatattttagcttcactattttcacatgtaaaatggatgtcacagggcatatggctccttggaatattacatgagataacatatttaaatcattcagcagtatacttagcacccatggagtgctcaatggatggtagctctgtagatcagctctcaatagagggacaggccattagataagcttggggaaggcttcctggaaaagactggcttggtactggactttggagcctggatagaatatacatgaatgttggctggaaggagcctattcaaatggaagagggaagaggacaggctttggatgctggcagtttgctgtgtaatctttaacaggtgactttcttttttttttttttagacggagtctcgctctgtcacccaggctggagtgcagtggcacgatcttgactcactgcaacctccacctcccgggttcatgccattctcctgccttagcctcccaagtagctgggactgcaggtgcccgccaccacgcccggctaattttttgtatttttagtagagacggggtttcaccgtgttagccaggatggtctcaaactcctgacctcatgatctgcccacctcatcctcccaaagtgctgggattacaggcgtgagccactgtgcccggcctaacaggtgactttacctctcaaagtctcagttttcttctctgtagaatgtggataccactagagcatacctcataaaactgttgggaggattaatgaggtgctatactgataagtggaaaccactgaacagaatcctcagcatgtgctgttgctgtttttttttttttgagacggagtctcgctttgttgcccaggctggagtgcagtggcacaatctcagctcactgcaatctccacctcccgggctcaagcagttttcctgcctcagcctcctgagtaactgggatgataggcacacgccatcatgcctggctaatttttgtatttttagtagagatggggtttcaccatgttggccaggctagtcttaaacttctgacctcaagtgatctgcctgcctcggcctcccaaagtgctgggatgacaggcgtgaaccatcgtgcccagcctggtgatcctttaaaaatgtatgtcggactgtcatttcttggttcaaaaccctccaatgactcttttttctgagacaggattttgctctgtcgcccaggttggagttctgtgagatgtgttcatagctcactgcagccatgaactcccaggctcaagtgatcctcccaccttagcctcctgagtagccaagattattggcatgtgccaccatgcctgacaaattttttgtagagatggaggtctcactgtactgctcaggctgatgttgaattcctgggctcaagtgatcctcccacctcagactcccaaagttttgggattacaggcatgagctactggacccagtcgattttccttctttttttttttggagacggtctcgctttgtcacctaggctggggtatagtggtgtgaacatggctcactgcaaccttgacctcctggactcaagtgtttctcccatctcagcctcccgagtagctgggaatacaggtgcgaaacaccacacccggctaatttttgtatttttttgtagagacagagtttcgccatgttgcccaggctggtctcaaactcctaagctcaagcaatctgcctgcctcagcctcctaaagtgctcagattacaggcatgagccaccacacctgcccttttttgcttttcaattagtgagtcaaggggagatctccaatatatctccaatagtgtggtggctggtctgctctgaaatgtaagcagtttttttttgtccccttgaccagactctaaaagtcttaaggtcaaaaagtccacaaataacgttttgtttacccatcctacagtgctaggcctaagcctcggacttaggcaaaggagatcagaagggtcatatggctaaatgtaggtggacaagagggagtcggggagggccttcctgtgaatcctcctgcctctcaaggacgctctgttcccttagcttgagaagccttgaggaaagctttttccatgaacaagcttttaaaaaccttttagctctttaaaagcagcaagtaccattccagtcatgaccctgcagacaggtggaacacccatactccagcctcattctgaagagacttgcagagcaggaaggaaggggtaatgactttcagttccagtaatgtatctagaagcagcagctgattcagctagatgatgtcaccttcccaaacctcctgaccagcagctgagatggtaaaagcaggaaacaggggatactcagctggctaagtccgaacatgcctctggcaaaggcctacagtaaccccaggctctggaggcatcctcctgaagatgaggagaaagagtcctctcagctgggagtacagtaggtgtccttcaagaccctcaaaccaagatgcttctccaactctccttttgctaagcagctttctgcatatcctgaaccaacaatccttcatttattccaagagtggagcaggggaaagaagcctggctttagagccagcccaatctaggtccaaatccaggattcaccacgtaaagctgcaggaccctggcatgcaacttcacttatccaaaccttagtttctttactggaaaagaaagtagggctaatggaccatttagcacacagtctaggtgagggaattaaatgagaaaatgcatgtagagtacctgacatgggctaggtgctcaataaatggtagtcaaccattatcccattggatctctgcagaggagatttgaaagatcacctccatctataacacaaaaggaaacaaaggtaccaactagacccaacagtgtcaaagctgagtaactgagttggcccatgcatatagttgcttcctagatattccattactcagtttcattttctgtacagcatttaacccaatccctgaaataatcttgtttgtttctcgggctagctgtctctcccattaaagtaagagttctacaagagcaatgtccttgaccttatcttgtttatcttagcatcttcagcatgtagcacagggcctggcacatagttggtgctcaataaacatttgccgaatcgccaaatgaatagcacctgggatggccaaaagctaaactgacaatggccccacacttaactcctcccctcactattagttgaaggctctggctcccatttcagaagctgccattgccacctgggaatcagcagcccaaccagtggccagcatgggcattagtccctgggcacgacctatctattgggataccagggctgccaaggagggccttggaatcctccccctggcacttgaagatcctacaaacctggttctagctgacctttttggctttattacctaatgaaagagacccctccacatatgcctaaaatttgactgccactgcccacgggtctcttcttgagagttggtctcagcctgcaaatcttaacccacattgactctcctactgggagctacagcccctcttttctccgctttgtggtaaggctcggtgtaaacctcacctcttctgtgaagtccttccctcatttggcatttagcatttattgttggcttttacaagatctcctttcatgtatattatgtcttttctctctaattcaactggaagtatcttgagagcagaactgggtttccaatggcaatatctcaattaataaaccttctacagaaaagactccttgaaacaaagttagctaggtccagagaggactggagaggggtctaggctcctccctgctggaccagcccctttggcaaaaagaggagatcgtgttgcctcaatccaggagcccagctgatgaggcaggaagggagccagcaaatcctagactattaggtgcagtctgggacaatcccaaggtcatctatgtaattagattttttttttttggagacggagtcttgctctgtcgccaggccggagtgcagtggtgtgatctcagctcactgcaacctccgcctcctgggttcaagcgattctcctgcctcagcctcctgagtagctgggattacaggcacgcgccaccacacctggctaattttttgtattttagcagagacagggtttcaccatgttggccaagacggtcttgatctcctgacctcatgatctgcccaccttgccctcccaaagtgctgggattacaggcgtgagccaccacgcccggcctgtagttagatttttaaaaaaccatcattttaaatgaatctgggcaatatttagttataaagaatggcataaaaactgctcagttcaaaggacttttgtaacatacatttgtgtgaactaattttacttttggctcgtcttcttacccatattttcctttcacccgactcccttagctacattatccttttggttgtatgaattttcctaagttgcttccaactctttgtaaaacagagcaaggttccaataaaaaataagattggtccagttttcttttaagtggtacagtggtatatataaaaaatgatgttccaaacaactcattataacaattaagaataagtggcaaaaataatgcatgtaaatcactgaatacagtgcttggcacttaatgagcattcaaaagtaggatgaaagaacactattaattctcattagcttctcttctctgggcctcagttttttcatgtcttaggttttgttcatttgtttaataatttattcaaaaagtattcactgaatgtttactacctgcaaagaacagctgcagacactggagatacaatgatgaacaaaccaaacgccctataatcatggggcttatattctaatagaagagacagacaaaaacaagtacacaaacaaaaagaaaattccaggtagaggctgttgctatgacaaaactacaagaagactggagagggatttagaaatagcatggctactttaaactgaaggtcaaggaaagtctctcagaggaggtgaccagcaagctgaaccaaatgtaggcctcagaaaggaaatactaggggcagaacatttcaggcagagaaaagagcaactacaaaggcccttgggcaggaagaagttatgccaggatccagaagcagcaaggaacccatgcggcttgagtggagtaagggagagacagaatgatggaggggcagccaggaccagatcacacaggcctcagaggttggtaagaagtctgggttttgctgggtgcagtggatcacacctgtaatcccagcactttgggaggctgaggtgggcagatcacgaggtcaggagttcgagaccagcctggacatcatggtgaaaccccatctctactaaaaatacaaaaattagctgggcgtgatggcaggtgcctttatttttttatttttattttttgagatggagttttgctcttgttgcccagggtggagtgcaatggtgcgatcttggctcaacacaacctccgcctcccaggttcaagtgattctcctgcctcagcctcctgagtagctgagattacaggcatgtgccaccaagcctggctaattttgtatttttagtagagacgggtttctccatgttggtcaggctggtctcgaacccccaacctcaggtgatccacccgcctcagcctcccaaagtgctgggattacaggggtgagccatcgtgcccggccagtgggcacctttaatcccagctactcaggagtttgaggcaggagaaccgcttgaacccgggaggcggaggttgcagtgagccgaaatgacacttactgcactccagcctgggcgacagggcaagactccatctcaaaaaaaaaaaaaaaagtctgggttttattctaactacagtggaagaccacttggagggttgtaaacaaaaatgcaataagatctgaacttggtttttattttattaaattttttgagacagagttttgctcttgttgcccaggctggagtgcaatggtgcaatcttggctcactgcaacctccacctcctgggttcaagtgattctcctgcctcagcctcccaggtagctggcatcacaggcatgagccaccatgcccggctaattttgtatttttagtagagatggggttttaccacgttggtcaggctggtctcgaactcattacctcaggtgatcacccgccttggtgtcccaatgtgctgggattacagatgtgagccactgctcctggctaattttttgtatttttagtagagacggggttgcatcatgttggccaggctggtctcgaactcctgacctcaggtgatccacctgctttggcctcccaaaatgctgggattacaggtgtgagccaccatgcctggcctaaacttggtggttgtttttttttttttttgagacaagagtctcactctgttgcccaggctggcgtgcagtggtgcaatctcggctcactgcaacctccgcctcctgggttcaagtgattctcctgcctcagcctcccgagtagctgagaatacagtcatgcaccaccacacccggctaatttttttattttcagtagagatggggtttcactgtgttggccaggctggtctggaactcctgatctcaggtgattcgcctgtcttggcctcccaaagtgctgggattataggcatgagccactgagcccagccctgaacttgttttttttttttttttgagacgagtattgctctgtcacccaggctggagtgcagtggtgcgatcttggctcattgcaacctctgcctcccaggttcaagcgattctcctgcctcagcctcccaagtagccgggactataggcccacgccaccacacctggctaatttttgtaattttagtagagacggggtttcgccatattggtcaggctggtatcgaactcctgaccttagttgatccactcggcttggcctcccaaagtgctgggattacaggcatgagccactgcacccggccctaaacctttttttttttttttttgagacggagtctctccctgtcacctaggctggagtgcagtggcgcgatctcagctcactgcaacctatgcctcccaggttcaagcgattcttctgcctcagcctcctgagtagctgggattacaggcgtgcaccacacccggctaatttttgtatttttagcagagacggggtttccaccaccttagccaggctggtcttgaactcccgacctgatgatccacccacctcggcctcccaaagtgctgagattacaggcatgagccaccgcgcccagcctgaacttggtttttaaaagaccactttggctggagtattgggcaagagtgattttctaaggtcccttcccagctttttccctgtcattctaggctgccatgaactggttgcctgagccataaagacacagtttctggattagagtgactgaagagcttagagtggttccttgcccttggccggagtagggaatctgtgtcaccttgttctgcaggagatggaggaagtgactccctcagggaggggtgggaatcccatcttggaaaacatcctcaaaccacctgtattgtttctgcctcctgtgtggaagtttctgccaatgacacagtgctctctggaatgcacccccccaacgcacacacccaatcttccgtttacacaggcatagctgtactttgcattcctcctaggatttagttcaaagctagcctacaggaactggtcgataaagagttactgattgattactaaagaaagagaatattctcagccattaagcaaatattaatgagttttatgagtattatgttggtctctgggggtgcaaggtgattaaatgggtttctagtcttcactgagctcagaattcagtggatagaccaaaaactacagacaactacaatgctggatacaatagttataacagcaacatttactagggccttccttatccaggtaggacaagttggctttggagccagactacctgggttcaaatcatggttttaccacttactcgctgtgcatctttgaacaactttcttaacttctctataggaataataagagaacctacctgagtggtactattttgagaattcaatgaactatctcatataaaacacttaagtgcaagtgctcattgttaaatattactaaaattaccttaatacctgcaccatatgatcttacatacattcttacaaaaggctcttaaatccttacaaaaaccctatgaagtattattattatccccatttttcagatagggggactgaggctcagaaatggaaaggaatgcacccaaaatctaacagctgatatgtaatagagaccagattcaaactcaactctgtctgattccagagcccatacttccaattaacaaaatgatccccttttcataaagagccccagcacagtgcctaacacacagcagagactttataaagggagctatggttattatgtcattgtccctggagtttccagctgtagatgctgtagaacccagaggagggggcctctctttcaccctaaagggatctgagaagggtttaaaggtgctgggtgccaactacaggctttgcttgggagtcccaaaggtttccctcactggggcttgggatactaatatggaacctacactagcaccactaaatcagacccagaaagttcccccaggtgtccaaacacctgcatgaacaagcaggcagtttcctctaggttgacttcttgtctggccctacacatctctcagtttcatcactcagccaccagccctgggtctcatgtatgcacctgctgcttgacccagtcccaggagacactgagccttagaattgggctccttctctggaccttgccccaaaggctatttctgagtgactccctgggacttccctgacatggtaacccctagggctccaactgaacatgggtgctgtgagcaaggggaaattcttctgagtagcagatggagagtgggtagaacaagaggcagttgttctggatcagagataagcatggggtgagaaccatagtacactggattttatgtttaagcagcactgatcctcgatagttcagaactcccgcactgaagtccagcgtaggcaggtaaggacaacctggagccaggcattaatactcacttctacttcccatctgagtcatattcagagtctggccttgcctggtactttgactgcagaaggcaacccatggctaaatcaaggcacctcaagcctcatagagaaaagggaaagactcagcatttgctgagcttttactctgcactaggcaatgtgtaagtgcactttacatgtaccattaattattaggaatgtttgttaatccagtcactaaacactcagccaccaagtactaggcccagcagtagctgttaagagtgaataagacatagtttttatcctcagtaagctcagagcacctcgtttagtctttctcccaacaaccctctgaaatgagtattacttccactttatagatcttcaggtttacagagggaagtaacttgtccaaattcatgaagccagttaagtgataagatattgcttctactcaaaaaatgcttgttgactgaatgaatgaatgaatgacacagctatggctgtgactttagtcaaggagtagcaacaagaccaaatatttatagttctcaaagtgctttttcatctatcatctctttgggcctccctgctagcccatgagggaggcaaggcgggtgttatctttcttcaacatatgaggcaacaggcagagcttgggcaagaggcttgaggccacagagcaaacaaggagtgagtggggccatcctggaaaaactccagagttcccacaatgccatgtttaatcattcaaacccatgtcaagcacctactgtgtgccaggcatgctcctacccactttaaatacttaactcattaagtcttccactcagtcaacaaacaaggaggaccctgggaagataaaacaaaatatgccccattgccaaacgcctagtcaacaacactggccaaacctctactgtgtacaaggtatgacttgggccttgtagaggaggtaggggacaaggttgtgagccaaggccccaagcttcaggtaccttaaaatctctaaactcttggtccaaagatatccacatattctgtcagcctgaaagttcactcctggagagtagatccaatagcaatgacaacaatttgtttaccagtgattgcaatgtgacaataacagtaataatagtagcttgttatactaagtaattactatatgctgggctccttggtaagtgctccatgtatcttttcaactattttcatgctctcaagagtgtttcaagaaaagcgctgtaggccgggcatggtggctcacacctgtaatcctagcagtttgggaggctgaggcggacagatcacctgaggtcaggagttcgagaccagcctgatcaacatggagaaaccccgtctctactaaaaaaacaaaattagctgggcgtggtggcgcatgcctgtaatcccagctactcgggaggctgaggcaggagaatcacttgaacctgggaggcgaaggttgtggtgagccgaggtggcaccattgcactccagcctgggcaacaagagcgaaactctgtctcaaaaaaaaaaaaaaaaaaggaaaaaagaaaagcactgtatattgttacctcttttccatacatgaggaaactaaggctgggaaagattaagtatttgccaaggataactattaagcaagtgagactcaccaactcaacaacggtttgtcaaatttcgtacctgactcttaacaacgatggaatttctcccaaggaggcaaggcagacaccaggaataccaggagcagctgctgcctgagagagtggggggcctccagagcccccagaagagtcttcctaacctctttccatcaggttttaacatcacactgagatggggaggtaaggaaagaatggttaggtgtgctcaatctatccttagggcaacaagggtctggccctctttgttgaccctcaagggaagaagtttgtgacttcccatttgtcactcaccaaccctctagagagaaacagaagggggcaagggcatgggagtattttctccctggggttggggggcacacacaagggaagaagcagcagccttactggctctttcctcccctgggcaagaagcctgtacatgtgatacagtgtatgtcattcacatggaacccccttggggaaatgccaaggtaccttttggacccaagaagcctcagagaggagagactggcaaagccctgaactgcaagctaagctgacaatttctaagcattgtaactaggtcatcaggttcctggagaagccagctgtggctgggggatggggaggaaaattttgcagcctaccaagatccctacttccctttaggccccaccctccctgaaatctgcacctgctcccaaactgacccctccccccagctgagcccagctgtcaacggctcccaatgccccgccctgccttccttaggccagaaccatgggggcctcttgggcaggaggtacctgattgccacctgagctttgcagagaaggagctgtggggcagggaaggattggcctctcctagaagatatttcttgctccaccagggcagcaagaaagttaggcccctttgggcctacctagggtacccttcctggcattgtcactgcaggtggcaggagacaggtgatgtttaccctgctgaggccagagttgccaaaaggcttcaatcaatcctttgaatctgcacctggccctgagtcccaaaataacaaccagggcagcttacctgatctgcaggttgcaggtgcctctggcttttctctccctgcagctctgcctgctgagccctggctggcaagagattctttttcttaggggttactgagacctaactgcatcccacaggtgctctgggcctctccccattaggcccacctctaccatcaaccatccctctgtccagaggcctctgtcatcagccacctggtttcttccctgaccaactttattgctgacacagaccatctttggctctagccagtctgcctcctcatgatctctcaaatgcttcatacatactccaccctccagttctgtctgggtggttcttacccgtctggcctgctcgtgtgtgtgtgtgcgcgcgtgcacgcgtgtgtaactagcctgatctttttggtgtgtgtgtgtgtggcagagtctccctctgtcgcccaagctggagtgcaatggcatgatttcagctcactgcaacctccatttcccggcctcaagtgattctcctgactcagcctcccaagtagctgggattacaggcgcccgccaccacaccctgctaatttttgtatttttagaagagacgagccgggtgcggtggctcatgcctgtaatcccagtgctttgggaggctgaggcgggtggatcacgaggtcaggagatcgagaccatcctggctaacacggtgaaaccccgtctctactaaaaatacaaaaaaaattagccgggcctggtggcgggcacctgtagtcccagctacccgggaggctgaggcaggagaatggcgtcaacctgggaggcggagcttgcagtgagccgagatcgtgccactgcactccagcctgggcaactgagcaagagcaagactccatctcaaaaaaaaaaaaaaaaaaaaaaaaaagaagagacaaggttttgtcatattggccaggccagcctcgaactcctgatctcaagtgatccacctgcctcagtctcccaaagtgctgaggttacaggtgtgagccaccacgcccagccacagcctgctcttgttacattcttttcacctatttaaacccatcatggtccacatcttcctaagacataacaatgcctaacattgactgagtatatcagacaccgtgtgaggtggtctacacagtcacttattcaacaaatatttgctaagtgcctcctatgtaccaagcactctgctagatgctggggatgaaagacaggataaagcccgtgtactccgagagcttatgttttactacaggagacagatggtaaacatgtaaacatggcgacctctagggaggtgatatctgagttgatacctgaatgataagaagagagagagccctgatcagatccataggatgagtgatacaggcagaggaaaaacagcaagcctataaggaagagattactatcatcttcattaagagattagtattatctccatttacagaccgggaaactgaggcctcagtggaaattgtacaaagctacggtgctgagaaagctatgattatttaagctgtcagtgacctctctccttcctaaccctttccactgttgatgcagaagacagtctggattggcaatgcagttggctagggaaagggtgcaggttgatgatacaggctgagggtggaggcctctgggcccagtaatcaactgggtagctgatggtggaagctggcccatttggcagaggcccagggcccagcaatgcagtcaggtgggctcaacttcttccacttttggtgtttactctacaggtttggcacagtttgcctcaagccattcaccaagtgtttgaggtctattcctactgcttcaaatgagtttgcttccttaggggcagaaactttttttgtagcctaacctgtatctaataataacccttcatgttcattgagcaggccctggctgagtcctcacccaaccgcgggccctgagccaggtagtcagggtaaaataagccagtctgggcttgtaagaagcaatgacgcttataggcttttgcatcagacacatctgagtataagacccagctctgcctcttagaagatctgttactgtggacacattagggagcctctctgaaccctagattctccatcttcacaggagagcatttgtgagaaccaagtaagatgattatattgaggggataaacacagcacctggcacagagcaagtaactactcaacccatagtatctgttattattaccaaaaaacacacttacatttcactttctcattcatgcctcacttactctggtggcttggcattattctctcaggcttatggatgagaatttgaagctgatttgctttgtgttatgccaccagcaaggagtcaagctgtctcaaatgtgaggccagagttttgtctgtgtatgtgttgaaggtgattaatacatatcaactataatgaatcttgcctggtgtgtctggcagctgaggagaaggatggatggcacatgtagactgattcagatggcagagggacaccagcaagacccaaggtgtggagtatggaaacagaccattgagggatgggactcagtctcagttaccacaatatccacagtatcactagcatttagcacattacaaagcatttgtcaatatttgctgatttaacaaaagaaatgaaactccaaggacagctccaagccacacatccagctttaggagaggcagacagtattgataatactgtgttaaaagccagaacatgaattctaagtctgatgctgccatttactgtgggacaagaccccttatcttagtttcccctctggaaacagggctgaacatacccacctctcctacttcactgggaaataacttataaaaggagtttggtaaattgaaagtattatcatgcacataaaaagaataatcatgacaatacagactactaagacagtagagtgtgaatcccagctcttcttggtactagcctgtgaagctctgggtatatcacttttctctgagcctcaattttctcaaccataaaatgaaggtaacaacacctactttgcaagatttttaaggactggagataaaaaggacaggcttcagagtaagagagacctggtttcaaatgctgactctgcctctggctaactataagccctcccaaatctcagtgcctataacgataaggttgttgggatagtaacaaaaacagcgtcactaaaggctgtcacatagtgagcactggattaatgccagcagtcacctagacaatagcgcactggacgagggaacacagtggagcgtttaaaagggggaggttggaagctaccctcccaggctttgcctcttactaactgtgctactttgcataaattgcttaacctctctgtacctcagtttcctcatgtgtgaaacagggataaaagaacctacttcagagtgctgctgtgagaatgaaatctattaatacatgtaaagcactttgaacaatggctggcatagagtaagcactcaataagtgttagatactattaatagtaatgttaacaataatattaatcaccaactggagtaagagggagggactgtttatcctgggacatgggtgtcccatgaaataattacagagaagtctcagcagctgtttgtaggcaagtttttagcctcgaagactctatggaaaggacacgaggctgggggctcctgagcaaatatcccagtcccactgaccaggaggccagtctctagggaagcgagtcaggctccttggaagggacactatgttcctatccctgcctgactcgggggaacaaaggcacgtgtgtatgtgtgtgtggccagggaggagggaggggaatgtttccctttcaagagaggaacaaaggatctgaggcatagttgagtgcgttccaatcccctcccaggccagctcccattcctcagatgattgtccaacaaggttttcaaccttctagcttcctcctcaaaggtgactgggggaggggaaggcaggctctgtttcactccaccctttatcatcaatttccaagaggcaggatttatatgtgccaaacctcaagttatctcttaagaatcccatcctatgcaggggtggggtggaatctcctaggggaactcagggttaatggatgacacagggcaccgcaagcaacaggtttaatgcatctccaggggaagtccaggactgaaactgctaatgcgtgatggagccaaggagagaacccaggaattctaactgacctccctcacagcctagcctagggtagggggtaatggcctggcagaaccaagtagaaaggcattttctaaatcttgaagggatgatcacagctggaggcagaagccaggtgaaggaggaaagggtagggagcaaagaaagtaatggacaagaggaaaggcagggacacgtccaaaaaaagtagtttttggggggcggacctctagggacattgctttccagtttccacactcttgccggcagggctgggacaggaagcagtccatggaagtcatcgcaatggcatttcctgaagagctggagaaaaacctccagttccgaggggagcactggaggctgcccaaaaagctgtgtggctcagagttcactgtaaggctcaagcttggcccgagagtctcatcagggatgaaaccaaatagcagacggtcccaaaggcagtttctttatacaaaaccacaatttcaaaaatcaatatgtaaaaaaagagaagccagatgatgtgagtgaagagccctaggatgatatgaaagccttaaaagaatgaattaattcacccaatcttcagaaaaaggtggcattactatagccatttacaagttaaaagacttgcccaaggtcacacagcaagctagtagtcaagttccaatttgaaagtccaaaaactgcctcttcctcctgatgtaaccttgggcaagtcaattcatctttctcacctgatttctctcctttgaaacggagatgtcatccttcctgctcacctctctgggtggttataaggatcaaaaaggcaaggtggatctgaaagtgctttggaagctgtaaggtgttacataaatatagggtagcactattgtgggctcagtgataaactagcctgccttgacactgggtttagttaaggtgctgacatatctgtcaacaggagagagccattttaaaatataactaatgtgaaatatgctgtaatggtggaatccgccacaaggcctaaggatagagagaaccagcattcctttattgcctacttcaaaccctccatcttgcataaagggaaactggggactgggggtgaagtgacttggccaaggtgagactgagagtagaactgggattccaactccaagaccagtgcttacaccaccattgcacacaaacactgtggagctcctactacaacagaaatgctgcaagggcctgctctgagatgtgctgatgggtcactatggtatttagaaaaaggagagtggatgctcaagattccgtgaatgggtctctgacatgcgttctgtggaaagataataagaataatgataccaacatggctccagtctttatgcatctcaggtatacctcactgtgtctttaccatcgccccctgtgaggcaggtattattatttgtcccaagattcagagaggtaaaaggagcttgcataggtagacacggatgagttgggaactgaactcagacaaatttcatttactcagacagaaatactgttggagtggaagaggaccattcatcagaatatcacatttggagagaactattcccaaagaacatctatcttacttaactttgattctaggacctccaagtagttgaaaaatatggtttccaggatggctggacccatcaatataccatgtgcaagcctggtcttattctccagtccccgtctcactacacctccacctctaggtccaagccactattctttttcacctggcaattgcaccagcctcttcactgggctccctgttgccacccttaagaatacagaccaggcctggcacggtggctcacgcctgtaattccagcactttaggaggctgaggcgggcggatcacgaggtcaggagatcgagaccatcctgactaacatggtgaaaccccgtctactaaaaataccaaaaattagccgggtgtggtggcgggcacctgcagtcccagctacttgggaggctgaggcaggagaatggcgtgaacccaggaggtgcagcttgcagtgagcagagatcgtgccactgcactccagtctgggagacagagaaagactctgtctcaaaaaaaaaaaaaaaaggaatacagaccattccaccaaagccaaatcctcatcatggtctgtaatgctgtatgcgatctggcccccacctacttctccatcctcctcctcaaccattccctccccaccttctacccttttcccctttgctgtttcttctccagccacattgaccttcttgctcatccttgaaaatgtcaagcatgctccctcctgagtccattccctctgctttaaacaccctttgctgtagggtacctacatcatccacctccttacctcatttagcgcttggctcaaataaatttaggtaatacttttgttgggactcaggacataccatcccaaaatatgactgtaggaaaacaatatgccaccccaaaaatatacttctttggcatattttgaactggttattctgagaaactgcagacataagagtagctctgaaaagctgtccttttgtaaaagaaattcacatctaaaaaggaaatctacactagtaaaggtatctgtattaggaagagggctgctccagacaaattttattaccagagagactttttatttttattttttgagacagggtcttgctctgtcacccaggttggagcgcagtggcttgatctcggctcactgcaacctccacctcccaggctcaagtgatcctcccacctcagtacaccccctcaacagtatctgggaccacagacacacgccaccaccaattctttccctcaccctgccataacttgggttgctgccactcaagcccctaacagaagtcccaagccccatattcttttctgtagctcaggatgctatataagcttcaattatctgacccttctttgagcctcatattttgtaggattcctgtgtacaactatgtaattaattatttttcctccagttaatctgtctatgtcaatttaattctcagcccagccaaaggacctagaagggtagaggaaagccatttttttctcccttacaccttctttgatcactcttttaaaactgcagccccaccctcccttgctagacatgccctatgccccaacctgctttattttcttcatagcatgtacaatcatctgatataaacatgtaattatatatttattgcctgtcactcctcattggaatgtgagctccatgaggacagaaacttagttttgcttacttttgtttactgccatactcccagtatggtacacagtaggagctcaataaacattgtttgactcaacgaatgaattattaggtaaatagccactcccattattgttattctggcttgacaagggtctgtttcttcagaaatttagtgggtttctcttcaattaggtatctgctatgcccaaggcctctgctcagtgctgaggaaacaagcatggacaagatgtggcctccaccctgaggagctcctaaatctaggacagagtaaatctgttagaaatgtcttctctgcacataatttaagctctaccaactgttaacttcttttcatttatccaagttttgccaggtaccacaccaataaaaaaagactcagtccctcttccttcagatatctgaagctggtgatattctcctgggtcttctcttccccaggctaaacaaaaagacccagtgggattgcctgactcaggtctgccaactgggaacaaggaagacagactgtcggatagaggggcagaagagaagaggatccaggagtagagtgactccttcaaagaaaaaagagggagtccttagggaggactctgtggaattaggttggaggttgggtggggacagggcctctgcttaattaaggcagtaggagattatacttccgtagaaaagcagtacactgggaattacccctatgtctatccacattaaactcaggcaaaaccacagttgcttcaagaaagccccatgatggaaggctgagggcactggcaaaaccagggagactggacacagaggaggacgctcaagcccactggcctcaggacagatatctgctgggggaagggacagagataacaactgctgtttcatgcagcccaaacaaatctggggacacccatacaaaagtcaagaaaaccctccaggttccattggagccccctgaaaaaatacccgggtaattttcgacagaagctaaagggctctgtggggctactggggaaattattcctaggaagtctggaaaaccctgtgatggtaacagaattttaagagcaacctcaaatgtacactcagaagaagtaggtgtttcaagggggagcccctgagacacttctacttaattttgggacccgaatgagattactaaaaatttccacatttggggtttctaatggggtttccctaagaaaaccacagaactgccactatctgcaaagggagctgaggtgcttcaactaagcatacatccatctgaagaagccacattaggcaataagagatctacagaaactcagaccactgagccatacagcttaagaaaggccaagttatgttttctcccccaacacagttcattgctcccaacaattacgtttctatcaggctaagggatttcttcagggacagcaatcccaaagtggcaaggcccacctgggtcccttcccacattcccattggaaagcaccagaaacacttgtgtcccttcggggaaggtcatgtatacaacattccaggaaagtatcacagggactttgtttctcaaggagaaactctagggggaagagtcagttctctgagggaagctgcccattcattaaagggtttccaccctacaattatggcaggagaagggcttttgtgctagatcctttactcgagtcaagctatggcagctggctatcattattccattttacaggcgggagagacagatggacaagacagccgaacaggttcagcatttcatcaggtgactccaggcaggcagtaatctggctaagggtctacactttcagtccttgaagcatcactccaccactaagtagagatacctggggcaggccaccttctccccacacgcacaccactgtcatctattggcagggcctgagagggttttaacaatgaaaaaattggccggggccaggcacggtggttcatgcctgtaatcccagcattttgggaggctgaggcaggcggatcacctgaggttgggagtttgaaaccagcttgaccaacatggagaaaccccatctctactaaaaatacaaaattagccaggtgtggtggcgcatgcctgtaatcccagctacttgggaggctgaggcaggagaatcacttgaacccgggaggcagaggctgcagtgagctgagatcgcgccactgcactccagcctaggcaacaagagcgagactccgtctcaaaaaaaaaaaaaaaaagaaaaaattaataagcagctcactctgggcaaaaccctgatgcccacttgaaacctgccatgtctgagttttaccagtgccagaatctgaggctaccaacacgcctctgggaacctgctactgccaactatccttcccatagctacctgaacaaagccagttatcagtccagagtgagcaccttcacaggcatggtttgcttggcccaacagcatctctggctttctgggccagcatgtctaggtcactttattactccctggacaacttgataggatgaaaagtgttggctttagaattatgccaaccttggtgtaaattctcattcagacacttaactggctgagggacacctggggtcagtcacttaggcacaaagaccttcatgtgtaaactgggaataaactcaccttccttggaaggttactgtagaatatatgaaacagcatgccgtttccatgaaggaaggtaccatgcgtggcttatggccagcacctagtacactgctagcttcacagtagatgctcaagaaacactggttgcataagtagaggacctaacacagtgcctagtacttaacaggtactcaataaagactaatttccttcccctttcctgtagggatgctaaatttagaacatagccctgagtagaatagcccataactcctacccttaaggatctcccagccgcagtctccaggataattacccgatgccaccacagtagccagtcggtgcagcttggaacaggataatacctgagaggaagggggcgggtaccttctacccaggctcaaaggatcctgagtcaaatgttctttactccctggccttagggagagaatgtgtgctcagaaatggttctgatataactggctcttccacacacatcccctctgttcaccaagaggaagtgacatgtggtatgttgtccaacaggctctgatgattcttaagcaaagagatggaagatggaatttcaaccccatggagatctaataaacttacccagagttgctgtgtctaagacctctttcatatgcaccactgggcagctggcaattctctggtaggggtagccttctgcagaggctggctagcagaccaggcacctctcccagactgccttttgtttatagctggcaacaacccacctggtattaggaccactggccaaagacaatagtcaggcaaagtgggcaagcagcctcaatccctacttggagatgcctcagagggtgtgtctgcagtactggaatcctgtccctcctgtaatcagctgaacaaatatttgccccaaaagagaatcaaagcaggagggaacaggagaggtcactgcacaaaccaacaggaactatttaatcatttatccccctagagagttcatttacagaatggctttcaagtctagtcagctagctcaagagaacccaccacctttacctcccctgaccccaccccagttatctgacctctattgacttgacccccttgccttttacaagagctggcacagacgagttgaaattgcaaagaaatgcaaaatgagagagggggtggggttccagggcaaactcaggaggtctcttgctcagtggtaaagtgaagtgcctgccacaccctaggcccagcctatagacagttgcattcttgacattcctgagtccatggtgcatgtccccttccacctcagctccttcaatggatgacttattttccacagcttgatgcttttctgcatactctgaggggatagaacatctctcataaaacctgcacctccgctaggtagggagataagcaagaaaacaggactgaattcactgaagagcaaaacttgcctacagtgaccactggtaaagaagctttcaccaccatctcatcctggctcagtgatgggcaggagaactctccctccctggaaagggaatttgctggtgtcagtcactgtgctcacattatcgccaagatttacaatacactgtaaggcaaggagagcttgccacattttttagtgaaagaaactaagcctcaagaaagtaacccagcctgtccaaggtcacacagctagttacatgacagaactggaacttatacctgcatgtgaagtctgttactaaatctcaatgtcccacagagccccaaagactaggttcttgctttgccagcaaacagtgcttgaagaggcccctgggctctggccggaaagtaacaggcagagcagctggagctccccaaccgaccccaggcaatgaggtgcaaagtcccctggcttaatgtgtgacacagcaagtgctccacaaacaaggcaaccatgcagaaagtcgcacactttgggggaaatgaacttagggggcgcagtgcaaacacaatctgcacagcctacactgccccaaaatctgacaattctcagccattcaacccagtgggaactcctgcctatggccatgccctagtctgagaggagagtgccatacacgcaaactttgaaataaagggaacttgatttgggggagagaagcccaggataggactgagaccccttggggggaacagatggagaggtctgtgggtcattgatgctcatcatcttctccaggcattatactcatcacccctttgtgtgtgaaccattgtataaggtaagggaaacaccgaactaacttcctaccctcacaggtttgggacttaatgaacacataggctacagttttctttgctgagaaactggaacacaagtatggaatagtggagtcatgggggtgaccagggtgaaagatgcctgatctctgaagcacagggtcatttgtatttccaaggagttaacctcttgtggtgaaatgaggccagtcaggtttcctcaactatcaacgtctccaacaatcacccaacacaacagaaagagatacagaagaagggctgttggggatctctgaccagaggccaaagaaaagggacacacaaggggcttggttcttacccagccgccgttctcctggatccaaggctctaggtggtcattcaggtaagtggccatccaagctgcgatccgactcaccaatacctgcatctccttgtctacgctttccacgcacagtgccccgccgaaggagaaaaaggccacaatgcgaccccagtttaccccatcccggaagagttcattcactacctgttcaaagctctgatatgctgtccctggggtgatgtggagctgggatgtcaggtcactgaatgcccgccggtaccgcagttcaaactcgtcgcctgcctccctcagcgcttgctttactgctgccatggggatcacctcccgggcatccaaactgctgctgtggccagtggctccattcaccgcggggctgtctgccaggtgccaggatgggttgccattgatggcactgggggtctccatctccgattcagtcccttctggggcctcagtcctgttctcttccacatcactaaactgactccagctgtatcctttctgggaaagcttgtaggagagaaagtcaaccaccagctcccggttgctctgagacatttttataatagggatgggctcaaccagtccattgtccaaaacacctgctcactcactgagtctcgtctctggttagtgattctcttctaagatccaaagccaagataagattctgaagggagagaaagagcttcaggaaaaaaaaataattaatatgcatgccatttaccctaaaaattccattccccctccaggtaccagaactggtttctttgtgggtcttacgaaggtctgggtctaggttccaagatacttcacttaagtcaaatcgaaagcaccagtggactctgaatctcccaccagccttttctacccccgtcttctccgaaatgccttcctcggaaagtcactccctgggcagtcccccccgccccactcccgctcccccgcaccacctacattcaaatccgccttaggcaaaggcaggcaggtgcagcccccggaagatcttttgtatcacaggtcgggagaggaggtggctgcggggatgccggtaactcagccggcctcgcggtggctggcaaaaaaaccagctccggccggagggatcatgcgacccggcaggctgggagcccagaaggcgacacaggaattgcgaagctcaggaaccagccccctcgcttgcttcctcctcc

SEQ ID NO: 407 - DNA, 58396 bp, Homo sapiens; identical to SEQ ID NO: 406

SEQ ID NO: 408 - DNA, 25356 bp, Homo sapiens
cgtcacttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaaggtagggtcagcgggaaaaccgggcactttccacccccataccgaacacggccgacatggacccttcctaggcgggacagacacctctccccggacactgactcttcccagccctgatcaccaccgttccctctgtctcgggcccacattccggggctggcatttcctaccccgggatctgggcaccgacccccgaccagggtatgataccttccccaataggaacttgcttctgctcccgacccggaccctgacacttccctccctgtgcatcatgccgcggctgggaacgctgtcagcccgtcccccactgcgactcgggcactgattgttctgagcctgttgggcccaggcagatcagccccatcatgtatacctgatggatactggtcctcacaacttactgaatggtacaatttcgtgtcattccctgttaggaaccctgcctcagcccaccgcagggccctttctaccatccagacccatccctagactctgactcctgtctcactggaatctatggcaccttatgtgctcacctagatcccccacacctggcccttgcccctgcctcaaaaacaatgatctcttagagcccagtttttcacatcactttctggaaccatcccagtcagctggctcctcagaagctggcatcttggtgcctctactttccaactaggcatggacgtcttattttcctggtttcctctcttaactaccatccaaccttggacatggcctagtcaaaacctagaccttgttcctaacctgtaacccttttcccacccagcctttgaccctatctcaaagtagcccttctccccatacccccaagacaatccccccaccaaactgggcctgtctgctgggccactgttggcccctcttgtgagactgggccagactccatccctggccttcctcaacatctgtcctattggataactaggaggactccagcacatttcaccttctgcttctccctcccccttccctgccccacttcttccctatattaagccctttctagcccgttgtaccaatgacttttcacttcctggcaccctctcccttcctccacaacctcttaatctgcaccttcccgatgctcctcccccacccagacctgaggatggacctaagtggaagtcttgcccaaagagggcaggcccacaaagcagctgccacttttgaaactgctgaagctgaggttctcaaaacactacccaacttgagcagtagctgaggcctgccatcttccttccccaggagcagagaactcactactggctctgtatgcgatcagatgcaaaggaaagtagttaggcggggcttaggctgagagactcaaacatgactccattttcctttttatttggctttttctaagctgagttcaggtgatattaagcctctctactatgcctgtcaggtagacacttagtgtagagagcagttctgagataacccaggacagaggaggcgaaggacagctggcataaggctaggcagcttgatctgagctgctctccaaactgagtaattctccctggcaccttctgtacatggatcactaatctctgcagaaaacaccttccaggcaacagtatttcctgaacttccaccactgtcaggggtaagggaggattgctgcaaagatgagtaggtcagagccctgtcaccaaggaattcgggagcgtaggtgaaagaataataactagattgtgattatactacaagcaatgctacaaggtttagggagaaagattgagcacatctgggacaatgcagggaggctttgtgctagaggtaggcctgagccttgacgtagaggtagaatttcagccaggagaaggcattctaagcaaaagaaaccaggtaagcagagagaggtacggaggcaggaggctacgaggcagttcaggaaatagtggaaggtttggtgtggctggaacagagggtatggataggagaaagccttagcctctgaatacctctcccaagcatctcctgcagggcagcagggtgtggaggactgtatgaatttacaaacaggacctgaccattaagagcctgccaccaccaatgacccagatgcggtaaagcttgcaaaaccttgacgccctttgatgctcacagcaactgaggtggcaggcagagccagtttcattatcctcattgtacaggaaaagaaactgagagtcaaagaaatgacttctgaagatcactctgccatttaggggcagaatcaggtatgcctagtcctcatccagggctctctcctaacacaggtacctttaaagacaagcagcattgacctagggaaaggacagggcaaatgactccccttctaccctgagtcgtttccctggtcatgtgaaaaggagagagaagagttagtgtggggacccagttttgatttcccaccagtgttggaccccaaaaccagttgggagagagggaatgtgaggacagaatccccaagggtcaaggtgtccataacaggcagggaaaattgtgaaatcatggagagaaagaaggtagagcctccaggagtatgttgtgaagaagtagccttgggaggagcagtctcagagcagcacccatcactgtcagagtcctatatcccagacagaagcgaatatgacccaggcagtagctgcacattaaacattggtttaaagggccctcagcgaacaggactgggtgcctgctgtgggctaggctctgggctgggtaccaggagttccgggacaaagaaggccaagccctgccctcactgagcccagtcaccaaggagaaacagacatgtgactagtcaagtaaatagagctctgataggcctcctggagggggcagcagttgtctctgcatggattgggagagtccaacaggcagagcaggagaaggtggggcaggggaccacaagatgtgttcagggaggcagtgaagagtgtggtgtgagcccaggagaggggcttggatgtagtgacaagatgttcaggaagcccgtggcctttctggggaagagaatcctgaaagcaatgcagcggttaatcgtattgttacaaaaatactatacacttgttaaaaaaaaaaaaaatcaagcagtgcagaagtataaaggaaaagcctcctgggcactattccttggaagtaacccaactggctgttgagtatataacctttgagagttttttctgtgtttacacattcattgtatatgtgtctgtgtatatagacatgtaaatttatttttataaaaattggattatatagtacatatttctctacaacttgatttttttttttttttgagatggagtttcactcttgttgcccgggctggagtgcaatggcgtgatcttggctcattgcaacttctgcctcccaggttcaagcaattctcctgcctcagcctcccatgtagctgggattacaggctggcaccaccacgcctggctaattttgtatttttagtagagacgggatttctccatgttggtcaggctggtctcaaactcccgacctcaggtgatccaccctcctcggcctcccaaagtgctgggactacaggcatgagccaccgcgcccagcaattttttttttttctttaacaatatgttggccaggcacagtggctcatgcctgtaatcccagcacttttgggaggccgaggcaggtggatcacttgaagtcaggagttcaagaccagcctggccaacatggtgaagccccatctctactaaaaatacaaaaattagctttgtgtggtggggcacgcctgtaatcccagctactcgggaggctgaggcacaagaatcgcttgaacccgggaggcacaggttgcaatgagccgagatcatgccactgcactccagcctggtcgacagagtgagactccatctcaaaaataataataataataatatgtttcattatttttctatgtcagtacatatagacctaaagttaaccagacatgatggcatgcacctgtagtcctagctactctggaggttgaggcgagaggataacttgagcccaggagttcaaggctgcagtgagccctgattgcaccactgggcaacagtgagaccctgtctcaaaaaatatatacatatatatatagagagagagagagagagatctacctcatcttttatggtggggagggtaggtaatacatgcccatggtacagaattcaaaaggtacaaaggggtgcacagtgaaagtctccctgctaccccaagctgccctatttccctcctcagaggcagcccctctcctgtgtttcttagatatccatccagaaagattctgtgtctttacaaataaataggcatatacttttccctgattttttttgttgttgttttaatgagaccgagtctcactctgtcacccaggctggagtgcaatggcataacctcagctcactgcacgctccatctcttgggttcaagcgattcttctgcctcagcctcccgagtagctgggattgcaggcacctgccatcatgcctggctaatttttgtatttttgcagagatggggtttcaccaggttgtccaggctggtcctgaactcctgacctcaggtgatccacccgccttggcctcccaaagtgctgggattacaggcgtgagccaccacgcctggccagtacactcttccttgcaccttgcttttttcacctaatgtgtgttgcagatccaatcatgtcagtacatagggggtgggtgtgttctttaacagctgtatggtatcccacttgtactccagtttgcttagaatgctagttctctagtatctggtccctgggccagcagtgtcagcatcaccccagaacttgttagaaatgcacattctgaatcagaagctcaaggtgggcccagcaatgtgtgttttaacaagcccacctggtgattctgatgcatgctcaaatttgagaatttgagtccccaactggtcatttaggttgtttcagtcttttgctattacaaaccatgctgaaattaataacattatacatttttatttcacacttgtctgtgtatttgtgggataaatttctcaaaattggtgggtcgaaggctatgcacactttttttttttttttttttgagacagtctcgctctgttgcccaggctgagtgtgagtgcggtggtgccatctcagctcactgcaacctctgcctcctgggttcaagcaattctcccacctcagcctcttgagtagctgggattacaggattacaggcgcgcacccaccacacctggctaatttttatgtttttcatacagatggggttttaccatgttggccaggctggtctcaaactcctgacctcaggtgatctgcccgccttggcctcctaaagtgctgggattacaggcgtgagccactgttcccagcccacactttttatttagatagattttaccatatgatccactatagaggttgtatcagtttactttcccaccagcaatgacctcaattcttgtttaatggctgtggagtagtctgttctccagaggttttgtttttttgttgttgtttttgtttgtttgtttgttcatttgttagagtctcactctttggccaggctggagtgcagtggtgtgatcttggctcactgcaacctccgcctgccaggtacaaacaattctcatgcctcagcctcccaagtagctggaattacaggcgcgtgccactacgcctggctaatttttatatttttagtagtgacagggtttcaccatgttggccaggctggtctcgaactcttgacctcaagtgatccgcccacctcggcctcccatagtgctgggattacaggtgtgagccactgtgcctggcttctccagaggtttttaagcagatacgtgatacaatcaggtgtaggctttagaaagagctcatggcagggtgggtgataggcaggagggagaagtgtaatgttggtgcaggggttgtgaagacagcaatgcagcaatgagggccaaaggattggggtgggaagttaggaaaggtaaccttggagagctgagtgactggatgttgtggtaaagaatggagactctggagtctccagctgggtcaacagtaacagaatggcccatgaatttcagatcatttccagggcatggcgtagaagcagtgctccgagagcttgaaccgtgccaatggcttgaagcaggcatctgtcctctcttacagcttttgtttccgctctgataacaacatccagaatgtcactggaagctacatttacttctgctgtttgtgtcaggtttttcccccactttctaattgtgttttatgttgcaggatctattgtatttacatacacaaatctggttaaaaaatcgcaattggattggtaaagaatcctagcaactttttagtatttttgtaactacaaagattagctgttcagttaccttcaggattctgttcctcagaaaggttgcaggcttcccaagtatcttcctgttaaaactttccaaccgaaatttccagataggaaagatagaaatcttctaggaaacagctcccaagagtttggggtctggaactggactgcctcagtttcagtcctggctctgccactcaccagctgtgtgacactaagcaagttacttcacctctctagacctccgcttcctcatctgtaaaagagctattaaaagtacctgctggccaggcgtgatggctcacgcctgtaatcccagcacttcgggaggccaaggcaggcagatcacaaggtcaggatcttgtgacagaccatcctgactaacatggtgaaaccctgtctctactaaaaatacaaaaaattagctgggcgtggtggtacatgcctgtagtcccagctactcgggaggctgagacatgagaattgcttgaacccaagaggcggaggttgcagtgagccaagattgcaccactgcattccagcctgggcaacagagcgagactccatctcaaaaaaaaaaaaaaaaagtacctgctttgtggggtttttgtgaggatgaaaacatgtaaagtacctagaacagtgcagtaatgttattgttattactattatcgtcagatttcaggtctcccattctttttttttttttttttttaatggaggcagagtatctccatgttgcccatgctggtctcaaactcctgggctcaaccgatctgcccaccttgacctcccaaagtgctgggattacagtccagtctcccattctgactcagcattgcagcatgggatatttataagtcacccgcaaaggagaccagagtcctctgtgtaatggagaggatctgtccaaccttggtttgtcactgaataagattaggcctcttcccacccagggtgctgagctgaattgaaaggaatatgtggaaatgagccataatgctggtttgtaggtgaagccacagagtcctgcgtgtcctttgacagccctgagcctctgcatgtgcatatctttctgcctgataagcacttcctttccttgtacacaaagcacactcctcaagccgggcatggtggctcacacctgtaatcccagcactttgggaggccaaggcaggcagatcatctgaggtcaggagtttgagaccagcctggccaacatggtgaaaccccatctctactaaaaatacaaaattagctgggtgtggtggcaggtgcctataatcccagctactcaggaggccgaggcagagaatcacttgatttgtagtgagctgagattgtgccattgcactccagcctgtgcaaaaagagcaaaactccactaaaaaaaaacaaaaaaaaaaaactgacaagctgactcctaaacccagtcagcatttgtctggctccagactaccagacactgtgcttgaccatcaaggccttgcttaagtggtacctgctcttgccacctctgactcccttacttctctgcagaaatagtgtcttgttggctgtgtcgtgattccgttttgcataataatgatacaaatggtgtatacggtttaaatgatgactcgagatacaatgctgagtacttccaaagcagaaatcagaatcctcacaacttgttttacagctgaggaaattgaggcttagagaaaaaaaaaatcactttcccaaggtcccacagctgggaagtagagctgggagtccaaatggacttcctgatctcagagtcccttcataactgctgatgttcatactgtgtgtcacagtgatatacatgtctattgcatcatgtgtcacactacattataatagcctgtttggggttttttttgggaggggggcttttttttttttatgagacagagtctcgctctgttgccgaggctggagttcagtggcacgatccccactcactacggcctccacctcccgggttcaagcaattctcctgcctcaacctcctgagtagctgggaccataggcgcacaatatcacacccggctaatttttgtatttttagtagagacggggtttcaccatgttggccaggctggtctttttttttttttgagacagagtctcgctgtccacccaggctggagttcagtggctcagtctcggctcactgcaacctccacctcccaggttcaagctattctcctccctcagcctcccaagtagctgggattacagatgcacaccagcacgcccagctaatttttgtatttttagtagagacaaggtttcaccatgttggccaggctgatctcgaaatcctgacctcaggtgatccgcccgcctccatctcccaaagtgctgggattacaggcatgagccaccacgcccagccagttttgctgtgcattccataaaatagaatacgtgttccctgtaatatgtatcatgtcacagtattaacctacctgcctgtgagtgtttcaagatcaggaactcatttttgtacccatactactgctacacaggaaatgtattgaatgtgtggagatgctcagaggggatgaggaacttgcccaagtcccacagcacactgctggcaaaagcagaagccaagggttgggagagaatagggaaggaaggaaactgggcctctcatgtgggtattgttcacccaccccactcccacctcctagcaaagctgtccaagtgactcacatggagctgcctccagtggctccagaggggagggtctcccttccagcccagagcctgggctgcctcagccatgcataggcaagggtgtggttaggggcctcctcactcacctctccctgatagtcacaacccccaatacaggcacagtactttagtttgccaggctgtttcgcatcccatatcttatttgctttaagactcctatggggctgggtgtggtggttcacgcctataatctcagcattttgggaggccaaggcaggaggatcacttgatgccaggagttcaaggctgcagtgagctatgatcctgccactgcactccagcttgggcaacagagagagaccctgtcacttttctttaaaaaaaaaagaaggctcttggaccttttttgaagtgaggctagagattgtcctcctgtttgacagagaagtaaacccagtcactcagcaagccgttaacagagcaaggaataccttggatacactttatgtgtagcattttacttatttatgaactatatctgtagggagaattcccacagatggaattgcttggtcaaagggtatgtgcatttgtaattttttgtgtattgcctagttgctttctacaggaagacagattgactcccataggcagtgtgggagactacatctttccccgtagccccaccgactcagtatgttacccagtgtgtggattcttacctttccgatagacaaaaaacagaatctcagtgtgctttagtttgagctcttattaagagtgagaataaagactttttttattattattaagagccatttgtagttcttgttgtgtggcttttttttttttttttttttttagatggagtctcgctctgtcgcccaggctggaatgcagtggcacaatcttggctcactgcacgctccgcctcccgggttcatgccattctgctgcctcagcctcccgagtagctgggactacaggcgcccgccaccacatctggctaattttttctatttttagtagagatggggtttcaccacgttagccaggatggtcttgatctcctgacctcacgatccgcctgcctcggcctcccaaagtgctgggattacaagcgtgagccattgtgcccggcctctgtggctcctctttttgtatctttgggcatgtggaaatttcagtctaatgcatcctgccaaattaccctcccgaaaaggctggacaggtttatactttaggccagtgctgtctatgtatttcctttagccaggcacagtggtgcatgcctgtaatcccagctacttgggaggctgaggcaagaggattacttaaacccaggatttcgaatctagcccacacctccctctcctagtagtcattttgtgggcttactgccctctgccccatctccttccctctttgcaaccttccacctgggacactagggcctctctgagccagtcttaccttctccagacaccctctctcttagcaggttttttattgttggtttttgtcagccaaaatatttgtgagtctccataactgaatgtgatcccttcttctagggatgctggtgctttacttgcaagatggatatggtgatagtagaatctcaggcactgtaatgagcctggctactatggaaagaacttcagcatgagcaggagtctaatctggcattgctaggacttttggtagccatgatataaaacagttgcagagtaggcttgtcccagcggggaaatctggaagggcttcgtggcagtgacatttactaggcccttgaggactgtgaggattttgcctagcagagagagggcaggtagagaccactgtgatcctggaagcttttgaccctgtttggaatacaaatttataccaaaaaaaaaagaaaaaaagaaaagaaagaaaagaaatttataccagtactatatatcattgataaattttcattagaaagttctggccaggtacaatggctcacacctataagtccagcactttgtgaggctaaggcgggtaaatcacctgaggccaggagtttgagaccagcctggccgacattgtgaaaccccctctctgcaaaaaacacaaaaattagccaggtatggtggcatgtgcctgtagtcccagctacttgagaggctgaggcgggagaattgattgaaccaggaggcagaggttgccgtgagccaagattgcaccactgcactccagcctaggtgacagagctcatgagactccatctcaaaaaacaaaaaagaaagttcgtcataaatcctttttttttttttttagacggagtcttgctgtgtctcccaggctagagtgttcagttgtgcgatctcagctgactgcaacctccacctcctgggttcaagcgattctcctgactcagcctcctgagtagctgggattataggtgcccgccactgcgcccggctaatttttgtatttttagtagagacggggtttcaccatgttggccaggctggtctcaaactcctgaccttgtgatccacccgcctcggcctcccaaagtgctgggattacaggcgtgagccactgcgcctggccttctttggcataaattctatgaagctaatctattcctatgttgatctgttactccattttcaattcttttccatttttataatactgaaattattttgattgcattcagttctttttcatgtaaatatttatccttcatcagttctttacccacatcacattcttgccaactatagcatctgccattataaatttaattgtggcttttatttttaccattttcaagtctgccagtcaaatttcttaaatttaagttttgtcaagatttgcttctcctcacagttggtgtctccctatgtgcagtttcagccattgtctgtcttgtttgttgttaatttcaactcataatattcattacctactggatgacagaatagtcatttttccctcttggctgatccattagaaaactgaaaacaattttcttcgagaggtctgaaactgctgtggcatcactggtgtccaggttttcttctctcagttattccatactggaatggcctctgccatagcccttctccccagatgtgtcacacatgccctgggttctccttggtctcttgatcagggtccagatctcctcatggtagaatggcaggatcagccaggcatggtggttcatacctgtaatcccagcactttgggaggccgaagcaggtggatcacttgaggtcagttcgagaccagcctagccaacatggtaaaactccatctctgctaaaaatacaaaaattagctgtgcatggttgtgcatgcctatagtcccagctactcgggaggctgaggcaggagaatcgcctgaacccaggaagcggaggctgtagtgagccaagattgtgccacttcattccagcctgggtgatagagcaagactccatctcaaaaaaaaaaaaatggcaagatcagagcatcttgccccaggatgaggcaggcagcatccctagccaagggaatagcattagcagagccttgcaggaacatatgggaaccagccgtgctgagccattgtcattcttctctcctctagaatgcttcagacatgcctgaaacaatcaccagccgggatgccgcccgcttccccatcatcgccagctgcacactcttggggctctacctctttttcaaagtaagtcttttgccacctgttgtgtcatttgatctaaatgactttatcttattttgttttatttttcccatcacaagaaccatgcatgttcatttatagaaaataaagaagaaagaaaaattaataattcacccatagacctacccaaagacaacaactgttagtgtttgggaccctttctcactagtccgtatttcttttctccatgtagctttttgttttgtttttgtgatatcagtttggtttcattgtactgtttatgttgggatggggtatagcttgtgctcagacatacctctaccatactaatggccttttttttttttttaatttatcgaggtttattttcccaataaaagttatgcaggctcagtgttgaaaacctggaaaacacagaaaagtaaaaagggaaaaacagcagtcatccaaaaccccactaccagagacagtcacagtttcccttcggaggtgtgtccttccactgtttctccctgtgcatggtttctccgtagctgtgaccacatggtgtattcagtttgtagctgcttttttcacttcacattaataacatcataaacattttctcatgttactgcaaaccttccttagttgtactattttctggattataaaaatatattcagaaaaactaaagaaagtatatcaatagagggaaaaataaataccacaacacagaagtagtcattaacattttggcatatctcatttcgggctttttatttatttattttaggacagagtctcactccgtcccccaggctggagtgcaatggcgccatcacagttcactgcagcctcaacctcttaggctcaagagatcctcctgcctcagcctcccaagtagctgggattataggcacgcaccaccacaccctgctaatgttttcttttttgagacggagtctcgctctgtcacccaggctggagtgcagtggcgcaatttcggctcactacaacatccacctcccaggttcaagtggttctcctgcctcagccagctgagtagctaggattacagacgcgcgccaccacgcccagctaatttttgtatttttagtagagacagggtttcactgtgttggtcaggctggtctcaaactcctgacctcatgatccacccgccttggcctcccaaagtgctgggattacaggcgttagccactgcacccggccaactttttcttttagtagaaacaagatttcgctttgttgcccagtctggtctcaaactcctgggctcaagtgatcctcccacctctccctcccaaagtgctgggattacaggcgtaagccactgcatccatccctttcagccttttaataagtgtatgtttagcattattataatcataactgtagtgttagatcttctttttgttgtttatgttaggtttttctttgtttattggtttgtttagagacagggtctcactcttgcccagcctggagtgcactggtgcaatcatggctcactgcaacctcaattcctggactcaagtggaaaaccgactgattttgttttattgtattttatttttagagacagggttttactatgttgcccaggctggtaacaaactccttggcctcctgaagcactaagattacagatgtaagccactatgccaggcccttgttttgtttgttttgttttgtttttgagacaaggtcttgctctgtcacctaggctggagtgccatagtgcaatcatggctcactacagcctcaacctcctgggctcaagcgatcctcccaccctgcctccagagtagctgggactacaaggcgtgcaccaccacacctagctaattttcatatttttagtggagatggggttttgcatgttgcccaggctggtctcgaactcctgggctcaagctgtccaccctccttggccttgtaaagtgctggtattacaagcatgagccaccacacctggcccctttttgttctttttaatagtacgtcagcttttttcctggtcattgaaaattcctcaaggatgtctttaatttacatcttaaaatgtaggctggacgcagtggcccacacctgtgatcccagcactttgggaagccgaggtgggtggatcatctgaggtcaggaattcaagaccaccctggccaacaatggtgaaaccctgtctctacaaaaactacaaaaatccatcctggccaacgtggtgaaacccggtctctactaaaaatacaaaaattaactgggcatggtggcatgtgcctgtagtcccagctactcgggagtctgaggcaggggaatcgcttgaacccgggaggcagaggttgcagtgagctgagatggtgccactgcacttcagcctggcgacacagcgagactctgtctcaattaaaaaaaaaaagtatcaattaaaaaaaatatgtacatgtaggcctggtgcagtggctcacctgttatcccagtactttgggaggctaaggtgggaggatcacttgagctcaggagttagaggccagtgtgggcaacatagtgagaccccatctcattcataggtaaataaataaaccgattcatcaataatgtacatcatttaaaaaaatttgttgccagcctaggcaacagagcaaaactccgtctcaaaaaaagaaatatttttttcaacctaaagtacaaatgaaccataatcctctccccaatacagtttcctgtgattctgtcatgcataaatctatacttatgttaaattatatatatttttatatgtatcaaatacatgattcttaccacggaggtatttttatatcaacacagtcaaattaccccattctttcattctttttttttttttgagacagagtctttctctgtcgccaggctggagtgcagtggcgtgcgatctcagctcaatgcaacctccgcctccctagttcaagcgattctcctgcctcagcctcccgagttgctgggactacaggtgcatgccaccacacccagctaatttttgtaattttagtagagatggggtttcaccatgttggccaggatggtcttgatctcttgaccttgtgatccgccttccttagcctcccaaagtgctgggattacaggcatgagccatcgtgcccagcctctttcattctttttaacagctgctcatggttctgttttacagtgtaccctgagggtatttaggtctgtccagtgttggggtatcatagcagtattgtcgtgaacacttcatacacataatttgtgcacttattttcttcaagtctatctgcagtaggtctaccaggtcaaatgcatctccatttgtaattagatagtgccaaatcaccctccaaaaagattgtgccattttacattcccactgacagttacaagtgtgctggcctacccaggcgctcacctgcattggataacaccaaaatttttagttttttccagtctgtgagtgaattaaaaagattttttttcttttttgagatggagtctcactctgttgcccaggctggagtgcagtggcacattctcggctcactgcaacctccacctcccaggttcaaacgattctcctgcctcagcctcccaagtagctaggattacaggtgtgtgccaccatgcccagctaatttttgtatttttagtagagacggggtttcaccttgttggtcaggctggactcctggccttaggtaatccacctgccttggcctcccaaagtgctgggattacaggtgtgagccactgcgcccagccaaaaacataattttttaacacctgtttcctatttcatagctccctcattttggatcggaatttttttttttttttagagatgaggtcttgctctgttgcccaggctggaatgcagtcacataatcgtagcttactgaagacttgttctcctgagctcagatgatcctcccgtctcagcctcctaagtatttgggactatagacgtatgtcattacatccagctataaatcctctttttttgttgttttttgttgttgttattgttttgttttgttttttgagacggagtctgtcacccaggctggagtgcagtggcatgatcttggctcactgcaatctctgcctcccaggttcaagcaattctcctgcctcagcctcctgagaaatgctctttttaatggttacagggtatccccacaagcaaccagcctgggcaacatagcaagaccccatctctagaaaacatttaaaaattagccagacatggtggtgcaggcttatattcccagctactcaggagattgaggctgaaggatgacttgagcacaggagttcaaggctatggtgagctatgatcacaccactgaactccagcctggacacgaatgttaccctgacaataaaagcagaaaaacatccctataagcagatacagcacagttgacttaaagcatccccctcactttaaacagaaaatgtcattctgatttttactctaagaaataagagtgcactaaataacattggctattcacagattttttttttttctttttttctggacctcaggtaaagagctgaatttaggccgggcgcggtggctcaagcctgtaatcccagcactttgggaggccaaggagggtgtatcacgaggtcaggagatcgagaccatcctggccaacatggtgaaaccccgtctctactgaaaatacaaaaactatcagggtgtggtggcacacgcctgtaatcccagctacttgggaggctgaggcaggagaatcgcttgaaccagggagtcggaggttgcagtgagccgagatcgtgcccctgcactccagcctggtgacagagagagactccatctcaaaacaaaacaaacaaacaaacagctgaatttatcaaatgccttggttcatagcataccatccttggtccatgccaggcccccctacttttttttttttcccacttcactccaatatccacctccatttcccaccttcatttctctctctgccagaggcagctgctttaatgcatttgacttctgtccttagatgtgtatgtttcttataaaatatgtagtgttggtatatctgtgtgtatgagtgggaattgcatttccataaatagaactgtgcattgatctccctctgtttccttttccgctctctgtaccttaagatctctccgtggctctgtgtacatccagccattgcttctgcctttgcttttggcagatatttctgaagtcttgagagaccttctaacatttttagtatttaggattctttccttagaccagatgctcccaaaaggaatttctggcagcaatgggtgtgagcatttttatttaaggcactggcttcctgttgctcagtctttcctcctctctgggcaggtaagcctcagtctgcctcgtgccagaagcacagagtataccccatgcctctagagtgtccccagtaagatttctgaaaggcagctgcctggacagcacagccactgggctcctcctggcctcccccctgacatctggctggttggtttgcttaacagaaaaacagcccaccacagcggctctccctcagcccttttcctcccctcctcctggttggggcactggagtttgtaactgcattgaacatttttaaaacttcagggctgagtgtagtggctcacgcctgtaatcccaacgctttgggaggccgaggcgggcagatcacctgaggtcaggagatcaagaccagcctagccaacatggtaaaaccccgtctctactaaaaatacaaaaaagttaaccgagcgtggtggcccatgcctgtagtcccagctacttgggaggctgaggcaggagaatcgcttgaacccaggaggcagaggttgtggtgagccgagaacatgccactgcactccagcctgggtgacagagtgagacttcgtctcaaaaaaaacaacaacaaaaaaacttcatattttcctgatgcctcaacatcccacaaataggccatgaacactttgcccaggtgaacaggtgccagtgtgataaggctggtccctgcgacaagttccctttcttgccctcctctactctgacctagtgacattcagacacatcagtgagatccccttttgcttgtgtctttcaccctgagccccaaagaaggcacttggccgtgggtctccttctgtaggacctgtgagtataataaatcctttcatttcatatgcctctctctcaaggactttcacactgagtttagaatgatcccatcctcatcaccaattgtgttgtaaaaaagatgttccccttgtgaggtttttttgtccttgtttttacaggcagggtcttactctttcacccaggctggagtgcagtggtgcgattgtagttcacaataactttaaactcccaggctcagttaatcttcccacctcagccccctgggtagctgggactacaggcatgcaccaccacgcccgcctaatttttttttattttgtagagatggggtcttgccatgttgcctatgcttcttgaactcctggcctcatgcaatcctcccgccttggcctcctaaagtgctgggattacaggcgcaagccactgcacccagcccactttatgaagtctttaaggatcactcgcacacagccacagaaactatgctcagagaggcttatgaaattacaggatttactatactcacatgttctagagaaggaggcatgcatgccacacagggggccatatgggaggagctccaaggaagccactcaaccaagcaggtagggagaagggggagaggacagaaggaaggaaggagaggggaggacccctgggcaagtgcctttgttagggctcagggtagtacaagcaaagggcatgaggggatttaccatgtgtttgaatggtattaggtcatagaagaagaagaccagaggctgggcaccgtggctcacgcctgtaatcccagcactttgggaggccaaggcagcagatcgtttgagcccaggagttaaagatcagcctggccaacatggtgaaaccctgtctctacaaaaaatacaaaaattagccaggcgtggtggcacacacctgtagtcccaactacttgggggctgaggcaggaggatcacttgaaccctggaggtcgaggctgcagtgagccaaaatcaggccactgcactccagcctaggcaacaaagtgagaccctgtttcgaaagaaaaaaaagaagaaatgggccgggtgcagtggctcacgcctgtaatcccagcactttgggaggccgaggcgggcagatcacgtggtcaggagatcgagaccatcctggtaacatggtgataccccgtctctactaaacaaaatacaaaaattagccgggcgtggtggcaggcgcctgtagtcccagctactcaggaggctgaggcaggagagtggcgtgaacccgggaggcacagttttcagtgagccaagatcgtgccactgcactccagccttggtgacagagcaagactccgtctcaaaaaaaaaaaaagaagaagaggagggccagaaggagaacctgggcagaatgttcatatcctatttgtggggatgttgaggcatctgtaaagtaagtttttaaaataagttttaaatttgcacaatatagtaatatttcacaaaatcatagtatttactttatcccaccttatttaaaattgattcctttgaggcaactcaaaaaattaaatccaacagcataagaaaaacagaagaaatagagttaaaggagaaaattaaaataagataaaacaaggcttgggtgaggaccacacccataccccatgctctaaagcctgtactcttgctagaaatgggcttagttgtggctctggctttttagcagccaaaacacaaaggaaagtgagacctggtgcccaatccacatgggtcacagtgaaaccaacaagaagctcagaggtgtggcctgagagtgatttgtcccaagggctcagactgaaagaatgcaatgtgagaggtatgccacatcttcataaataaagcacaatccatatgcctacaaagtctgctcataggtctttttcttgtagcactaacatggaccaccaatttgcccttccattcagtcattctgcatttattgagagcctgctacatcaggccctggctgggtactggggatactgaagtgagaaaaacagctgaccatccctgtcctcaagaagcatcttgttaagtggtagagacagacaccaatcacacagatagatgtgaagttacagctgtacaaagtgctgttaaggcgaggtccatagcaccaggaaagcatggaagaaccagctcagggtgaacctacacccaaggtgaactgcccaagccccttatccacaacagcacctgcattgacctagctcagccgaaactccaggagtcatccttctccctgtccccccaagcccttgtatccagccccttcacacgtcttgcagctccaattccagaacggatctggaggctgggtgcggtgggtcacgcctgtaatcccagcacttttgggaggccgaggcagttggatcacctgaggtcaggagttcaagaccagcctgaccaacatggtgaaaccccatctctactaaaaatacaaaattagccgggcatggtggtgcatgcttgtaatcccagccacttgggaggctgaggcaggaaaatcacttgaacccaggaggtggaggttgcagtgagccaagatcgcaccattgccctccagcctgggcaacaagagcgaaactccatctcggggagggtgggggtcaggggagcagaacagatctagaatccttccactgctcatcacttcccctccatccccccaagccagggcaccgtccccctctcctgctccctgcttccactctagccctgcagggtcttctacacagcagcagagaagtcctctcatgctgtctgatcatgtcaaaccctgccatcagcactccagtaccagcctgtctcatgcaggcaaatctaaagactttcccatggcactgcagggtctggctcccttttcccgcccagcctactttcctgacactgtccccatgctcccttagctctgggctcacaggccctctgtagtccctgcacacatgaacattcacccacctcaggacctttgcacctgctcccttcgtttatgacgctcctcctatgtcctctcctccagaaccttccctgaccacctgtctaaaatagcagctctgccctttcattctctatctccctgccctggtttgcttttcttagtgcccattaccacctaacaatacatgtaactgtttctttcgagattctttctccctcactggcccatgacctctaggagagcagcgactttgcctgattccttgctgaatcactggtgtctaggacaatgccttgcacgtagtaggcaatcaatcagtatgggctgaattactgaggggttattgtctcatagaaactatgtgagcaaagcttccctgatctgggagctaaagaaggttgagtaagggtggcctcagtgaagagagaagagaggagaacatctcaggcagcaggagagcttgtacacagctgcctgtgggtgggcatgtagcacacacatcatactgcaaaaaggccagtgtggctgcagtgtgtagagcaagagcatgtgtgagccaaggctcaggagacttgtggtggccaccacgagggcaagaggccaacaggtggatgtgagctttcggcttatgagagcagaggttagctgcggagaggcttccagtaagggagtgacatgatctgacagatgttcagcagattccaaaacagccctgcttgagagtggccaggttccctataccccacacaacagcacattattcccttattccctccaggttagagaccacgatagtaacaaattcatcagggatgcagcaaacatggtgtaccatggcatagcctttccaaagtctagaattaacatgtgaccattgactggagcattgtgacagaatatttctcaagtttcacctaacgacgaaaagaccaagaagcagctgtcagggatgctgtcatagcttcagccatcactgcaggaggagtcatcacaaagcagaatgtggagaatggagtgggacagatgtcttgtaactagcatgcttgcggcctgggtggccactctgtaggggatccctggatgattaaacagggagaaggaaatgtggaagagcgagttctgaggttccaacagctctcctggggctctatactgaagactcccttatcccttcagaacccctgtgcagcactttgagcacaaacataattgcctccctccagataatggagccactaaatgtaaacttacaaacccctttgcgaggtacagctgggggcttgaggtttctcacctttcccccacagctgcagaaactagaatgccactagtattgtctgagactcttcctgactgtcccccgactcaagaagggtgagaccaacctccagaagagacgcagggactctggtttcctcacagccactggcaaccctaacttcctgtttctctttgtatttctgcctcagatattctcccaggagtacatcaacctcctgctgtccatgtatttcttcgtgctgggaatcctggccctgtcccacaccatcaggtcagaaggcatctctctgcaacatttgaagcagctttctcgggaaccagtacagggtcttggatgagaacatgacttttggcatcattcagagccaggtttgaatcctggctataaaactcaagggactctttcccctgcacactgtagatgactaggacaagaacaatgacctctctgggccacagtttccttatagacatgatgaggatctggtgggtgtttccaccaccacagctgttgggaaagtgatttgtgagcagtaatgtcatgttagttgtgacagtactcaggtgagtaacaccagtaccacctgccgggtgttgtggcctagctgtgtgctaagtgccatgttgggctcctcacacatgatcgtgtttcgtaaggagccagaggcagcatagtgaaaagttaggagcgtgggctctggcatttgactaccttactttgagtccagactctgccacttaatagctctgtgatcttgggcaagttacttaatctctctggcctcaatttcctggtgaatgtggagaaaaataatagtgcccttcccatggggtcatgtggaaagcttttagcacagtatctggtgatttaaagtgttcagtaactattagctgttactgtcattatctgtgttaacctgccagacaaccttatatgggttgcttttgctttcacacctgtatgatagtcatggaaactgaagcccagagaggttaagaaatttgctaggatcacaccactaataagcaacagagccaggattcaaacccaggtgtggctccagagcccatcctcttcccactgctaccctaactcaaactgccacatgctcgtgtcctttcagtggggagagtggttcattagagggggttgctacttttattttggacaggccagttctccattctgcaggactatcccatgtattacaaacagttggcaaccttgccctgctcaccaaatgggagttgcataccagtattccccagcttgtgactacagagatgtcccagtatgtttctttctgccccgttgaagaggtgcagcctcaggctgagaaacactgatagaccaagaggtggccagggttcccagaaggaaggaactcaccttgaacttagctttctttgaagggtaggaaacctggaagacgtacaaaggagggagaggtcaggtgctagaaagtttgtgcacattgagggcatgggcagaatctgctcccaaaagcattgaaagccaatatgaggccaggtggtggctcatgcctgtaatcccagcactttgggaggccaaggcaggcggatcacaaggtcaggagattgagaccatcctggccaacatggtgaaaccccgtctctactaaaaatacaaaaaaattagctgggcatggtggtgcatgcctgtagtcccagctactcaggaggctgaggtaggagaatcattgaacctgggaggcggaggttgcagtgagccgagattgcaccactgcattccagcctggcgacagagtgagactccatctc

SEQ ID NO: 409 - DNA, 43233 bp, Homo sapiens
tcaagctgggaattaggcaaacctgcctcccgttttatttctaaataacatagttacaatgataagaagctacacgcctccctcataattagcgtccagggaaattccttgtggacaaaggacagacggaactggaagtcatccctctggggctcccctgagacaaacgcttatatgattgccccgttcccttactgtttacataaaaatgcggattcactgggccagactcaatcgtgtattcagtggaaggctgactgaaccaatgtacgccatacacatactgatcttgtgtctccctaagatgtataaaggcaaactgtatccccagccacctcaggcacctgttgtcaggacctcctgaggctgtcacaggtgcatccttaaccttggcaaaataaactgagactggtctcagatatttggggttcacaaaggcgtgagacggcagggtcctgaggtctgaggcgccgtgggcgaggaggagggtcctgaaatctgaggcgccgtgggcgaggaggagggccaagcacacgccagggtcaggtcctgggcaggtggaattgtgcagtccccctgcgtctgcaggtgctgtctgtctggcttgggcagggttgggggaggaccgaggccagagccatccttcctccaggcacttgcagggccaaccggagattctaggcctggcctgagtctgcgcaggtgctagtgggaccagaggcacttcttgggaatggattctggaggtgtcagacacttccctaacttttcacagcccggaggtgcccagttctgggaaatgaaaattgagaaaaagaacatgcagttattcaagctcttctggacccagcagcagcgggcattttgttgttgctgttctgagacagtctcactctgtcacccaggctggagttcagtggcgcgatcttggctcactgcaacctctgccttccgggttcaagagattctcctgcctcagcctcctgagtgagtagctgctgggattacaggcacgcgccaccacgcctggctaatttttgtatttttagtagagacggagtttcaccatcttgaccaggctggtcttgaactcctgacctcgtgatccacctgccttggcctcccaaggtgctgggattacaggtgtgagccaccacgcccaaccatttttgtatttttggtagagacaagggttccccaagttggccaggctggtctcaaacttctgacctcaggtgatccacctgccttggcctcccaaagtgctgggattataggcgtgagccaccgcgcttggcctcgagcagttttgatgtgtcccctgcccaggtcaaccccggaccccaaccaattggcctcagtgtggggaccacctcggtccaggtgggcagctacacagacgctccccaggaatcatgggaacttgggagatggcaccctcttgactcggcctctcagctctgaaggctgccattggagaaatgagaacttggtggggaggtcccgggtatgggggatgcagctgccaagtggctgagggcctccgagggccagcagtgttagaaagggcaggcggtcctcccaggagggcccaccctgagcttctcaactcatcaccctctcctgcagcttcagcctctcaagaagcctttcccagggagaagccagtccctactgcgctgctgggctcagttcagtgcggtgctgagcggagcccgcacccctccatcgcctgggtgtgtgtggacctcacagtgcagccttgcttagcggaagccttgcttgatgggagggcacttttcctggcaacagaaagggagacttatgccgctaagaggagccttcttggctgaaatgagtgcagtttggttctgtgtccccatccaggccacttctgtgccacgtcagacgccgcatggccctgagggcactttccggggacagactttggattctgggtgctgctcagggtactaaggacagtctccagccctaggcggcagcagggatgccgcatgagtgtccctgcccccttggccaccagagcaggagtgggtttgggtgaggaagctgctcccaaactccaggggcagcagaggcagccgcagggtgtgtttgagtctggatgggggatctgcatttctcaaaggccgctcagctgtcccagaagcaggggtccaggtggccacactccctctcctctgtgccagagacgccactgagcccctctcctggggctggcctggagttggcggggacagagggcagggaaggggtaaggagggcccccaggcttcacacgcgtgtctgtgcatctcccccatggctctgctcacggtggcatctgggcccctcagaccccagtggctcagctcgccaggtctgagttggcacttttccccctgcagagagcacaggtgtggcggtgggggcagttcccccagtgcccaggagatggcagtggcagccaggctgtgtgcgcccacctcccctgccctgtgcccactgtctccatggcaggtgtggcctgcgcccgtggagccactgcagcctgggtcgtagagaaggacccagcagcacggagtgggattgggtgtggaaggcagaaggccagggctcctccacggctggtggccctgggctcctggggccccgagactcaggggtcctgagacagggacctccctgctccaccactgagtccagaggcggggacgccagctgcccaggtccctttgaaggaagggccctgaatatcttcctatgaaacttgccaggcacccccgccccccgccccccaactaacggaggtggccctgccctgcccagtcctaaataaccctgcagggtggactgtccctgggcagggacaaggccatctgccctccatggtcctcactgctggtaggtgctcccgatggccggtgctctcctgttacatccgccggcccacgctgtggctccctggctgttcagagccaccaccttccttcccacggcacggcgggcacccagcggctcccacgctgcagccgggtctggccctggaaagaggcttcagctgggccttttcgcccgcacagcaggagcccaggctgaagtctgcagctgccgaggggccttcttcccgaatcctgcgcggcagatccaggggctgtgggcagccacgcccagcccgtgtaaacaggtgagcgacggcccaggggcctcgaggctgggctcggccatctccactgtgctcggtgggctctgggcacccaggagcgacaccgcagacctgtgtgtggctcgtttttgccgactagagcgagggccgcacgtgtcccatctgaaggagctgtgaagacctgccctgctgggacccacatcagctgtgctgggaaacaggcctttgcggccactgcacacgcgggatggctgggccgtccacatgccaccctatgggacccccaagcaggggacagaaaagctgctcctgagaggccctgactgctgcggcccccagggctggacaagacgacgacgcatcctttgtggcctgaacacagacttcagtgaaactttggaggcacgtctgtgcttgtgtttctggccgatgctggcgtgatgaggccgtttctctactggaggtgaacaaggcctggtcttgtcaggctgcacggaggtgctgctctgggtgggtgcctatgagtgagatcaggtctgatgcgaaggtctctggggctggcccagcatgaaggaggcacaaatgagaacctcgcaggtgggccctggggccgccgccactcaacagtgcccaccagcccacccgggacccaccgggcagtgccgttcctgcctcggtgccttcagagcccgggagtttggaggtcatcacagggcccctgcaaggagaagctgcccgtgtgggagtcgaggaccaggggaccccggaccctctcacgcgccctgctgtccctcagtgacttgtggggggcaggagaggggccttggagctccccagtctcagctcagccaggcagaggcccgggtggccggctgtggacctgcggctgccctggtgcagcgttgttctggtccccgagtcgcttggctcctgcctcccgaatcccggacgccgccgcgtgtgctctgaggcacgagggcctcaccactgacggaggcggggaagcacgcctgcctctgccctgtgctggccacggttcatcctgggccccgggtgggtggctgcagccccggcaaagagacggccgcccacacaccagccacttaccatgaccgcccagttgcacacgttgagctggggctgcgcggggaccaaggcctcctggtgctgctggacgaccgaggtgatcctgctgagggcctcctggtactcggcgctggcaaagctggggacagagagctctggtcacacggctggggctgacagcgaaggacggagaggggctggcctggacaggctgaggctgcagagctctaacgggctgagaaccacagtgagcagtcactgggaccatgtgctcaagcctgcagcggccccgggcctcgctaggacaggcagcaggcacccgagccatcctctgccctcagactcacgggcaagagaggaaatgaaggctcagcaggccaagccctggcagagaggctgtgagtagagccgtcccatcctgtccctgcctgtgaccaggacccgggatatgtgggctggggcctgtgggtctccccagcactcactactacgtaaacatttacaaatatgacacacccttctttcattacaaaagcaacgtcatcccattgccaaaaagcaggaaatggaggggaacggcatctgcagttctaaaattccaatgcaagctgcggagtgtttggattcctttcatcttcacgaagatacgattacacggctcgacgaggtgccacggttcgcgatgtcagggccgcagtttgcgatgctgtgaatcttgggtccacggcgccgtcatgctgtgctctgaggacatctgcacagatgatgccttttcaccattttcaatcacttctaatatcgacaacatccacataaaaagacacctgccatcgctgccatagcggagatgcagggaggaacttctgcgagtgtggctgaagctggagtttctcaatgcccaggctgggagctgcgttgctgctggtggggacgtggaccggagcagccactctggaaggtggtgtggcagctccttacaaagctagagacggggttaccaggtgagtcagctcccctcctgatggcagcacctgtccaggcccagtaccttctgggaggtgagcccggacccactgaagcccagtcttctgccttggacgctcagcagtctgtgagaactggctttttgctccagaaccttccctaaaaatgaggcttcacacggaagctgcatgcaacagggacggggatgcgcccccctccccacccccggccacctgccccagcctctttctgctcgatccacccactccctgcttaggcctcaggcctggggttgcatcagagggcgaccttcaggagagctggggtccttcagggctccccgcttggtgcccgcggagatgcctgtcctggtcccagcctgggcttcacacagcgcccctgagcacagggtccatttttaatccaggagggtctcaggtgcatttgtgtttctgcaggattctgtggccaaatactgctggttgagaactggcgtgaactgcacgtgcactttctgacggtgagcgtccccgaaggccgtggcctggcttgttgctttaatcttgtttatttcatttattttttagagacaggatcttgctctgttacccaggctggagtggtgagacagcagctcactgcagccttgaccttccaggctcaagcgatcttcctgcctcagtctcttgagtagctgggaccatagatcactgtgcctggctaattttaattattattttttgagagagagtctcgcgctgtcacctaggctggagtgcaatggcatgatctcagctcactgcaacctccgcctccctggttcaagcgattctcctgcctcagcctcctgagtagctgggagtacaggcgcccgccaccacgcctggctaatttttatatttttagtagagacggggtttcaccatgttggtcaggctggtctcgaactcctgacctcatgatctgcctgcctcggcctcccaaagtgctgggattacaggtgtgagccactgtgcccggccttaattttttattttctgtaccagtaaggtcttgctgtgttgaccaggctggtctcaaactcctggggctcaagagatcctcctacctcggcctcccaaagtgctgggatcacaggtgtgagtgaccatgcctggccccgtcgtctttttttctttagacggagtcttgctctgtcacccaggctggagtgcagtggtgcgatctcagctcactgcaacctccgcctcctgggttcaagcaattctcccgcctcaccttctcgagtagctgggattacaggcaccgaccaacacatccagctaattttttgtattttggtagagatgggatttcaccatgtaggccaggctggtctcaaactcctgacctcaggtgatccactcacctcagcctcccaaagtgctgggattacaggcatgaaccatggcgaccggccacccgtctttaatttagagaggctcctggcaaagtgacatgtgtgtctgtgtctgagaagcagcccacggtgaatcaggctgtgtcatgggtgtgtgacctcagggacagtggttctcaaaggcatggccgacagctgggcctccttgtgaccccctctgggaagctctgcctgctgcctgggtttgctttgaaataaccctgccttctccagctgtgagggcggggctgggtggctgtggtgggtgggactgtgtctctgctctggcctggctggaggggctccagcaaacgcaacaggcggggagcagtggccctgaggacccccctgtggatgccaatcacgcccagtggacgcgagggggcaccgccatccaggctttaacctcgggtggtccctggagcgaccagcctgtggggggtgtggcgggcaccggtgtggccagcagcttgttctgtgtaactggggcctgcaatctgctccccgtggtccccctgggacggcgcttccagctgggggggctgttggctcctcagtgacttctgcgggcacagggggctcccagacagcccctccagctccacaaggccccaagctccaggccccccatggtttcacgggtctcacccccatgggtgatcacgagtcccccgggggcgtctgtctctgtatctcggcacccccacaacatatgaccatgaactggggcttaaaacaatgaaactgcagatgcccctcacttttccagaggccagaggctgaaaccaagggtctcagggctgtgcacccctggaggaactggggctccttcctgcctcttccagctccagtggccccaggtgagccgaggctggtggcgctctgtccagtccccgtctcgtcccgtggccttcaccatgtctgtgtctcctccctctggactcagggcatttggccttggacccagcgccacccgtgccttaatcacaaggcacaggccctacttcccttcaggccaagctgggaggtgtgggtggacctgggcctggggacactgctgtccactccaggctccatgctgccttcccgcagtcaccatcctgggcttctgagctggacgctcggtggaggagaggtgctgccgaggaagtgcccaagggatccctgaggggctgcagcccaggagcctcaccgcaggctcagccccgtgggaaggcggctgccccgtccagagggtgcaggagcctcagggcaccttggcggtggtgctgccaccctcggtcctgtactgctctctgctgcctcccaccggccctactcaaacccaggcccatcggggagcatagaaagcctgggcagggagcaaccgctgtgctcaggcctggttctgcctctgcacgccactcccctgatgctcctgggtcttcccaggaccaactcgatagggcaggaatgctggagaccactaggcatgcacgtgccccaggacccccaggccaggagcaggaattggggacctgctcatcctgctggggtgagggggggaagcctccaggtagccctagcccagggagatgggttcggacaaaaaaaaaggaagccagggcggggtctccagccaagtgttggggcctctgtgtcgcccctaaggagctgccagcaggtgagtctggtactggcgaccatgaccctcaagactcctgagggtaaggggagggcttccctgaaaactggcaggtgatggcgcagactccggcatcctcggtggggtgaggacaaggcccagagagcagagggtggagctggggctggtggctttctgccattcctcctgctagctgacctgtgtccttgtacctcctacttgccccagggcctggacccctcccctctggcctcagccatccccaaatgcagctcagagtaggggatacatcactgggggccaggtggatggtggcccagaaggggcagaagtggggagaccaccagggtgggcagcagcaggcaccctgggaggagggcaggccaccaagcacgtgtgggtatgaatagcaacagcagatgcaggcaaggggaggcggcgggcagggtgcagagggctctgtccctgtggagcctgcatttgggggagtccggctggcactgcctcagcagccaggaggccctgcaccgactcacctgagggggaacctctcccctgggtcccgtcccaggtggaagatcaggggcagcttcgtgtggtcttccagattgtgagttgtgacccctgaaacgttctgcccagggcagaaatcaatgccctgcaatgagaagagggaaggtgtgtcctggagcccctgacctgcggccgtgaggggcctcgtctgcccgtgtcctggagcccctgactgcggccgtgaggggccttgtctgcctgtgtcctggagcccctaactgggggccgtgggggggtctcgtctgcctgtgcctagcagcgtccctggtactcagcatggtgcagggcgctggctaaacgctgaaggactagcgggcccataagcatcctgtggaggaggtgaagccacccgctctgggcccgagatgcgtagctggcatgcctcacgtaccctgttttcatgtacccctcttctttgcgaggcaggtgagtgtatttaaaacaccttagccagcctcagatctggactgccactaatttcatggaggaaagccccttttaacagcctactctctgctggggaagggaggggagggaaagggacgggaagggaggccctgccctgggagaagggagagccacaacgctcagaatccctacagaaaccctaagacagggaggagcaggaccaacatgtgaaaggcaagagaaaacacagaaaacaaaaacagacccagggagctgacacagattcacacactcaagaagggcaaggattttacagtaaccacaattctctttctgctgcccctgggcctcctgattcgggaaaggcgaggtatgcctctaacattcccagagcgggtgctgcaggccaaggggctcgtccgaggactgtgcccaggacggccctcgcaggcggcaatgccggggaccgatgcccaggacggccctcgcaggcggcaatgccggggaccgatgcccaggacggccctcgcaggcggcaatgccggggaccgatgcccaggacggccctcgcaggcggcaatgccggggaccgatgcccaggacggccctcgcaggcggcaatgccggggaccgatgcccaggacggccctcgcaggcggcaatgccggggaccgatgcccaggacggccctcgcaggcggcaatgcccggggaacgatgcccaggacggccctcgcaggcggcaatgcccggggaccgatgcccaggacggccctcgcaggcggcaatgccggggaccgatgcccaggacggccctcacaggcggcaatgccggggaccgatgcccaggatggcccttgcaggtgacagtgctgggtaaaacccgaaagaagagcgggtgcggggcctgcacagggtggggaggagccaaaacactcctgggcatcattgccctccagacactgccccacgagcagcttccctcctcagcctgggtgctcagccctcagccccagttctcacttccagtctttagactctccattacactaaatgattttcttcccaattaaggcagattagcagggggttcatatctcaagactttgatgctgggagtgggtggggctgagagagacctctcaggaggggctgggggatgctggagcgtaggggtcagcaggggccagaaaagaccgtggggagggagcaggaggcttgaggcgagggctcgtgggagaaagcctggcgctgacaatgctggggtagcctggggcggcaggagccccaggccctgtgcgtgtggcgtttcaccctcccacactgggggttgctgtggtgatgccaatgctgcggcccccatgtagcacctgggccaagcaggccacgtctctgtcgcctccagcctggggtgtgggggaggctcagatgccctggcaggatggagaggcccatgggggccacctgaccagggtctaggccacgcctgtagctatgccgcggggctactgtcatcacgcggggcaggaagaggtccctccctcctctccagcctgtcagctgccatgccctaggccacgctgaacgactgggggccacacagagaaggctgtggagggggtggagttcctgcctgtctcaccctcctgtgcctcccccaggacggtgctcaggggccacgtctggatagagatgggggcagctccgcctgcgcccacgtcccgagccctgtacctgtctgaagttctcccaggagttggtccaggtccagaagtgagccttgtgctgcccgagggtggccgccatcagcgtgtcgccacggtaatagaagataggcctgtgggatgggaggggaggaccatgtaatgacaggaaggacacgctggggccacctggaggctctgggctgcgtctgtcatcagtggctcatgcctccacgtgaggtcttggttgatactttacaaagatgattgaaaagtaaaaaggcccgcaaggtggctggggctggggtgcctgggcggccggggctggagctcctgggtggccagggctggggtgactgggtatctggggcgcctgggtgtctggggctggggtgtctgggcggccggggctggggtgactgggtgtttgggcggccggggctggggtgactgggtgtctagggtgcctgggtgtctggggcgcctgggtgtctggggctggggtgtctgggtggccagggctggggtgcctgggtgtttgggcagccggggctggggtgcctgggtggccggggcgactgggtatctggggtgcctgggtgtctggggctggggtgtctgggcaaccggggctggggtggctgggtgtctgggtggccggggctggggtgactgggtgtctggggtgcctgggtgtctagggctggagtgcctgggcggccagggctggggtacctgggtgtctgggcggccggggctggggtgcctggatgtctggggctggggtttctgggcagccggggctggggtgcctgggtgtccgggactgggattcctgggcagctggggctggggtgcctgggtgtctggggtgcctgggcggccggggctagggtgcctgggcgtcccctcattgctggtccttggcaaggctgggccagaccctggggagggtgggcagacaagaggataagcaggcggcacggggtctcctgaccatgttgggcctgcgagtcaggaacggggagtgggggacgcagctgggcaccgtctctccccacagtgaccaaccacttgtgccaggtctcgagaggggacaagtgagcaaaactccctctacccggccccagatagccggaggcggcagctgccttgggccgtccccaccttgcttcccgttgagcctttggaatcctcatcccttcaggaccacccaggaaacgtggtttgagtggaatggtggctgctctcagggggtaggaaatggactttggacactaaggatttggacagaaggtaagagctgggccatggacttggcagagcagcgacttggatggaaggaagaaggaagctacaggaagccatgaggcaccaaaaaccaggctgggcagggaacaggggtggggcagacaggggcagcgtgtgcccgggctacagacagggaacaggggtggggcgggcaggggcggcgtgtgcccaggtacaggcaggcaacaggggtggggcaggcaggggtggcatgtgcccgggctgcaggcagggaacaggggtggggcggacaggggcggcgtgtgtctgggtacaggcagggaacaggggtgcggcggacaggggtggcgtgtgtctgggtacaggcagggaacaggggtggggcgggcaggggcggcatgtgcccgggtacaggcagggatgaggcccctctcctggccttgccctccctcctaaggctttcttgaaagccagggcctcgctgtgcttggaccctcccaggatggcccctgccccacaggcaggtccccaggtcctctcgtctcaggcacccctgcctcctcctgccctgggcacgagcacgcctgtgtccagaaccaggagggctgctgggcctgggggttgcacctgattagcagctctgggcttcactacttggatcgggggaaggggccggggcaggtctagcaccaacctgtccatcagccggccctgcaggagggtggggaggaggttgaggccatcaatggccctgtcgctgggcggcgtcaggcccgcaagggccaggctggtggtgaagaggtccatgatgctgcccagctggtggctcacctgaaacacatggcagcaacacggtcagggcactctgcaccgacccgatggggctgggggccaatccctgggggggcgtgagccccgctgcccagctgggtctacagatatgcatacatgctcacacgcccacagcagggactgagcggggtcacaaggcctgtgagagacagaggagcctcaaaccaggcccaaagaccccagagccaggccacgccctcactccctggcacccttctctgcctctgtggatcagatgaaaggagaatcacagccctcccagggagatgcccctccaggcccacctgtccggagaggatcagcctcgctctaacactgaatgccctaaggccactgtgagccctgccccttaagtcagaggagcaggtggagaaaaaccagatgtggaggggcagctgaggctggacaggagcagctccgagtggctggggtggggacggctcctgacacacccagagagctccaggacaggcaggaggctgtctttcccgccgtgccttgacctccggagggcgtgggcactgctgaccagccatgagcagagcgtgccatctggcttccctcagtggccctgtctgcttcttgttttttgtttttgttttttgagatggagttttgttcttgtcacccaggctggagtgcagtggtgcgatctcagctcaccacaacctctgccttccaggttcaagtgattctcctgactcagtctcccgagaagctgggattacaggtatgtgtcactacgcccggctaattttgtacttttagtagagacggggtttctccatgttggtcaggctggtctcgaactcccaacctcaggtgatctgcccgcctcagcctcccaaagtgctgggattacaggcatgagcccggcggccctgtctctttcttaactcgggggctccaggcttgggtcactcgacggggagactggggtggggctggagagacacccctgcctggcaagctcagcccctggggcagctgggcagggaccgccatccgctgccaggccctggagctcccacccagtgtcgacagccctccccacggtccaggggcaccctcgccgcctgcagccagctcctcgctagggcagacggcgatcgccagcttctccaacagaggagccctggcctcacagggacactcactccgcgctgcagccgctcacgggatgtggggtctgcagcgcccagtgtggggcagggaatgcaaagctcagcgtttgccaggaaagttcaggaagctttgcagaaggtgagaagcttccccaggtctggtcagcagtgtctgtgcgactgcttcccgtccttcccgtgtcctttaaaggacagaataataaaggaaagaaatccagatgcttttgtcatctgaaaaaataactgcggagcagtgcttgtggtgccggcagggcgggcgggcgggagtggtgtcagcacaggcagggtcctcgtggagcgttttcgaagaactctccaggcagcgatgccttccagaaacatccagaaatgcagtgggcagctgcggctgtgggagaagtcactgaaaccgttatcagcgctttcgagacttcactcagaatccagggctgcagggactaaagcctcccctgcccagagggaactgtcgggacagacgtcaggcgctttcactgaaaccccgtcgtggtgtcctggtgcacaggcctgatgccatcgaattcaatttcactttgtggcccacgggaaaaggcaacttggtggctctgggaagagggtttcccttcctcaggtggggagagggtttcccttcttcagggagcgaggcagatggcaaggttccaaaacgctgaaattggcatttttctcagctggagcctttccgtgggcaggtgggtggggaggtctgtggggtacagacgtccctgaacccactacgcatggagccgggcggcgctggggtggctcccctcaccttttccaggctgctgctgagcacagccacgggtggctcccagcctggggagcagagccccagccctgtcccggcctggtgggcacccactgcagtggggaacctcacatctcccagacctacgcaggtcccgagtctcatgccatcgtctcccagacctacgcgggtcccgggtctcacgccatcgtctcccagacctacgcgggtcccgagtctcacgccaacgtctcccagagctacacgggtcccgagtctcatgccaacgtctcccagagctacacagttcctgagtctcatgccaacgtctcccagagctacgcgggtcccgagtctcatgccaacgtctcccagagctacacagttcctgagtctcatgccaacgtcacagtgttcactgagtgaccaccggccactccctgcaggtgcccccacacaagaaaccaaatggcccatccctaccctcagggggatggcgctcaggggagtggagggggcggcacagctgcattctgtcctaggggcaccccacaccacaaaggaggccgtgcccaccacccatgcttctcctgcacaacaaggcggtcactctcacagccactctgcccttcacacggagccgcagctgccttttcagtgaaccgtggggtctcttccaccttcagggtcctgggaacttggggtggcccaggagtcccatgtcagacaaaggctgccctgggcagggtctgagggaggcccagacagctgtagagaacaggcgcccttggcagttgccgcccccagtcccactggctgctggggacacaggggactgcccaggcatggtgggcaggagtgcaggatccacagccaggcgcctgctcccacctctgctccctagtaattgggggaccctgacagacgacttcctctctggcctcagtttcctgatgtgtagaatgagtggggaagaggaggatctggcagaacagcagccaatccctgggccttcaggcgcgcgaccaggccaggcaattgaggcggcagacacaacgcaggccgctcatcagcgaggctcgaaacagggaggccagcctgggtgagcagggggtggggtgggacacagccacagggtcctcaaaagtggaacaggcgccgggcgcggtggctcacgcctgtaatcccaacactttcggaggccgaggcgggcagatcacgaggtcaggagattgagaccatactggccaacatagtgaaactccgtctctactaaaaatacaaaaattagccgggcatggtagagcatgcctgtagtcccagctactcgggaggctgaggcaggagaatcgcttgaatctgggaggtagaagttgcagtgagccgagattgcactactgcactccagcctgggcaacagagtgagacttcatctcaaaaaaaaaaaaaaaaaaaaaaaaaacgtggaacaggaaggccagggacagatgcctgcgtgctgctggctttgacggtggaggggccaggagctcaggaatggggcagctactaggattgggaaaaggcagggaacagaacatctcctggagcctccagaaggagctggccccacgcacgtcttcactcagccccatgagccccatgttgactctggctgtcgtcatgtgtgatgttccagctgccactgggagccccccccatcctcgtggggccacttgaaggggatggctgcctctggaggccattgggagggcaaaagactaagaaacagtgaagaaacagcggtcgtttacaaacaccagactcagccccgcgtgttgatgggtatgtctggctcaagtgcctgttacagaagaccacacggtgtgattctcaaccgaggggcagcttcctgggccagaggagatgcagtgacagcatgaaggtggtcacactgagatggcagggcgcaccctcgcccagccaggacccaggccaccaccgaggtccgcaccccatgcggcagacagacaccaacggtctcgtgtcgggctgctgctgttctctgagtgtccttaggacactggcctgagaagatgtgctttgggggaaaaaacgaccgattctgtagtagacagacaggtttttaaacactcagcctgctctaagccccttctagaagctcatggtgcccaccagcatgctaaaggcactgataagtcctgcagggaagaaacctgtttagctccatttaactcaggactgctgcggtgactggaccacggatgtctcctcaccacacagtcattaccagcacccacgtgacacacggcagtatacgtggctccagtccccaccgagagccttcctgcctgtctgaccaagcacagcaagccctacacaccgagagccaccgagagggacctggttccgaggagagcggtgaggccgagcacggggtgcgtggggaggagagcggtgaggccgagcacggggtgcgtggggaggagagcggtgaggccgagcacggggtgcgtggggaggagagcggtgaggccgagcacggggagcgtggggaggagagcggtgaggccgagcacggggtgcgtggggaggagagcggtgaggccgagcacggggtgcgtggggaggagagcggtgaggccgagcacggggtgcgtggggaggagagcggtgaggccgagcacggggtgcgtggggaggagagcggtgaggccgagcacggggtgcgtggggaggagagcggtgaggccgagcacggggtgcgtggggaggagagcggtgaggccgagcacggggtgcgtggggaggagagcggtgaggccgagcacggggagcgtggggaggagagcggtgaggccgagcacggggtgcgtggggaggagagcggtgaggccgagcacggggtgcgtggggaggagagcggtgaggccgagcacggggtgcgtggggaggagagcggtgaggccgagcacggggtgcgtggggaggagagcggtgaggccgagcacggggagcgtggggaggagggtggtgaggctgagcatggggtgcgtggaggctgagcacagggtgcgtggggaggagagcggtgaggatgagcacggggtgcatgggggaggtggccagtgaggggcgcacacaccctgggatggctgcaggcctggacctgctgcccggcagaccggtggacgctgactcacctggcctgcagtgacgtgccctggccaccatgcgagggcaggctccctcatccctccttcaaacgtggtctgcttcccacacagaaaggggccgttgctgccacctgggagagaggggcccttgtcaggccactgggaccagatgtccccaggccctccccctccctccccactgagtcactgagactggtcatagggacaaagggcccggccaaggcactctggctggagtgcatgatccgagcctcggggtggctctccaggggctcatctgagatgccgcggctgcaaagtctcctggagaaagtggggacatcatgcccactgaggaaatggaaacacaaccatacggtgtcagcaagactcagagaggtacactcccgcagcagaggccctgggtgccacgtgcgcagctgccgactggtgcttcccgaacgtgaatgttcacaagcctcccggtgtttggggtacttaaaatgcagccaacttctggcctccccatggttctgactcagtcagtcacggtggggcgtaggaatctgtgtttctgacaagcccccaagaccggattttggtttctgaaccatcacttgtgggaagtggtcacggggcaaaggccatctcaggtgactacaccatccctggctcactcccagacatggaagaagggggtggggggcccacgtcagggacaaaagccacccctgctgctgtagcctgagccacttgaggctctctcagcttcgggtcccctgaataaaagggaaaaaggaaacgaaggggccggctgcggtggctcatacctgtcatcccagtaccttgggaggccgaagcagggggactgcttgaactcgggagttcaagactagcctagactggtttctaccaaagagagaccacggctaaaccccatctctacaaaaatacaaaaattagctgggtgtggcggcacgtcctgtagtcccagctactcaggaggctgaggtgggaggattgctggagcccaggaggtcaaggctacagtgagctgagatcgcgccactgcactccagcctgggcaacagagcgagactccttctcaaaaaaaaaaaaaaaaaaaaaaagaaaatatttttccggcagtgaaaaagtgaaccatccaggggaggcaaagtcaccgcagctccttcctgcgctgccatccaaccccgagcggcagcgtggggaagcctctgaacggaacctcgcaggcagctctgctcagagcccctcacgggcaaacacgccaacacccgcaacccggcctgtctcagggagggccctgctcacagcagcagagccacagaacctgtgaagggacaatggacactgagctggggacactggccacttctaggggacactcaggctcacaggaggccatgctgtgcttcttctccttccctccctccctttctttccttctctctcccatcccctttttttttttttttgacatggagtctcgctctgtcgcccaggctggagtgcagtggtgcgatctcggctcactgcaagctccgcctcccgggttcaagtcattctcttgacttagcctgcccagcagctgggactacaggtgcccgccaccacgcctggctaattttttgtttttcagtagagatggggtttcaccgtgttagccaggatggtctcgacctcctgacctcgtgatccacccgcctcagcctcccaaagtgctgggattacaggtgtgagccaccacgcccagccccctcccctgctttctttctctgggatgttctgtttctagtcttgtgctgggtgctgggtgtgtgggttctcatcttgttacaaataggtacatataccatttgttggtatgaaacatgccatttgttggtatgaaacattccatcatttagaaatgaagactcaggtcgctgggacccttgcccctgctggctggtggttgtgggtgctggcgtcgaggtgggcccccccgggctccccatggggaatgacggccaacaccaccctccccccacccagcaccctgcctcctgggagctgcctgtagccctccacacatgggtctgttgggggcctcgactcgtgggtctgactccagtgggcgggagatggagctgtccggagggcctgcacgagagccaggctcacccaggggagctatctggtgggacgtggcgcgagggagcctatgcttctgttttggctttcagctgtgctggtttctatcacttgaaactctgaagcccccaatccccgcagcacactgggctgtaggcgccccccgacatggtctgggacgaggctgtagggctctccccaccacgtggtctgggaagaggctgcagggcccccccccgcgtggtctgggaagaggctgcagggcccccccgcgtggtctgggaagaggctgcagggcccccctcagcgtggtctgggaagaggctgtagggccccccccgtgtggtctgggaagaggctgcagggcccccctcagcgtggtctgggaagaggctgtagggctctccccaccgcgtggtctgggaagaggctgcagggcccccctcagcgtggtctgggaagaggctgtagggccccccccgtgtggtctgggaagaggctgcagggcccccccccgcgtggtctgggaagaggcgggttcaggtttgttggcgctggggatgggtcaggcattcatcagtgccgagcgggggaaaggctgaagctccatcccaggaaccacttgacagggctgtggtgggggcaggagtccatcttcatggaggcagcccggcccctgggtgaccaggtccaggccacactcacagggctgctcggggtctggggtgccggcccccacctcagcagggacaccctgctccaccggccctgctgtttccatgcggcctccaaagcctccggcctccggggtcacccttcgggaggcgtcagcctcttccaagacaaaccctctcccctgtgtcacctcctccccacccccaagttcaaggtcactcctgcttccaggttagtcctgggccagaagggccttgctcgaggctcggtgacatctgctcctcccgctggacccagagggacccttcatgctctgcccaccacagaccccgtgggcacagccggtccaggcactcttcgctgacacgctggctgtggggaaaccgtgagaagtgacagcgagcactcaccttgttcgggggcggaaatgagggcagcgccgttgtccgacgtgaagaagacgaaggtgttgtccgcgacgtgcaggtcttggaggagctccagtatcttcccaatgctgtcatcaatctcccggacggcgtctccatacctgcaggatggtgacaaaaggcatctccatacctggaggatggtgacaaatggatcaggcagccaacggcatactgtgattcacggagttcattaaatcataacttcacagaccacagtgaaactggccggcctcttcccagaagaggaatggcctcagttcaagttcatgtggcttatgaaggacagagccagcacccccaccacagccctcctctgctgatcccaggccagtggacggcttcaaaggggtggggttgctctggcctttccataattggcctaaatgccacggtactgagtgtcccatctctggagtcaagcacagctggggcctccagcgaggtctatgctccatggagccaggactcaccgccctcgctgactggtgcccaagaagggtttggaggcatagacgggtgcgtgcgtggcgtcgacagcccagtagaggaaaaaggggtggtgccgtgcctgtctcttaatgaagtccagggcttcctatggagagagccacaccgtcgtcctccagcctcaggccgacctcctcatgcctcccacggtccccgtccccacacgtcccacggggcgaggttggtgcggtccccgtccccacgcgtcccacggggcaaggttggtgcggtccccgtccccacgcgtcccacggggcgaggatggtgcggtccccgtccccacgcgtcccacggggcgagggtgatgaggtccctgaacccatgcctcccacggggtgaggttgatgcattcctgtccccacgcctcccacaggatgaggttggtgcggtccccgtccccatgcgtcccacagggcgaggatggtgcggtccccatcacctgcaggtagatctgggtgaggttggcttcccccgtcttcagattaataggaaattcttcataatatctgaaaagaacacagatccagacagacttcagaatttaggccaagaaagtcccgttctccctgatttcaccagcaaagccatgggcttcatttaaaagaaggctagggctgggcgtcatggctcatgcctgtaatcccagcattttgggaggctgaggaaggtggatcatgaggtcaggaatttgagaccagcctgggcaacatggtgaaactctgtctctactaaaaatacaaaaattagctgggcgtggtggcgcacgcctgtaatcccagctacttgagaggctgaggcaggagaattgcttgaacccaggaggcggaggttgcagtgagccgagatcgcgccactgcaatccaccctgggtgacagagcaagatcctgtctcaagaaaaaaaaaaaaaaggaagcctggaaatgaaatgtccactcagggaacaaccaagctggacgcatccctcgctcccccagggcacggtcttgcatctgatgacctggctgaggccggtgctgcaataacctgccacatgggaagatgggggaatggggctgagggcacgacaccaaggtgaaggcagtgaggcggctgtggtcactcggctggggctggggagccgccgctcaggccatggggctcgttctgaagcagctacagtgctggttgtcccagcctgtgactaatgccaaccacagaactgcacacttcaaatgggggctgcgtggtgcgactcccacacctccacggggctctatctagaaagaggcagcaagctggtgctgcttctggtcaccgtcatgtaatgaatgagcacttccgccaagaagagtcaagttaagcaaaataaaattcacaaaagatgagggtcccggacccggcactgccgtgtcaagaggtgctgcccccacgcccgggcaccaggacggctctgtctggacagcggcttttgctcctggtgtggctcccagtgggggtttcatcccacctcctgtcctgcccatgtccctggatgtctggagcacagccggcctccccacccgtagaccacatgggcagtaccctgacagctagggcagaccgtgtgggctcgctctgctgggggccttcctctctcaggacagctacagggatctacgaccctgaaaaggtgggaaaccccaggcaggagtctcataggctctggggcaaaacttggtgggacagaagccaccaaaccaaagccctcggtgcccggggacccagggacagaccagccctcatgagtggcgacttgagcccaccagtgctagaggcggggggcaggcacgccgggcacagcagttcaggacgtgggaggggaaggggtggggctccattacctgccaaccatctcccagtccctgtacacagggatgttgggcctggccttgttgtcataaggtccaaagtggcagttgggggatccaaaccactcatcaaatccgtgcttcagggggtggaactggggcctgtgacccagatgcctggaaacaggaacccaggacacttcagggaccccacgtggggacactcggaagttctgagcagcaacagataccaccttcacaaaattcttggtaagacgagcaccctccagcactgagtatgggctatgcctgggcacggcagggacaaaagaccaaggcctcacccgaggagggtgctggcactgcccgcctaccctgcagagcgtctgggcacaaccgagggcggcaggcatggcggcggccggggttccctgcacggtgaagggtggtgcatcgtgaggagcctcccagccgcctggaacccgcctgacatgcccctcgtggccccggctccttccttccacgttttctgaactcccaggagagttttgcgggtcatgcctcgaacccaagtgtgtctcctctgggttttccagggcagaaaatatttcctgccaggtaattactgggtctctccacaccgaggcgctcagagtctcatctcccagttcagggcaatggccccaggatgacgactgggcggggcgttgtgtgccgtgcgggagccccggggcctgccagctgtacccacatccccaggaccctggcagaggcagggattagagtgacgacaagagaacgtgacagtgtggccacactggtgacctccaccaaccgctctcctgggaccggggttcacctgctgggaatggccatcgccaggcatcacaccccaggcctgtgggaacccctccagaccccgtcccgcactccccttctgacaatcccccgcagaccttgtgctcccaccctctggtggcacctaatctcatcctccggcccacagcagccctgcaggccacacctctgtgcccactcgccctggcccccaggccagctgtccgggtttccttgcgcagcctgtcctgtcctggaacgaatccagcttgcggctgctcttcagaacgggctgcaggagaggtggtatgagatggcttctaggcacggccgtgggcgggtctcacgtcagttgcgtgtcgtctgaggaaagttcttctgcagctacggctttgaaagcagcatccccgacgcagatttccccgaggcagatttcaccacagcagatttctgctgcctccctggacatggcctctgtaccctggacctcccgagctgcctctccccatctcctctctcaggtaagcacgcctggacctctctgtgacctcagagctcccttggctgccaactccgggctgtttcctttgggtcttcagcacttgggcccattgctagagcaccccgacatccctgaacaccccaggcaggtcaccacccagccacaggggacactcgtgcgtccacgtccgcaggtcaccgcccaaccacaggggacactcgtgcgcccacgtccgctggtcaccgcccggccacaggggacactcgtgcgcccacgtccacaggtcaccgcccggccacaggggacactcgtgcgcccacgtccgcaggtcaccgcccggccacaggggacactcgtgcgccaacgtccgcaggtcaccgcccggccacaggggacactcgtgcttccacgtccgcagcacaaaggccttgctcaggggaagcacatgggcaggacgctacacaaattaagctgtcagctcaacgtccttgtccgaaagcagcagtggggcctggcactcaccagcaggtgacctggagcagggagtgtccgcggccctctgggactcaagtccctgccctgcacacccgcgtggcttcatgcagatcaagcagcctctttttgagtccaggtgaggggcctcagggaagtctgagtcatggctgacaacacccctactgccctgagaggggaccctgctgggatagggacccccccacctgactgagcagccgctgtaggacccagcccgggccatccagccactgcaccatgtgcgggaggagcctggggctctgaggtctgcctggctcctgctcccactccttggggtcccctctctcccgtcgacagctgttcaggagcctcgaggcctctatggagacccactccctgtctagctctggccaccggcaccaatgaccatgcataggaggccgctgggcccaagacagagctgccaggccaggcggagagctctgggtcactgtggggcttgtcacttggagaggccaccggctcttcctcctgttggcacagtactcacgcgctccagtggccctcgggggctgacttccgccatggcccctggcactggctcagggactatgcaggctgcgtggggcccaacctccctgtgtgaggactctgcagctgctgtgcccatcagctctgccctgtgctttctgagagctcagctcggcaggctgcttcctctcatctgaagaatgatgaagtgctccctagacagcctctgggtcctcctcatccagtgatcaagctcagcaaattcctggctgccatgaccatctacatccaaggagcatccatctgaaggggaccggcaggagccacaggcagccgactggggatcacagaggctgggaaagcagcaagggcttcctggaggaggcggcatgcggacctgacaggcggggaacgctccaacaagtggagagaaattcgggacaggtgactcctacccaaccctctaggctcactcaggcgtcccagggagtaaaagaaatgaaacatcctgtgcgcctaaaaccgcagcgtgggggctgtgtagcacccaagctctcatcagctcaggatttcatcaactgctaggctgttactctccttcctggtggcttctttgtggtttagaccagagctttcaccatccaacaggcccctagggtggacaggcagctcctccgccacagctcctgtgtgtaatgacgtggcccctccaaggacgacgtggcaggaggcagccggggggcagtggtggcgggtgctaggggctgtgactcgagggatgacggtgacaggcctgcggagtctgatgccgcaggatactcgcggccgtgggaccagcctggtgacctgagatcctgctggcaaggtcacgctggcctgcacagggacgctggagacacctgaacacacccagaatcagctgccgtttcccacccaagacaccctcctcatttggaaacttgtggccatgtcccttggaaccaaggccaggaagtggatggagcaggacgcctgggcaggcgtggccaggagacttaccacttgccgacaatcttgctgacgtagccggccttcttcagaagctccggcaggagctgctccgagtctgggatgccgcccacaatctcctgcggtgtgtaggctggaagagcagcgctgggtgagccccgaggagaccccgagaagctgccaccaaccccatcctaacaggacactgggggctgcgtccacacatcctaacaggacactggcccctcggggtcaaaggctgtgcctgggggctgcgcgtccacagggcatggcacttcccaagatttttccaggcacccctcagagccagtgccatcaccagagggtggggacggggcagactccgtgccccccagcgccttccttgggactcctgcccaccctcaggccccaccctgcctctcaggccagcctcccacctgcctggtctccaggggtctctggaatatgccacgtgatgctgcactgccccacccctgcctcccccgtccttccctttcctcaaatgccactggaaatcccacttcccctgtgagatgcccctggggagcccatccaaacccctcaagcacagcgattccagaacattccagaactgccgctgatgccacagccccggcctccctgtgggtgtgcggctcacccgcctggggagtgggagcttctggggtgggggtgccggctcagctccttaggccagactgggcaccctccgctcagtccccactgggccagggcagggaaggaagccagctaggggggcctgcacttccacctaagtcccagagacccaggcaccagcggtaccccacctgcagcttgccacccgagtcccggagacacgggcaccacccgtagcccacctgcccaaccctgcaccccaagggtgtccctggaggcggtgggcagcctaccgtttctggcatgggcgttggtggtgtagaagccattgcggatgggtagccgtcctgtgagcagtgccgccctcgctatgtggaggtgacagaaacagaaactggataagaagggtgtggctcagaccccgggcgtcaacaagagccccaacgagtagacagacgcgtgacagacgaggcacgcgcaggtttacaaggggctgccacgcctgtcaatccccgttagcgtctccaccacctgggtggggcacggcacccattccactgaaagacgcgtggcccttgggccctgcagctcagcgttgtccccaagaccccgcctcctttcgcaggctcctgggacacccactgggcgtgcaggtccacacgcccccatcctcgagcaccagccccgtgccctgccttctcctcttcctcacgatcaacaccacatgtttctgtctccagcaggagagactctccccagggagggagggagtgggactcctgcttcccaggtaccctgagacggagccacactgcagcacctctccccaggcggccacagcactcgactctgggaaacagaacagcagccaccaacaataccgcaacttcgaccctgaaaacccagcaggtgccgcaccccacatggcacggagccgggctgggatttgatgagaaaggcctgagcccacctgccaccctccctgcagtagtaggaatagacaaggttgatgcagccgcccagagtcagggctggaaggacccgggaggcctcggcctgttgggctcaccccttcctgggggcgagggccccgctgacttacatggcgagcacagagggttggcagaatagaagtttgggaaaagcagcccttctgcagccatccggtccaaattcggggtctctctggagggctctccatacaccccgaggtcaccccatcccatctgcagggaagagcacggggaggaggaatgagcgccttctgcaggtgcttctggcctggggagctgcccatggtgccaagagcgtgtcggggaccgtggaagccagcaccaccctgtgtcccagccagcggcagagctcggccaaaccccagcatcgcctgcgtgcgtgcacgatggggccgctccacgccagcccaaacctcagcatcgcctgcgtgcgtgcacgatggggccgctccacggtcagcccacgctgtctttcgcctccacttctgcttggtcttcaggtggggaatgtgtccgtctgcctcctcccagcctgacaccagcatctgcatgctcgcaggagctggcctctaaacacgtgcatctattttcaacataaatacacaggccctcgtatgtctgtacacgtctagatttcaaagtcaactggtaactgtcccccagaagcccagttatcgtgtgaccctgcagttccacgctgcaactccactcctagctgtacacccaagagactgaaacttacgtccacacgcaggcctgcatacgagcgtccagggcagcacgactcagtggccaaaaggcaggagcaccctgagcgcccatcggcagacgacaaagtgcggccggcgtgtactacgtgggtgtggccacatttggaagtagggtctctgcagatgtagtgagctaagatgaggtcacgctgggccagggtgggccctcaatcctatgactgggcccttagagacgcagacatgcagtagagatgccgggtgaaggccgaggccgagactggagtgacgcagccaccagccaggggacagcaaggaccttcctggagagcctgagggggaggggcccggctgacaccttgattttgcacttctggcctccagaatccggcaagaatccatttccgctaaggccacctggcctgtggtaacgtgttatgtctcaggaaactcacgcacgtaccgcggcacactacccaaccatcgaaaggaagggcaccccacaccgcgcacggccctggaaagcttcatgtgagggaaggaagcagacacaagggccacacaggctgtgatttgctcattaagcctccggaacaggccggtccgcagaggcaggaggcggctgagtggctgccggggctgggggtgggtgctggggagggcctgctgatgagtaccggtttcttcttgggatggactgtttggaagcaggtagaagggatggaggcaccacgctgtgaatggactgtgcccgagtggtgcacgttaaggtggctgtcatggtcaattttacgttctgtgtattttacaataaaaaccccaagcaggaggacgggtgagcacagggcaggaagcacggaggctggggtgatgccaggaggccggggtgatgccaggtgtgatggcaccagcacagcaaatgcccacggcaaactccggaggtgagtggcagcggcggtgttcactgaaaacttcttcaaattttacagtgtgtattgttggaaaaaagtgcttttaaacaggcagtgggccaggactttgctctagaaggagaaggggagggcaccgcctggggctttggctctcctcggatcctccagccgtctccctgagcgcccacctcagcaggagcctggtagaagccaacactccgaggcccctctgtctggcctgtcttccttccttaaggacatattccctcctgaggtgctccaagcaccaaccaagacaccagtgaagtgactgtgcctgcctgggcccctgccctctacaggccgccttcagcagcttcggcagcacaaacacacaacacctgggaaagacaacacattctaaacacaacgaccaagttcacaggcccagctgaattcaaccaccacgttcacaggcccagctgcattcaacgcatatttatttctgaaaccaatctgaatgcaaatatggatatttagagctggcatcagcaaatgcattatgtaaagggcctcacagcaaatcctttcagctttgtgggccatatggggctgtcacagcccctcagccctgccacaagccagcatgcgagcagatgtgcacgctctgtgccaataaaactttattcatcaacatctgaatttcatataatttttcatgtcacaaaatattactcttttggttttttgaacaatttaaaattataaaacccatgcctggcttatgggtttaaaaaacggcaggtggtgggccgggctcggtggctcacgcctgtaatcccagcaccgtgggaggccgaggcgggcggatcaccaggtcaggagatcgagaccatcctggctaacatggtgaaaccccgcctctactaaaaatacaaaaaattagccaggcatggtggtgggcacctgtagtcccggctactcggagtacagtagccggcaggagaatcgcttgaacctgggaggcggaggttgcagtgagccaagattgtaccactgcactccagcctgggcaacagagggagactccgtcccaaaaccacaacaacaacaaaacccagcaggtggttcacatttgacccatgggctggagttggccaacctctgtcttagtgaaagtgcagctaccctatcttaaaaggcaatcatggggctgggtgcggtggctcacgcctgtaatcctagtactttgggaggccgaggtaggcggatcacaaggttaggagttcgagaccagcctggccaatatgatgaaacccagtctctactaaaaacacaagaattagctgggcatggtggcgggcacctgtaccagctacttgggaggctgaggcaggagaatcgcttcaacccgggaggcggaggttgcagtgagccgagattgtgccaccgcactccagcctgggtgacagagcaagactccgtctcaaaaaaaaaaaaagggcatgagaggatcacttaaagccaggagttcgagaccagcctggacaacacagcaagactccaactctaaaaaaaaaaaaaaagccaagtgtggtggtgtgtacctgtggtcccaactactcaggaggctgaggtaggaggatcacttgaggccaggaggttgaggctgccgtgagccatgatcacaccacagcactccagcctgggcaacagggtgagacactctcactaaacaaacaaacaaaaaaagatcatggcccagcaattccacttgtaggagtttatcctaagaaaataattacagctatgtataacccattatgccaatttaaaattgtggttgagatactgggaacagaaatttggttaaataaatcacagttcatctgtgttaatgggtggagctgtatccccaaaagttatgctgaaatcatggccccagtgtagctcagcatgtgaccttagttagaaacagggttgccgcagatatgattcagtaagatgaggtcactaacatgggggtggaccctcatcccacacactgcagtccttataggagacagggcgaaggtggccgtgtggcaatggggtcagaggcgggagacacacagccatgggctccggacggctgggggccaccagaagctgcaggggcaagaggtcccttgcaggtttccgagggagcgaggtcctgcccacaccttgagctcagacttccggcctccagaccgagacagaatgcgtttctggcttttttttttttttttttttttttgagacgaagtcttgctgttgtcgcccaggctggagggcacaatctcgactcactgcaacctttgcctgcacgatctcggctcacggcaacctttgcctctcgggttcaagcgattactcctgcctcagcctcccaagtagctgggattataggcgccctccatcatgctcagctagtttttgtatttttagtagagacggggtttcgccatgttggccaggctggtctcgaactcctgacctccggtgatctgcctgccttggcctcccaaagtgctgggattacaggtgtgagcactgtgcccggccgtgtttctgttcttttaagctcccgacccccgtgtgtggtcccaggaggctcctgggatgggtgagatgggggtgtggccagggggttactgagaagcccacttagtgtgaacagacattcacgacacctggttgtgtggacacctgtggacacacctggacggcagggagggaaaacctcttagtaaagcaagtatctgcagcccagccatgtctggcagccaaagccttcaggaggaacgcaaacagctccacccgcagctcttaagcacactggagaccaccgatggttctttttttaagtctctgaaatacttttctctctcgttgaccagcctgggcaacaaggtgagaccccatctctataaaaaatcaaaaaatcagctgggcatggtggcacacacctgtaatcccagctacttgggaggctgaggcaggagaatcccctgagctcaggaggcagaggctgcagtgagctgagatcgcgccacggcagtccagcctaggtaacagacagagaaccctgtctcaaaaaaataaaaaacaaaaacctgccacttttctccaaattcaccccatccagcctcctcctgtcacaagtggctccaggactcacccacagagtaggactgccacctgcatggacagcagggaccttgaggagggctgtgcctggaggccgagtggggctcacctgcccatcgggcccttgtaaagtttccaccatttcaaatgaccccaagacaggctgcatgggccctggtgctccaagagccggagagaggctcactttggtctctccacagttcaccacgacagggactagagtctgatcgctgattgtctaaggttgatttttaccaaacaaaacaaaacattaaaagtgaactcactggaaactggagccctcacacaccatgtaagaacgtgacacgcagcacctggtgagaggtccggcagcgccacgcagggtggccacgccgcccggcagcgcctccctggtacacgcccaacagaactgaaaagtgtgtccacgtggaaacctgtgcatgaaccaacacccacagcggctcgctccctggcagccaagctggaaacacccggatgcccatccatgggtggaagcctcagccacacgtggtccctccacactgtggaccatgactcagccacgaaaaggaatggagtcctcacacaggctgtgtgtgtgaagcccaaaaaccctgtgtgaggggaaaatagacacaaggcccatgagccgtaagattccattcaccggacacgtcagaaaaggcagatccttagagacagaaaggggagcgggtcggccaggggcttcggggagcacaagggagtgacccccatcagggctggggcttccttccgtggtgacaaagatgatgtgacgatgtgtggtggcaggacgactctgagaacacactaaaaatgacccgcacactttcaccagcgaattccgtctcagtaaagcggctataaaagaatgaaaggccgggcgcggtggttcacgcctgtaatcccagcactttgggaggccgaggcaggtggatcacgaggtggtcaggagatcgagaccatccttgctaacacagtgaaaccccgtctctaccaaaaatacaaaaaattagccaggcgtggttgcaggcgcctgtggtcccagctactcgggaggctgaggcaggacagcctgggtgacagtgagactccgtctgaaaaaaaaaaaaaaaggaagtgcgggcatcctggttttctgcagatggaccaggggctcccctgacactgctgggtcggggccggtgggcgtttgactcgctgggtcctggtaagtcaaagaagcagcagcctcggggcctgtgtgaagtgacaggggtctgaacagaggggaagccctcaccgggggcgggggtggcagcgtgctgactgggaacggctgctggagggatgggcgctgggccccggggaccgcgggaggacagtgggccgctctgggcgcacgtgggtggctggacatccaggtctgcgtggtcacaccttggtctttgtctggatgcaatgatccatttccccggtggacggcaggctacatggcccctgcctgtaaggctcagcttggcagggtggccgctccttgcctcagcccctcctaacgtgtggagtcccagagctgggccaggtctgggctttttcctctcaaaggccctccatgtctcatgggacacaattctgtttggcccttttagctttggatcccttttgagatggtttatttttttgagacagggtctcactctgacaaacaggctgaagtacagtggcgcgatcttggctcactgcaacctctgccttccgggctcaggtgatcctcccacctcagcctcctgagtagctgggactacaggcacatgccaccatgcccagttaattattattatcattattttttgagatggagtctcactctgtcacccaggttggagtgcagtggcgtggtcttggctcactgcaacctccggctcttgggttcaagcaattcgcctgcctcagcctcctgagtagctggaattataggcacccaccaccaagctcatctaatttttgtattttttttatagagatggggtttcaccatgttggccaggctggtcttgaatactgacctcaggtgatccacctgcctcagcctcccaaagtgctgggattacaggtgtgaaccaccgtgtcaggccaacttttttgtatttttggtagagatggagttttgccacgttgcccaggctggtcttgagtgaactgagctcaagcagtccacccgcctccacctcccaaagtgctgagatcccaggtgtgagccaccacgcccagccctgagatggtttattttgaagtcactgaaatggcttttctgaggacaatggaggctggaatgaaaggaggacctagagagaggtgtcccctgaagctgatgaggaagaaagggaggtgggaggacagggggcaggacgcccgcagagctgctcatgggctgagaagggaccttgggctcagtggcacctagtcacagtgggcgaatgcgcccatgtcagggtgaggtgcatcccactgaggcagcagaaacctgcagtgcaggctgggacggtacagctccctgaggccagcctgagggggactggccacacacgcccaaagctccttgccctccacctccccgagtgcagattcatcctctcaggtggcttctgcacttcctgctgtctccagtccaggtgggagagtacagaatggcaggtgggccgggggcacaaggcctgggatgggagggagcagtatgtttcgcccgttacactgtctgcccatgcccaggaccactgctgggctcccttcgggctgggagtgaggccgcacatctgaatactgggtgccatgtgcccgaccctccctgcaggctgcgtcctgaggcttcccgaggcgggtctggcctccccagaaggtcggcagtcagcagagctgcgtccggatctgcttgtgctcacctgggtcatcctcctacctgttccaggccacaaataacatgaatggatgcagcggaaaatgctgtaaagggagtgggctccacgctcatcactcaccagaaaatactgcggggaggagtcccagggcttgagggagggggctccacgctcaccactgactcagaagataccgcaagggagcactctcgctgggaggagtcccaggtcttggcgacagtcctactcactgccatgacttacaacggggagggcatcagccaggggagaaggtgcgggcggggccggggagaccagccgcagcgtggaaccctccccaggcggagccacacgggacgctcgggctgcgagcacaggtgcgggatgctgacggggaagctgtgcgagactcagttcccagggcttttgcctaggctggcagtgcggccgcctctgcctggcatgtgccgagactctttatgcccagaaggaggatgctgggcataaatcgtggcatgtgcaaaaacagtgtggcaaggtgagctgctcctatcagcgaacagcggggggacctcctgttcccagacgccagccgagggcaaaaacctcccacacatgtgccttctgaccagccgagggcaacgtcccacacgtgggccttctgaggacagcgtcccaggctgctgggccagctctcatctgctgaccctgttctttcattatttatcggcgcctttcttggctatgaaaagcaggtgtggacagcctccctgcagagtgagcaggttaccattgaacatctaaaacccccacagggcaccacgggcaggaaccacctttcttctctcccttaaaagtcctaaaagggctggatccagtggttcacgtctgttatcccaacactttgggaggctgaggagggaggatcgcttgagctcaggaagtcaagaccaacctgggtctcacagacagacactgtcactaaaaaaaactttttttttaattagccgggtgtggggattccgttccaacatggctgaataggaacagctccgggctgcagctcccagcgtgattgacgcagaagacggcgatttctgcatttccaactgaggtgcctggttcatcctactgggactggttggacagtgagtgcagcccatggagggtgagccgaagcagggtggggcatcgcctcactcaggaagtgcgaggggttgggggatttccctttcctagccaagggaagccgtgacagactgcacctggaaaatcaggacactcccgcccaaatagtgcgcttttccaacggtcttagctaacgacacaccaggagattatatcccgggcctggctcggagggtctcatgcccacggagccttgctcactgctagcacagcagtctgagatccacctgcgaggtggcagcctgcctggggaggggcgtccgccattgctgaggcttgagtaggtaaacaaagcggcagggaagctcgaaccgggcagagcccaccgcagctctgcaaagcctgctgcctctgtagaccccacctctaggagcagggaatagctgaacaaaaggcagcagaaacttcggcagacttaaacgtccccgtctgacagctctgaagagagcagtggttctcccggcacagtgtttgagctctgagaacggacacattgcctcctcaagtgggtccctgacccccgtgtagcctaactgggagatacttcccagtaggggcccactgacacctcatacaggcaggtgcccctctgggacaaagcttccagaagaaggatcaggcagcaatatttactattctgcaatagttgctgttctgcagcctccactggtgatacccaggcaaacagggtctggagtggaccttcagcaaactccaacagacctgcagctgagggacctgactcttataaggaaaattaacaaacagaaaggaatagcatcaacatcaacaaaaaggacatctacgccaaaaccccatctttaggccaccagcatcaaagaccaaaggcagataaaaccacaaagatggggagaaaccagagcagaaaagctgaaaattctaaaaaccagagcacctcttctcctccaaaggatcgcagctcctcgccagcaagggaacaaagctggacagagaatgactctgacgagctgacagaagtaggcttcagaaagtcggtaataaccaacttctccgaactagaggaagatgtttgaatccatggtaaggaagctaaaaaccttgaaaaaagatgagacgaatggctaactagaatcaacagtgtagagaagaccttagatgacctgatggagctgaaaaccatggcaccagaactacgtgacgcatgcacaagcttcagtagccgattcgatctagtggaagaaagggtatcagtgattgaagatcaaattaattagccgagtgtggtgatgggcggctataatcccagctactcaggaggctgaggcaggaaaattgcttgagcccagtagtttgaggctgcagtgagctgtgatcgagctactgcactccagcctgggtgacagagccagaccttgtctcaaaaaaaaagtcctggctgggtgtggtggctcatgcctgtaatcccagcactttgggaggctgaggcaggcagatcacctgaggtcaggagtttcaggccagactggccaatatggtgaaaccccgtctccactagaaatacaaaaattagctgggcacggtggtgggagcctgtagtcccagctactcgggaggctgaggcaggagaattgcttgaacctgggagacggaggttgcagtgagctgagatcacaccactgcaatccagcctgggtgaccagagtgagactccatctcaaaaaaaaaaaaaaaaaaaaaaaaggcctaaaagcccccaaatgattgtccacgttcagcgagcacagctgtgagccatggatcagtatccttcagaatttcagagttttaagaaacgcagtttccattcctactggttgctatgggattattatgaagacgagcaggccagtgcttgtctgtttcaaacgaggggcactgagcaaccctccccggactctggtggctcgacgaggctgctgtggcaacaggagctggcctgggtggccctgactctccacttcctctgtggtcagggctgaccctccttaaccctattttccaaataaggagtggagacacagagtgctgctcgccctgggaggcaggagctgtgtgtgggccagagtggaacttgtcactgggtctcacctgtctccaaggccccagaagccctggagagcagagtgggccacgcaggtttcctcactcacgcagcaggtgcccagggtactacgaagccaggccgcgctggaccgtgggtcagtgaaaggccagggcagggcagccctggggagtgcaggtagacccgtccttgcccggctcagctccccctggacaggtgggggctcttgccagctgctctcacccctgagtcccagcttccccttctggtcccgactctgggggcaatggttctctcccgggtcagtgtgaccagttggagagtggcttctggccatgaggggtgcaataagctagttttggggacaacccttttctgaaactgcacttgcttagacgaaaggggggcccaggccccccactgcccagccacagaggactggatagggggagactgggctggaggcagccggtccctggagggccatgctccaaaatctgaacttgagacatgcacactcgtcctcaagtggtgctgggcccagagctgtgggtcatcaagccatcccatgtcatgccagaggccgaatgacctgttgcaggttcagacgccagcgccctggcagaaacaaccggtctgcagtgcaggaagaggtgtggacagggctgcggaggaagccccggactccaaggagagaagacagcctgtgaggacccccttgcaccctgggccacgtcagggcacctcggggctccactgtgagcttctgtggctctcacctgccagcatccctgccctgtcctggcagctgcaccatgggcccttcagggaaccccctctctgctgggtccaggcagatgagatgatcaggggcagtctcccttctggggtaggcccgaggctccgaggcctgggctggacaggtcagcatgtgcccctcccccagtgtgcttggcgcagggctgagacccacatcacgctaacatgacacgggcagagccaacctcccactgggtctgctgactgcaggggtgacttggagtcacctaggaccatcacaggctgagtgaggatgtggccagttcagaggcagcagagccacgaaaggggaaactcgccaggcggccctggtctgtcgactcaggagggccagggaatccccactgttgcttgtcactttgacttcatcttctgctgtctgcatcagaaagtccttacaagtacacctaccggccaggacacagctcctctggggttctttaggcgtcagctgccaaacgaccccacaagccacacagtggaggccacagaacaggtgcccaggtgggcggggcttcctgtcaccctcccccacatgtgccccggtggccacaccccacccctccaccctgcacggcctgaacccttgctgtcctatggaaacgtagggtgagtccacatgcaattccctatttaccgggagccacattagaaaagcagaagtaggtgaaatacagactaactttatattttatttaacccaacataaccaaaatattatttcgacaagtcttcaacataaaaaattattcatgagctgccccgcctcacccctctgtcctctgagaaagtcaggaaaagcagaaacttaacagggaggcttcacctgcagagcccagctcatccagcgaagctatgctggcccagaaggagttacacaatgaaaagaagaaattctgaaacaaagtatctacactggcccagaggaacttcaaaagtgaaaggatgaaattctgaagcaaagtatctttaggagggagatgccactcagtgcagagaaaggcccggctactgctgtcaggacacggacccctgggcgctggagagcgtgctctggaaagcagtcactgcacacaaataagacatatgagatggaaaagcagctgcccaggactgtcggctgtcacccctgggtggggaaattatgggtggtgtctgttatcttttcaagtatatctttatgttaaaaaaccattaatttaataaaattgttaagtgagatattttacattatttttctttcaccaagtcttctaaatctgtgtattttacactaccagcaccttccaattccgacagccacgactgcccagcccttgggtgtggcccgtggcccccactggtcagcacaggtgggtctgaaggcacctgtcagggtctctgctggtcggagccagcacacaggggctgagcgacaccgacggcccaaaactgtctggtactcggtgtcgtcccagtcctcacacacaacgtgagcacggcgggacaggtgtaaccccccaggtgtggcagctgaggttcaagaatggaagtgacccccaagcttggagacagtagggtttcaacccaggtgtgtctggggtcctgcacggtgacccatgccccaggcaggctcattcctgagtctccaggtggctcccacaaggagttagggaaggaggcctccaggctggctgtgacccctgaccccgcacttgcccaccaggagacattccagcctttcagttcttcagaccttagggacacctgaccttcgctcagcattctccagaggacagagacagccgtcaggtaagactggagcccagcggggggacccggcggcccgaggtggcgggagtgattcctagggcgacgcagctctcaggcagggcggcaggagcagcctcttcctccctttggggaggccacgctgcgcgcccacctttcccaagagtagagggcgggaaaggtcagacgggggaggcagggcccggtagcacgccggccacccacctgccagggaggacgctgtcccggtcatgcagcacagtggcagcgcgtgtggtgatcggtgaccgccgagaccccacgcctggaccccgcggccactccccgaggggcctccccctccccgcacggggataccccccgtcccctccccctcctcctccccgcgcggggcctccccccttccccaaggggcctcccctcacctctccccccaccccgcccgcccttcccccacctcgctcctccctccatccgcccctcccctccccgccccaccccggccctgccccgtcccaccgcccgcactcacgtcgtccatgagcaggagcaggatgttggggggctgcggggcgcccgaggcccccatccccgcggcgctgagcaccagcaacagctgccaccacctcgtcgccgcgacaaccgccgccatggcaaccacgggagccgcggagccccggccagcgagccgacctagcgagcgtccgccggcccttccggctgggctgcggggcggggcct

SEQ ID NO: 410 - DNA, 4015 bp, Homo sapiens
gcgtgaccagcggcgggtcacgtgacgcggtgcctggcgccgagcctcccaagatggcggtgtgcatcgcggtgattgccaaggaggtgcgtacgcgcggcgtggggcgtccgggctcgcaccatcctcggctctccgctttctttctacttcttccctgggcttagaaggcaccttaggaaatgggacctggaggaggccttcgccgagctccagcggtcaggggcttcgcggtggacgagccgccaggcagaccctgactgagaccccagttccgcgctcgcccgtcccgctgctgaacgcacccctcggcgcagcaggtctcctccccgccaggacccaccagaaacctaggtggtcccgggcactacctccgtcctccgtcctcagcaggttctgcccgttctcccgtccagcgctggttccccgcggacggcggccccggccctcctgccagtctccccggagccgagttaaaaacaaatcggatcctgtcacgcctctgcctgagacctctgcagtggcttctcgttgccttaggatgctgtctgaataacctgctctgggatcctttccccccataacccttggcactctccgctccaaccaaacaattctgcagctccctggacatgctctgccctctcacctgtgggcctttgcacgcggaacacctctccccagctcccatcctctttactggcccacatacatttcaactggaaagcattttctgaaggctaagactgagctgggtggctgcccacacgctcctgctgcacggagccttcatttcctagccagggtctcccgagaccagactcgagaccgctccctgctgggcggtggctgctgctaagctgctcatgggcttccctcttggccaagatgatcatttgcttgtttgtgggtttattgactaggtatcactccccacgagggtagcgaggactcttgttcactgtatttgtgcaggacccagtgctgaacacacacagggtaaatggtggtgtgtgaaagaccgagaaagaagctgttaattctgggcttccaatggtcagaaatgcagagatgaagggaatttgagctgagtcttgaagggtttagtaaaagggtcactgtcaaggtgaagaaaagccagtattgagggtgctgtatttgggtgagccatgcagagttagaggtgggctgaggcagagtggcctccaggagaaggtgagaggcgtgcccaggtgccaggcttgatcggcaggctgtgctcaggcccatttttctgattcattttttcttttccgcccaccctactgctgctgctttgcaaacaacacataaatctccttaggttagctgggatcccctgaaggcagtgcccactgcggcatagagaatgaagcggtgggccttagagcatgggaatgcgttccccgggtggctgcaggtcacggctctgcagcatagttcagagctggtgtgcgctgggtggagtcttgtcctttcagtcgccgtcatcctttcttgcagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggtgtatctttcagggcagggtgtgtgtcagggaggacctacagttgcaagatgtactttaggatcagataacttgaaaccttttagaagaaaaagaggtgagagtttttagccagccagggaattagggtagcttgaggtgaatgaaggcctgtaactcttctctttcattggaagagccatttgggaaaagcaaggctagaattccccgtagaatgttttggtttgcacgtgtccgttgtctggtttgcagaggaagtgggacacttctgctttgtacctgcaaggatttctttctgtgcttttcagggggagccaccacctttgagcaggggataatagtttcatttatttcattaggccttgcctcttatgtcactagacactcgtctagtcccttgggacaaatcacttgaggccatggaattcaaagaccttcccaaaagtcatcatgtagcctgtccatggtgacatttgctagtagccactattttacaaaataatgtggcctctagagaggggatccgccttgttcacgaagcctctggttttgcagttaactttccgggccaggcattgattcatgaagagggtgaggtgttccagacagacagactcggagtctaggtggttcggctcctggagtgtgaactgggtaaggcttggctgcctgctcttcgcttctcctgcaaacaccagacgtcgccctagcaaagtatttaggcttgtacccagcacggccactgcaggaccagcccagcatgggcatttcctgtgattcaaggttgccacatttctccaaagtgagggcccacagagggccctccaccggcagtccctgtgttacgagtgccttccctaaccagctgtgcagatacggctacgtcaccaactccaaggtgaagtttgtcatggtggtagattcctccaacacagcccttcgagacaacgaaattcgcagcgtaagtcagggagttagagggccacgcccgagtgggtgttttgtttttcctttttgactttgttttgaaatgctgagaaactaaaaatctggcagtggctgtgtgtatgtggcaaggtcatggtttgctgggtctttttcagatgttccggaagctacacaactcctacacagacgtgatgtgcaaccccttctacaacccgggggaccgcatccagtccaggtgggccctactttctgtgtcttgccaccttctttctgtaggacatgccttgccattttggttgccaaaatgcaaccatttggaaaataagggaggaaagatctttttaagctatgagcaccatccccctagggcagaggttttaaagccacaaagccccgtttctccacaccaactcttacacagatctccagcgcataaagtggatagagtgtgtgtggtgtggggagtagagcttgcccatttggcttcccaggtgtgcccagtgggtacctggggcacctgcaggactcagggccaagcacatgggcagtggctttcagggatcacacgtccttttgtagctacctgatcttttatgttgaatttggaacagtcaggaacctggtttgcaggtgtcttccgaatagtccacaaagtaaacagatttaacttttgaacatcatgagggaaatgtggggtccatgcccacattccagacttgctttcagtgagtccccagttccaagacataattccctgtggttggcagggaagaggacgctgcagtgatccaaggcaggcccctccctccaccaggacactgtcttggggccatcctggtcccagatgggagcaggcaggcgaatgtccacagtcttgcctcctgggctgcacagggccatccttgccacaccaccgctctgcctgcccatgctgctccctcctccaccccttcctggggccttgggaggctgcacagggaacttggaggcagcagatgggttctcagtgcccggtggggtgggactcctgtcctggcctctcagcggagttcacatttctggaccctggagaaggtcccgagcatcctgtggatggagccatgctgcccggcccgtctctgagcagaggggtggagggcctggctctcctctgagtgggtctgtttctcttagcagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttcagggcaggcagctgtgcatgttctctcaactaaaggtcttgtgagagga

SEQ ID NO: 411 - DNA, 3321 bp, Homo sapiens
ttaaaaagagcccaagtttaataatttatgcttcaccattaagacacacgtttctatttttcttaaaatgacttagttgaagagctgagcatgccaaccccaagctggcctggcactgcctgggactctgctcctcccctccctcaacacccagagccccgcagatccccgtggggcccatgccaggctcaccaccgggccgtggctgtgactcgtggctgtggccttgggtctggaccaccatacaaggccctactgggccatccccccgccaagagggggccagtggctgctctggacacccctctcctctggcctcgcccccgcgccactccctgccccagccccaggatggagcacaagtggtttactcctgatccaggccccagcccctctctcaaaatcgggtcttccctttaatacggtgaaaaccatggtgagaattttccacgggccctgcacggagagagaacacacactgagtggccttccagaggagaaggggtggtggcccagggccccgggggacaacaggataaggatgcagggaggtcacctggctgctcaggcaatgccccaggggcctttctggtgactcccagctgctctcttgggagggtcccacgaaaaggaaaggcagtgccaggagagccccttggggcagctgtagcccaccctggggcctttgtgggaacaagaaggggtcacctctcccagcagagaggctacaaaaagcgccccccccaccagctgatgcagcagccacagccctcacccaggccccgccaggtacattcctgcagccccatgaggaacgagctcagggaccccctcctgcccctgatgccctccaccatggccctcgcccccaggctgcccccacaggcacccactcaccggttctgcccttgtggtctgagccggggcctgccctggaggccgctgtgggggaagggtgcccccctggagcctgggtgtcctcgaaggcccccgcggtctgtggagctgatcccagggaagttggttcttttcggcagcacctggagcaaaggcctgttttgagtcctcctcaaggagcagccgagacccagctcacagcccccgcagcccccaccaccccggagcatggggtcctgcccggctcaggataccattcgggcctacagggttccctgcctttgcctaccatagctgtcatatgacaccccgtcacggccagcacccctgcagaggggggggtcacggccagcacccctgcagaggggggggtcacggccagcacccctgcagagggggctcccgcccgagaggggacacttccccaccatgccactggcagaccaaacccagcttcaggtccgagggtcccgccacatcctgtccaggcccagccaagcaccgtgcctgagacacgctgtgcagagaggagccagctggggctgctgtgtgtcccagggccagtgggccagcccctctgcgctcatgttcctggacctggggagcaccggcgcaccttgatgacccggccccggaagaggctctggtccagctccacggcggcctgcacggagcccttggtggcaaactctatgtaggcataactgaggggaggggcagggaggggaggggtgaggctgggccctgtccgcatggccagtgcccccaccaggccccacactgaccccttggggtgtccagagaacttgtcacacaggatcgtgactcggtggacctccccacagcggctgaagtgggcctccagctcctcggcggagcccccgtagtccacctgcacccaggcccagaccagcatgtgagggagacgcctggccctgactcggggccttcttgttagaggtgaggaaagaaaccccaaggctgggccccgtggcggggatggccccaggcctccaccccacacccccgctggggttggagggaagagaggaaaggatatctcgtatggagcgcttccttctggagagctggagccttttaaaaagcttctcaaaagtggagatttcatgtgcaaccccgaattccagctcatgttgaaaaactggaatatgtgcccaggccagtgtttcctcaaggtgacggggctgcccccagggtcagacccccttcccagcaaggctgcctggcccatggccgggcgccagaccctctggtagagatggggccccattcgctgcctgccccttcaccccgcccaccactcacgttgcccacgtagacggatctgtggtcagcctccaccttctcctcgggggtcccagagagggggcagcctgcggagaacacagctcaggcccgcaggcccttggttccttcctcactcctctcacggggaaggtcgcccaggcttataggggaggtgacaccttggagcctgccaggcccaaccttaatggaaactgtgggacccttgctcagtggggggcggcctgtgcccttggttcctacccacggtctcagggctcagcagctgcccggccgcggtgccctcctcttcctcggcctgttgctgcactcctggaggccgtggcgtcccctcggcctgctccatggcacacaccttcatcttgatggcctccagctcctgccgacacacggccctgagccgggcaggcagcctgcaggctctgctcaaggaaggtgggtgtgtggcctgccagctccagcagagggtcacagccccaaggggcagcccttctctggacagggacactccttcctggggcagctggctggggatgaactcgcccctgcagagaagcccccgaaaccgcacctcaagggcccttccccaggcgagagaggccaccttgaccctgcagtctgtgtggctgggggcggggggtctccttgccaccttcgtccaggcaggtgggcaatggccctctcccctcctaagtcagctgcagccatccgtcacccagaccccgtgtctccaccagcccctgtgccccaggtcccctgagatccccagggcctccacacagctgttacctggtcaggcaatgggcactcagccaggttctcttgctccagcagagacagcagaaagcctgcatccccatcctggtcttcctctgcatcctcttcctcctctttctcctccttcccttccccaccctctggccccagaatctccttggtctcgttccaggccccccagccctgggcctcagggtctgaggagaccgtctggagccaggcctgagtcgggggtgggaagagagagcggctcgggaagggccacatggtagaggggcaggaggaaggtgggccaggcgaggcctcccctccactcccctc

SEQ ID NO: 412 - DNA, 66346 bp, Homo sapiens
tcctgcggtttctgttttttatttggcaaacatctcgtttattaccatcatgaatatcatttggacctctgcaaagactatatacattcacattaacgtacacgctcagcttcaggcctctggcgggctgttcgtggctggttcagtagctgggtcactcccgtattgcactgagttcctagaactcctgatagccacgcacacagatgccaggccacgggccacgccacgcgcacagatgccaggccacgggccacgccacacacacagatgccaggccacgggccacgccacgcacacagatgccaggccacgggccacaccacgcacacagatgccaagccacgggccacgccacacgcacagatgccaggctgcgggccgtgcctgctgtctgtccttgtactcggtgcaagcatgaatttctttatccctttatttccttcttgaaatcgctgaggcagttgagaggagtggagggagggtgggcagggctggaggatgggagggagcacgtctgatagaaaacgtcaccgagacacaccccagggccagaggcgaacgcatctgaggggtggctgggcaggagcaccagggctatgtacacggtcagggtcttccctggggaggaggcagagggctgcttttgtttgtagtttttttgttttttctgcaaaagtttggaagaaaggggagtagctgcggtggggcgatggggccgagaggttggagttggggcgatggggctgagagaggtcggagctggggtgagggggccgagagaggtcggagggcgcggagaggagagaggtagaggaggacgggctggccgagaagcagtgtttcagggaggcctgctggctccgcatgctcgaaaagcagtcgagaatcaacccaaaagattgtcacagttttgtttcggaattatgctctctctgggaagaaaactttagcactttttttccacaagtggaaaacggaaatatgaaaagtcacagggggcgtgaggacagacggcgtgtcctttcctacacatatggagacgcaggccggagcaacggcacacggaccacgcacacgcggcggacgcaccaacgcctacgcagaagagaacaaaagtcgcttctaactgggcacaaaccctctgcacccaaatatcccgacacccacaaacaaaatcagaacagaagagaaaaagacccacatccaaacaaacccaagagcaagtgaaacagtgaaaaaaatactttggcagtgacaaacaaattttggattttgatttcttgtgtttgcttttttggatttcctttggagcagaggtgtgtccggtatccttggctggctagctagcaaggtagttcacaagtatgcttcctttgcttttttaaaaaaactttttggatttttacttaaagccaaagagtttaacattacaggaaaaaaaaatctgaaaccaaaaatgcatcttgagtcagaaatcgaaatctttcctcccgtcttcgctgatcagcctcacgcccctgggggaggggcacagctgggttcagatctccagctataaaatcgcagttttctttctccctttttaatcaggagggggagaacccccccgttttctttgtccatttctgagtagctcttttgccaacacacaaaaccccccaaaattctttgctgaaaatataagccaccaattcgattttttcattgaagagaaagtgtgtgatagtcatagagagagagaggatagagaagacagagggggagagacagacagagaggaaaagagaggtgggcagagccgccgcgcctgcggcatctgctctgctgtctaaagctcagtcgaggcttctgaggatgcttgaagagacgttgtcaggaggtctccgcgcggaatcattaggtagctgaggcaggtgcactgaatgcggttttgttggttctgtgtcttctttcggagaggggcagtagcagcagtgactaattggtcggctcccccaggtcaggcggggcgcagtgtctggcaggccaggcatcggaggccaggcacagcatccggtgggcctggagctgggtggggttggcacggtgctgtgtccggcaggccaggggccagtggggtcagcggggcacggtgtccagtgggccaggtgggctgggggagccggggcgagaaggccccgcagagccggcttcgctggggctggcagcacccacaggcagggaggggcccaggctgtgggcggcttcgggcggtccaggcaccgggtcggccaccacggctgtggggccctgcaggctctggccacacacgtggtgatgcttctcccagtcccgatgctggcagaaggacccgcagtagcgtgccgcgttgcagccgctgcacgtctcactggctttccgcccgcagttccagcagctctgggtgggggcagaggggccagtcagggctgggtctggccacccgaatccccaacacacgcctcaaccaagccattcagacccagccacgtcatcaccaggtgagaagagagaaactccaaagccccacagccctcgggccatgctccagatacagccactcactgggccattttgcgggacggcatcccactaccgtgtctcacgctccagcccacccagataggtctgcgctgtgctaactggacaacgacccctgcctcctctccaggaagccctcctgagctcaccaggctccaaaaccgcaaaaccaaagggcgtggccccggcaggattgaggctgctgagatctcaccatccgcctctgctgcatccacacccacccgtccccctccccacctctgccccacccctgcctctgctgcaccccctccacctctgcccccaccctgtggtgggctctgctcccttcccgtagggtgagttgtgccctaggcatccctgtgggcagagggggtgggggatgccacaaaaagcctgtgggcagagcaggtaggagatgccacacaaagcctgagcatatttcttcttggggcctggctggatctctcacagacggttgggctgtggggtgggaagcccaaacctgccctaggggagaagcccaggtccctatttggcctccaaagcctctggtaccacctcccaccccacctcgccctcactgccactgcagcagcagcttccctgcggactaggcactgccaggcacagtccccgctccaggccctggcccctgccggtccctccgctgggcccgctcccccgatgcctgcgtggccagcttcattcctcccggcatctgctcaggtgtcacctgccgtgaggcctccacagccccactccccacacacttccacctcccgaaactgcacgcctcacttctgcgtttggtgtttccttctcagtgccagctctgtgagagttgtgcctgtggtggtctagcttctccctagctgagagcaggcgtggaaatggccggtgcagagacccctgaatcgatggggctccatctcctcccaccccggggctggcccaggcacagatgcacacaggggcttcagatagagatccgccctatctcaagggacagtcctggggctcccctggaaagggtctctccctgtcccctcttcgtggacaaggcagaaaagggtcgcggagggtcctctgcccccgcctgcctcccaggtgcacgggcacaagcatcgtaattctcaggcctgccgtgtgcaccgggagggagccgggcgcctcggacgccacctggggccctcacagctctcctggatcctcctgttctcacaggctagagaacacgggtttcaggccaggcacagcggctcgcttctgtcatcccagcactttgggatgccgaggcgggtggatcacctgaggtcaggagttcgagaccagcctggcctacgtggcaaaaccccatctctactaaaaatacaaaaattagccaggtgtggtggcgggcgcctgtaatcccagctacttgggaggctgaggcaggagaaccgcttgaacccgggaggcggaggttgtaatgagccgaggtcatgccacagcaacaagatcacttcagtctgggcaacaagagtgaaactccatctcagcatcagccaacctgggctcgagtcctggccccaccgcttcccaaggccgtgacctcagacaagctgccaaccctctcgagccctcagtttctggaactacagaacggggacatccataggacgcctcactgaaccatgtgggatctctgtgctgataaagcacagtgtgggcggggatggcgtgcctgctgcaggatgcccgtgacaactgtgctgatgccacgtggaggctcagaatcctcatgggggtggcgtgggaccgcacgggagccgaggcaggggatgggtgtcagcgtggccgggtggccctacctcgctggagtcctcctgctggttgatgaccgtcagggcgtcctcggaggcctgccgcttcgcctcggccagggcccgctccatcttggcacgctccgtggtgatgagctcgtgcgctttgcgctccgcgtccgacacggctttctgcagctccgacatggcctgccgcttcacctcattcacggcctcttctgcaaaggacatgggcagggctggcggtcacatgggccatcccagatgggtctctggacttcctacgcgtggccacaacctggggacaggggctgtgtgcagctgaacacacgtaccatctgtgcacacaaaggcacatgttgatggggctgtaggcagctgaacacacgtagcatctgtgcacacacagacacacgttgatggccctcatgcctgtgcagacaagtgcatgcaaataaacacaggcatcccaggcatgtgtgtgcaaagctgggtcacgtggtgtcacaagtcaaagcttgcactctaccgcagcggctccccaggcactgcacccctgcagggcaagggcgaggcccaccccagggcctggtcagccaggggcgcacccggaatctgcattcctaacgcgagccgggggagctgctgctgacctgaagcacttggataactctgccgttccgccttcacctctggccccacccagacgcagcccaggaagccccctcgtccagggctctgtgctgtcaccccagaccctgctgttatcctcaccgcacttgccatcctttaacctggctggcctctgaagaccatgctccccgacccacacacagccacacacagatcctgatctgtgctaagatggggtaggctcagagcagcctccagggagcactgcccacgcagctggggaggccatgtttcaactccaccactgaaagagaccctgaggccagctggagaccccggtaccgctgcccaaccctaaccctaaccctaaccccaaccctaacccctcttgctgcccacatatctggctctgccccagcccctcccccaaggctgattcccacggcatgagcaaatgtccccacagccttgcccagcgctcagctccacgtctgcccctgttctgaccccattctgcccggactctggccccgcgtgcctgacgcgcccaggctccgagtgtgtgcgcttctgcgtgccctcctgggtgtgcaggtccaggacccactttattctgctgggcggccaccggtccgtttcctggtaggcgcaggtagcagctgtcctgccctaagtgtgaacctactctgacctctccgtgagccacacagcggaatgcagaaagccttgtagcctgagcccccagagagagacagaagctcttcaaagctgagccggtgagaggcgcatctggggccctggcctcccacagctctgctggccaggcccctgcacccccactcaccagccttcctccagatgtcctcaggcacgtagccggtgagggtcctcggcaggaactcgcgaggcacgtctgaaacaggggccggcgtcacacaggatgggccacgcggctgcccctcccacgctggggccctccccaccctggctgggccctgagtgcagggcgtgagtgtgtgcgtccctggggggaggcccaggtgccctcggacaaggtctggctcaggcacccagggcagtgcccgggcacggggggcattggagctgtggaccttggactcggctgggagccgtgtgtgtcctgggcctctcctgtgtcagcattcgtcgctgaggcggagaagcagagaccctcagggcctcccagctccgagcctctggcccaccagacgctctgagctccaggcttcctggcagaccagcccgtgttttcctacaaagtgaaaaaggtgcctctttctcaagcgaaactgttctgcctggtgtttcgttgcattgcctgcctgacagctcccaggtgtccgccccaccagagcaccccgtgtctgctccctccccccacaccccacacgcacctagctgaggcccttcgggaccggcggagctgctgcggggccgggccgcggcgggagcggggcccttctttgtgtcctcggcgtcgctgtagcgccgcgcccagtggttgagctcctcgcggtcggcctcctggcacctgcgcagcaccgtgagcgagcgccgcgtcttctccaccatgtccatgatgcagttcaggagctgggggcgggcggcgcagccttcagcacctcagagggaccgggacgcaccagacactcccccagcccactcggccagagccccggacaggatgggtgcccgaccagcccaccgcccgtgagagtaagggggtgagggagggcccacctccatggcttgcaaagatgggtccctagcctgggactgccgagcgcctgggggtaccagactcacatggacacgtgcctagacgcacgcaggagtttgggattctcctttttaacccgctcagcggggctctgcctcagggacctggctttccgcctgggctccccttccaaaaagcatgagggcgaggggcgaggctgacaacagtgctgggaggggtgctggccccatgcctggcgacccctcctgggacgtgctgcaggatggggtgggtgggttctgaggagcccagttccgggccgtccccgaacacgtcctgcctcaaagaggcctcggcactgcttttgcccacacttcttgcaagactcaggatagactctgggaagagccagtgagcagaaagtaagtggagggaagcaaggcccgccatgagggttttaggaatcctcctccctgggcctctcgagatgcctgggctgcgctgacagctgggaggaggggggctcaggtgaaggacccagccgctgcgcagggacggcgcaggccacacaggagggcactgagctcaggggcgcccacacagccctgctgtctccagcagccccaggccccatggggcagagccatggccgtgtttatgcataggcatacaggtgtggctgtgtggggacatggctgtgtgggtgtagctgtgtgtgggcatggctgtgcgtgggtgtggctgtgtacatgggggggttgtgtgcatgggtatggctgtgtgtgtgggtgtggctgtgtgtgtatggctgtgtgtgggtgtggctgtgtgcgtgggcgtggctgtgtgcgtgggggtggctgtgtgtgactgcacgggcgtggctgtggctgtgtgggcgtggcttgtgtgggcatggctgtgtgcatgggtgtggctgtgtgtgggcatggctgtgggcgtggctgtgtgtgcatggctgtgtgtgcgtggctgtgtgtgtgcgtggctgtgcgcctgggcatggctgtgtgggcgtggctgtgtgtggacactcacgttgttgaggtgcttccactcttctgcccactcacgctctgtgagcttgtggtcgatcacttcttcctgccgggacccaggcaccactgtggatgggggaggtgcacgcttaggtcccacccacagccagtctctgccctattctcccagaccccgccctctgctcccaggccccacccgtgggctgtgcccgctggggacgatggacagggtaaccgaagggctggttgacttggtgaccgtggaggatgcctgggttactgagccgcctggggctctgggccgactgctcttcccctgcaacacggcacacgcctccaagggagggttcagtctcagtcccattctgcagctgaggaaactgaggctggttaagaggatgtgtttgcctgtggtcaccaggcagggagcggtgggggtggggtgtggaccgaggctggctggagctggagcagtgtcctcagccactggccgggaaggctttgttagactaagcgtggcctgaggatgcctcagtgccaagtcacaccatgacctggacctgccttagtccgtgaatcaatgggtaacctcactgggaggagctggtctcagtcattcgcggcagccctctgcggtcacccgcaggcgcccatgactccgatgaagccacgccaaacaccacccaaccacgtggcctcggcacccgcctcctgtctctgcctgtgaacaccgccagccaagccgaggccagggctctcggaacacgctggctctgaggcccatcctattcggggttgttctctgctcagttaaactctgttcaatacagcgtgtctaaggtttttcccttttgacaggctccaggactgaagccgcagaggccactcccacaggtcaccagaaactaagacgtgagtgacgcccggcagtggccgactcttccgccgtggctgtgcccatgggagacgtgagtgacgcccggcagtggccgactcttctgcggtggctgcgcccacgggagacgtgagtgaccccggcagtggccgacttccacggtggctgcgcccacgggagacgtgagtgatgcccggcagtggccaactcttctgcggtggctgtgcccacgggagacgtgagtgacgcccggcagtggcttactctttcgtggtagctgcgcccacgacttctggagacatcagaggcttccaggccccactgttttctgcatttggccactgcccacgcttctggggctgaggtctccctcttggggcccttttcagcccctaaagatctcctagcctccgaacctgaaatggctcccccaaattgcagaggaggtggggaagtggcagccacagctcagtcaccagcctgctctgccgcctgtgaagctgcagctggcagcaacaccccaaccaaaatagtggctgagacgtgcccgacagctggcgtttatttctgtattagcagaatcgggtgggagtcagcacctgcctgacccggctgcagcatgccagacgccgtcacctgctgcctgggccctggaaccctccgcaaggtgggggctgggagatggccttgtgtagggcaaggcctctgctgaccctgctgctgggcccccaccgggccctgggcctctgtctcagcatggcagactggaggcctccctgcagcctgtcctgggggggctcctggggtggggctgggcctgaccatctctgggttctcagcacagaggccgtcaaaacgtcaggcaggctgggctgtgagactgtgggtgcattatgtgtgctctcaggcctcagtctcctcatctgtggtatgggggtgctgacgccaccccactgacgggctcagaaacgagtgaaggataaaatgcaccgagactccgtgcccacctctctgttatccacaccagcctggcctcacgcagagactctgtgcccctctcctgctctagataccagccaggcctcacggcagcccttgctgggccctgcattaactcccccaggccttggactctgagagttgggactctcgtctggcccaggtgacagaggaggaaactgagaagcagagagccacgtgactcacctgtgggtggactgtgggaatcgccaagctcggatgagaaccacgtgggcagttccaggcccgaggccgcccaccccggggggagaggtgggttcagggcccaggacaggcccctctgcagccaccgctctgctccagggggaatgccaggcagggggaaggggtctcccgagctcaggtgcacacagctgcccgtggtgccctgtgcccacatgctcaggtgtacatgtgggcgcatgtgtgctcctgtaacacgcgtccacgctcccgccccaccgggctgctcaccaagcggccgatggcgctctcgtagctcccgggggtctgggtggcggtaggcatctcggaagtggtgggccatggctatgtcctccaggcggtagtgcggcggcggtgtgggctgcggtggcccgttgctggggctgtagcgctgggcagggttcagggtgcatggccgtttgctgaggtgctcggggtgcagcgggtcgcggtctgacccgttctctttggtcctagccccaagagcaggtggggcgagggcagtggacataggatgaaccggggacagaggtgcaggtggggtgagaggcagacaggcaagggcagagagaaagaggacacgtaagggcgagacagaaacacggagcaaaacaccagccccgggaagcccagcccggcgcccccactctctgcccctctgccggggcccatgccagcctcaacccctgctccagctgcatggcatcctggggcctggtggtcaaagagccggactcgctgctctgggaacgaggagagggatacaccaggcttccgtaactggagaccacctgccccttgggcagcagcagcacaagagcgtctggggcagcagagggggcccagcccaggcacctggggaccatggaccccggacgctcggagtccatgcccggcacacaggggagagccgtcctcccaccagcctcctccctgtcctcctaggctccccggagcatctgagtctgcagcccactggggtgtccgcccgtgcagccaccaagcctgctggccctagtacacctcgccacgctccctcagcccgagagagccggccgggctggctgcagccccagaggaggttccctctcttacccagaggggagcagggtgagccgcgtgtccacggcacccccagcccagatccccggagcccacaggtacctgtcgggcgtcctcctcttgccgttctcgttgacttccagtagcagctctgaggagtcgatgggggaggaggcgctggcgtccagcaggagctgctcatgctgggccaagtactgggcgggcgtctgcttggccaggcgtgcacagtgcaggagctcccgctgcagcaagggcaggtttgcctgtggggtggggaaggagggcctgggtagcatgcaggggtgcacagccctgctcaggtccgagcagagggggcctgggctgggtggccgaaagctcaacttgacctcgggcctcaaaggtcaaggtgctcgacctctctgggcctcaagttccttcctagcagtgccatgggagggtggcgtgggagggtgggcacagagcttcgcaggagtgcctcacctgggccacacggcgatgtggggcatgtgggacttgagcccagatcctggactcccagggtggggctttcccaccgcacccagctccctcccatggcgtggtctggagaaggcgagaggacgaaggggcagcagatcatggttggtcttcccgcctgcacccgccctgcccagcaggcaccacatgacccaacacagctggggaaatgcaggctcagagagggggaggcagccctgggcctacaggcggctcacacgagggagctgggagtgaaacccagctgggattgcctgcagtgtgtctgctccagccctgatgggaagccctgaggttcagcttccccttcccttcccgctggtttccagccttggccttgatggagcgtggacctaggacgtggacacccacgttctgtggctgctcaagtgatcctccagccttggtgaggacggcctcaagacccacgtgtgcgggtaaagactccgcagcatgcggccgaaggacggcccggtgtacgggatccgtatgcagaccctgcctttgacgcctgtgtgtacccgcggcgcccgccgcctcgtccttggctccaggctggcactgctgggccgcaagccgggctcctcgggtgccttccccaaagtcttcccagagctgccgcgggagggcggacaggcgtgctggaccctgagcatgctggaccagggcccagcagcaggccacttgggagagccagcggttctaagcatttgtaaataaatccaattccccaactttctcatgcgtttcaaagctgccacgccgccttctcctgccagcgcctccccattccccacgagtgcatccaccaggccctcgagcagtgccggctgccggcctgtttttctctttggatggctgaacaggggccaaccggccatctgttgaggacatcaggagcatgagctgggaaacgaggtcccgggaggtctgaggagccaaacatcctccctccctcatcagcccctccccaggggcctcctcttggtcagttcgggaaccggctggtcgctgttagggcggggagaacatctggatccctggctggctggggccagctgaggccagctgggagccggggcggtgggtggggctgcatcccccagcttctggaaggcctgacccttgggctgcgtgtggggcaggctcaggaaagggtgcagagaacccaggactgggcagcatcagcgtaggggccggatgcacagcagccctcggcaagcagggaatgtttcctcaaggcctgcggaatggggtggggactgtgggaacctccggcagtgcctccttcaaggcagtgtccccactctgtccccaggagcccagggcacccggggaggtgtcaccactaaaatgctacacacactgagctggtcaaaatgccccaactccaccactgaacggaagttctgcctgcagaacttctgaagctgccctctgcacagatgggcgctcaggctggggaactggtgtttgcaatgacggcggcggtggctgaggcactagttgagctacaagggctttcgcggactccgctgctctgccaagcacccagctaaagcctccctgaccgtgggctctgccatagaggggctgtggccttgggctggtcatttaacctctctgacccttgctgtatctgcaaactagcgctgtggagcctctggccgagacagactccggggagctccgggtgaatcagctcagtcctttcccaccaccccgtgagggagattcaccaccccaactacgagagagagggcccaagccagggctggggttccagccaagcaggcccccactctctccggcccctcagccacgattcctgccgtttctaggatgatgtcttcaaggactgcgtgagagtaccccagactgggcctggcgggctgtggatgtcttgggaaggtgctacccctcccccagcccaggccacagtcaggaacaccgaggcccaaggggactggctgggggtcactcccactcggcacctcctgtctggcctgggaaggtcggactcccccactgcactctgtgtctgaaggggctgcggccctgcaggggtgtgggtggggttgggggggtgcgggtggggttggggaggggtggggtgggggaagggtgtgggtgggggaggggtggggtgggggtggggtaggggtggggtggggtgggagggggtggggtggggtggggtgggtgggaggggtggggtgggggctgctccctgggtgggacagtgacagtagggccagggttctggcttgtatctgagccacaagacctggaagcaggactggccgcaagatctttattttttatttttgaatcctcctggcctccccctagaagcgccatgtcagagaggtgaacagacttcatgtcccactggccccgggccccgggtgggggcacgaggtgggctggccctgagctccagctaccccacacaggccgtgggatcccctgtgtaccaaggggagactgaggtggacacggccctcacgagagccgggccgcgggcggcacctgctggggcgtggccgggggacaccagggcctgaccagacgtcatggacaggggccgtaggcctggtgggggcaagggtggggatgctgcggcgtttctctgcctgaccctgatcctcagttaagcaagggtggctgaggctgggggcatctgttggtaataagcaggcgcactgtgtccccaaagactgggaggggtggagtccgcagcaagttaaaagaagggaagggaagggccgctaacgaactgcaaacgacgccagatgggcccaggctcctgccactccagaagcttctcttttgtcaccatctgggagcatgagcacagcagggcgtgggagggggcggaggaaggcgggaggagggatggagcgatagaggagggagggcaggaggaaaggagggggtggtgggagggagggaggactggggcagcggagggagggagggcaggaaaaagcagaggaggcaggggcgggagggagggagcgagggtgggaacagaggtgggtgtgatgtggggtccccttggggagggactgaggggaatgagggtctgaccctgtaagtgccctgggacgaccagggcgtttggaatttgacagacctaggtttgagccctggcgccctctctccactacctggggggaacccagagcctcagtttccccacctgttaatcaggaacatggcagtgcctacactacaccttgacagaggccaacaggtctgtgagagaccttcctgaagcactcctcctcctccagggacgacaccccgcgattcctcctcctccagggacacttcaaatccctggacgacgccccgcgattcctcctcctccagggacgacgccacgcgattcctcctcctccagggacacttcaaatccctggacgatgccccgcgattcctcctcctccagggacacttcaaatccctggacgacgccccgcgattcctcctccttcagggacgacgccccgcgattcctcctcctccagggacgacgccgtgcgattcctcctcctccagggacgacgccccgtgattcctcctcctccaggggacgtttcaaatccctggacgatgccccgcgattcctcctcctccaggggacgtttcaaatccctggacgatgccccgcgattcctcctcctccaggggacgtttcaaatccctggacgatgccccgcgtgaatctagaacatgcctcacctccctgtagtccccgctacctgggaggctgaggtggaagattcccctgagcccgggagtgaggccccgttctttccgcgtgtccctccacgctgtctcctcaacagcctgaggatgattccattttgcagatacagaaaccgaagcacagaggaactggcctcacccaggggccaacagctgctaagtggcaggctcgggctcaagccagggagcatctggtctggtctgtcctctggacccccgaggggaggcctggcccagcagagatggagcccacagcagtacgggcagtgctcaggctgggcccgaaggtgtggccaggctggcagctcccaactaagctccacggaaccctgaccccaacacgtgctcggcagagaaggtcacatggtcagacacatttggggaacctttcctcagctcctgctagagatgtgcagccgtcttggggaaatggagacccgcagagatggcagtctgactccacggcactcccgtgcccgtcccgtctgtgtgtgcgtgggaatcactctcccatgggaatcactggcttcattcattcattcattcattcattcgttcagagacagggtgttgctctgtcgcccaggctggagtgcagtggcgtgatcacagctcactgcagtctcgacctcctggattcaagcaatcctcccacctcagcctcccgggtagctgggatcataggtgcatacaacgctcagctaatttttatattttttgtagagatggggtctagctgtgttgcccaggctggtcttgaactcctggcctcaagcaatccccgttcctcagactggcatctttaaaaatgcaggctctgattcagcaggtttgggccgggccgagagcctgcaaagctgacaagccccgcgtgctgccaccctggtccacggttgatctgggtgtgaccatctgacctgctttcacctgacacctcttcatccatcggcctgcgcagccacagaagccccttcccgcctgtctaccgccctcacctcccgccctcacctctgctctctccaccccacgtattctgttccagtcacactgacccctctgctgttcctcaagcacagcgggcgccccatacctcagggcctctgcacgtgcagttactgctgtctggaaaaccctgcgctggctctgcacctagctccgccctcatcctcagccctcaccaacacgcctccaagcaaaggactttcggaatacttctccaccacgtgcagctgcagatttgagagtggctgtggaccgaacgccttcccaccccagggtgctggctccaggagggacctgctgcatgtcctgggccctatccccgagccttgcccccacactggcacgtcgtcagtgctcaaaaatcacccgtggagtgagcgagcacattcggccaacggcaaccagaggcgaaccggacagctctgtcctgtgctggatttaagggctgataatcatccggtctggcaactaattttcaggccttaactagtaggagtcaaccctgactagtcagcagtgctcccctagggtaccacagggtcccaggttggccaagatcgatgcctcacacctcttcatccacctgcctatctggccacttaagccccttcccgcctgtccaccgctgtccacgctggcaaggagtgggattaaggggccttctagggaggctcccgcagcacgggggacgggtttcgcattaccttcaggaagggaatgacaaacggccgcagagggaagttggtggcctcctgaagcttggaatgaaactcctcgatcgtcaatgtcgagttctgcaggggagaaaacccacctcacatcagcaccgctcggcatgtgagccagcgccgacccacccatgcctgaggaggaggcttccgtgttggaggcaggcaggcagcccaggagctgggcacggcctgagagggtgcaggtggcatcgtgggagcgggtccacgcccggttgtcagcgtggagcccatgtaaggagtggccgtggctgcaacctcattaaacggagggaatatgcatgtcccaaggccccggctgtccctgcccaactcaccaccaggcccagcaccagtgtgcgcacgcgctccccaatctctggggagatgtcgctgccaaactgctgcagtgtggtgaggaagcgcttgagcttgctgagctgccgggccccgcaggctgggggcaggtgctgtgtggacaaggaggctgtggacgaggtggccgggccattgctgaagccgttgggtgtgcacggtgcaccattgatggctgttggtgagtggctgctgccgttcatcactgcaggagggaagcggacatgaggacacaaaggtgatggtgacaacacaacccagacggcggcgacagtgagggaagcagcgactaaggtgacaatgtcaaaagtgacggcaacaatgatgagacacaaggacagtagcgctgaggatgacagcaggagccctgggcccgcccagggcagctgagctggcccttagcatgctgaccatctgtccttccggccctgctctgagaggtcacacacacccccttacagacctggaaatggattcccagggaggtgaagcctctttgccccaggtccccaatgggtaagggctgggatggcacccacaatggtggtggccgtggaatgactgcgttctgagtgtggcttctcctgcctggcaccactcttgggacttgctctggggctgaagtcaggcccttcacacccagcaggggtgcggcccctacgcctggcctgggagacaccaaccctaccaggctggctcaggttttcactgtgaacagggagcaaggggcttctccacacgtcgggggcttgatggctcacttcccactttctggaggcacaggagacttggaaaatgagaagtcgctcatcccccgaaaggccagctaccatcacctctggcatgatgttcccaagcaatacccccacccccaatcaggcatctcccagccctgagcaatgtccccacaacaggtgcctcccagccctgagcaatgtgcctccccacacacaggcgcctcccagccctgagcaatgtgcctccccacacacaggcgcctcccagccctgagcaatgtgccccccccgacacacaggtgcctcccagccctgagcaatatgcgctgcaggtgctttccagcagagcaatgtccctcctacaagtgtctcccagccctgagcaatgtcccagacaggtgactcccagccatgagcaatgtcccagacaggtgactcccagccatgagcaatgccttcatttgcacacagccccaacgcctgctaatggggttccagggggcagaggagctgggacacccaaggacacactgggtgggttcctgcccctggcggctggacacgcagatgcccgtgcacacaggccagtgcatgttgaggacaagcaggtgacataaggaacagctgatgagcgcgctgcagggccgcctgttggccactgagacgtgactgcctggctggccctgctattggggtcagtgttccaggggcctggcagacatggggctgctatggaaagtcccagggccgggcctcaccccttttctcaggtgacagagctaaggccaagcctcttgcaaggcggccagcgcacccctcctgcgcctgggacacccgcaccccgtgcccttggcctcaggagcctgaggggcggcctccaggctctgaaggcaggtcagaggtcacagggctcccaagtcccttgctgacaggggagggggactggatgcctctgggaggcctgaagtcctggccagctccttctgtcaggaggactgaagccccgcacacactcacggctggctcccgcctcctgcagaaggacacgctccctacaaagggtaccaactcccctgccctcagagcgagccctccatttccctgcctccactcaccccccaccacccttacacacatgcacgcacacatgcacacacacatgcatacatatacacatgcacacaatgtacacacatgcacgcacacatgcacacacacatgcatacatatacacatgcacacaatgtacacacatgcacgcacacatgcacacacacatgcatacatatacacatgcacacaatgtacacacatgcacgcacacatgcacacacacatgcatacatatacacatgcacacaatgtacacacatgcacacacacatgcacacacacatgcatacatatacacatgcacacaatgtacacacatgcacgcacacatgcatacatatacacatgcacacaatgtacacacatgcacacacacatgcacacacacatgcatacatatacacatgcacacaatgtacacacatgcacacacacatgcacacacacatgcatacatatacacatgcacacaatgtacacacatgcacacacacatgcacggctatgatgtacacgctcgtctctcttgctccactgtggccccaagtgcccctctccaggggatccacccctcacccgtgctgagagtgtgggtctacgggtggggggcagctcagagccacctgctccctcagggccgaattcctccgaggccccagccgtgtgttcgcacctgtggctgagacctggcggggcctgtgtgcgccgaggaggaggggaaaaccctttctacaggatggagacgcccctgggctgggctggtgcagcggctccccctgggcagccggcaggcaccagctgtttccttcctgtgccctggatggtggggggtcttggtgtacccttcagatcaggccagccctgcccatcctgacctggcccctgggaggtgacccctgctgagtgttgtggcctctgtctggacgggagggaacatgggacgtggggacctacatgccggcccccctttctgggctgcgtccccacagctggggctccggctaggccaggcctccctttctacccgctcctgcaggcctggactggaaggggccgcaccctccagagggcactgaccagcccgtacctccaacaaggcccttctgaggggtcaggccctctctaagtgtccctccagtaacctttaggtggccgccatcagcttcctccactccgccttcccagaagccgcctgaggctcccaccttcccgacccgtggtctagtggcacctgcgaagtgcgcccgggtcaggaagctgtgctgtggcccgggctgggctctacacctgcacacaggctgcgcggttatcacacacatcccatgcggcaaatgggctccgaggaaccgaagacacacagcagggcagcccggctcccccagattgcctcccgtccccggcaggccccacacaccgagcaaacagcgctgggcacagtggcacaggggggaggccggccctgtgctctggatgttcttggtggagcggggggaacaggtgtgcccacgactgcctcccccggggcccagcgctcactctgctctcactccagcctgggcctcacagatacccactgcaggggctgtgggaggccaggagggcgggggatgctacagaggccctcagacacaccagcgtggtgaggaagtccagacagacacggccctgccctcgagggctgggggaagctgccctggttaggagtgaggaccggccgccaggcccagacgtgccctgtgagtcagactcggcgcctagcctcagtttcttcatttgcaaatggctcccaacccatcctggagttccaagtggggctccagggaccagaggacagcatggcagtgacctcctttgtactgtgtgtccccagccagagtcgctcaggcctgacctgggcttccccagcctctcctgcgctgcccaagtcagccccccagggttgctccatcctgactggttttatgggtcgggtgttgtgtgaggctgttggcaataaacagcccccacacctagtggaattctggaaaccactaatcgcaggtcagatatggcacaaaaccttgagtgcacgcgtggcctcagactttccctacgggggggctgcaggattgagacatctctgttgctggggccgcgaacctccacacgctgttctgagcggctgctcccctcaaccgggcaacctgcacagggggtagcctgtctgcgcccctggcttgaacgatcttagcagcgccttcctgggctcaggatggacgcaccggccctctggagcgcgcggcaccgataacggcgtcgtattctggggctttccctcttctggggggacagtggacgctgacacaggatgcaccgagcccctggtctctcgccttctgagcctctgtccggaggaccccaccgcgctgccgagtttccctctcaatggtgagctccatgtggccacacggtggactgtgacacacacaccccgtcaagactgaggatagccacttgcggtcacccagccaggccaggagatggcccgtcaccatgggagacctcactgcagcgggaggctggtttctccagaacacgagggactgtcgtcaggactgtggaccttccagcagcttctcagacgcgccacagtgcacgccggggcccctgcccaccgccccggccagcctgggcctggccctcccttaggtgcgcttaccagccttgccccgggtgcctggtccttccggcggcctgctcgccctcgcctgcccgcgcactccctcccgcgctgctgggcagtctcagcagctaaagagacgccaaaaataaccccggcacaagcgctttcattcccacgacaggtgtgttcctaagttagaccgcacacgtgtccccagctgaggattgggggcacacgcgagcacccccgcggctcccccagcctcagagccttggtgggggggtcagatgcgacagaggcaccctaacgcagcccctcctgtcacccctgctccttgctgtgggggctccgggatctgggattcaccaactttgccatccataagatcacagagtggatgacaagagccactgtccaggagctgcacgccaggcgcgagtgcgtggccaggcccatcacagaataatggctgtgaaaaggacagccctgtgcaacagaaacaacgcacagttgttctgctgccctcgttcttagagccgggagtgccacgacagccacacctgggccatgctgccaggctggctggtagtgatggaccggagtctgtctgatgggctcaagcatggctgcactcagtggttgacaaaaactataaccaccacctggtaagagcccatgctccctgaacgcccgccatgggccacgcacgttgacagaaacgtctgctggtgactcaagtctgctgagctctcagcatgtgcccggccccaccatctgacggctcctggagatcaccattggcactaggggccatgatgacttccattttacaggtggggaaactgaggcacggggggtggtacctggccaaggtcaccctggcaggaacagttgcagctgggactccaggtaggtggggtctgccctagcaatagctgagctacaggctggccagggacagtgtctcgcccctcccctcggcactcgcagtcagccccattggccatgttttgctgctggggaaggagagctcagagaggctctgctcctgcctaaggccccgcagcttggagcggagggtctgtgggatgcagcgacccggcggctctgccctcctgcgccctcttctccctaaggaggcaagaccaacacaacagaggcaatgctgagggtgcggaggccggggaggagagctgagcgcccccagggcagcagtgttgggccagctgaggatgctgcggtgaagacctctggggaggcctgcggtttttgttattttacttacagagacagaccatagaccattttaagcagccatgaaaacggccgtggggcagcgtcgcaggcccgtcctctcgatctgtaagcaaaataagaagaacacgctgtcaggaggggcgtgggcaggagactctgccctcaggggcgcccgcggccaccttttcctacttctcagagtgatttttggtgggggcgtgggcaggagactgccctcaggggcacccgggccgccttttcttgcttctcagagtgatttttgattttcggaggggcctgggcaggagactctgccctcagggacgcccgggccgccgtttcctgcttctcagagtgattttctgacggggctctgtcaccacctggggccaggccactcccctctccgagcctcagtttccttctctgagagtgggtgatccctaagggccgttctggcagcactgttccggagtttacaagaaccgcggcttctctatgagcaggggcggggccccttgttttcatcgtcctcttcccagaaggcccctgtgaccccatgagcaccatcctcagggacctgggccgaagccgcgtgtcctaaaagcgacctgagactcggcttggagtctctgaaacaaagccctgggtcggcactggaggaggaagcaccaaacaggaagaaagattcggctgggctcagtggctcacgcctgtaatcccagcactttgggaggctgaggcgggaggattgcttgagcccaggagttcaagaccagcctgggcgacgtagggagacccaaactctactatataaaaaaagaaagaaagattgaatttgttcgagctgaagtcagtggcgcaggccacaggaagacaggctctagtaaagacgggtagtgagttctctgtcatgggggtaatcaagggcaggataaagccttagccctttaagcgtcctcccagctttagaggagcttggtctgggtccctgctccttatatgccttccccctccccaccccccaccccacagcagcaccgcagcttcaactccaagatgaatttgcgcccagggctgtcactgggcaagagaaacttcggccctcaagtctccgttcagactcagtctcccatcagcttggctcagaggccagtccccggggaggagcctcccggcagggctctgcaactgagctgtggcccctgaagggcacccaccacccaccagccaggggcaggggtgcggccaaccacctggctttcacggaattgtgtggattaggggataaatctgaggctacctcaggggtggccagagcctcagactgatgctgctgacagcccagtgggactgaagcatcggcttagaaaagaaaaagcacctgcttatctctttcataaccttcacgctccttaaaccagctgggacctcaccccaaaaacatgaccccaaggcgggctgggagtggagggagcaggaaggaccccagccccaggcatgccggctgccctcacatccgttcacaggtctccagaagcagagcccgacgctctgctgatcccaacccacctccagccaggagcatcagaccggcaccttccaagcagaggctgctggtccccagggaagagcaggtgggggagacgcacccttgagggtctggggaaccaggctcagcccacggtgtttgtccctgacagtggggcctgaggttgtctgtggagcgggtgttttaggcactgcgcccatggccgggtctcccgtggtccgtcctgagcgtttcctcccccggggctggggtatactgcaaatttaacacagcagcggtctccctctacctatgtgggctcggtgtggtcgcaagctgcctggtagagagacggcccgtggtttgtaccagaccggagggctcttccgaagagagggaagggtgatcccagcccggccacatcgccgtgtgacaaggacatgtgagaaaaagcccagccagcctctcactagaaaccgtggccagctccgcagagccaggacctgcacgctgggcccgccgtcccccaggacctgcaaaatcgtgagtgcggcgtcccgactctctgaggcagggccggccccgcgggtgcagggagtagccgttaggctgtttggctcctactgagtgccgggcacatttccagctgtacctgcctctgggcggcacacctgggggcaccccattgctgggccaccccattccccaaccaagtcgggaggctgactcggagccaacatcctacaaacagggccgcaaatctgctgcctgaccgcacagccagtgctctctccagatggaggggagatgatggccaaagccctcggcggagcaggcccccagcctcagcggcagagccagggagggagccaggcctggcctatagccacccggtgctctgaggacagtcgtgacgtaaagggactgaggaagcagctctttctggcccgtcagggacccggggcaagcaggacggaagtctcaggctccccgcccagagaggggcttcgtttgagtttcagagcctggggagggtcccccaggtacggggctttctggccgctgcatgtggaggtggtacatggagtctcccccctgcagacactgagatgcactcctgagcccccagccttgagggacagggacgctgccaccccgccggcccagcaactgggccaaagagcaccaatgtctgtcctcaaagccaaggctctgcgggtgactgtgatgagaactggctgttccctgccccacagcctcccagggcccaccatcggcggctctgtgcgccaagcacggccaaccccttgccagggccagcaagacaaggcctgacagcttcttgaggtcccacccttccggcctcctgtgccaaggcccccaccctggcccccgtgctcagccgggctgtggagctcctgagatctgagcccctccaaggccagagctgcctctgtggtccctccacggggcctgtacgcaggtgacctgctgtatgaccctgcggaagcccctgaccccatccgagttccacgttctctctggatgagcctggcattcctaggcctgccggacgaggcaggaagcctgaggcacagcggccggctttgacccatggccggccctggtgaaaggcctgtgtggactcacctggccccaccacagccctgggaggacctgcattgcagaagaggaagcccaggccccccggagggcaaggacatgacccggagctacccagtgggaagcagggaagctgggatttgaaccggccaagcctgggctctgggccacacgagctcctcacactcagggctcacagaaggtgcccgctggctccgggcaggaagctcagaatttcaaacaacacaagggcctcccctgaaacacctggccctcggctgccaggtgggggctacttacgtgtgtgtggcgtgaaggagggggggcgtgtggccccctgggatgcggcaggcggtgggggcggcatgctggggggtgtggaccggggctgcgtcttcacctccgctggggagtccggcatcgctgaggccttagctttcctgtccactggggctgcgaccaacggagaaagaaagagtcggtgaagcaggctaagtgcaaaggccagggcccgcagccccacggttcccagcgaaggccccactgagtgtccgcccagcgctggggcagtctgccccaggtgtcctgacaggtggctgacgtcccacgtgcaggatcacgggggcagaaccaggccggaggacgggcttgggccagctcatctgaggtggccggccaggctggagctggggccctcggtgtgtggccgccctgcgagagccgtgccccactccaggcttgaggcttctacagaccagggagtgggcagtgccccgaggcagcggtgccttgctcccacctccatgagcatcccccggggggtgttcagacagacctcagcctcttcccccagtcctgattcagcaggtcaggctgagacccagaatttgcatttccggcatgttcccaggtggcgctgctgctggtctggccctggaagccatggttctaagagtcccttccactttcagatgctagaaggctcccctgggctggggggcgggggacggtgtctgcccagggagaggccggcaggcaggccatttagggcggcaaaacctctattttaaccgtcttctgccccggtgattcacaggacagccaagacagaggcggcattgacttcaggatggccgaggcctggctgcgctgggcgcagcccccggcaggtggtaacgccaggacacgtgattaatgagaacctgcagctgaacaagattccctcgtggtctgaggctccctgaagtctgagaagctccacccagggccagctgtgtccggagacggcaggaaaacgctcaaggcgctggtgggccgggactggggggcacggagcccccttgtgccacccagagagcaggacctgcagacaaggttaaccgaagggcctgcagcacagacgtgcccgagacaccaggaggccaagccagcaccctgtctgcggcattttctgcagggggtgcgggtgtaagccccagggcctccccatttatcttaaggcaaggtcagccagtgccaaagcaaggcagaaagacctgctatccgtggctgagacttcgggggcctcagcggcttagagcagcaaggtaggcatcctcaatctgctgaataccggactgccccgcaccctgctcctgctgacacctgtgggtctcacccacgactgccccgcaccctgctcctgctgacacctgtgggtctcacccacgactgccccgcaccctcctcctgttaacacctgtgggtctcacccacgactgccctgcaccctcctcctgttaacacctatgggtctcacccacagcctggggcatgaaacaggtgaggccacagttgggggctggtatctgtcgtgttattagtcaactgtgggcgctgcccctgcttctgcccgttccccattcccggggccccagcaccatcgtcagacggagagatccacccagggccacggccacgcggactctgtggaaggtgacggataaatgacttctacagcgatcacatgccaaatacggcacaaacctctgctgatcctcttgccgccggctccttttacagagaggcagagaggttcagaggtgctgaggtcctgcccaacatctcagggcagtggcgcctgggctctaaccggcccctggtgctccaggcaggagtggagcagtccccctctgctgggcctgtggggagtggtggggggaggaagcagccagtaaacagccacaggcctcgcggcacctgctgtcccctccgcacagccgctgacctccctcgcacagggcgccctgctcctcctggccacccgcctgtccggaggctgatggctgggcacacgtgtggccacagctgtgggggccatcaacaccgcctggctgcagggccggtggccagtccctggtgacaaccaaagaaggtgaatgtggcagggtgttcctgtggtgggggtgttcccggctgggggggggggcgttcctgggggggcattcctggggggggcgttcctggtgggggcagcccttccagaccaggctgcccttgggccagcgtgggttgggcatgcccagaagggagcaggcagggatgtggccgagagcttcaaacgccaggctggctcgggggacacaggtccaggacactggggatgccccctgtttggactttccaaagccctcccatggaggcggctacatttgagccacgagacttgaataaaacagaagtggatgcagagagccccactggggagctggtgccgggcgctggacgggcgctcgtaggatggacggacatgccacatttcctaaggtggagagggtggccaggagaccgctgggccgtcatgccacggcgcaaggagtcaccacagccgtcacccaacaagggctcatggccaccacctgcgtgctcacggccaccacctgcgtgctcgtgacactctggatcccgaagctagagcagacagtgccctgccggcgccctgagcagtcggggacttcatgtggttccctttgggcagaacaggaggctgtccctttacttcagaggcctggacagaggctcactgcaggaagatccttctcggtgctctgcagatatcgacgactcattgcatcctcaccgagaccctctgcggctgatgctgccatcagcccattttactaggacggaccaggctcggagagatgaagtcatctacccaaggtcacaccgcgagtgtgctgcgggccgggatcggaaccacgacctggtgttgcccccacagggccaggactcggcaggactccaaagtctccgcttgtcatcaacacgcttgcctccttttaggcctcaaggtacttgcaaagaggcagcaggtctgggattcaaacctgaggccgaacggaggctgcaggggcaggaggccccgtgcctgaggaacaccctgggagctggtggtgtcctcccctccgttctccaggccccaccccgggttgtgcgggggcagctgtgcaggagatgggacctttccgggccccaccccggattgtgcgggggcagctgtgcaggtgatgggacctcacgggtgtctgttgaatcctgtgtgagtgctcctggctgtgtggcctagggagagcctcttcccctctctgagcctcactttccttcctctgtacatgtggaggaagccaggtgacaggaagatgacgcggagttccccacgccctgccttggcaagcaaggaaaccaggccaaggctcatggagcaacgtgtggccgggacctgctcctggcgctgcccctggcacagactctacccgagaaagcagaaagtgacaaggaccctcagagaagatgaggggtgagtgtggaaaggtagaggaacagcatttgtggccaagagaacagcctaggagttggccaggacctgtggagggacctgggaaggaggggggtgggggagtgggcagcggggagtctggagctctgcacagcagcagctggcgccgtctctggggcgggcacatcgtctctctcctgcttaatacccttcagcagcttccactgtacatggggcttcaccagcccacacccactccatgacacccatctccctgctctcccccagtgcggggctcagggccatgcacgaccccccaccgcccctcgttccctctgggattcagcttcaacctcacttccccaggagaggctgccccgcccccgtgaagctcttccatccttccctgttcagtcctcaggatgtcaccccacactgggcggtcctgcctcttgtttgacctgtttgcagggtctctgtgcttgactgggccccccaggatgcagctcgcccagggtagccttcaaaggaaggcccccagaggaaatgcctctttgggttcccccagcccccgcttaggggctggaggagagcaaagatggaagtggggtgagtggagcgccatgatcagggcgggcctgaggggaggtggggctgaaggaggggcggggctgaaggaggggcggggctggaggggcggggctgaaggaggggcgggactggaggggcggggctgaaggacggtggggatgagggggcggggctgagagctagtctgcggcaggtgggaggggctgggctgcccagctgcaggacaggtgctttctgcagacatggggggctggttgctcagggcaggagacccatggctgccctggacacccatttccttggcgctggctgggcagggaggcaccgtgggtccaccccacagccacagcaggaggctgagtcctgccggcctggcttcctcgggcaagccacagcctctctgtccatttccttgcctcttcaaaggggatggagatgaggccgtgcgcagcaggggggtccagcactctccgccatcactcgaaatggtggctattattatcctcctctatccctgcacccccaagcagtgtggggagtctctggagctcccaccggcccacagctccaccaaggccaactgcaggctcctctccaggctaagacaccgctagacaggggcagcctcgtccttcctaggtgcctggcttcccaccccattcccctttgaggccctgcacctcggccacaggccatttctactccgcagacccacttcgaggctcggaggccccgtgggctaccagcccacggctgcgaaccacacaggaagaggcctggccgcatcccctcgtccccaagaccacttgctgaccctgctccccgctccagccgcaagacggccccgtccagacacacggaggtgaataagtcatcaaaccacttggaaaaataaaatcgcacagagcttcacagtagacaccagtgtcctggtgcaatggccctgaggcaaccccgggggctcagcagcgccagaaaggggaccgtctctgtctcaaggcagaatagagaagtggcaggaagggctaatgtcacggaggaacctggtgccccaggcctattctcagcaccgtctacccgctgccccatgaggcgggccctgtcactacgcccactttctagacggggaaactgaggcccagagagggtgagtgacttgttctgggtctcagagcccagaagcaccagggcatgtgcctgcagcccccaggagattaaacggtcccgatgccagccagcctggaccctgactcagccttgctgggacagcccaggcatccagccccacgctgggacacgcggccctgtgggtgtcacataggccgaagggacgctggctcgtactggaggctggggtgggtggcccgtcaccatacagggtctggggtagcacctggggtggccggctctgaggcatgagcggaaggaccatctttcaaaccccaaggggttttctttccagagctcgaagtgcccatgaaagagaaacgaggcctccagcatccctgaactctacatcagctgcaaggggaccccggtccccgaggacacccacatgtattttcaaacagctcccgaggcccagcgctgcccgtgcagaagaaagcatggaatttggggagggctcccgaggcctggccgcccagcacaagggggtccctggggcacctgctgtccccaccctggctatcctcctgtggcctacacaagtatcctaacccctccctggctcagaacagcactgaggtcctcctgctggggtgggtggggtcagtctgggtcccagtcccttccctatggccctggctcagaggcaggtgggcagcgggtgcggaatctgacgagaagggctctgacgcccggaggggaggaatctcatacagaggaccaactctgtcctcacggattcttccgcggccctgagatcctgcgcttctctatcttacgagtggggaaacagaggcacagagaggctgaggagggggagagccaggtgtggatccaggtgacctggcccagctaccccttccccactggccacagagggcacctgcagcctgggaaccccgaggggaggcacctgccctcctggcctccctctgtggcttgggcctctgccaagtgtccttctcactccccctgcccatgactgacggtggcatcttctaattgtcccctcaccccagagcaggggctttgcctgtccttcccaccctcgatggctcaggcactggctctggacacagtgcgcccctctctgggcatgcctgagtctgccctgatgttgggtttccctctatgcggttttccccaaagggtctgggcatgcaggaactggtcagatgtctaaaggaagaggacagggagagagtgccagttcctcccccagccctggctgcagcctcatctgcctcccaagctcccactcatcaagaaagttcccagacctgccagacgtggtgactcacacctgtcatcccagcactttgggaggccaaggtaggcaaaccacttgaggtcaggagttcaggatcagcctggccaacatggtgaaaccccgtctctactaaaaatgcaaaaattagccgagcgtagtggtgcgtgcctataatcccagctacttaggaggctgaggccggagaattacttcagcctggaaggcagaggttgccatgagccgaattcgtgccaccgcactccagcctggacaacggagcgagactctgtttcaaaaaaaaaaaaaaggaaaagaaaaagaaaattcccagaccctggaggccgctccccggggcccatgggagaggccgtttctttcccagacggcacatccagttcccagcaaaatgtcactaacgggccgggagaggaagccgctttgcaggttgggcagagccagtgggaaagagcctgcaatgtgccggggccgctcatccatcacttccccgtccgtgggggcacccagcccgccctgcccagctgggaaacagccacagcccagggctcccagcctgggagttccagaactctccatggaaggaggacccatggacaccagtgcaagagctcatctttccggccttccccgcctcgtaccctcgccagctctggagtaacaagccctgcttccgctgtaaccttctttgacccctcacaaaagccttggggcataggacgctgggcaggtaacgcaggtgacctgtcttgaggcctttgcacaggcaacatagccacggtgatgacgtcctactgcgtgccaggcctgacctgagcattttgtgcagaacacctcatttcgtgcccccgaaagtctagaggctgtcaggtggggaaactgaggcacgggccctgggcacctggctctggatccgatcctctccgtgggtttggaatatgctcccggggagcggggggcaccggctctgcccttcctggagctgaccacaggccccaggcaggggaggaggagggcatggcctgcaaccaacccgagggctccaggcctctcctgttactccagccgaaccctcatcccaggatgccccaaagtccagcctcagaggcccagcaaggcctcttgcaaagccttttctggggctgtggtgcaggcagggctcggagatgctcaggacaggtccaggacgggctctggacccagaacagtgctgtgcctcagttggcccctccataaaagtgcagaattaaggggatgagctcaggctccgggccctgcaacctgggtgggcagcctcagtgtccacatctgtgcaatgggggtgagggttgacatgaatgcacgcgtggcagtcactggcaaatcccaggcaaccccagcggcggctgggacggaggacaccactacatcccgggtgaccccgacggcagctgggacggaggacgccactgcaacccgggtgaccatgacggcagctgggacagaagacgccactgcaacccgggtgaccatcacggcggctgggacggaggacgccactgctttaaacagctgtttattttccttcagaatcacacggtcccacagcttcctctgggaaaggcacagatgtgcaaagaggagaccccgagagtcatccgtccacggccgccctcccgcctcctcacagccccggagatggacgaccccgcacccacgctgcccctgagaggtgaggtcatctgaggtcactggccacggccgtgcagtgagtgaggggctgagccaggaatggagccccagcctctgaactccagcctctacttggccgggcagccgtccagtgcagtaaacccaggccaaggtaaacccgtacacttggatttctggggaaccagagggacgagccaccctccaacacatttcccaagagctgtccacggcggctcccacggcggctccccagctgcttggccagtgccacagtggcccggctgttcctcgcttggtgcctggctgtcccctctggcctcaccagctgtcccctctggcctaaccacacgcactaccccacacccgcctgtgctgtgcctcggtcactcgccgcacttgccccagggcctttgcatggcggtgtttctgcagggaatgcacttccaccaggtccccgcaagtctgcctctcatcctcacacctttgctgcaggctgcctccttcccggtgatgctgcagcccgcgcggcccttcaccctggctcccctcctgtcaccggctctccctgtagctctgctggtgagcccacccgcctgtcctgctccttctcttctcttgtggatgctccccgtgagctccaggagggctgggcttcctctacagcctacaacagtgccggccacactgcaggcattcagcaaacacttgctgcgtggtgactgagaaaacctggaaaggcacagcccactgaggaccggacactcccagcctcagtgtcctccggagccaccgtcatctgaaggcgtggggacaggcagtgccctcccacctcaggaagagctgtggggtgagctgcggatggcgtgagcagtgcagggcggccctcgcagcggggtctctgtgccactctctggtgcccctgaggggcatgtgaaacagaggagaacctggtgctgactccgggaagggccctgagaaggtctttgaccagcatcagacctggggctcccaggccaagatagaggcaaagtgaagggacgtggggccccttcttggcaggctctaggacagtgggtgtccccccaaatcccctcgtatccagatgaccaggaggcggctccctcccctgcccccagcccccagcctccagggctgtgccaagtgtggggatctggggtgggcagaggcggcctgagagcctcaggcgctgccctgcggccgcctccacatctggcttgtatccagccttcctgcctggcgaataagcagccatataaacacggggagcagtgccttctctgccatcggtctaggcagaccctcccgcccccacagggacaaggagccaagtcctatttctctcccaggcccttccaggtcctcatgggcctgacccagggcggacccttcctctggccccactcactcactcctgctgcccttcccgccgtggacaggaacaagggaccctgaccccaaggcctgtgggtgatgacgatggacggcacggggttgccatggcaacagagcggggccaggtggcaggaaacccagttcgcctcccgcgccgctgtgtgaactgactgtgaactcggggtgggggccgtccccaaatgtgtatgagtctctggctccccttgggtaagatgcagtgcctctttgggtggggtcacagcaaacaaaaaggctttcgtaaactcaaaagccctctgtggccctgccacggggacgtcatctctggcgatctgaaggacaggggcagggagggaacgggaacctcaggcgccctctccctgcaggaacggagttggcttttccgtctcctaatctggcctcagttttctcatctgtaaaatgggaatggggatggaattcccgcagaatcacggagggacgaagtacatgagctcacgaaaagcgtctagaacagagcgcctggccgctcgccctggccacccagctgtcatgcttcgggctatctgtccggccacaacggccgcgtggagctggtgcaggtggggcttgtctttggcactgtgcccagagctggcccataggtgacactgagcatcagtgttggggaaggggacccatcggagagcctctggggcacagtgaagaccccccctcctgcctcgcagctgtgtgggggaagctctgttgcccagagttggctggcagggcccagactgcccaccggctgccatcaccaacacgaacaggtacccagggcatgccttcagccggcctgggtgcagaggtcccgtctgtcacagaagtgctgctgaaccgtagcagacgaaaatctcacaaactccctccgggccccggcccagggcttcccgttggaaggtgcacaggccggcctctgcctgcaggctgggcccacccgcgcctccccaacccactacgtggctccaggcggacctggccttgcctcttcctttcccaaggagagaagaaagcctccctcatgggtttttgaggaccaagaaggctctctggatagctgcaccctgcaagtgaacccagggctcgccaaagaaatgcggaagatgggacaaagtgtgctgtgcgtcctggggccagatggggacagatgggctgggggtctctccgtcagtcttggccagccacgccagctgtgcttctgtccctcccgttggcctcagggccttggctcctactggaatacttccctcgatctctgcatagccgtctcctcatcattcaggtcttggcgcaaatgtccctcctcagagaagccttccctgaccgcccatgtccctgcccccacgctctctgccccatcacccatttttcttctccagccactcgtcaatgtctgaagcctccgtctgtgttggtcctcgtgtttacgcccgtctcccccagggcagggccctgaacagcacctggcacacggcagggccccgtaaaggtttgctgactggcgcataaggacaaagccccctatctgcctcccctggcagccctgtcctctgcaggttcaacggggcggctcgctgctgcaggacagagcctgggctgggcttgaatcgaggcctgtcccctctgccgtgtgagcccagcaggcagctcccctcatccattaagtgggaggaacacacctcccgggggtgcgtctgaggaataaggagctaattgagtctgtcctgcagcaggaggccagggaatgccggtcatggctattcagggccctctcccccaaggcgcgtttcctgctaatggcctcgatttcccaccctgccaaagcccctgccctttcgatgggattgcagctcttccagtgcagaggcggggtccacttccctgccccctggatctgggctggccgggggacttgctttggctgggggcaggatgtggcacaagggatgtcagatgaccctgagcctggacgtcagcggcgggcagccccactagccctctgtggagcccccacgtgaacacgcccaagatgagacacacgcaggacagggttggcccggccacttggtggagctggactgaccgtggctgaccacggaccagccagcaaacccagccacgcccagaagaaccacccccctgagcttgccaaaactgccaacctaaagaactgtgagccaaagaagggtggttgctttgagccactgtttgagggtagcttgttacatggcgatagctgactgatacactttggtacttagaatctcaacatatcagagctgcaagggacctgagagacaatcaaatttcacagctggtgagagggaggctgggaagctggagaagagaagtgacccatcttgtctctagccgaaccaggcctcagatgccaatgctgcacttgccctccgctactccacacctcattcctccgtgggggggtctcagccgggaccagcaattccaccttcaggaatgcattctcaggacatgtgcacaaacagtgatctacaaggatgtttgtcacagcatcgtttatgagaatgacaaacggaataaatacgatgactcctcagagagggctgggtagataaattatctactcgacacaaaactaaggaacctgaaaatcacaccgtggccaccttcattttggaaagctgtttgttggtatctgctgactggaacagtcacagctgctggaatagccggctcactcctgggcacagaacctgcagaagagccaacccacagacacaggtgcctccagagcaacaagccacagctgcaccggccacttcctcagcaagcgtgcaccgaggtagagggacacgaggctgcagcacggccatacaatggaatacaatacagcaaggaaaaaggacaggcccaccaagtacaacactgcacacggtctcacaaatgtacagcactgcaagcggtctctcacaaacgcggtggccaggccccgcagagcatgggatgcgagagtccgtttctagaaaattcagaatcaggcagcaacactctgtgatgctagaggtcaggaatggtggccaccctgacagcgcagtgaccagagggggatcggaggccttggggacaggtcggaaaacgtttgtcaggcccatagccgtgtgcacgtgatgctttgtggtgcacacttctgtgtgcagtgctgcgagcatacatttaattgcaaaaatgatgtcacgggacgctctctattgacatcccctatgagtgaacatcaacaaggcgacaaagcatgaggttctattttggaaataaaaacacgcacagaaagacgactagaccaaaaatgtgatcgtggttgccgggcaggacgctgtcgcagccatcacagtcttgccatgtttttaaagcgaccagggtgagtctgggcctgtcctctggcttaagcccagagcccctagccatcaaaggtgccatcaaaggtgccctgaccctctgccctgcaccctgtggacagtgcccagggcctggtcttctacagcaccctgccggttgagcaaagcctggaaaggctgggggagagtggtgagctcagaggctggagtgaaaaatcttccctgctccccaaagggccgcaaatgggacccagatgtctggggcctgcttgccccgtggccgcacacaaaggaagcacattccttgcccagctgctagagctgcgctgccaacagcaactccctgagcgccctgggggaggtggccccacaatctgggccgcccgctgccggggcggggtgggggtgggggtgtggctgccagccgggggcaggggtggagggaggaaggggcgctgtccttacccagcactggccctggcaccctgggagtcctgggggtagcgggtcccttctcttgtctccatgcccccaagccaccaagggaggcagccgaattgcagacaagcaagcttccgttgaggatccgtgtgctgggggtgccgccaggtggtggcgtgggtgtggggtggggaggaggcgtgggtgtggggtggggaggagatggggctggggggcctatgggtgggtcgcggggtggggaaactggtgggtggtggcctcctgctctgggtctgcctatctgagtgaattctccagtctgatctcaactcagaggagggacagctccttcaggagctccacaagcagcatggaggggggagcgtggaggggggagcgtggacgggggcagcgtggaggagtggaacgtggaggaggggagagtggagggggcagcatggacgggggcagcatggacggggagagcgtggacggggggagtgtggagggggagcgtggagggggagcgtggacagggggagagtggacgggggagcgtggacggggggagcgtggaggggggagcgtagaggggagcgtggaggggggagtgtggaggaggagcgtggagggggagcgtggacgggggagtgtggagggggagcgtcgacgggggagcgtggacggggggagcgtggagggggagcgtggaagggggagcgtggggggggagtgttaagggggaagtgcagagaacgagcagacacgtgggctagacacagggtgggcgggcgccctggtgggctgtgtggctggtcacctcagtcagaatctcgccctctctgggccactccctgccaccttcccctctcaggagcgtcacggtgccctctatccattaggcatgtgtgcgtgtgagtgtgcatgcatgagtgtacgtgggtgcatgggtctgtattcatgtgtgtccatgggtgcctgtgtgcatgggtgtgtgtccgtgtgtatatgtgtgcactcgtgtacacatgggtgtatgtgtgcatgtgtattcatgcatgtgtgtattcatgtgtgtgcatgggtgtgtgtccgtgtatgtgtgcactcacgtgtacatgtgggtgtgtgtgcatgtgtattcatgcgtgtattcatgtgtgcgcatgggtgtgtgtccgtgtacatgcacttacatatacatgtgggtgtgtgtattcatgtgtgtattcatgcgtgtgcatggctgtgtctgtgtatatgcacttacatatacatgtgggtgtatgcgtgtgtattcatgcgtgtattcatgtgtgtgcatgggtgtgtgtccgtgtatatgcacttacacatacatgggggtgtatgtattcatatgcgtattcatgcgtgtgcatggctgtgtccgtgtgtgtgtgcactcacgtgcacatgtgggtgtatgtgtgcgtgtgtattcctgtgtgtattcgtggggtgggtgttgcgtgtgcatgttgtctggtaagggctgtgtgacctcagggatggctgcagaacactccggcctgagtgaaaggtggtctgatctgcagacagagcttctctggaaggaagaagggcggcccctggggagaggtgggtgggctgggtggggaagggggatggggggctcctttgccttccctccttgcctcccagccctttattgtatgccacatccttgttttatttttaaaaatgcctcttggccactggcacaggcccctccttgctacagcccctgggggtgaaggcgagactgctaggtggagtggccaacagagaggaggtcaggctggctgtcatattggttactagacaggcgtggaggggccaacagaggggagggcagggtctcgaacgttgtatcagttactagacgggcgcagaagcacggattcttttagaaaaagagggctgcttaggaggctgaggcaggagattcgcttgaaccagggaggtgggggttgtagtgggctgagatcccaccactgcactccagcctaggtgacaccgtgactctgtctcaaaaaaaaaaaaaaggaaaaaaagaaaaaagaaaaaggaaaaaagagaagaactggtggaatctgagatcatcggctgtcggctgaccccaggcccgggctgcaggagttagctggccctgccctctgcacagccacatgcctggacttaggtgtggagcagaaagtcccacagacaaccccagacacaagcggagcggagaaccttccaggaagaggctgcacctggttctgaaggctgcggaactggcaccgtgggagaaaggtgccaccgtgggaggggagggcctgccccggggagggcacagaggctgggatgctggggacaggcaggtcacacagccctgggaacgggaccctcccacgtgcagggcctgcagggaaggctcagctgtctgcggagggtctggaaacccctggaaacctgaggcctctgttaggattttccaccaatgaggcgccaggggaggctacaccggttcccaaagtgtcgtcgctgtttaaaaaaatgtgtgaattggctgcaaatcaccttgaactctgcagagggcggctgccaagtttaaagtcagccactgccggtgtggacgctaaggaataattagggtctggcggctcatggtgcccctgcgtcaagtcaagaatgttttccctgaagtgccagaatgttcccccagcaacccccagcagtgtcataagtgtgacatgtgatgtgcgcacgtatgacacacacatgcagacgagagtgtgcgtgaagacgagagtgtgggtgtggacgacagagtgggtgcggaggagagcgtgggtgcggacgagagtgtggggtcacaatcccctctgtccctccggggtgcgtggagggaccccaggagacggtgcaggcgaaacccacaaatcctagcagcccagacaggactttagaggtggcctccctggagtggaggagtggacagcctgggctggctttgccctggggcttcccgccacgtcctgtgagctggcatggccaggctgtgcaggaagtggcccccatggagagacagcgtggcctccctggtgctgactgcaggaagcccctgggaccccaggaccctgggccggggatgcctgtggcttttctttctcacccccacccaaatgcaaacacgcgcacaaatggccttttgcttctcagttttttgacactgaggcaccaagctgggccctccctgatccctgcaggccgggggtgaagggaggcctgggagaagaccccaccatggcctgggccctgtcctcttgccctggcatcagaaggggccctgatccccctgccttcgcagtgtgggctgtggctgcccctgggaccagctgcatcacaacgaggtcccagcccacagccgtggggaggccttcgccactctcacctcctggacagggtggggctcccgcccctccagagcccacacggttactggcacaggccctgagctccaagcgtgcggcccaccaacctcctcaaaatttgtggctgttgctggttttatgttgtgagccccacacaggaggctgggtggcctccaatgcctccaggagggagggctgagcagagctatgcccaggccagagcccccagcccagaacattctgtcttcttgccctaagaacttttgaaatgtcccagaagttccatggcaggtcacccacatggcccagcccggcctcccacggcagggggtgccgagaaccttggagccacacggcctccagggttggtgctgagagaggtcggagctgcaggctcgccgggttatcagtgtaaaaaagtagaggttccccttcaaagatactttcctccccgtctaattaggaataaacagtaacttctcttagaagcaaaatttattcaaagacctgtgctgacattcttaaatatctgctagccttaataaagaaatcaatgtactttatgttcttagctcccacaatttagcctaagtatctgccctggcatgtttatactggtcgaagcaagcattaggtcacggcctgttcctcttccttatttgaaggtgtttttacctttctcagcattccacaaattacttcctccttcctttgttctcctctgcctttgcctcttttaaaaagttctaagttgcgagccaatcgggacaaatacagaatgtgaggtcccgttccagccaatggaaaccggacacagcagtaggtataaaaaaaccggacacagcgtcaggttataaatgaccctggtctccttcattcggtgtactctcgtggcaaaactgctggcgagtgtaccctttctgcagaaagtaaatatggccttgctgagagaattaaatttacgttcaagtgctatttctttgcagcaccagggaacaagcactctatttctaaataaacattcctaacatcagcgtggcctcaggcgctgtccctaccgcccggtattcactcagccttacgggtaagaagctcagtgcccatggccatgatcacaagggcaaaacccactcctcgaattctccaaactgcacgcatggtgcagggcaagcgcgggtgttccctcccacccagagcagcctctccgcggagtccccgggcgggaccccagttacttctgagcacgtgcagtctggtgcatgtttactctaaaaagaaagacaaggatggtgcctacaagaggaactgttggaaagtcagtgtcgctccacgtaatccgtggacactgtttcaatgcaggtctggaggccgcatcagaccccgccccacactgcaactcctgggcctcggttccttcatctgcacaaaggggccaatgatagcgtctccctggagagttaccttgggaagcagcatgagaattgatgagaattaaagcgatttacaagtgcaggcatacagcaagtgctcaattagtgccagtctgtaaaccagcagcttcccgagcactctgctcaaggattcaacccgctccctggggtgggcgttcctgcctccctccttccccagatagtgaaagggtcaggcggtgtgcgcccgaggcctgccgtcctcccacaccagggactcgcaagtcagctgaccagtgaagcttgtgcaacggtggaatgttctaggcccatgcactgacagtcgctggagccccaactggctgccaagtacttgaaaggaagccctatgaggggagaactgaattttacattttatcttctttttttgagatggagtctcgctctgtcacccaggctgaagtgcagaggcatgatctcgcctcactgcaacctctgcctctcaggttcaagtgattcttgtgcctcagcctcccgagtagctgaggttacaggtgcccaccaccatacccggccaattttttttttttttttttttaaatagagactgggtttcaccatgttggccaggctggtctcgaactcctgacctcaagtgatccgcccacctcggcttctcaaagtgctgggattacaggcggaagccaccacccctggccaggaatatttcatcttaattaattcaaactccaacggccacaggtggtgcatggtgacggagtggcaggaggccccaccacgcaatgccaaaggcaccaaaagtgcaggtggacaagggcggcctctgcctccccgtggggcagccacacctgcctgctcctggattctgccaggaggactgggtccccagcccctccctgccctgcctgcttgccagccccagctgggtggtcttcctccagccaggcccacctgaggctgcctcccgccctcctggaggccaagcccctcgccagggggctacattaaacagcagggccaaactcactggggaggcatcttggagagcagcgggacgggtgtctccacaacctggaacaacacatcctttctctgagtttaaagaaaacaggctgctctggaggcaaaccttttaaacagatgtttcctcttggcggaacctccctgctccgcccccaccctgggccttcccccaggcaaggcctgcccggctctcacagggcggaggcctggggcaagggagaccaagtgatttcaattctttctaggaaaggggaggaaaatatttttaaaaatgtgttttacaagcctgcctctgccattgttgatgtaaacaggtaaattgtttcctgcctcaattaaaaacatctgccacataaatgaataccaattaactcatcctgtttttaattactctgttaattacacgcaggcagcagaaaggatgggcggggggagcagggaagccgagccgatcctccgtgccacgccgccccaccccagcttggcaggatcggaaatgtgtctggctggtgacggatggggtggcagggaggtggtggcacgtggccagccgggatttcccgatccagggcggcgagtgggcccctcttcccgggatctccctgggtggggtccagcccctgcccctctcctgccctccctctctgtctgcagccccctgctcacttcttgggccacattttgctgggggagggagggggggcggttggggggaggcctggattttgtccaggaagttctgccttaaggctggggtggtaggaggataagagtcaccctaaacaggacccctgggaattaggatcctgtcagctgccatttcctgagccgtacatccgcggtgccgggggacttgcggctgcagctccctcatttgaagttgcttcctcggcggcacctgggacgccccccatatgcgccatagccttcgtggtaatgacacagtttctcgttcgcttgcttcattaaatgtctacctggggaatggggacgcctcaccccgtctcacccagacctctctgcgcggcgcattttgactcccagttcacacgtgtcaaagctgaggcccacacaagcaactgcctgtccagggttaaatcactgggacaggccagggtgagccgtgagcccagggctctgatttcagggctggtgtcgatgccaccaaacgtgtcgtggccaggacatcccgggagctgggttcaatggctgaggctggcctgcgccacactttgggtgggggtacttccggtctaagggcatctgagggtcttcacccaagagggtaccccatgcctccctggaaaacagcccccacagaaactgttctcaccctaggtttctgcagtctaaggatgcggagatggccagacctggctgggctctcagagccggtctagccagagtaaaagtcctgtccagcagcagggcctaggatcctccccgggaagactgctgctgccttagcaggattgagggggccgagggcttcggtgcactcaccatgtctgccccgggcaccagcgtgggcgcagtgggaaggggctgtatgggcctggagcattagatcctgtctgccctttgcagcacagaggaggcaggacctgagtcccagggcctggccatgctgatgcccggggcagacattctgcaagcagtctgcctctcctatcccacgccagggctatgcttgaggccttcccgagggcggggtcaagaatgcaccaatgcccgggacagcagccaacccacgcctgttcctgggcaaatcccgcctacaggccgggtcccagcttgcagccgtcggagggtggtggacggccccttcctggaatcccatcccgacctcggagacggtgacaccactgttcccgtggcacaggctttgcccctgcgtggtttcacatggccaacaaaatactaactcatttaacctcggcagcacccccacccaggaggctgttctgttatataatcacgatgaaaacataaacctctcactcttcccaccgtacagatggggcagcaaaggcccagagaggaaggaactgctcaaggtgcacagcggacggacagagctgggacccgaccagctctacacggctctttacaggcccccagcgccctcacctagcgcaccccagctgcctgctcccaccaggtccctccaaataccccacgtctccccaattcgccaaatgtggagggagagacgcgggggagtttgtgatgtgctgagatggcacagcaggttggcgagctgggagcacagctttggggtttgaagtcagcgtccactggtgtgggcgagtcccctggccttgctgggcctcagcgttctccctgtgaaacgggggggacccgcaccccctcctcatcgcacagaggaggtgaggattcggcgcttctgcccactgccccctgcctgcctccttttccaggcaggccaccaggctgagctgctagttgccttgaggtttcctgagctgccagggacttgcacagagacctcaagctgagtgggggcctctcagacctttggccacccatgttacccgccacatccactgccaccagaagggctgtttgtttggggcctttgagacaatttcagcaacaaatgcacttcctgctgtgtgagctggggagcaactgagccgtgagggggcagctggggagcagctgggttgtgaaggggctgcaggctctgcacagcccagtcctggcgcgcagcacagctcggggagggaggccaagctgcgcatcctccgcaacccggctcacacatgtcgctcctgctgtcagggtgggaaggctccgacatggaggtcggctttggaactcgggctctgggctcctgggctggacaccggcaccgtctaggttggggaggctctgggaaagaccagaatgccgaacccacccccgaggaccgtcctctctcaaaggtggggccgggggaggagcccagtcaaaggtgagaggccaggctcactggccaggactttggagcatagatcaccacagtgcaaggaccacgaagaccctgggatctcatgctgagggtgcacagcccggcaagggtgcacagcgacccagccatggttacagcaaagaccgcgggtggaggtgggggcgtggtcaggcaaggtcacagcaacccagccagggctaaagcaaggagccagggtgggagggccgcgcctgctgggctaaagcaaggacccctgcggtggggcggggcaggtggtggtcatgtctaccctggaggggctacacctgctgggctgagtcccagtgagcctgagtgaagatctgccctctctgggccccgccttccttgctattccctgggagctgcaacggctgtgctgacgtggggcacactgcgtgccttcaggaccgctccagtcgccctgcacaagctccgccctggccctgcctccctggggccgccgaccacaaggaggctagactctgctgagacaaaaggagagggacccggggtccaggaaggtggggaacgaggctctcgggggcgatggctgggatggccttggagacgggtccagcaatgggcagacacaggccagggggagaagagcgggcggagggcccagtggtggctgcgggggccaccagggcagctctcggtgctgtgtcgtggggcctcgaagcagctggaagcagggagtggcccctgcaaggcagcacaggacaagccttgtggctcccagaggcagagccccatggccgggagcatgaggtcactctcgtcagacagcctctgctgcccagatgcagatggtctcacccattgccccagctggccggacgcggcggggacagccaggcactgggggccaagcaggtgcaggaaaccacctgttgaatttagacccaatcaggggctgtgaaggcgagtcctgcccacagcttcgggctgatggaggccgctgccaccgcctcccacctcactgagtgctctctccaccaaggccacagagccacactccccgccaccacgtgtgggtgcagacagtgaaaactgagggacggccctgaagaaattacaagccaccggtcaccgtggccaagcccagggcttgctgtgtctgcgaggggtctcagctctgcaccagcccaagggggaagcagtggagagagagggacccgcccggaatcacacagcaacggcctcgtcctggacaccgagctcgctgaccctggggcagcaggccatgtccgcagtgggcagagggccgggttccagccctgcccggattggtcctctcccagcccccggccttgggaaggtgccaggcaggcagatgggccgggcttgggcacggtgcagccgcagccgtggtggcagctgctcgggggagacccacaaggggcctgctctgctgctccctcctgagcggtgccttccgggtaccctgactcatccaccaggcgctctcatgcagcctccaggagatctgcagggggccagggggtggtgctgctgagtcaaaacagcccccagggaatattctgcaggggagggaggcccttcctgtgccaggcagccagagacctgctccgagtgccctgcgctgctctcatcccagcagaaggacgactctgagggtggcaggcgggacaggcagtcactttgcagtggcagacacaggctcagagaggctccaggcctgcctgaggccacctggatgactctgaatgctgcttctccctccagggcaccagggtaaccggaggcttctagtttcttcaggggccgtccctcagccttcactgtctgcccgactgcccgccgggagcccctgcgtgtgtggagatggcaatgtgctttcccgggggctcagagctgctcctgctccccggcgacgggcttttccaggctgcggcatagggagccccggtaccaaggacatgggtggcactgcggagtcggtgccatcctctctacgccagacgccatgtgaacgtttttacgatgatttttaaaagagaggctgagaaggaccaggaccagaaagacacggctgtcctgtctcccacaggctgcagcctcgaactggcaccatctcttctgccccctggaaggtcagctccgtgagacgggggaggcccccgtgaattgtgcagggagcacttggtgggcgctgggcggtctcacgttccccacctgtgaaagggggttaatcccactgtgatggggccagtgagcgaattcccaggagggcagagcagagccgcagccgggggtacaactggcttctggggccgggctgccgcctccaagagcctaaccttgttcccagaggcgaggagtgaatctgggttccgtgcagggagttccagcacctaaaaggtgtgacaaattcctcctccaatgtccagctggacaaacctcctcaatccaccactgaaggccccccaagcgctccgagggacctggcgtgctatgggctggggggcgtctgtcccagcctcgtctccaaaatgtcggtgtctgctcagccctgtgctgtggttttcaggggtcgaggctgagcgacctctctttctatctctcctgctcggggccagtcaccaggccggagtctcagggctgtgacacagaggtttgtcatgcgtcacaccaggtggccctgggtcagccaacgagctttgtgtcaggacagcgtgggtgagcgctgcccccactgcatggctgcagggaggcccgagggcaggatcttcccaagggacaagctggccatggtcccgtgcgtgccagggtggggcctgctgagcctcagtttcctcggctgtaagacgggacggaggtgttcacagtgggggttgctgggaattcctcctctggattgggctggtgcctcggtgcaccgtgggctcccaggagctcacaaggccttccgtgcctgtcccttgtgccccacctcacagcgaggtccttgcagcagcagggcagccccgtccggcccccgctgcctccctgccctcatctcctttctctgagacaaggctcctcactggtcctggaggtggcggcacactcctgcctcgggcctggcacgcgtggtccttccctcctcccgcagctaagttccacgtccctttaccagagaagccagtgtcaacccccacggcccttggtggggcaacatcatcgctgctcccttccttcactctgtctctgccagacggagcagcagccccgggcgtacagcaggcaccaatcactatttgtcgagggaatgaacgggcaccgcctaacgagttgggtcagatggaggcgtggctcagagatgtcagcgtcaaggccaggtcgacgtgacaagccgggtcccgccctgccctcgggtgcatggacttccccaggcagcactgatgcccccgctgaggtgaggccgctgggccccatctgtggggagaggcagctggaaactgggggccccagatcctcctcgagccagatcctgaccccagacccagcctgttttctgggtgtctgaatcctgccggggtggaggaggggctggggaagaggtgggtccacctgttctcctccagggacctccctgcaacccttcatgaggtcagagctgggcatccagggagacagcgaccctggccatgggggccacgccacccaggtaccagcctggcatgcagcctgcaggtgataatctccgggctgctctggggctaggctgcagctgtaggggggttcagctgtcacagagggagccggggaagccagcactgcctgggatgatcccccttccgcctcctcctccccaggccccggaggcccagctggccgtccgcccgtgcggacacccgggagccaacactgacccgaagacaggtcagccagacttcccacctgctccctcaggaggtgggatccggtcccctcctgctgggctgcacgggccacgatggaaaggcgcctcgtgacacgctgcggtcagctcagaaaagccgcagatgctgacacgggcaaccctgcccagtgtggggcgtcctctgaagtgggagccgcagggagggcctcacggaggcctctgtccacaggcagcggctcccggcacccaccgctgctgaccgagcccctggcacccccaagccgagcctttgaaccccagcagggaaggccacctggccgagaccctggccaccacggggccatcactgtcccacggggctctgttccgactccttggcccgagggtctctgagcaccaccagggttgcctcacgcctctgagtttggggtggtttgttcggcagcactggggcccggggcagcttcttgcccggcgtgtggcacagctgtccttgttgggggcgtttctgggatcctgtggtttcggggacgctcccctactccctggccttgggggccgatgaccaggtggagcgggcccggtctgtgagggagtcacaacgccaggtcactccaagctgcctctgtggccacacgtccagctgcccccacacaggcgagacccatgatcaagccccagggctggaaagcagacacaggggatgtatttgtttgtggaatcaaatacgacggcagcttgcaggcagcccagccgctgtgcaaacaaccctcttccagcacccagtgagggcgtccctgaagcagccggcgaccccgggcgctgtcacccgccaggtggggtatggggaccgtccctcaggcaagacagggtgcctgtgtactgagcgcctcgtgtgtcaggtgcaggtgcagacaggcaaaagtcctgccccacggagctgacctcggacgggagcccaggaacactgtgcaaacgtacgagaccgaggctgggaggtgtggtggttgggagaggcacgggtgggtgactggatggccactgaaaaggtgccatctgagcaaggcctgaaggagggcagctgggagccacgcaggcgtcggggggagcattccaggcactggggccagcagcgcaaaggccctgaactgcagccaggcacggtgggccagcagcaaggcggagcagagtgggtggtggaagggaggggagtttgtgtggtcttggaggccccacgaggacctcggctccgttcctggagagctgtgactggcctttaatgggttccatctggctgccgagtgcaaaatagacctgggatgggggtcaggggtagaagcaaagaaaccaggtacagaatctggcacaagtcacgcggtcagagagcaggtgctggagagatcccataactgtttgtggaatcaaacaggacagcagcttgcaggcagtctggctgccgctgtgcaaacaacccagggcgcccctgaaccagcccgtgacctcaggcaaacggcatccatcaccggggccggcacaccatcgcctgtgagaggcgtggtgagggctgctcccacgggcctgcgggaggacccggtgacagcaaggccaagccccctgcccaccaggacagtggcttttcttgataatttatcccttgaaaccccgtggacaattaaacccagagttaccaggtgagccagggattctactcctaggaatccaaccaagagaaatgaagacattcatccacacaaaagctaccgatacccacagctgcatggtccacgcaaaagctaccaatacccacatctgcatcacccacgcaaaagtcaccaatacccacatctgcatcatccacgcaaaaactaccaatacccacagctgcgtggtccacgcaaaaactaccaatacccacagctgcgtggtccacgcaaaaactaccaatacccacagctgcgtggtccacgcaaaagctaccaatacccacagctgcatggtccacgcaaaagctaccaatacccacagctgcatggtccacacaaaagctaccaatacccacagctgcatcatccacgcaaaagctacccatgcccacagctgcatcatccacgcaaaagtcaccaatacccacagctgcatcgtccacgcaaaagctaccaatacccacagctgcatggtccacgtaaaagctaccaatacccagagccgcatggtccacgcaaaagctaccaatacccacagctgcatcatccacgcaaaagtcaccaatacccacagctgcatcgtccacgcaaaagctaccaatacccacagctgcatggtccacgtaaaagctaccaatacccagagctgcatggtccacgtaaaagctaccaatacccacagctgcatggtccacgcaaaagctaccaatacccacagctgcatcatccacgcaaaagtcaccaatacccacagctgcatcgtccacgcaaaagctacccatgcccacagctgcgtggtccacgcaaaagctaccaatacccacagctgcatggtccacgcaaaagctaccaatacccacagctgcatcgtccacgcaaaagctacccatgcccacagctgcatcgtccacgcaaaagctacccatgcccacagctgcatggtccaccataacaacaatgggggcaacaacccacgcgtccatcaacggacacacaaaacgtggtctttctgcacagtgcagtgcagctcagccacagggaaggaggctccccactaggctccagtgcggggagccacgaaggccccgagctgacaaagccagacacaagggccacacgtggccccgtcaccttcatccgcggtgtccagaacaggcaagttcacagagatgcaggagcgggggcagactgagggctgggggtggaggagcgaggagatggggagggggcagactgggggctgggggtggaggagcgaggagatgggggagggggcagactgggggctgggggtggaggagcgaggagatgggggagggggcagactgggggctggggtggaggagtgaggagatggggaggggcagactgtgggctgggggtggaggagtgagtggcagtgggagtggggtttcctttccgggtgatgagcacgtgtgggagcgagctggcggggggcgtggcgttgcattgtgagtgcactaagtgctactgaagtgacactataactccacgatgcttaaaatgataaacgttatgtgtattttcccacaattaaaaaaacagcggggagactgagacaggcagctcatgacctattaacctgcccctgccagggacccatccacgttgctaacagcccaggagtgatgagtggagccaggctgcctcttccctgagtttgggcaccttaaatgtgagaggggctcagcctccctcccaggggccctgctcctgtcaactggggccaacttgcaggcaggtagcggaggcactgctgtgactccagccctggctctgtgagcctggctgtgctggaaaccaggagggtggaggccaggcccagaaggctgctggctggagtgagtgggagctgagcgaccttcttgctgcaaacaacccccttccagagacacaagcacacccttaagggtgggaagcgctcacaaggaccggtctgtggcaagtgacaagtgacctttccaacccgaaggtctcctcggcagaagccccttcatgtgccaaggacgagccagaggtggagaagggccgtgggccggccccgtggacgagccagaggtggagaagggccgtgggccggccccgtggatgagccagaggtggagaagggccgtgggccggccccgtggacgagccagaggtggagaagggccgtgggctggccccatggtgcagagtgagcaggtgctgggggcactggcctgcagctcaggcctctgcttgtccctctggtcaccccagtcctggggcagcatggtccctgggtctgggcaggtttggttggatgcaggtgctgtggtccccagtgagccctggtgtcacggctcacgctttataaaagctctcaaggggtcacagtgcagaggggatggggaggagggtttggggagggtaagcacttcgccggggcacttatcatttgtggaacattctctgaggctggctgtggggatcccctgtgagtctggacagccaggtcataggtcatgcttcctcctggcccggttttcacaccgtggtaccccacacgcatgcacacgtgtgcacaccatcacacactcagactttacacacatgcacctgcacgtgcgcccctggcaacggcacccgacgcagtgaccttggggctgctgtcgtcgggaagacagcctgccaggtggcccctcacacggcccctgcttccccctcacacggcccccgcttccccctcacacggcccccgcttccccctcacatggcccccgcttccccctcacacggcccccacttccccatcccggaaaacaggcagagcacacacttccaggaaagaggccgccctggcgctggactcaatgaccataaaacagcctcttaagctgggtgcagcggctcacgcctacaatcccagcactttgggaggctgaggtgggaggatcgtttgagcccaggagcttgagacagcctgggcgatgtagcaagaccccatctctaccaaaaaaattaaaaattaaaaaaacaattagctgggcatagtggtgaacacccatagtcccagctactctgtaggctgaagggggaggatcgcttgagcctaggaggttaaggcagcagtgagccatgatcgcaccactgcattccagcctgagcgatagagggagaccccgactataagtaaagggaaaaaagaggcagggcgcggtggttcacgcctgtcatcccagcactttgggaggctgaggcaggtggatcacctgaggtcaggagttcgagaccagcctggccaacatggcaaacccgtctctactaaaaatacaaaaaaaaaaaaaaaaaaaaaaaaaaaaaaagccgggtgcagtggtgtgtggctgtaatcccagctactcaggaggctgacgcaggagaatcacttgaacccgggaagcagaggttgctgtgagctgagattgcgccactgcactccagcctgggcgacagagtgagattgtgtctgggggaaaaaaagaaagaaagaaaagaaaaatggcctcttgggccaggtcctgggagctcgagggaggtgacggcatggagccaggacccggagacgtcacttctgatggaagtccgcacgcccagagacaggccaggccctcagtgtgcaagtcaccagccttctctcctttccagacaggctttgccctgtggccccggccctgcctggtgcacctcccgtttgcctcactggtcaactcctgggggctgttttgcgctcccccagtgcagggtcccagactgcacgcctcacagtgccacacgtctgcacgcctctgcacacgtcacgtgcctctatacgcctcacacgcctcacagtgccacacgtctgcacgcctctgcacacgtcacgtgcctctatacgcctcacacgcctcacagtgccacacgtctgcacgcctctgcacacgtcacgtgcctctatacgcctcacacgcctcacagtgccacacgtctgcacgcctctgcacacgtcacgtgcctctatacgcctcacacgcctcacagtgccacacgtctgcacgcctctgcacacgtcacgtgcctctatacgcctcacacgcctcacagtgccacacgtctgcacgcctctgcacacgtcacgtgcctctatacgcctcacacgcctcacagtgccacacgtctgcacgcctctgcacacgtcacgtgcctctatacgcctcacacgcctcacagtgccacacgtctgcacgcctctgcacacgtcacgtgcctctatacgcctcacacgcctcacagtgccacacgtctgcgtccccacagccatagtggccacttcatgccacgcgtatgtgacttggtgaaatccccgtccctctgctctgtgcagtacagcagccgcaagcacaagaccggcacgaggaggacagaggcgagaccccagtgagccaagctgcacgctgcccccgggagagctgaaaaaaaaatacctcagtcgcttaaaaatcagtgcatgtcgaaaataatgagttttggacacactgggttaagtaagattatatattataaacattaattttgcccggtctcttcttccctttttcaacgtggccacgagacagtctgaaatgatccacgccccttccctggcatgccgaagctcccttgggagaggccgcccctcggcacacggaggcaccggcgagaagggctgccccacgcccctcggcacacggaggcaccggcgagaagggctgccccatgcccctcggcacatggaggcacgggcgagaagggctgccccacagtggctgctcaggtcacaggaggggccgacttgggcccataggggaggctccatgcacgttcccgaacactctgctcccaggtcccctgttggatgctttgggcttctgggcatgaaaagtgctggaccctgaaggagcagctcggccgcagaggcacggtggggacacagcagccagcagggccacacagagagggtctcagccacacacctggccggcacggccggcaccatcggggggcgacaggcgaggctccatcttccctgtgcacagtgtgtggtgctgaccaacccccgcaagggacagatggggacacggaggcccagaggagcggagaggagtctggcctcgctgcctgcctattcttgctgttggcagggcctggtaaaggaggcagagatgccacgaaagaggcacgaagggccgtgccctgccctcttccacccccgaagttcagaaggacgcattctttttttctcggagacggagtctcgctctgtcgcccaggctggagtgcagtggcgcgatctcggctcactgcaagctctgcctcccgggttcacgctattctcctgcctcagcctccccagtagctgggactacaggcgcccgccaccacgcccggctaattttttgtattttttagtagagacggggtttcaccgtgttagccaggatggtctcgatctcctgacctcgtgatccacccgccttggcctcccaaagtgctgggattacaggcgtaagccaccgtgcctggccagaaggacgcattctttaagggagctgaaggccacgtggtggagctgcaagcctccatcaggcacagggatacgtggagtccagcacccaaggcccctgttctgtccacttgggcacagccacggcccagagacccaacgctgcccccggtcaggggcagtcctgggttctgatgtctctggcgcaggagaggctgcatggaagggccccatgtccactgcgctctgagtacaggctgggctggactaggctgtggagccctggtgtggtggccaaggcaaggggaggggcccggcaatccccaggcctggtgagagccccccaccacctgcgtggggaccctggtggtgcagaaatacctaggctctggagggcccaagtcaggtggcctcggctcccaagtgggaattctgcctctgacagggagtaactagagtacaactgatcttaccctcagtttcccctctgtaaatgggtctgcaggtggcgtggtgcacccgggggcccagggcttggccccaagcttgcaggctgtcctcgcgtgggtggagcaggcacagggcctggggtctgggctgtgccagagtctgaccatcgaggtggtctctctggaccaccccattttgcaaaggtgcagacaatgaacttctgttcgggggcctgcagagaagggggcctgggtgcagagctgcatcatgccgcatccaccactgagcctcaggacaccaccgggtgtccccccagaaaagggacgaggctgatggtcccagtccagacacacacatcccagctcatcacagcccgaaggggtaaatgcctttgtgactgcattttgcgtttgagacccgagggacagatgggaatatgtggtgtaggtcacgcagctgctgggaggggagtcgaatccaggtgggggctccaagaaaccgaggggctgcccatccccctccccgctgcctccgggaacagggcagggggctgcagtcacccctggccctcgtggggagcccctccccacctgtaagagggtctcactgcagctggagctgcttcccctgctggcttgatggcaccctggctttcccgggtactcagggaggtcgggtacactgggcggggacttcctcatgagttccatgtgtgacctggggccaccagggtgcgcaggagccctcctgactgccccgggcatttcctgggcgtctcccaggtatctcccatcctggtctccggcaggtcccacctgctgcctccccggtgtggactttcctctgctgagtaaacagaagactgccccggtgcctggacttcctccccaaacctcctcctgccacgtccaccatgaccccagcctcaggggcagccaagcatccaccacgaccccagcctcaggggcagccgagtatccaccacgaccccagcctcaggggcagccgagtatccaccacgaccccagcctcaggggcagccgagtatccaccacgacctcagcctcaggggcagccgaggaggctctgagctgcccagacccgacggggcagaaccggccctgggtggctaagcgggcgggaaacgcagaggcaggcggccgacagcagtgcggggtgagctgccggctgggctgctggtgccttggctccgggagacatcttccttattacggccaaattcatctttgttttccttcccagtgacatctggctctcagtgaggtcccacgaattacaaaaagcagaagtctgaacttctgttttattgccacaggaaactcattgccacagcacaggcggaaagccggatcccggcgggtcctgagtccccagctcccaccctcggggcaagctgcgagctcagaagtggggactggggagcagttatctctcactctcctcatcgtcagtttccagcccaactgccaggtctccgcctgagtcttttccactgatgctacaagggcggtttccactccaggaattttttttccagacaagcaaagcccttgcctgcatttgctctcggctaaggcggccctcccaggcctgcccggtgggctgtttcccgcagcacggcctgggctccgctgaaaggaaggtcccggcctacggaagcgcagaagcagaaccaggccttctcactctgcccaggaaagtcaggaggtggagaataaaacccccaggaaaggatctggggtgtcgttcactgacgcaggctttcccagagagactgagccacgaggtggacgaacagcgtggtgtccacccaacctggccctgacaccagggatggtgacgctgtcgtgagcctccctctgagctgccctcaagcggcctgcacctccctagccagtaccccagcagttgtgtttccacccctctcctgcccctgcgaggcagcgggtcccagcccacagtgtgcactggactctgcacactcccggcccactccctgccgtccccacgctggccctcccgtgtcagaactcagtgggaagttccaggggcctgaccaccctggatgtgtcacagacagagccccgtggtacccacccgcgtcgggctcctgcgctgtgagctaggaacttctgtgggcctcggcttcccggtctggaaagtggggcagcagcggtgccctcagggctggctgccgtgaggatccaatgcagggcctgggtgcctctcactgcatgtgactctgcccccgcctggtatggagtaggtgttcgatcaatacttgcccagggaatgagcactggaggacaggcactttttgtcctgtaagtgaagtggtggcaaagccaccctccggcattgacaaattgtagagtttaggtcctttccgtccccaggggcctggggccagcctgggaggtgacatcggttgcctggacgtggatttctatgaacactggatgccatgtctgtgataatagccgggcaatgttccagtggcttctggagggtctttagcaacaacgacctccctcccctgcacagcagggcaggaagcagaggtggggctggccagaggtgcagacctagagcagccgggatgaggctggccttggggctccatgacccaggcagggcagaggtcaagttctcccacccgtgccctgaccccagatgggccccagggcctgtatccaggtgagggcttttgcacctacagtgctaaccccgagtcatgaccgagccctcagccaccagatcccccagtcccttgggggtgctcaggtgctctaagaatgtggcccggcaggctggggatggggaccgacagcacaggcaaaggaacgcccgggcagggctggacagggactgggcggggctggacaggggcctggagacactcgctgcggcccgccgtcagactggctccctgcatgacctgtggagtgactgtacctctcccggcgtcggagacggggaacgctccacggccctcgtgggtgttacagggacgcgacagtgcgtgtaagccccagcgctgttgtaggctctaagacccacccaggaaggctccacgaccctgtgagcaggagacacaggccacaggcaggcagtgcagcaagtgcgggccgggagagcagccccatggagacgccagcgccttcacctgtggcaccaataacaaggccctgctagtccctccatgctgggtctgaacacccgcgtggcacacacggcactggggcacgctgaagttgcttctggttcctccctgccagggaaggaaattcagagccacttaattcaagcaccatccttccaccctggcactgtgggaggctgaggatgaatcagaaaaccccaaagtcaacctgctaacggtgcagcagggaaggggggaggccagcggagagccccaagatggttccagaagctggcagggaaatgcctcacccacctcacaccctccctgccaccccagaggcggcagcggcgaggcccggccctccccactgcagccctgagggctgggatcttggggattagtgacccagcctgctggcagcatctccagatcctcgcgtagggagaaaaattaatttcttccagtcatgcagaaatgaaaatacgtggagccaaaccagagagatttcctggaggtggtaactgaattacgcagatagcgggcggcaggggaagagctcaggggggctcgggcggctggtgtgtggcttcgtagccccagagggttctggaaggcgatgtctggggaaagccctcccactcaccagccctggcttcacaggtggtgacagcacggccccagcaccacgaaccactcatgtgaacttcccttctcccctgtcactagaggatcccagcacatcccaggagagatggagcctgccggaagactgatcctgatgcgacactctcttccctccctgagccccaatctcgggtggaggccacatctgttcctcctgctctgggcgcttcttcctttctgtttccctttcagtgtggaagagtggccgcttgcccagcaggacggtcccaaatagcatggcttttccaggcacggtgctgtcggccgcacagaacaggaccctcccggcagctccggcttgcacagcatccgcctgtctggcccctgtggaagtatctgactcccaacgcccagactggagcgggggcaaaggacacagcccgaccccagaggcacacagagccagccctccacggaagaacgtgcccaggaactgtgggctgggccttcctgcctcctcccctgccgcgaaagcgatgccaggggcaggtgagggtcggacgcgctcaggcccagccctcgccccttcaggtctgggggacacagtggagtcccagcctcaagaagtttccccaacctctcagaaacttgaagggcaatgccaggtaccgaaaaaccggcccccgccccttatccccggccgacccgtccgccgaggtggctgccctgggaacctcctgttcctcgtccaggagaggaaacgcacacccgggccggacgcacagaagccgcaccctggctggggccacaagcctgacagctaccgacaagcccccacccacaggagcacgcgacgtgctctcttttcaagggaaaggtttttcttcctgggccctggaatgggcctgaagtcagccggcctcagcccacagggtgaatgaggggtgggcacagcccggccgcggccccagcacacacgggcggacgcaggggcgggggagcgccagccccgcagtgtgttcggagcccagcggctctgagtcgccgccaccagcctggccgccttctgctccacgtaagtgaagtcagccgtctagggctgcgtttccagccatctgtccctccacagaggctcacacctccctccccgctgttcccacagcctggctcggggcctgcccaacacagatggacgcttcccaaaggctgtgcgcgccatcgctgccacccggctgtgccgaggcccgcggccgtcaggaccccagggaccgcatgccaggcagggtccaggacccccagcgcggaccacctttagcctgcggggcagcgccggggacccgggcaggagggagaggagcaggagggagctctggacccccctccccagaccggccgccgccacctctgcctctcccagggccgccctcggcctccccactcccgggtctccgtcacgcgggccgcggggcctttgttaggaaaaccgggcggccccaggggagcccgcgagactcccagcgcccgggcgcgtcgttcccctcgaagtttcgccgcagcccccgcaggtcaggctctgctcacggggggctgcgctcagcccggatgggtgggcgctgggcgggttggctccaccctgccgtgggcaccaactttgaaaacggcccgtgcgctcggcgcggctgcggcgcagatccgggaacggcagccgcgggcggagtcggggtagagcggcggcggcgcgcggggcggacacggcacttacggtcggggggtccgggggatccggcgggcggcggacggcgcacactcgcgactcggtccgggagtcgctgctccttccagcttggtccccgcctccacgactcaggggcggctgcgcgctgtcttctggcgccgcaccgggctcaggcgcgcggcggggctggggcgcgcggggcggccgc

SEQ ID NO: 413 - DNA, 102242 bp, Homo sapiens
tcctgcggtttctgttttttatttggcaaacatctcgtttattaccatcatgaatatcatttggacctctgcaaagactatatacattcacattaacgtacacgctcagcttcaggcctctggcgggctgttcgtggctggttcagtagctgggtcactcccgtattgcactgagttcctagaactcctgatagccacgcacacagatgccaggccacgggccacgccacgcgcacagatgccaggccacgggccacgccacacacacagatgccaggccacgggccacgccacgcacacagatgccaggccacgggccacaccacgcacacagatgccaagccacgggccacgccacacgcacagatgccaggctgcgggccgtgcctgctgtctgtccttgtactcggtgcaagcatgaatttctttatccctttatttccttcttgaaatcgctgaggcagttgagaggagtggagggagggtgggcagggctggaggatgggagggagcacgtctgatagaaaacgtcaccgagacacaccccagggccagaggcgaacgcatctgaggggtggctgggcaggagcaccagggctatgtacacggtcagggtcttccctggggaggaggcagagggctgcttttgtttgtagtttttttgttttttctgcaaaagtttggaagaaaggggagtagctgcggtggggcgatggggccgagaggttggagttggggcgatggggctgagagaggtcggagctggggtgagggggccgagagaggtcggagggcgcggagaggagagaggtagaggaggacgggctggccgagaagcagtgtttcagggaggcctgctggctccgcatgctcgaaaagcagtcgagaatcaacccaaaagattgtcacagttttgtttcggaattatgctctctctgggaagaaaactttagcactttttttccacaagtggaaaacggaaatatgaaaagtcacagggggcgtgaggacagacggcgtgtcctttcctacacatatggagacgcaggccggagcaacggcacacggaccacgcacacgcggcggacgcaccaacgcctacgcagaagagaacaaaagtcgcttctaactgggcacaaaccctctgcacccaaatatcccgacacccacaaacaaaatcagaacagaagagaaaaagacccacatccaaacaaacccaagagcaagtgaaacagtgaaaaaaatactttggcagtgacaaacaaattttggattttgatttcttgtgtttgcttttttggatttcctttggagcagaggtgtgtccggtatccttggctggctagctagcaaggtagttcacaagtatgcttcctttgcttttttaaaaaaactttttggatttttacttaaagccaaagagtttaacattacaggaaaaaaaaatctgaaaccaaaaatgcatcttgagtcagaaatcgaaatctttcctcccgtcttcgctgatcagcctcacgcccctgggggaggggcacagctgggttcagatctccagctataaaatcgcagttttctttctccctttttaatcaggagggggagaacccccccgttttctttgtccatttctgagtagctcttttgccaacacacaaaaccccccaaaattctttgctgaaaatataagccaccaattcgattttttcattgaagagaaagtgtgtgatagtcatagagagagagaggatagagaagacagagggggagagacagacagagaggaaaagagaggtgggcagagccgccgcgcctgcggcatctgctctgctgtctaaagctcagtcgaggcttctgaggatgcttgaagagacgttgtcaggaggtctccgcgcggaatcattaggtagctgaggcaggtgcactgaatgcggttttgttggttctgtgtcttctttcggagaggggcagtagcagcagtgactaattggtcggctcccccaggtcaggcggggcgcagtgtctggcaggccaggcatcggaggccaggcacagcatccggtgggcctggagctgggtggggttggcacggtgctgtgtccggcaggccaggggccagtggggtcagcggggcacggtgtccagtgggccaggtgggctgggggagccggggcgagaaggccccgcagagccggcttcgctggggctggcagcacccacaggcagggaggggcccaggctgtgggcggcttcgggcggtccaggcaccgggtcggccaccacggctgtggggccctgcaggctctggccacacacgtggtgatgcttctcccagtcccgatgctggcagaaggacccgcagtagcgtgccgcgttgcagccgctgcacgtctcactggctttccgcccgcagttccagcagctctgggtgggggcagaggggccagtcagggctgggtctggccacccgaatccccaacacacgcctcaaccaagccattcagacccagccacgtcatcaccaggtgagaagagagaaactccaaagccccacagccctcgggccatgctccagatacagccactcactgggccattttgcgggacggcatcccactaccgtgtctcacgctccagcccacccagataggtctgcgctgtgctaactggacaacgacccctgcctcctctccaggaagccctcctgagctcaccaggctccaaaaccgcaaaaccaaagggcgtggccccggcaggattgaggctgctgagatctcaccatccgcctctgctgcatccacacccacccgtccccctccccacctctgccccacccctgcctctgctgcaccccctccacctctgcccccaccctgtggtgggctctgctcccttcccgtagggtgagttgtgccctaggcatccctgtgggcagagggggtgggggatgccacaaaaagcctgtgggcagagcaggtaggagatgccacacaaagcctgagcatatttcttcttggggcctggctggatctctcacagacggttgggctgtggggtgggaagcccaaacctgccctaggggagaagcccaggtccctatttggcctccaaagcctctggtaccacctcccaccccacctcgccctcactgccactgcagcagcagcttccctgcggactaggcactgccaggcacagtccccgctccaggccctggcccctgccggtccctccgctgggcccgctcccccgatgcctgcgtggccagcttcattcctcccggcatctgctcaggtgtcacctgccgtgaggcctccacagccccactccccacacacttccacctcccgaaactgcacgcctcacttctgcgtttggtgtttccttctcagtgccagctctgtgagagttgtgcctgtggtggtctagcttctccctagctgagagcaggcgtggaaatggccggtgcagagacccctgaatcgatggggctccatctcctcccaccccggggctggcccaggcacagatgcacacaggggcttcagatagagatccgccctatctcaagggacagtcctggggctcccctggaaagggtctctccctgtcccctcttcgtggacaaggcagaaaagggtcgcggagggtcctctgcccccgcctgcctcccaggtgcacgggcacaagcatcgtaattctcaggcctgccgtgtgcaccgggagggagccgggcgcctcggacgccacctggggccctcacagctctcctggatcctcctgttctcacaggctagagaacacgggtttcaggccaggcacagcggctcgcttctgtcatcccagcactttgggatgccgaggcgggtggatcacctgaggtcaggagttcgagaccagcctggcctacgtggcaaaaccccatctctactaaaaatacaaaaattagccaggtgtggtggcgggcgcctgtaatcccagctacttgggaggctgaggcaggagaaccgcttgaacccgggaggcggaggttgtaatgagccgaggtcatgccacagcaacaagatcacttcagtctgggcaacaagagtgaaactccatctcagcatcagccaacctgggctcgagtcctggccccaccgcttcccaaggccgtgacctcagacaagctgccaaccctctcgagccctcagtttctggaactacagaacggggacatccataggacgcctcactgaaccatgtgggatctctgtgctgataaagcacagtgtgggcggggatggcgtgcctgctgcaggatgcccgtgacaactgtgctgatgccacgtggaggctcagaatcctcatgggggtggcgtgggaccgcacgggagccgaggcaggggatgggtgtcagcgtggccgggtggccctacctcgctggagtcctcctgctggttgatgaccgtcagggcgtcctcggaggcctgccgcttcgcctcggccagggcccgctccatcttggcacgctccgtggtgatgagctcgtgcgctttgcgctccgcgtccgacacggctttctgcagctccgacatggcctgccgcttcacctcattcacggcctcttctgcaaaggacatgggcagggctggcggtcacatgggccatcccagatgggtctctggacttcctacgcgtggccacaacctggggacaggggctgtgtgcagctgaacacacgtaccatctgtgcacacaaaggcacatgttgatggggctgtaggcagctgaacacacgtagcatctgtgcacacacagacacacgttgatggccctcatgcctgtgcagacaagtgcatgcaaataaacacaggcatcccaggcatgtgtgtgcaaagctgggtcacgtggtgtcacaagtcaaagcttgcactctaccgcagcggctccccaggcactgcacccctgcagggcaagggcgaggcccaccccagggcctggtcagccaggggcgcacccggaatctgcattcctaacgcgagccgggggagctgctgctgacctgaagcacttggataactctgccgttccgccttcacctctggccccacccagacgcagcccaggaagccccctcgtccagggctctgtgctgtcaccccagaccctgctgttatcctcaccgcacttgccatcctttaacctggctggcctctgaagaccatgctccccgacccacacacagccacacacagatcctgatctgtgctaagatggggtaggctcagagcagcctccagggagcactgcccacgcagctggggaggccatgtttcaactccaccactgaaagagaccctgaggccagctggagaccccggtaccgctgcccaaccctaaccctaaccctaaccccaaccctaacccctcttgctgcccacatatctggctctgccccagcccctcccccaaggctgattcccacggcatgagcaaatgtccccacagccttgcccagcgctcagctccacgtctgcccctgttctgaccccattctgcccggactctggccccgcgtgcctgacgcgcccaggctccgagtgtgtgcgcttctgcgtgccctcctgggtgtgcaggtccaggacccactttattctgctgggcggccaccggtccgtttcctggtaggcgcaggtagcagctgtcctgccctaagtgtgaacctactctgacctctccgtgagccacacagcggaatgcagaaagccttgtagcctgagcccccagagagagacagaagctcttcaaagctgagccggtgagaggcgcatctggggccctggcctcccacagctctgctggccaggcccctgcacccccactcaccagccttcctccagatgtcctcaggcacgtagccggtgagggtcctcggcaggaactcgcgaggcacgtctgaaacaggggccggcgtcacacaggatgggccacgcggctgcccctcccacgctggggccctccccaccctggctgggccctgagtgcagggcgtgagtgtgtgcgtccctggggggaggcccaggtgccctcggacaaggtctggctcaggcacccagggcagtgcccgggcacggggggcattggagctgtggaccttggactcggctgggagccgtgtgtgtcctgggcctctcctgtgtcagcattcgtcgctgaggcggagaagcagagaccctcagggcctcccagctccgagcctctggcccaccagacgctctgagctccaggcttcctggcagaccagcccgtgttttcctacaaagtgaaaaaggtgcctctttctcaagcgaaactgttctgcctggtgtttcgttgcattgcctgcctgacagctcccaggtgtccgccccaccagagcaccccgtgtctgctccctccccccacaccccacacgcacctagctgaggcccttcgggaccggcggagctgctgcggggccgggccgcggcgggagcggggcccttctttgtgtcctcggcgtcgctgtagcgccgcgcccagtggttgagctcctcgcggtcggcctcctggcacctgcgcagcaccgtgagcgagcgccgcgtcttctccaccatgtccatgatgcagttcaggagctgggggcgggcggcgcagccttcagcacctcagagggaccgggacgcaccagacactcccccagcccactcggccagagccccggacaggatgggtgcccgaccagcccaccgcccgtgagagtaagggggtgagggagggcccacctccatggcttgcaaagatgggtccctagcctgggactgccgagcgcctgggggtaccagactcacatggacacgtgcctagacgcacgcaggagtttgggattctcctttttaacccgctcagcggggctctgcctcagggacctggctttccgcctgggctccccttccaaaaagcatgagggcgaggggcgaggctgacaacagtgctgggaggggtgctggccccatgcctggcgacccctcctgggacgtgctgcaggatggggtgggtgggttctgaggagcccagttccgggccgtccccgaacacgtcctgcctcaaagaggcctcggcactgcttttgcccacacttcttgcaagactcaggatagactctgggaagagccagtgagcagaaagtaagtggagggaagcaaggcccgccatgagggttttaggaatcctcctccctgggcctctcgagatgcctgggctgcgctgacagctgggaggaggggggctcaggtgaaggacccagccgctgcgcagggacggcgcaggccacacaggagggcactgagctcaggggcgcccacacagccctgctgtctccagcagccccaggccccatggggcagagccatggccgtgtttatgcataggcatacaggtgtggctgtgtggggacatggctgtgtgggtgtagctgtgtgtgggcatggctgtgcgtgggtgtggctgtgtacatgggggggttgtgtgcatgggtatggctgtgtgtgtgggtgtggctgtgtgtgtatggctgtgtgtgggtgtggctgtgtgcgtgggcgtggctgtgtgcgtgggggtggctgtgtgtgactgcacgggcgtggctgtggctgtgtgggcgtggcttgtgtgggcatggctgtgtgcatgggtgtggctgtgtgtgggcatggctgtgggcgtggctgtgtgtgcatggctgtgtgtgcgtggctgtgtgtgtgcgtggctgtgcgcctgggcatggctgtgtgggcgtggctgtgtgtggacactcacgttgttgaggtgcttccactcttctgcccactcacgctctgtgagcttgtggtcgatcacttcttcctgccgggacccaggcaccactgtggatgggggaggtgcacgcttaggtcccacccacagccagtctctgccctattctcccagaccccgccctctgctcccaggccccacccgtgggctgtgcccgctggggacgatggacagggtaaccgaagggctggttgacttggtgaccgtggaggatgcctgggttactgagccgcctggggctctgggccgactgctcttcccctgcaacacggcacacgcctccaagggagggttcagtctcagtcccattctgcagctgaggaaactgaggctggttaagaggatgtgtttgcctgtggtcaccaggcagggagcggtgggggtggggtgtggaccgaggctggctggagctggagcagtgtcctcagccactggccgggaaggctttgttagactaagcgtggcctgaggatgcctcagtgccaagtcacaccatgacctggacctgccttagtccgtgaatcaatgggtaacctcactgggaggagctggtctcagtcattcgcggcagccctctgcggtcacccgcaggcgcccatgactccgatgaagccacgccaaacaccacccaaccacgtggcctcggcacccgcctcctgtctctgcctgtgaacaccgccagccaagccgaggccagggctctcggaacacgctggctctgaggcccatcctattcggggttgttctctgctcagttaaactctgttcaatacagcgtgtctaaggtttttcccttttgacaggctccaggactgaagccgcagaggccactcccacaggtcaccagaaactaagacgtgagtgacgcccggcagtggccgactcttccgccgtggctgtgcccatgggagacgtgagtgacgcccggcagtggccgactcttctgcggtggctgcgcccacgggagacgtgagtgaccccggcagtggccgacttccacggtggctgcgcccacgggagacgtgagtgatgcccggcagtggccaactcttctgcggtggctgtgcccacgggagacgtgagtgacgcccggcagtggcttactctttcgtggtagctgcgcccacgacttctggagacatcagaggcttccaggccccactgttttctgcatttggccactgcccacgcttctggggctgaggtctccctcttggggcccttttcagcccctaaagatctcctagcctccgaacctgaaatggctcccccaaattgcagaggaggtggggaagtggcagccacagctcagtcaccagcctgctctgccgcctgtgaagctgcagctggcagcaacaccccaaccaaaatagtggctgagacgtgcccgacagctggcgtttatttctgtattagcagaatcgggtgggagtcagcacctgcctgacccggctgcagcatgccagacgccgtcacctgctgcctgggccctggaaccctccgcaaggtgggggctgggagatggccttgtgtagggcaaggcctctgctgaccctgctgctgggcccccaccgggccctgggcctctgtctcagcatggcagactggaggcctccctgcagcctgtcctgggggggctcctggggtggggctgggcctgaccatctctgggttctcagcacagaggccgtcaaaacgtcaggcaggctgggctgtgagactgtgggtgcattatgtgtgctctcaggcctcagtctcctcatctgtggtatgggggtgctgacgccaccccactgacgggctcagaaacgagtgaaggataaaatgcaccgagactccgtgcccacctctctgttatccacaccagcctggcctcacgcagagactctgtgcccctctcctgctctagataccagccaggcctcacggcagcccttgctgggccctgcattaactcccccaggccttggactctgagagttgggactctcgtctggcccaggtgacagaggaggaaactgagaagcagagagccacgtgactcacctgtgggtggactgtgggaatcgccaagctcggatgagaaccacgtgggcagttccaggcccgaggccgcccaccccggggggagaggtgggttcagggcccaggacaggcccctctgcagccaccgctctgctccagggggaatgccaggcagggggaaggggtctcccgagctcaggtgcacacagctgcccgtggtgccctgtgcccacatgctcaggtgtacatgtgggcgcatgtgtgctcctgtaacacgcgtccacgctcccgccccaccgggctgctcaccaagcggccgatggcgctctcgtagctcccgggggtctgggtggcggtaggcatctcggaagtggtgggccatggctatgtcctccaggcggtagtgcggcggcggtgtgggctgcggtggcccgttgctggggctgtagcgctgggcagggttcagggtgcatggccgtttgctgaggtgctcggggtgcagcgggtcgcggtctgacccgttctctttggtcctagccccaagagcaggtggggcgagggcagtggacataggatgaaccggggacagaggtgcaggtggggtgagaggcagacaggcaagggcagagagaaagaggacacgtaagggcgagacagaaacacggagcaaaacaccagccccgggaagcccagcccggcgcccccactctctgcccctctgccggggcccatgccagcctcaacccctgctccagctgcatggcatcctggggcctggtggtcaaagagccggactcgctgctctgggaacgaggagagggatacaccaggcttccgtaactggagaccacctgccccttgggcagcagcagcacaagagcgtctggggcagcagagggggcccagcccaggcacctggggaccatggaccccggacgctcggagtccatgcccggcacacaggggagagccgtcctcccaccagcctcctccctgtcctcctaggctccccggagcatctgagtctgcagcccactggggtgtccgcccgtgcagccaccaagcctgctggccctagtacacctcgccacgctccctcagcccgagagagccggccgggctggctgcagccccagaggaggttccctctcttacccagaggggagcagggtgagccgcgtgtccacggcacccccagcccagatccccggagcccacaggtacctgtcgggcgtcctcctcttgccgttctcgttgacttccagtagcagctctgaggagtcgatgggggaggaggcgctggcgtccagcaggagctgctcatgctgggccaagtactgggcgggcgtctgcttggccaggcgtgcacagtgcaggagctcccgctgcagcaagggcaggtttgcctgtggggtggggaaggagggcctgggtagcatgcaggggtgcacagccctgctcaggtccgagcagagggggcctgggctgggtggccgaaagctcaacttgacctcgggcctcaaaggtcaaggtgctcgacctctctgggcctcaagttccttcctagcagtgccatgggagggtggcgtgggagggtgggcacagagcttcgcaggagtgcctcacctgggccacacggcgatgtggggcatgtgggacttgagcccagatcctggactcccagggtggggctttcccaccgcacccagctccctcccatggcgtggtctggagaaggcgagaggacgaaggggcagcagatcatggttggtcttcccgcctgcacccgccctgcccagcaggcaccacatgacccaacacagctggggaaatgcaggctcagagagggggaggcagccctgggcctacaggcggctcacacgagggagctgggagtgaaacccagctgggattgcctgcagtgtgtctgctccagccctgatgggaagccctgaggttcagcttccccttcccttcccgctggtttccagccttggccttgatggagcgtggacctaggacgtggacacccacgttctgtggctgctcaagtgatcctccagccttggtgaggacggcctcaagacccacgtgtgcgggtaaagactccgcagcatgcggccgaaggacggcccggtgtacgggatccgtatgcagaccctgcctttgacgcctgtgtgtacccgcggcgcccgccgcctcgtccttggctccaggctggcactgctgggccgcaagccgggctcctcgggtgccttccccaaagtcttcccagagctgccgcgggagggcggacaggcgtgctggaccctgagcatgctggaccagggcccagcagcaggccacttgggagagccagcggttctaagcatttgtaaataaatccaattccccaactttctcatgcgtttcaaagctgccacgccgccttctcctgccagcgcctccccattccccacgagtgcatccaccaggccctcgagcagtgccggctgccggcctgtttttctctttggatggctgaacaggggccaaccggccatctgttgaggacatcaggagcatgagctgggaaacgaggtcccgggaggtctgaggagccaaacatcctccctccctcatcagcccctccccaggggcctcctcttggtcagttcgggaaccggctggtcgctgttagggcggggagaacatctggatccctggctggctggggccagctgaggccagctgggagccggggcggtgggtggggctgcatcccccagcttctggaaggcctgacccttgggctgcgtgtggggcaggctcaggaaagggtgcagagaacccaggactgggcagcatcagcgtaggggccggatgcacagcagccctcggcaagcagggaatgtttcctcaaggcctgcggaatggggtggggactgtgggaacctccggcagtgcctccttcaaggcagtgtccccactctgtccccaggagcccagggcacccggggaggtgtcaccactaaaatgctacacacactgagctggtcaaaatgccccaactccaccactgaacggaagttctgcctgcagaacttctgaagctgccctctgcacagatgggcgctcaggctggggaactggtgtttgcaatgacggcggcggtggctgaggcactagttgagctacaagggctttcgcggactccgctgctctgccaagcacccagctaaagcctccctgaccgtgggctctgccatagaggggctgtggccttgggctggtcatttaacctctctgacccttgctgtatctgcaaactagcgctgtggagcctctggccgagacagactccggggagctccgggtgaatcagctcagtcctttcccaccaccccgtgagggagattcaccaccccaactacgagagagagggcccaagccagggctggggttccagccaagcaggcccccactctctccggcccctcagccacgattcctgccgtttctaggatgatgtcttcaaggactgcgtgagagtaccccagactgggcctggcgggctgtggatgtcttgggaaggtgctacccctcccccagcccaggccacagtcaggaacaccgaggcccaaggggactggctgggggtcactcccactcggcacctcctgtctggcctgggaaggtcggactcccccactgcactctgtgtctgaaggggctgcggccctgcaggggtgtgggtggggttgggggggtgcgggtggggttggggaggggtggggtgggggaagggtgtgggtgggggaggggtggggtgggggtggggtaggggtggggtggggtgggagggggtggggtggggtggggtgggtgggaggggtggggtgggggctgctccctgggtgggacagtgacagtagggccagggttctggcttgtatctgagccacaagacctggaagcaggactggccgcaagatctttattttttatttttgaatcctcctggcctccccctagaagcgccatgtcagagaggtgaacagacttcatgtcccactggccccgggccccgggtgggggcacgaggtgggctggccctgagctccagctaccccacacaggccgtgggatcccctgtgtaccaaggggagactgaggtggacacggccctcacgagagccgggccgcgggcggcacctgctggggcgtggccgggggacaccagggcctgaccagacgtcatggacaggggccgtaggcctggtgggggcaagggtggggatgctgcggcgtttctctgcctgaccctgatcctcagttaagcaagggtggctgaggctgggggcatctgttggtaataagcaggcgcactgtgtccccaaagactgggaggggtggagtccgcagcaagttaaaagaagggaagggaagggccgctaacgaactgcaaacgacgccagatgggcccaggctcctgccactccagaagcttctcttttgtcaccatctgggagcatgagcacagcagggcgtgggagggggcggaggaaggcgggaggagggatggagcgatagaggagggagggcaggaggaaaggagggggtggtgggagggagggaggactggggcagcggagggagggagggcaggaaaaagcagaggaggcaggggcgggagggagggagcgagggtgggaacagaggtgggtgtgatgtggggtccccttggggagggactgaggggaatgagggtctgaccctgtaagtgccctgggacgaccagggcgtttggaatttgacagacctaggtttgagccctggcgccctctctccactacctggggggaacccagagcctcagtttccccacctgttaatcaggaacatggcagtgcctacactacaccttgacagaggccaacaggtctgtgagagaccttcctgaagcactcctcctcctccagggacgacaccccgcgattcctcctcctccagggacacttcaaatccctggacgacgccccgcgattcctcctcctccagggacgacgccacgcgattcctcctcctccagggacacttcaaatccctggacgatgccccgcgattcctcctcctccagggacacttcaaatccctggacgacgccccgcgattcctcctccttcagggacgacgccccgcgattcctcctcctccagggacgacgccgtgcgattcctcctcctccagggacgacgccccgtgattcctcctcctccaggggacgtttcaaatccctggacgatgccccgcgattcctcctcctccaggggacgtttcaaatccctggacgatgccccgcgattcctcctcctccaggggacgtttcaaatccctggacgatgccccgcgtgaatctagaacatgcctcacctccctgtagtccccgctacctgggaggctgaggtggaagattcccctgagcccgggagtgaggccccgttctttccgcgtgtccctccacgctgtctcctcaacagcctgaggatgattccattttgcagatacagaaaccgaagcacagaggaactggcctcacccaggggccaacagctgctaagtggcaggctcgggctcaagccagggagcatctggtctggtctgtcctctggacccccgaggggaggcctggcccagcagagatggagcccacagcagtacgggcagtgctcaggctgggcccgaaggtgtggccaggctggcagctcccaactaagctccacggaaccctgaccccaacacgtgctcggcagagaaggtcacatggtcagacacatttggggaacctttcctcagctcctgctagagatgtgcagccgtcttggggaaatggagacccgcagagatggcagtctgactccacggcactcccgtgcccgtcccgtctgtgtgtgcgtgggaatcactctcccatgggaatcactggcttcattcattcattcattcattcattcgttcagagacagggtgttgctctgtcgcccaggctggagtgcagtggcgtgatcacagctcactgcagtctcgacctcctggattcaagcaatcctcccacctcagcctcccgggtagctgggatcataggtgcatacaacgctcagctaatttttatattttttgtagagatggggtctagctgtgttgcccaggctggtcttgaactcctggcctcaagcaatccccgttcctcagactggcatctttaaaaatgcaggctctgattcagcaggtttgggccgggccgagagcctgcaaagctgacaagccccgcgtgctgccaccctggtccacggttgatctgggtgtgaccatctgacctgctttcacctgacacctcttcatccatcggcctgcgcagccacagaagccccttcccgcctgtctaccgccctcacctcccgccctcacctctgctctctccaccccacgtattctgttccagtcacactgacccctctgctgttcctcaagcacagcgggcgccccatacctcagggcctctgcacgtgcagttactgctgtctggaaaaccctgcgctggctctgcacctagctccgccctcatcctcagccctcaccaacacgcctccaagcaaaggactttcggaatacttctccaccacgtgcagctgcagatttgagagtggctgtggaccgaacgccttcccaccccagggtgctggctccaggagggacctgctgcatgtcctgggccctatccccgagccttgcccccacactggcacgtcgtcagtgctcaaaaatcacccgtggagtgagcgagcacattcggccaacggcaaccagaggcgaaccggacagctctgtcctgtgctggatttaagggctgataatcatccggtctggcaactaattttcaggccttaactagtaggagtcaaccctgactagtcagcagtgctcccctagggtaccacagggtcccaggttggccaagatcgatgcctcacacctcttcatccacctgcctatctggccacttaagccccttcccgcctgtccaccgctgtccacgctggcaaggagtgggattaaggggccttctagggaggctcccgcagcacgggggacgggtttcgcattaccttcaggaagggaatgacaaacggccgcagagggaagttggtggcctcctgaagcttggaatgaaactcctcgatcgtcaatgtcgagttctgcaggggagaaaacccacctcacatcagcaccgctcggcatgtgagccagcgccgacccacccatgcctgaggaggaggcttccgtgttggaggcaggcaggcagcccaggagctgggcacggcctgagagggtgcaggtggcatcgtgggagcgggtccacgcccggttgtcagcgtggagcccatgtaaggagtggccgtggctgcaacctcattaaacggagggaatatgcatgtcccaaggccccggctgtccctgcccaactcaccaccaggcccagcaccagtgtgcgcacgcgctccccaatctctggggagatgtcgctgccaaactgctgcagtgtggtgaggaagcgcttgagcttgctgagctgccgggccccgcaggctgggggcaggtgctgtgtggacaaggaggctgtggacgaggtggccgggccattgctgaagccgttgggtgtgcacggtgcaccattgatggctgttggtgagtggctgctgccgttcatcactgcaggagggaagcggacatgaggacacaaaggtgatggtgacaacacaacccagacggcggcgacagtgagggaagcagcgactaaggtgacaatgtcaaaagtgacggcaacaatgatgagacacaaggacagtagcgctgaggatgacagcaggagccctgggcccgcccagggcagctgagctggcccttagcatgctgaccatctgtccttccggccctgctctgagaggtcacacacacccccttacagacctggaaatggattcccagggaggtgaagcctctttgccccaggtccccaatgggtaagggctgggatggcacccacaatggtggtggccgtggaatgactgcgttctgagtgtggcttctcctgcctggcaccactcttgggacttgctctggggctgaagtcaggcccttcacacccagcaggggtgcggcccctacgcctggcctgggagacaccaaccctaccaggctggctcaggttttcactgtgaacagggagcaaggggcttctccacacgtcgggggcttgatggctcacttcccactttctggaggcacaggagacttggaaaatgagaagtcgctcatcccccgaaaggccagctaccatcacctctggcatgatgttcccaagcaatacccccacccccaatcaggcatctcccagccctgagcaatgtccccacaacaggtgcctcccagccctgagcaatgtgcctccccacacacaggcgcctcccagccctgagcaatgtgcctccccacacacaggcgcctcccagccctgagcaatgtgccccccccgacacacaggtgcctcccagccctgagcaatatgcgctgcaggtgctttccagcagagcaatgtccctcctacaagtgtctcccagccctgagcaatgtcccagacaggtgactcccagccatgagcaatgtcccagacaggtgactcccagccatgagcaatgccttcatttgcacacagccccaacgcctgctaatggggttccagggggcagaggagctgggacacccaaggacacactgggtgggttcctgcccctggcggctggacacgcagatgcccgtgcacacaggccagtgcatgttgaggacaagcaggtgacataaggaacagctgatgagcgcgctgcagggccgcctgttggccactgagacgtgactgcctggctggccctgctattggggtcagtgttccaggggcctggcagacatggggctgctatggaaagtcccagggccgggcctcaccccttttctcaggtgacagagctaaggccaagcctcttgcaaggcggccagcgcacccctcctgcgcctgggacacccgcaccccgtgcccttggcctcaggagcctgaggggcggcctccaggctctgaaggcaggtcagaggtcacagggctcccaagtcccttgctgacaggggagggggactggatgcctctgggaggcctgaagtcctggccagctccttctgtcaggaggactgaagccccgcacacactcacggctggctcccgcctcctgcagaaggacacgctccctacaaagggtaccaactcccctgccctcagagcgagccctccatttccctgcctccactcaccccccaccacccttacacacatgcacgcacacatgcacacacacatgcatacatatacacatgcacacaatgtacacacatgcacgcacacatgcacacacacatgcatacatatacacatgcacacaatgtacacacatgcacgcacacatgcacacacacatgcatacatatacacatgcacacaatgtacacacatgcacgcacacatgcacacacacatgcatacatatacacatgcacacaatgtacacacatgcacacacacatgcacacacacatgcatacatatacacatgcacacaatgtacacacatgcacgcacacatgcatacatatacacatgcacacaatgtacacacatgcacacacacatgcacacacacatgcatacatatacacatgcacacaatgtacacacatgcacacacacatgcacacacacatgcatacatatacacatgcacacaatgtacacacatgcacacacacatgcacggctatgatgtacacgctcgtctctcttgctccactgtggccccaagtgcccctctccaggggatccacccctcacccgtgctgagagtgtgggtctacgggtggggggcagctcagagccacctgctccctcagggccgaattcctccgaggccccagccgtgtgttcgcacctgtggctgagacctggcggggcctgtgtgcgccgaggaggaggggaaaaccctttctacaggatggagacgcccctgggctgggctggtgcagcggctccccctgggcagccggcaggcaccagctgtttccttcctgtgccctggatggtggggggtcttggtgtacccttcagatcaggccagccctgcccatcctgacctggcccctgggaggtgacccctgctgagtgttgtggcctctgtctggacgggagggaacatgggacgtggggacctacatgccggcccccctttctgggctgcgtccccacagctggggctccggctaggccaggcctccctttctacccgctcctgcaggcctggactggaaggggccgcaccctccagagggcactgaccagcccgtacctccaacaaggcccttctgaggggtcaggccctctctaagtgtccctccagtaacctttaggtggccgccatcagcttcctccactccgccttcccagaagccgcctgaggctcccaccttcccgacccgtggtctagtggcacctgcgaagtgcgcccgggtcaggaagctgtgctgtggcccgggctgggctctacacctgcacacaggctgcgcggttatcacacacatcccatgcggcaaatgggctccgaggaaccgaagacacacagcagggcagcccggctcccccagattgcctcccgtccccggcaggccccacacaccgagcaaacagcgctgggcacagtggcacaggggggaggccggccctgtgctctggatgttcttggtggagcggggggaacaggtgtgcccacgactgcctcccccggggcccagcgctcactctgctctcactccagcctgggcctcacagatacccactgcaggggctgtgggaggccaggagggcgggggatgctacagaggccctcagacacaccagcgtggtgaggaagtccagacagacacggccctgccctcgagggctgggggaagctgccctggttaggagtgaggaccggccgccaggcccagacgtgccctgtgagtcagactcggcgcctagcctcagtttcttcatttgcaaatggctcccaacccatcctggagttccaagtggggctccagggaccagaggacagcatggcagtgacctcctttgtactgtgtgtccccagccagagtcgctcaggcctgacctgggcttccccagcctctcctgcgctgcccaagtcagccccccagggttgctccatcctgactggttttatgggtcgggtgttgtgtgaggctgttggcaataaacagcccccacacctagtggaattctggaaaccactaatcgcaggtcagatatggcacaaaaccttgagtgcacgcgtggcctcagactttccctacgggggggctgcaggattgagacatctctgttgctggggccgcgaacctccacacgctgttctgagcggctgctcccctcaaccgggcaacctgcacagggggtagcctgtctgcgcccctggcttgaacgatcttagcagcgccttcctgggctcaggatggacgcaccggccctctggagcgcgcggcaccgataacggcgtcgtattctggggctttccctcttctggggggacagtggacgctgacacaggatgcaccgagcccctggtctctcgccttctgagcctctgtccggaggaccccaccgcgctgccgagtttccctctcaatggtgagctccatgtggccacacggtggactgtgacacacacaccccgtcaagactgaggatagccacttgcggtcacccagccaggccaggagatggcccgtcaccatgggagacctcactgcagcgggaggctggtttctccagaacacgagggactgtcgtcaggactgtggaccttccagcagcttctcagacgcgccacagtgcacgccggggcccctgcccaccgccccggccagcctgggcctggccctcccttaggtgcgcttaccagccttgccccgggtgcctggtccttccggcggcctgctcgccctcgcctgcccgcgcactccctcccgcgctgctgggcagtctcagcagctaaagagacgccaaaaataaccccggcacaagcgctttcattcccacgacaggtgtgttcctaagttagaccgcacacgtgtccccagctgaggattgggggcacacgcgagcacccccgcggctcccccagcctcagagccttggtgggggggtcagatgcgacagaggcaccctaacgcagcccctcctgtcacccctgctccttgctgtgggggctccgggatctgggattcaccaactttgccatccataagatcacagagtggatgacaagagccactgtccaggagctgcacgccaggcgcgagtgcgtggccaggcccatcacagaataatggctgtgaaaaggacagccctgtgcaacagaaacaacgcacagttgttctgctgccctcgttcttagagccgggagtgccacgacagccacacctgggccatgctgccaggctggctggtagtgatggaccggagtctgtctgatgggctcaagcatggctgcactcagtggttgacaaaaactataaccaccacctggtaagagcccatgctccctgaacgcccgccatgggccacgcacgttgacagaaacgtctgctggtgactcaagtctgctgagctctcagcatgtgcccggccccaccatctgacggctcctggagatcaccattggcactaggggccatgatgacttccattttacaggtggggaaactgaggcacggggggtggtacctggccaaggtcaccctggcaggaacagttgcagctgggactccaggtaggtggggtctgccctagcaatagctgagctacaggctggccagggacagtgtctcgcccctcccctcggcactcgcagtcagccccattggccatgttttgctgctggggaaggagagctcagagaggctctgctcctgcctaaggccccgcagcttggagcggagggtctgtgggatgcagcgacccggcggctctgccctcctgcgccctcttctccctaaggaggcaagaccaacacaacagaggcaatgctgagggtgcggaggccggggaggagagctgagcgcccccagggcagcagtgttgggccagctgaggatgctgcggtgaagacctctggggaggcctgcggtttttgttattttacttacagagacagaccatagaccattttaagcagccatgaaaacggccgtggggcagcgtcgcaggcccgtcctctcgatctgtaagcaaaataagaagaacacgctgtcaggaggggcgtgggcaggagactctgccctcaggggcgcccgcggccaccttttcctacttctcagagtgatttttggtgggggcgtgggcaggagactgccctcaggggcacccgggccgccttttcttgcttctcagagtgatttttgattttcggaggggcctgggcaggagactctgccctcagggacgcccgggccgccgtttcctgcttctcagagtgattttctgacggggctctgtcaccacctggggccaggccactcccctctccgagcctcagtttccttctctgagagtgggtgatccctaagggccgttctggcagcactgttccggagtttacaagaaccgcggcttctctatgagcaggggcggggccccttgttttcatcgtcctcttcccagaaggcccctgtgaccccatgagcaccatcctcagggacctgggccgaagccgcgtgtcctaaaagcgacctgagactcggcttggagtctctgaaacaaagccctgggtcggcactggaggaggaagcaccaaacaggaagaaagattcggctgggctcagtggctcacgcctgtaatcccagcactttgggaggctgaggcgggaggattgcttgagcccaggagttcaagaccagcctgggcgacgtagggagacccaaactctactatataaaaaaagaaagaaagattgaatttgttcgagctgaagtcagtggcgcaggccacaggaagacaggctctagtaaagacgggtagtgagttctctgtcatgggggtaatcaagggcaggataaagccttagccctttaagcgtcctcccagctttagaggagcttggtctgggtccctgctccttatatgccttccccctccccaccccccaccccacagcagcaccgcagcttcaactccaagatgaatttgcgcccagggctgtcactgggcaagagaaacttcggccctcaagtctccgttcagactcagtctcccatcagcttggctcagaggccagtccccggggaggagcctcccggcagggctctgcaactgagctgtggcccctgaagggcacccaccacccaccagccaggggcaggggtgcggccaaccacctggctttcacggaattgtgtggattaggggataaatctgaggctacctcaggggtggccagagcctcagactgatgctgctgacagcccagtgggactgaagcatcggcttagaaaagaaaaagcacctgcttatctctttcataaccttcacgctccttaaaccagctgggacctcaccccaaaaacatgaccccaaggcgggctgggagtggagggagcaggaaggaccccagccccaggcatgccggctgccctcacatccgttcacaggtctccagaagcagagcccgacgctctgctgatcccaacccacctccagccaggagcatcagaccggcaccttccaagcagaggctgctggtccccagggaagagcaggtgggggagacgcacccttgagggtctggggaaccaggctcagcccacggtgtttgtccctgacagtggggcctgaggttgtctgtggagcgggtgttttaggcactgcgcccatggccgggtctcccgtggtccgtcctgagcgtttcctcccccggggctggggtatactgcaaatttaacacagcagcggtctccctctacctatgtgggctcggtgtggtcgcaagctgcctggtagagagacggcccgtggtttgtaccagaccggagggctcttccgaagagagggaagggtgatcccagcccggccacatcgccgtgtgacaaggacatgtgagaaaaagcccagccagcctctcactagaaaccgtggccagctccgcagagccaggacctgcacgctgggcccgccgtcccccaggacctgcaaaatcgtgagtgcggcgtcccgactctctgaggcagggccggccccgcgggtgcagggagtagccgttaggctgtttggctcctactgagtgccgggcacatttccagctgtacctgcctctgggcggcacacctgggggcaccccattgctgggccaccccattccccaaccaagtcgggaggctgactcggagccaacatcctacaaacagggccgcaaatctgctgcctgaccgcacagccagtgctctctccagatggaggggagatgatggccaaagccctcggcggagcaggcccccagcctcagcggcagagccagggagggagccaggcctggcctatagccacccggtgctctgaggacagtcgtgacgtaaagggactgaggaagcagctctttctggcccgtcagggacccggggcaagcaggacggaagtctcaggctccccgcccagagaggggcttcgtttgagtttcagagcctggggagggtcccccaggtacggggctttctggccgctgcatgtggaggtggtacatggagtctcccccctgcagacactgagatgcactcctgagcccccagccttgagggacagggacgctgccaccccgccggcccagcaactgggccaaagagcaccaatgtctgtcctcaaagccaaggctctgcgggtgactgtgatgagaactggctgttccctgccccacagcctcccagggcccaccatcggcggctctgtgcgccaagcacggccaaccccttgccagggccagcaagacaaggcctgacagcttcttgaggtcccacccttccggcctcctgtgccaaggcccccaccctggcccccgtgctcagccgggctgtggagctcctgagatctgagcccctccaaggccagagctgcctctgtggtccctccacggggcctgtacgcaggtgacctgctgtatgaccctgcggaagcccctgaccccatccgagttccacgttctctctggatgagcctggcattcctaggcctgccggacgaggcaggaagcctgaggcacagcggccggctttgacccatggccggccctggtgaaaggcctgtgtggactcacctggccccaccacagccctgggaggacctgcattgcagaagaggaagcccaggccccccggagggcaaggacatgacccggagctacccagtgggaagcagggaagctgggatttgaaccggccaagcctgggctctgggccacacgagctcctcacactcagggctcacagaaggtgcccgctggctccgggcaggaagctcagaatttcaaacaacacaagggcctcccctgaaacacctggccctcggctgccaggtgggggctacttacgtgtgtgtggcgtgaaggagggggggcgtgtggccccctgggatgcggcaggcggtgggggcggcatgctggggggtgtggaccggggctgcgtcttcacctccgctggggagtccggcatcgctgaggccttagctttcctgtccactggggctgcgaccaacggagaaagaaagagtcggtgaagcaggctaagtgcaaaggccagggcccgcagccccacggttcccagcgaaggccccactgagtgtccgcccagcgctggggcagtctgccccaggtgtcctgacaggtggctgacgtcccacgtgcaggatcacgggggcagaaccaggccggaggacgggcttgggccagctcatctgaggtggccggccaggctggagctggggccctcggtgtgtggccgccctgcgagagccgtgccccactccaggcttgaggcttctacagaccagggagtgggcagtgccccgaggcagcggtgccttgctcccacctccatgagcatcccccggggggtgttcagacagacctcagcctcttcccccagtcctgattcagcaggtcaggctgagacccagaatttgcatttccggcatgttcccaggtggcgctgctgctggtctggccctggaagccatggttctaagagtcccttccactttcagatgctagaaggctcccctgggctggggggcgggggacggtgtctgcccagggagaggccggcaggcaggccatttagggcggcaaaacctctattttaaccgtcttctgccccggtgattcacaggacagccaagacagaggcggcattgacttcaggatggccgaggcctggctgcgctgggcgcagcccccggcaggtggtaacgccaggacacgtgattaatgagaacctgcagctgaacaagattccctcgtggtctgaggctccctgaagtctgagaagctccacccagggccagctgtgtccggagacggcaggaaaacgctcaaggcgctggtgggccgggactggggggcacggagcccccttgtgccacccagagagcaggacctgcagacaaggttaaccgaagggcctgcagcacagacgtgcccgagacaccaggaggccaagccagcaccctgtctgcggcattttctgcagggggtgcgggtgtaagccccagggcctccccatttatcttaaggcaaggtcagccagtgccaaagcaaggcagaaagacctgctatccgtggctgagacttcgggggcctcagcggcttagagcagcaaggtaggcatcctcaatctgctgaataccggactgccccgcaccctgctcctgctgacacctgtgggtctcacccacgactgccccgcaccctgctcctgctgacacctgtgggtctcacccacgactgccccgcaccctcctcctgttaacacctgtgggtctcacccacgactgccctgcaccctcctcctgttaacacctatgggtctcacccacagcctggggcatgaaacaggtgaggccacagttgggggctggtatctgtcgtgttattagtcaactgtgggcgctgcccctgcttctgcccgttccccattcccggggccccagcaccatcgtcagacggagagatccacccagggccacggccacgcggactctgtggaaggtgacggataaatgacttctacagcgatcacatgccaaatacggcacaaacctctgctgatcctcttgccgccggctccttttacagagaggcagagaggttcagaggtgctgaggtcctgcccaacatctcagggcagtggcgcctgggctctaaccggcccctggtgctccaggcaggagtggagcagtccccctctgctgggcctgtggggagtggtggggggaggaagcagccagtaaacagccacaggcctcgcggcacctgctgtcccctccgcacagccgctgacctccctcgcacagggcgccctgctcctcctggccacccgcctgtccggaggctgatggctgggcacacgtgtggccacagctgtgggggccatcaacaccgcctggctgcagggccggtggccagtccctggtgacaaccaaagaaggtgaatgtggcagggtgttcctgtggtgggggtgttcccggctgggggggggggcgttcctgggggggcattcctggggggggcgttcctggtgggggcagcccttccagaccaggctgcccttgggccagcgtgggttgggcatgcccagaagggagcaggcagggatgtggccgagagcttcaaacgccaggctggctcgggggacacaggtccaggacactggggatgccccctgtttggactttccaaagccctcccatggaggcggctacatttgagccacgagacttgaataaaacagaagtggatgcagagagccccactggggagctggtgccgggcgctggacgggcgctcgtaggatggacggacatgccacatttcctaaggtggagagggtggccaggagaccgctgggccgtcatgccacggcgcaaggagtcaccacagccgtcacccaacaagggctcatggccaccacctgcgtgctcacggccaccacctgcgtgctcgtgacactctggatcccgaagctagagcagacagtgccctgccggcgccctgagcagtcggggacttcatgtggttccctttgggcagaacaggaggctgtccctttacttcagaggcctggacagaggctcactgcaggaagatccttctcggtgctctgcagatatcgacgactcattgcatcctcaccgagaccctctgcggctgatgctgccatcagcccattttactaggacggaccaggctcggagagatgaagtcatctacccaaggtcacaccgcgagtgtgctgcgggccgggatcggaaccacgacctggtgttgcccccacagggccaggactcggcaggactccaaagtctccgcttgtcatcaacacgcttgcctccttttaggcctcaaggtacttgcaaagaggcagcaggtctgggattcaaacctgaggccgaacggaggctgcaggggcaggaggccccgtgcctgaggaacaccctgggagctggtggtgtcctcccctccgttctccaggccccaccccgggttgtgcgggggcagctgtgcaggagatgggacctttccgggccccaccccggattgtgcgggggcagctgtgcaggtgatgggacctcacgggtgtctgttgaatcctgtgtgagtgctcctggctgtgtggcctagggagagcctcttcccctctctgagcctcactttccttcctctgtacatgtggaggaagccaggtgacaggaagatgacgcggagttccccacgccctgccttggcaagcaaggaaaccaggccaaggctcatggagcaacgtgtggccgggacctgctcctggcgctgcccctggcacagactctacccgagaaagcagaaagtgacaaggaccctcagagaagatgaggggtgagtgtggaaaggtagaggaacagcatttgtggccaagagaacagcctaggagttggccaggacctgtggagggacctgggaaggaggggggtgggggagtgggcagcggggagtctggagctctgcacagcagcagctggcgccgtctctggggcgggcacatcgtctctctcctgcttaatacccttcagcagcttccactgtacatggggcttcaccagcccacacccactccatgacacccatctccctgctctcccccagtgcggggctcagggccatgcacgaccccccaccgcccctcgttccctctgggattcagcttcaacctcacttccccaggagaggctgccccgcccccgtgaagctcttccatccttccctgttcagtcctcaggatgtcaccccacactgggcggtcctgcctcttgtttgacctgtttgcagggtctctgtgcttgactgggccccccaggatgcagctcgcccagggtagccttcaaaggaaggcccccagaggaaatgcctctttgggttcccccagcccccgcttaggggctggaggagagcaaagatggaagtggggtgagtggagcgccatgatcagggcgggcctgaggggaggtggggctgaaggaggggcggggctgaaggaggggcggggctggaggggcggggctgaaggaggggcgggactggaggggcggggctgaaggacggtggggatgagggggcggggctgagagctagtctgcggcaggtgggaggggctgggctgcccagctgcaggacaggtgctttctgcagacatggggggctggttgctcagggcaggagacccatggctgccctggacacccatttccttggcgctggctgggcagggaggcaccgtgggtccaccccacagccacagcaggaggctgagtcctgccggcctggcttcctcgggcaagccacagcctctctgtccatttccttgcctcttcaaaggggatggagatgaggccgtgcgcagcaggggggtccagcactctccgccatcactcgaaatggtggctattattatcctcctctatccctgcacccccaagcagtgtggggagtctctggagctcccaccggcccacagctccaccaaggccaactgcaggctcctctccaggctaagacaccgctagacaggggcagcctcgtccttcctaggtgcctggcttcccaccccattcccctttgaggccctgcacctcggccacaggccatttctactccgcagacccacttcgaggctcggaggccccgtgggctaccagcccacggctgcgaaccacacaggaagaggcctggccgcatcccctcgtccccaagaccacttgctgaccctgctccccgctccagccgcaagacggccccgtccagacacacggaggtgaataagtcatcaaaccacttggaaaaataaaatcgcacagagcttcacagtagacaccagtgtcctggtgcaatggccctgaggcaaccccgggggctcagcagcgccagaaaggggaccgtctctgtctcaaggcagaatagagaagtggcaggaagggctaatgtcacggaggaacctggtgccccaggcctattctcagcaccgtctacccgctgccccatgaggcgggccctgtcactacgcccactttctagacggggaaactgaggcccagagagggtgagtgacttgttctgggtctcagagcccagaagcaccagggcatgtgcctgcagcccccaggagattaaacggtcccgatgccagccagcctggaccctgactcagccttgctgggacagcccaggcatccagccccacgctgggacacgcggccctgtgggtgtcacataggccgaagggacgctggctcgtactggaggctggggtgggtggcccgtcaccatacagggtctggggtagcacctggggtggccggctctgaggcatgagcggaaggaccatctttcaaaccccaaggggttttctttccagagctcgaagtgcccatgaaagagaaacgaggcctccagcatccctgaactctacatcagctgcaaggggaccccggtccccgaggacacccacatgtattttcaaacagctcccgaggcccagcgctgcccgtgcagaagaaagcatggaatttggggagggctcccgaggcctggccgcccagcacaagggggtccctggggcacctgctgtccccaccctggctatcctcctgtggcctacacaagtatcctaacccctccctggctcagaacagcactgaggtcctcctgctggggtgggtggggtcagtctgggtcccagtcccttccctatggccctggctcagaggcaggtgggcagcgggtgcggaatctgacgagaagggctctgacgcccggaggggaggaatctcatacagaggaccaactctgtcctcacggattcttccgcggccctgagatcctgcgcttctctatcttacgagtggggaaacagaggcacagagaggctgaggagggggagagccaggtgtggatccaggtgacctggcccagctaccccttccccactggccacagagggcacctgcagcctgggaaccccgaggggaggcacctgccctcctggcctccctctgtggcttgggcctctgccaagtgtccttctcactccccctgcccatgactgacggtggcatcttctaattgtcccctcaccccagagcaggggctttgcctgtccttcccaccctcgatggctcaggcactggctctggacacagtgcgcccctctctgggcatgcctgagtctgccctgatgttgggtttccctctatgcggttttccccaaagggtctgggcatgcaggaactggtcagatgtctaaaggaagaggacagggagagagtgccagttcctcccccagccctggctgcagcctcatctgcctcccaagctcccactcatcaagaaagttcccagacctgccagacgtggtgactcacacctgtcatcccagcactttgggaggccaaggtaggcaaaccacttgaggtcaggagttcaggatcagcctggccaacatggtgaaaccccgtctctactaaaaatgcaaaaattagccgagcgtagtggtgcgtgcctataatcccagctacttaggaggctgaggccggagaattacttcagcctggaaggcagaggttgccatgagccgaattcgtgccaccgcactccagcctggacaacggagcgagactctgtttcaaaaaaaaaaaaaaggaaaagaaaaagaaaattcccagaccctggaggccgctccccggggcccatgggagaggccgtttctttcccagacggcacatccagttcccagcaaaatgtcactaacgggccgggagaggaagccgctttgcaggttgggcagagccagtgggaaagagcctgcaatgtgccggggccgctcatccatcacttccccgtccgtgggggcacccagcccgccctgcccagctgggaaacagccacagcccagggctcccagcctgggagttccagaactctccatggaaggaggacccatggacaccagtgcaagagctcatctttccggccttccccgcctcgtaccctcgccagctctggagtaacaagccctgcttccgctgtaaccttctttgacccctcacaaaagccttggggcataggacgctgggcaggtaacgcaggtgacctgtcttgaggcctttgcacaggcaacatagccacggtgatgacgtcctactgcgtgccaggcctgacctgagcattttgtgcagaacacctcatttcgtgcccccgaaagtctagaggctgtcaggtggggaaactgaggcacgggccctgggcacctggctctggatccgatcctctccgtgggtttggaatatgctcccggggagcggggggcaccggctctgcccttcctggagctgaccacaggccccaggcaggggaggaggagggcatggcctgcaaccaacccgagggctccaggcctctcctgttactccagccgaaccctcatcccaggatgccccaaagtccagcctcagaggcccagcaaggcctcttgcaaagccttttctggggctgtggtgcaggcagggctcggagatgctcaggacaggtccaggacgggctctggacccagaacagtgctgtgcctcagttggcccctccataaaagtgcagaattaaggggatgagctcaggctccgggccctgcaacctgggtgggcagcctcagtgtccacatctgtgcaatgggggtgagggttgacatgaatgcacgcgtggcagtcactggcaaatcccaggcaaccccagcggcggctgggacggaggacaccactacatcccgggtgaccccgacggcagctgggacggaggacgccactgcaacccgggtgaccatgacggcagctgggacagaagacgccactgcaacccgggtgaccatcacggcggctgggacggaggacgccactgctttaaacagctgtttattttccttcagaatcacacggtcccacagcttcctctgggaaaggcacagatgtgcaaagaggagaccccgagagtcatccgtccacggccgccctcccgcctcctcacagccccggagatggacgaccccgcacccacgctgcccctgagaggtgaggtcatctgaggtcactggccacggccgtgcagtgagtgaggggctgagccaggaatggagccccagcctctgaactccagcctctacttggccgggcagccgtccagtgcagtaaacccaggccaaggtaaacccgtacacttggatttctggggaaccagagggacgagccaccctccaacacatttcccaagagctgtccacggcggctcccacggcggctccccagctgcttggccagtgccacagtggcccggctgttcctcgcttggtgcctggctgtcccctctggcctcaccagctgtcccctctggcctaaccacacgcactaccccacacccgcctgtgctgtgcctcggtcactcgccgcacttgccccagggcctttgcatggcggtgtttctgcagggaatgcacttccaccaggtccccgcaagtctgcctctcatcctcacacctttgctgcaggctgcctccttcccggtgatgctgcagcccgcgcggcccttcaccctggctcccctcctgtcaccggctctccctgtagctctgctggtgagcccacccgcctgtcctgctccttctcttctcttgtggatgctccccgtgagctccaggagggctgggcttcctctacagcctacaacagtgccggccacactgcaggcattcagcaaacacttgctgcgtggtgactgagaaaacctggaaaggcacagcccactgaggaccggacactcccagcctcagtgtcctccggagccaccgtcatctgaaggcgtggggacaggcagtgccctcccacctcaggaagagctgtggggtgagctgcggatggcgtgagcagtgcagggcggccctcgcagcggggtctctgtgccactctctggtgcccctgaggggcatgtgaaacagaggagaacctggtgctgactccgggaagggccctgagaaggtctttgaccagcatcagacctggggctcccaggccaagatagaggcaaagtgaagggacgtggggccccttcttggcaggctctaggacagtgggtgtccccccaaatcccctcgtatccagatgaccaggaggcggctccctcccctgcccccagcccccagcctccagggctgtgccaagtgtggggatctggggtgggcagaggcggcctgagagcctcaggcgctgccctgcggccgcctccacatctggcttgtatccagccttcctgcctggcgaataagcagccatataaacacggggagcagtgccttctctgccatcggtctaggcagaccctcccgcccccacagggacaaggagccaagtcctatttctctcccaggcccttccaggtcctcatgggcctgacccagggcggacccttcctctggccccactcactcactcctgctgcccttcccgccgtggacaggaacaagggaccctgaccccaaggcctgtgggtgatgacgatggacggcacggggttgccatggcaacagagcggggccaggtggcaggaaacccagttcgcctcccgcgccgctgtgtgaactgactgtgaactcggggtgggggccgtccccaaatgtgtatgagtctctggctccccttgggtaagatgcagtgcctctttgggtggggtcacagcaaacaaaaaggctttcgtaaactcaaaagccctctgtggccctgccacggggacgtcatctctggcgatctgaaggacaggggcagggagggaacgggaacctcaggcgccctctccctgcaggaacggagttggcttttccgtctcctaatctggcctcagttttctcatctgtaaaatgggaatggggatggaattcccgcagaatcacggagggacgaagtacatgagctcacgaaaagcgtctagaacagagcgcctggccgctcgccctggccacccagctgtcatgcttcgggctatctgtccggccacaacggccgcgtggagctggtgcaggtggggcttgtctttggcactgtgcccagagctggcccataggtgacactgagcatcagtgttggggaaggggacccatcggagagcctctggggcacagtgaagaccccccctcctgcctcgcagctgtgtgggggaagctctgttgcccagagttggctggcagggcccagactgcccaccggctgccatcaccaacacgaacaggtacccagggcatgccttcagccggcctgggtgcagaggtcccgtctgtcacagaagtgctgctgaaccgtagcagacgaaaatctcacaaactccctccgggccccggcccagggcttcccgttggaaggtgcacaggccggcctctgcctgcaggctgggcccacccgcgcctccccaacccactacgtggctccaggcggacctggccttgcctcttcctttcccaaggagagaagaaagcctccctcatgggtttttgaggaccaagaaggctctctggatagctgcaccctgcaagtgaacccagggctcgccaaagaaatgcggaagatgggacaaagtgtgctgtgcgtcctggggccagatggggacagatgggctgggggtctctccgtcagtcttggccagccacgccagctgtgcttctgtccctcccgttggcctcagggccttggctcctactggaatacttccctcgatctctgcatagccgtctcctcatcattcaggtcttggcgcaaatgtccctcctcagagaagccttccctgaccgcccatgtccctgcccccacgctctctgccccatcacccatttttcttctccagccactcgtcaatgtctgaagcctccgtctgtgttggtcctcgtgtttacgcccgtctcccccagggcagggccctgaacagcacctggcacacggcagggccccgtaaaggtttgctgactggcgcataaggacaaagccccctatctgcctcccctggcagccctgtcctctgcaggttcaacggggcggctcgctgctgcaggacagagcctgggctgggcttgaatcgaggcctgtcccctctgccgtgtgagcccagcaggcagctcccctcatccattaagtgggaggaacacacctcccgggggtgcgtctgaggaataaggagctaattgagtctgtcctgcagcaggaggccagggaatgccggtcatggctattcagggccctctcccccaaggcgcgtttcctgctaatggcctcgatttcccaccctgccaaagcccctgccctttcgatgggattgcagctcttccagtgcagaggcggggtccacttccctgccccctggatctgggctggccgggggacttgctttggctgggggcaggatgtggcacaagggatgtcagatgaccctgagcctggacgtcagcggcgggcagccccactagccctctgtggagcccccacgtgaacacgcccaagatgagacacacgcaggacagggttggcccggccacttggtggagctggactgaccgtggctgaccacggaccagccagcaaacccagccacgcccagaagaaccacccccctgagcttgccaaaactgccaacctaaagaactgtgagccaaagaagggtggttgctttgagccactgtttgagggtagcttgttacatggcgatagctgactgatacactttggtacttagaatctcaacatatcagagctgcaagggacctgagagacaatcaaatttcacagctggtgagagggaggctgggaagctggagaagagaagtgacccatcttgtctctagccgaaccaggcctcagatgccaatgctgcacttgccctccgctactccacacctcattcctccgtgggggggtctcagccgggaccagcaattccaccttcaggaatgcattctcaggacatgtgcacaaacagtgatctacaaggatgtttgtcacagcatcgtttatgagaatgacaaacggaataaatacgatgactcctcagagagggctgggtagataaattatctactcgacacaaaactaaggaacctgaaaatcacaccgtggccaccttcattttggaaagctgtttgttggtatctgctgactggaacagtcacagctgctggaatagccggctcactcctgggcacagaacctgcagaagagccaacccacagacacaggtgcctccagagcaacaagccacagctgcaccggccacttcctcagcaagcgtgcaccgaggtagagggacacgaggctgcagcacggccatacaatggaatacaatacagcaaggaaaaaggacaggcccaccaagtacaacactgcacacggtctcacaaatgtacagcactgcaagcggtctctcacaaacgcggtggccaggccccgcagagcatgggatgcgagagtccgtttctagaaaattcagaatcaggcagcaacactctgtgatgctagaggtcaggaatggtggccaccctgacagcgcagtgaccagagggggatcggaggccttggggacaggtcggaaaacgtttgtcaggcccatagccgtgtgcacgtgatgctttgtggtgcacacttctgtgtgcagtgctgcgagcatacatttaattgcaaaaatgatgtcacgggacgctctctattgacatcccctatgagtgaacatcaacaaggcgacaaagcatgaggttctattttggaaataaaaacacgcacagaaagacgactagaccaaaaatgtgatcgtggttgccgggcaggacgctgtcgcagccatcacagtcttgccatgtttttaaagcgaccagggtgagtctgggcctgtcctctggcttaagcccagagcccctagccatcaaaggtgccatcaaaggtgccctgaccctctgccctgcaccctgtggacagtgcccagggcctggtcttctacagcaccctgccggttgagcaaagcctggaaaggctgggggagagtggtgagctcagaggctggagtgaaaaatcttccctgctccccaaagggccgcaaatgggacccagatgtctggggcctgcttgccccgtggccgcacacaaaggaagcacattccttgcccagctgctagagctgcgctgccaacagcaactccctgagcgccctgggggaggtggccccacaatctgggccgcccgctgccggggcggggtgggggtgggggtgtggctgccagccgggggcaggggtggagggaggaaggggcgctgtccttacccagcactggccctggcaccctgggagtcctgggggtagcgggtcccttctcttgtctccatgcccccaagccaccaagggaggcagccgaattgcagacaagcaagcttccgttgaggatccgtgtgctgggggtgccgccaggtggtggcgtgggtgtggggtggggaggaggcgtgggtgtggggtggggaggagatggggctggggggcctatgggtgggtcgcggggtggggaaactggtgggtggtggcctcctgctctgggtctgcctatctgagtgaattctccagtctgatctcaactcagaggagggacagctccttcaggagctccacaagcagcatggaggggggagcgtggaggggggagcgtggacgggggcagcgtggaggagtggaacgtggaggaggggagagtggagggggcagcatggacgggggcagcatggacggggagagcgtggacggggggagtgtggagggggagcgtggagggggagcgtggacagggggagagtggacgggggagcgtggacggggggagcgtggaggggggagcgtagaggggagcgtggaggggggagtgtggaggaggagcgtggagggggagcgtggacgggggagtgtggagggggagcgtcgacgggggagcgtggacggggggagcgtggagggggagcgtggaagggggagcgtggggggggagtgttaagggggaagtgcagagaacgagcagacacgtgggctagacacagggtgggcgggcgccctggtgggctgtgtggctggtcacctcagtcagaatctcgccctctctgggccactccctgccaccttcccctctcaggagcgtcacggtgccctctatccattaggcatgtgtgcgtgtgagtgtgcatgcatgagtgtacgtgggtgcatgggtctgtattcatgtgtgtccatgggtgcctgtgtgcatgggtgtgtgtccgtgtgtatatgtgtgcactcgtgtacacatgggtgtatgtgtgcatgtgtattcatgcatgtgtgtattcatgtgtgtgcatgggtgtgtgtccgtgtatgtgtgcactcacgtgtacatgtgggtgtgtgtgcatgtgtattcatgcgtgtattcatgtgtgcgcatgggtgtgtgtccgtgtacatgcacttacatatacatgtgggtgtgtgtattcatgtgtgtattcatgcgtgtgcatggctgtgtctgtgtatatgcacttacatatacatgtgggtgtatgcgtgtgtattcatgcgtgtattcatgtgtgtgcatgggtgtgtgtccgtgtatatgcacttacacatacatgggggtgtatgtattcatatgcgtattcatgcgtgtgcatggctgtgtccgtgtgtgtgtgcactcacgtgcacatgtgggtgtatgtgtgcgtgtgtattcctgtgtgtattcgtggggtgggtgttgcgtgtgcatgttgtctggtaagggctgtgtgacctcagggatggctgcagaacactccggcctgagtgaaaggtggtctgatctgcagacagagcttctctggaaggaagaagggcggcccctggggagaggtgggtgggctgggtggggaagggggatggggggctcctttgccttccctccttgcctcccagccctttattgtatgccacatccttgttttatttttaaaaatgcctcttggccactggcacaggcccctccttgctacagcccctgggggtgaaggcgagactgctaggtggagtggccaacagagaggaggtcaggctggctgtcatattggttactagacaggcgtggaggggccaacagaggggagggcagggtctcgaacgttgtatcagttactagacgggcgcagaagcacggattcttttagaaaaagagggctgcttaggaggctgaggcaggagattcgcttgaaccagggaggtgggggttgtagtgggctgagatcccaccactgcactccagcctaggtgacaccgtgactctgtctcaaaaaaaaaaaaaaggaaaaaaagaaaaaagaaaaaggaaaaaagagaagaactggtggaatctgagatcatcggctgtcggctgaccccaggcccgggctgcaggagttagctggccctgccctctgcacagccacatgcctggacttaggtgtggagcagaaagtcccacagacaaccccagacacaagcggagcggagaaccttccaggaagaggctgcacctggttctgaaggctgcggaactggcaccgtgggagaaaggtgccaccgtgggaggggagggcctgccccggggagggcacagaggctgggatgctggggacaggcaggtcacacagccctgggaacgggaccctcccacgtgcagggcctgcagggaaggctcagctgtctgcggagggtctggaaacccctggaaacctgaggcctctgttaggattttccaccaatgaggcgccaggggaggctacaccggttcccaaagtgtcgtcgctgtttaaaaaaatgtgtgaattggctgcaaatcaccttgaactctgcagagggcggctgccaagtttaaagtcagccactgccggtgtggacgctaaggaataattagggtctggcggctcatggtgcccctgcgtcaagtcaagaatgttttccctgaagtgccagaatgttcccccagcaacccccagcagtgtcataagtgtgacatgtgatgtgcgcacgtatgacacacacatgcagacgagagtgtgcgtgaagacgagagtgtgggtgtggacgacagagtgggtgcggaggagagcgtgggtgcggacgagagtgtggggtcacaatcccctctgtccctccggggtgcgtggagggaccccaggagacggtgcaggcgaaacccacaaatcctagcagcccagacaggactttagaggtggcctccctggagtggaggagtggacagcctgggctggctttgccctggggcttcccgccacgtcctgtgagctggcatggccaggctgtgcaggaagtggcccccatggagagacagcgtggcctccctggtgctgactgcaggaagcccctgggaccccaggaccctgggccggggatgcctgtggcttttctttctcacccccacccaaatgcaaacacgcgcacaaatggccttttgcttctcagttttttgacactgaggcaccaagctgggccctccctgatccctgcaggccgggggtgaagggaggcctgggagaagaccccaccatggcctgggccctgtcctcttgccctggcatcagaaggggccctgatccccctgccttcgcagtgtgggctgtggctgcccctgggaccagctgcatcacaacgaggtcccagcccacagccgtggggaggccttcgccactctcacctcctggacagggtggggctcccgcccctccagagcccacacggttactggcacaggccctgagctccaagcgtgcggcccaccaacctcctcaaaatttgtggctgttgctggttttatgttgtgagccccacacaggaggctgggtggcctccaatgcctccaggagggagggctgagcagagctatgcccaggccagagcccccagcccagaacattctgtcttcttgccctaagaacttttgaaatgtcccagaagttccatggcaggtcacccacatggcccagcccggcctcccacggcagggggtgccgagaaccttggagccacacggcctccagggttggtgctgagagaggtcggagctgcaggctcgccgggttatcagtgtaaaaaagtagaggttccccttcaaagatactttcctccccgtctaattaggaataaacagtaacttctcttagaagcaaaatttattcaaagacctgtgctgacattcttaaatatctgctagccttaataaagaaatcaatgtactttatgttcttagctcccacaatttagcctaagtatctgccctggcatgtttatactggtcgaagcaagcattaggtcacggcctgttcctcttccttatttgaaggtgtttttacctttctcagcattccacaaattacttcctccttcctttgttctcctctgcctttgcctcttttaaaaagttctaagttgcgagccaatcgggacaaatacagaatgtgaggtcccgttccagccaatggaaaccggacacagcagtaggtataaaaaaaccggacacagcgtcaggttataaatgaccctggtctccttcattcggtgtactctcgtggcaaaactgctggcgagtgtaccctttctgcagaaagtaaatatggccttgctgagagaattaaatttacgttcaagtgctatttctttgcagcaccagggaacaagcactctatttctaaataaacattcctaacatcagcgtggcctcaggcgctgtccctaccgcccggtattcactcagccttacgggtaagaagctcagtgcccatggccatgatcacaagggcaaaacccactcctcgaattctccaaactgcacgcatggtgcagggcaagcgcgggtgttccctcccacccagagcagcctctccgcggagtccccgggcgggaccccagttacttctgagcacgtgcagtctggtgcatgtttactctaaaaagaaagacaaggatggtgcctacaagaggaactgttggaaagtcagtgtcgctccacgtaatccgtggacactgtttcaatgcaggtctggaggccgcatcagaccccgccccacactgcaactcctgggcctcggttccttcatctgcacaaaggggccaatgatagcgtctccctggagagttaccttgggaagcagcatgagaattgatgagaattaaagcgatttacaagtgcaggcatacagcaagtgctcaattagtgccagtctgtaaaccagcagcttcccgagcactctgctcaaggattcaacccgctccctggggtgggcgttcctgcctccctccttccccagatagtgaaagggtcaggcggtgtgcgcccgaggcctgccgtcctcccacaccagggactcgcaagtcagctgaccagtgaagcttgtgcaacggtggaatgttctaggcccatgcactgacagtcgctggagccccaactggctgccaagtacttgaaaggaagccctatgaggggagaactgaattttacattttatcttctttttttgagatggagtctcgctctgtcacccaggctgaagtgcagaggcatgatctcgcctcactgcaacctctgcctctcaggttcaagtgattcttgtgcctcagcctcccgagtagctgaggttacaggtgcccaccaccatacccggccaattttttttttttttttttttaaatagagactgggtttcaccatgttggccaggctggtctcgaactcctgacctcaagtgatccgcccacctcggcttctcaaagtgctgggattacaggcggaagccaccacccctggccaggaatatttcatcttaattaattcaaactccaacggccacaggtggtgcatggtgacggagtggcaggaggccccaccacgcaatgccaaaggcaccaaaagtgcaggtggacaagggcggcctctgcctccccgtggggcagccacacctgcctgctcctggattctgccaggaggactgggtccccagcccctccctgccctgcctgcttgccagccccagctgggtggtcttcctccagccaggcccacctgaggctgcctcccgccctcctggaggccaagcccctcgccagggggctacattaaacagcagggccaaactcactggggaggcatcttggagagcagcgggacgggtgtctccacaacctggaacaacacatcctttctctgagtttaaagaaaacaggctgctctggaggcaaaccttttaaacagatgtttcctcttggcggaacctccctgctccgcccccaccctgggccttcccccaggcaaggcctgcccggctctcacagggcggaggcctggggcaagggagaccaagtgatttcaattctttctaggaaaggggaggaaaatatttttaaaaatgtgttttacaagcctgcctctgccattgttgatgtaaacaggtaaattgtttcctgcctcaattaaaaacatctgccacataaatgaataccaattaactcatcctgtttttaattactctgttaattacacgcaggcagcagaaaggatgggcggggggagcagggaagccgagccgatcctccgtgccacgccgccccaccccagcttggcaggatcggaaatgtgtctggctggtgacggatggggtggcagggaggtggtggcacgtggccagccgggatttcccgatccagggcggcgagtgggcccctcttcccgggatctccctgggtggggtccagcccctgcccctctcctgccctccctctctgtctgcagccccctgctcacttcttgggccacattttgctgggggagggagggggggcggttggggggaggcctggattttgtccaggaagttctgccttaaggctggggtggtaggaggataagagtcaccctaaacaggacccctgggaattaggatcctgtcagctgccatttcctgagccgtacatccgcggtgccgggggacttgcggctgcagctccctcatttgaagttgcttcctcggcggcacctgggacgccccccatatgcgccatagccttcgtggtaatgacacagtttctcgttcgcttgcttcattaaatgtctacctggggaatggggacgcctcaccccgtctcacccagacctctctgcgcggcgcattttgactcccagttcacacgtgtcaaagctgaggcccacacaagcaactgcctgtccagggttaaatcactgggacaggccagggtgagccgtgagcccagggctctgatttcagggctggtgtcgatgccaccaaacgtgtcgtggccaggacatcccgggagctgggttcaatggctgaggctggcctgcgccacactttgggtgggggtacttccggtctaagggcatctgagggtcttcacccaagagggtaccccatgcctccctggaaaacagcccccacagaaactgttctcaccctaggtttctgcagtctaaggatgcggagatggccagacctggctgggctctcagagccggtctagccagagtaaaagtcctgtccagcagcagggcctaggatcctccccgggaagactgctgctgccttagcaggattgagggggccgagggcttcggtgcactcaccatgtctgccccgggcaccagcgtgggcgcagtgggaaggggctgtatgggcctggagcattagatcctgtctgccctttgcagcacagaggaggcaggacctgagtcccagggcctggccatgctgatgcccggggcagacattctgcaagcagtctgcctctcctatcccacgccagggctatgcttgaggccttcccgagggcggggtcaagaatgcaccaatgcccgggacagcagccaacccacgcctgttcctgggcaaatcccgcctacaggccgggtcccagcttgcagccgtcggagggtggtggacggccccttcctggaatcccatcccgacctcggagacggtgacaccactgttcccgtggcacaggctttgcccctgcgtggtttcacatggccaacaaaatactaactcatttaacctcggcagcacccccacccaggaggctgttctgttatataatcacgatgaaaacataaacctctcactcttcccaccgtacagatggggcagcaaaggcccagagaggaaggaactgctcaaggtgcacagcggacggacagagctgggacccgaccagctctacacggctctttacaggcccccagcgccctcacctagcgcaccccagctgcctgctcccaccaggtccctccaaataccccacgtctccccaattcgccaaatgtggagggagagacgcgggggagtttgtgatgtgctgagatggcacagcaggttggcgagctgggagcacagctttggggtttgaagtcagcgtccactggtgtgggcgagtcccctggccttgctgggcctcagcgttctccctgtgaaacgggggggacccgcaccccctcctcatcgcacagaggaggtgaggattcggcgcttctgcccactgccccctgcctgcctccttttccaggcaggccaccaggctgagctgctagttgccttgaggtttcctgagctgccagggacttgcacagagacctcaagctgagtgggggcctctcagacctttggccacccatgttacccgccacatccactgccaccagaagggctgtttgtttggggcctttgagacaatttcagcaacaaatgcacttcctgctgtgtgagctggggagcaactgagccgtgagggggcagctggggagcagctgggttgtgaaggggctgcaggctctgcacagcccagtcctggcgcgcagcacagctcggggagggaggccaagctgcgcatcctccgcaacccggctcacacatgtcgctcctgctgtcagggtgggaaggctccgacatggaggtcggctttggaactcgggctctgggctcctgggctggacaccggcaccgtctaggttggggaggctctgggaaagaccagaatgccgaacccacccccgaggaccgtcctctctcaaaggtggggccgggggaggagcccagtcaaaggtgagaggccaggctcactggccaggactttggagcatagatcaccacagtgcaaggaccacgaagaccctgggatctcatgctgagggtgcacagcccggcaagggtgcacagcgacccagccatggttacagcaaagaccgcgggtggaggtgggggcgtggtcaggcaaggtcacagcaacccagccagggctaaagcaaggagccagggtgggagggccgcgcctgctgggctaaagcaaggacccctgcggtggggcggggcaggtggtggtcatgtctaccctggaggggctacacctgctgggctgagtcccagtgagcctgagtgaagatctgccctctctgggccccgccttccttgctattccctgggagctgcaacggctgtgctgacgtggggcacactgcgtgccttcaggaccgctccagtcgccctgcacaagctccgccctggccctgcctccctggggccgccgaccacaaggaggctagactctgctgagacaaaaggagagggacccggggtccaggaaggtggggaacgaggctctcgggggcgatggctgggatggccttggagacgggtccagcaatgggcagacacaggccagggggagaagagcgggcggagggcccagtggtggctgcgggggccaccagggcagctctcggtgctgtgtcgtggggcctcgaagcagctggaagcagggagtggcccctgcaaggcagcacaggacaagccttgtggctcccagaggcagagccccatggccgggagcatgaggtcactctcgtcagacagcctctgctgcccagatgcagatggtctcacccattgccccagctggccggacgcggcggggacagccaggcactgggggccaagcaggtgcaggaaaccacctgttgaatttagacccaatcaggggctgtgaaggcgagtcctgcccacagcttcgggctgatggaggccgctgccaccgcctcccacctcactgagtgctctctccaccaaggccacagagccacactccccgccaccacgtgtgggtgcagacagtgaaaactgagggacggccctgaagaaattacaagccaccggtcaccgtggccaagcccagggcttgctgtgtctgcgaggggtctcagctctgcaccagcccaagggggaagcagtggagagagagggacccgcccggaatcacacagcaacggcctcgtcctggacaccgagctcgctgaccctggggcagcaggccatgtccgcagtgggcagagggccgggttccagccctgcccggattggtcctctcccagcccccggccttgggaaggtgccaggcaggcagatgggccgggcttgggcacggtgcagccgcagccgtggtggcagctgctcgggggagacccacaaggggcctgctctgctgctccctcctgagcggtgccttccgggtaccctgactcatccaccaggcgctctcatgcagcctccaggagatctgcagggggccagggggtggtgctgctgagtcaaaacagcccccagggaatattctgcaggggagggaggcccttcctgtgccaggcagccagagacctgctccgagtgccctgcgctgctctcatcccagcagaaggacgactctgagggtggcaggcgggacaggcagtcactttgcagtggcagacacaggctcagagaggctccaggcctgcctgaggccacctggatgactctgaatgctgcttctccctccagggcaccagggtaaccggaggcttctagtttcttcaggggccgtccctcagccttcactgtctgcccgactgcccgccgggagcccctgcgtgtgtggagatggcaatgtgctttcccgggggctcagagctgctcctgctccccggcgacgggcttttccaggctgcggcatagggagccccggtaccaaggacatgggtggcactgcggagtcggtgccatcctctctacgccagacgccatgtgaacgtttttacgatgatttttaaaagagaggctgagaaggaccaggaccagaaagacacggctgtcctgtctcccacaggctgcagcctcgaactggcaccatctcttctgccccctggaaggtcagctccgtgagacgggggaggcccccgtgaattgtgcagggagcacttggtgggcgctgggcggtctcacgttccccacctgtgaaagggggttaatcccactgtgatggggccagtgagcgaattcccaggagggcagagcagagccgcagccgggggtacaactggcttctggggccgggctgccgcctccaagagcctaaccttgttcccagaggcgaggagtgaatctgggttccgtgcagggagttccagcacctaaaaggtgtgacaaattcctcctccaatgtccagctggacaaacctcctcaatccaccactgaaggccccccaagcgctccgagggacctggcgtgctatgggctggggggcgtctgtcccagcctcgtctccaaaatgtcggtgtctgctcagccctgtgctgtggttttcaggggtcgaggctgagcgacctctctttctatctctcctgctcggggccagtcaccaggccggagtctcagggctgtgacacagaggtttgtcatgcgtcacaccaggtggccctgggtcagccaacgagctttgtgtcaggacagcgtgggtgagcgctgcccccactgcatggctgcagggaggcccgagggcaggatcttcccaagggacaagctggccatggtcccgtgcgtgccagggtggggcctgctgagcctcagtttcctcggctgtaagacgggacggaggtgttcacagtgggggttgctgggaattcctcctctggattgggctggtgcctcggtgcaccgtgggctcccaggagctcacaaggccttccgtgcctgtcccttgtgccccacctcacagcgaggtccttgcagcagcagggcagccccgtccggcccccgctgcctccctgccctcatctcctttctctgagacaaggctcctcactggtcctggaggtggcggcacactcctgcctcgggcctggcacgcgtggtccttccctcctcccgcagctaagttccacgtccctttaccagagaagccagtgtcaacccccacggcccttggtggggcaacatcatcgctgctcccttccttcactctgtctctgccagacggagcagcagccccgggcgtacagcaggcaccaatcactatttgtcgagggaatgaacgggcaccgcctaacgagttgggtcagatggaggcgtggctcagagatgtcagcgtcaaggccaggtcgacgtgacaagccgggtcccgccctgccctcgggtgcatggacttccccaggcagcactgatgcccccgctgaggtgaggccgctgggccccatctgtggggagaggcagctggaaactgggggccccagatcctcctcgagccagatcctgaccccagacccagcctgttttctgggtgtctgaatcctgccggggtggaggaggggctggggaagaggtgggtccacctgttctcctccagggacctccctgcaacccttcatgaggtcagagctgggcatccagggagacagcgaccctggccatgggggccacgccacccaggtaccagcctggcatgcagcctgcaggtgataatctccgggctgctctggggctaggctgcagctgtaggggggttcagctgtcacagagggagccggggaagccagcactgcctgggatgatcccccttccgcctcctcctccccaggccccggaggcccagctggccgtccgcccgtgcggacacccgggagccaacactgacccgaagacaggtcagccagacttcccacctgctccctcaggaggtgggatccggtcccctcctgctgggctgcacgggccacgatggaaaggcgcctcgtgacacgctgcggtcagctcagaaaagccgcagatgctgacacgggcaaccctgcccagtgtggggcgtcctctgaagtgggagccgcagggagggcctcacggaggcctctgtccacaggcagcggctcccggcacccaccgctgctgaccgagcccctggcacccccaagccgagcctttgaaccccagcagggaaggccacctggccgagaccctggccaccacggggccatcactgtcccacggggctctgttccgactccttggcccgagggtctctgagcaccaccagggttgcctcacgcctctgagtttggggtggtttgttcggcagcactggggcccggggcagcttcttgcccggcgtgtggcacagctgtccttgttgggggcgtttctgggatcctgtggtttcggggacgctcccctactccctggccttgggggccgatgaccaggtggagcgggcccggtctgtgagggagtcacaacgccaggtcactccaagctgcctctgtggccacacgtccagctgcccccacacaggcgagacccatgatcaagccccagggctggaaagcagacacaggggatgtatttgtttgtggaatcaaatacgacggcagcttgcaggcagcccagccgctgtgcaaacaaccctcttccagcacccagtgagggcgtccctgaagcagccggcgaccccgggcgctgtcacccgccaggtggggtatggggaccgtccctcaggcaagacagggtgcctgtgtactgagcgcctcgtgtgtcaggtgcaggtgcagacaggcaaaagtcctgccccacggagctgacctcggacgggagcccaggaacactgtgcaaacgtacgagaccgaggctgggaggtgtggtggttgggagaggcacgggtgggtgactggatggccactgaaaaggtgccatctgagcaaggcctgaaggagggcagctgggagccacgcaggcgtcggggggagcattccaggcactggggccagcagcgcaaaggccctgaactgcagccaggcacggtgggccagcagcaaggcggagcagagtgggtggtggaagggaggggagtttgtgtggtcttggaggccccacgaggacctcggctccgttcctggagagctgtgactggcctttaatgggttccatctggctgccgagtgcaaaatagacctgggatgggggtcaggggtagaagcaaagaaaccaggtacagaatctggcacaagtcacgcggtcagagagcaggtgctggagagatcccataactgtttgtggaatcaaacaggacagcagcttgcaggcagtctggctgccgctgtgcaaacaacccagggcgcccctgaaccagcccgtgacctcaggcaaacggcatccatcaccggggccggcacaccatcgcctgtgagaggcgtggtgagggctgctcccacgggcctgcgggaggacccggtgacagcaaggccaagccccctgcccaccaggacagtggcttttcttgataatttatcccttgaaaccccgtggacaattaaacccagagttaccaggtgagccagggattctactcctaggaatccaaccaagagaaatgaagacattcatccacacaaaagctaccgatacccacagctgcatggtccacgcaaaagctaccaatacccacatctgcatcacccacgcaaaagtcaccaatacccacatctgcatcatccacgcaaaaactaccaatacccacagctgcgtggtccacgcaaaaactaccaatacccacagctgcgtggtccacgcaaaaactaccaatacccacagctgcgtggtccacgcaaaagctaccaatacccacagctgcatggtccacgcaaaagctaccaatacccacagctgcatggtccacacaaaagctaccaatacccacagctgcatcatccacgcaaaagctacccatgcccacagctgcatcatccacgcaaaagtcaccaatacccacagctgcatcgtccacgcaaaagctaccaatacccacagctgcatggtccacgtaaaagctaccaatacccagagccgcatggtccacgcaaaagctaccaatacccacagctgcatcatccacgcaaaagtcaccaatacccacagctgcatcgtccacgcaaaagctaccaatacccacagctgcatggtccacgtaaaagctaccaatacccagagctgcatggtccacgtaaaagctaccaatacccacagctgcatggtccacgcaaaagctaccaatacccacagctgcatcatccacgcaaaagtcaccaatacccacagctgcatcgtccacgcaaaagctacccatgcccacagctgcgtggtccacgcaaaagctaccaatacccacagctgcatggtccacgcaaaagctaccaatacccacagctgcatcgtccacgcaaaagctacccatgcccacagctgcatcgtccacgcaaaagctacccatgcccacagctgcatggtccaccataacaacaatgggggcaacaacccacgcgtccatcaacggacacacaaaacgtggtctttctgcacagtgcagtgcagctcagccacagggaaggaggctccccactaggctccagtgcggggagccacgaaggccccgagctgacaaagccagacacaagggccacacgtggccccgtcaccttcatccgcggtgtccagaacaggcaagttcacagagatgcaggagcgggggcagactgagggctgggggtggaggagcgaggagatggggagggggcagactgggggctgggggtggaggagcgaggagatgggggagggggcagactgggggctgggggtggaggagcgaggagatgggggagggggcagactgggggctggggtggaggagtgaggagatggggaggggcagactgtgggctgggggtggaggagtgagtggcagtgggagtggggtttcctttccgggtgatgagcacgtgtgggagcgagctggcggggggcgtggcgttgcattgtgagtgcactaagtgctactgaagtgacactataactccacgatgcttaaaatgataaacgttatgtgtattttcccacaattaaaaaaacagcggggagactgagacaggcagctcatgacctattaacctgcccctgccagggacccatccacgttgctaacagcccaggagtgatgagtggagccaggctgcctcttccctgagtttgggcaccttaaatgtgagaggggctcagcctccctcccaggggccctgctcctgtcaactggggccaacttgcaggcaggtagcggaggcactgctgtgactccagccctggctctgtgagcctggctgtgctggaaaccaggagggtggaggccaggcccagaaggctgctggctggagtgagtgggagctgagcgaccttcttgctgcaaacaacccccttccagagacacaagcacacccttaagggtgggaagcgctcacaaggaccggtctgtggcaagtgacaagtgacctttccaacccgaaggtctcctcggcagaagccccttcatgtgccaaggacgagccagaggtggagaagggccgtgggccggccccgtggacgagccagaggtggagaagggccgtgggccggccccgtggatgagccagaggtggagaagggccgtgggccggccccgtggacgagccagaggtggagaagggccgtgggctggccccatggtgcagagtgagcaggtgctgggggcactggcctgcagctcaggcctctgcttgtccctctggtcaccccagtcctggggcagcatggtccctgggtctgggcaggtttggttggatgcaggtgctgtggtccccagtgagccctggtgtcacggctcacgctttataaaagctctcaaggggtcacagtgcagaggggatggggaggagggtttggggagggtaagcacttcgccggggcacttatcatttgtggaacattctctgaggctggctgtggggatcccctgtgagtctggacagccaggtcataggtcatgcttcctcctggcccggttttcacaccgtggtaccccacacgcatgcacacgtgtgcacaccatcacacactcagactttacacacatgcacctgcacgtgcgcccctggcaacggcacccgacgcagtgaccttggggctgctgtcgtcgggaagacagcctgccaggtggcccctcacacggcccctgcttccccctcacacggcccccgcttccccctcacacggcccccgcttccccctcacatggcccccgcttccccctcacacggcccccacttccccatcccggaaaacaggcagagcacacacttccaggaaagaggccgccctggcgctggactcaatgaccataaaacagcctcttaagctgggtgcagcggctcacgcctacaatcccagcactttgggaggctgaggtgggaggatcgtttgagcccaggagcttgagacagcctgggcgatgtagcaagaccccatctctaccaaaaaaattaaaaattaaaaaaacaattagctgggcatagtggtgaacacccatagtcccagctactctgtaggctgaagggggaggatcgcttgagcctaggaggttaaggcagcagtgagccatgatcgcaccactgcattccagcctgagcgatagagggagaccccgactataagtaaagggaaaaaagaggcagggcgcggtggttcacgcctgtcatcccagcactttgggaggctgaggcaggtggatcacctgaggtcaggagttcgagaccagcctggccaacatggcaaacccgtctctactaaaaatacaaaaaaaaaaaaaaaaaaaaaaaaaaaaaaagccgggtgcagtggtgtgtggctgtaatcccagctactcaggaggctgacgcaggagaatcacttgaacccgggaagcagaggttgctgtgagctgagattgcgccactgcactccagcctgggcgacagagtgagattgtgtctgggggaaaaaaagaaagaaagaaaagaaaaatggcctcttgggccaggtcctgggagctcgagggaggtgacggcatggagccaggacccggagacgtcacttctgatggaagtccgcacgcccagagacaggccaggccctcagtgtgcaagtcaccagccttctctcctttccagacaggctttgccctgtggccccggccctgcctggtgcacctcccgtttgcctcactggtcaactcctgggggctgttttgcgctcccccagtgcagggtcccagactgcacgcctcacagtgccacacgtctgcacgcctctgcacacgtcacgtgcctctatacgcctcacacgcctcacagtgccacacgtctgcacgcctctgcacacgtcacgtgcctctatacgcctcacacgcctcacagtgccacacgtctgcacgcctctgcacacgtcacgtgcctctatacgcctcacacgcctcacagtgccacacgtctgcacgcctctgcacacgtcacgtgcctctatacgcctcacacgcctcacagtgccacacgtctgcacgcctctgcacacgtcacgtgcctctatacgcctcacacgcctcacagtgccacacgtctgcacgcctctgcacacgtcacgtgcctctatacgcctcacacgcctcacagtgccacacgtctgcacgcctctgcacacgtcacgtgcctctatacgcctcacacgcctcacagtgccacacgtctgcacgcctctgcacacgtcacgtgcctctatacgcctcacacgcctcacagtgccacacgtctgcgtccccacagccatagtggccacttcatgccacgcgtatgtgacttggtgaaatccccgtccctctgctctgtgcagtacagcagccgcaagcacaagaccggcacgaggaggacagaggcgagaccccagtgagccaagctgcacgctgcccccgggagagctgaaaaaaaaatacctcagtcgcttaaaaatcagtgcatgtcgaaaataatgagttttggacacactgggttaagtaagattatatattataaacattaattttgcccggtctcttcttccctttttcaacgtggccacgagacagtctgaaatgatccacgccccttccctggcatgccgaagctcccttgggagaggccgcccctcggcacacggaggcaccggcgagaagggctgccccacgcccctcggcacacggaggcaccggcgagaagggctgccccatgcccctcggcacatggaggcacgggcgagaagggctgccccacagtggctgctcaggtcacaggaggggccgacttgggcccataggggaggctccatgcacgttcccgaacactctgctcccaggtcccctgttggatgctttgggcttctgggcatgaaaagtgctggaccctgaaggagcagctcggccgcagaggcacggtggggacacagcagccagcagggccacacagagagggtctcagccacacacctggccggcacggccggcaccatcggggggcgacaggcgaggctccatcttccctgtgcacagtgtgtggtgctgaccaacccccgcaagggacagatggggacacggaggcccagaggagcggagaggagtctggcctcgctgcctgcctattcttgctgttggcagggcctggtaaaggaggcagagatgccacgaaagaggcacgaagggccgtgccctgccctcttccacccccgaagttcagaaggacgcattctttttttctcggagacggagtctcgctctgtcgcccaggctggagtgcagtggcgcgatctcggctcactgcaagctctgcctcccgggttcacgctattctcctgcctcagcctccccagtagctgggactacaggcgcccgccaccacgcccggctaattttttgtattttttagtagagacggggtttcaccgtgttagccaggatggtctcgatctcctgacctcgtgatccacccgccttggcctcccaaagtgctgggattacaggcgtaagccaccgtgcctggccagaaggacgcattctttaagggagctgaaggccacgtggtggagctgcaagcctccatcaggcacagggatacgtggagtccagcacccaaggcccctgttctgtccacttgggcacagccacggcccagagacccaacgctgcccccggtcaggggcagtcctgggttctgatgtctctggcgcaggagaggctgcatggaagggccccatgtccactgcgctctgagtacaggctgggctggactaggctgtggagccctggtgtggtggccaaggcaaggggaggggcccggcaatccccaggcctggtgagagccccccaccacctgcgtggggaccctggtggtgcagaaatacctaggctctggagggcccaagtcaggtggcctcggctcccaagtgggaattctgcctctgacagggagtaactagagtacaactgatcttaccctcagtttcccctctgtaaatgggtctgcaggtggcgtggtgcacccgggggcccagggcttggccccaagcttgcaggctgtcctcgcgtgggtggagcaggcacagggcctggggtctgggctgtgccagagtctgaccatcgaggtggtctctctggaccaccccattttgcaaaggtgcagacaatgaacttctgttcgggggcctgcagagaagggggcctgggtgcagagctgcatcatgccgcatccaccactgagcctcaggacaccaccgggtgtccccccagaaaagggacgaggctgatggtcccagtccagacacacacatcccagctcatcacagcccgaaggggtaaatgcctttgtgactgcattttgcgtttgagacccgagggacagatgggaatatgtggtgtaggtcacgcagctgctgggaggggagtcgaatccaggtgggggctccaagaaaccgaggggctgcccatccccctccccgctgcctccgggaacagggcagggggctgcagtcacccctggccctcgtggggagcccctccccacctgtaagagggtctcactgcagctggagctgcttcccctgctggcttgatggcaccctggctttcccgggtactcagggaggtcgggtacactgggcggggacttcctcatgagttccatgtgtgacctggggccaccagggtgcgcaggagccctcctgactgccccgggcatttcctgggcgtctcccaggtatctcccatcctggtctccggcaggtcccacctgctgcctccccggtgtggactttcctctgctgagtaaacagaagactgccccggtgcctggacttcctccccaaacctcctcctgccacgtccaccatgaccccagcctcaggggcagccaagcatccaccacgaccccagcctcaggggcagccgagtatccaccacgaccccagcctcaggggcagccgagtatccaccacgaccccagcctcaggggcagccgagtatccaccacgacctcagcctcaggggcagccgaggaggctctgagctgcccagacccgacggggcagaaccggccctgggtggctaagcgggcgggaaacgcagaggcaggcggccgacagcagtgcggggtgagctgccggctgggctgctggtgccttggctccgggagacatcttccttattacggccaaattcatctttgttttccttcccagtgacatctggctctcagtgaggtcccacgaattacaaaaagcagaagtctgaacttctgttttattgccacaggaaactcattgccacagcacaggcggaaagccggatcccggcgggtcctgagtccccagctcccaccctcggggcaagctgcgagctcagaagtggggactggggagcagttatctctcactctcctcatcgtcagtttccagcccaactgccaggtctccgcctgagtcttttccactgatgctacaagggcggtttccactccaggaattttttttccagacaagcaaagcccttgcctgcatttgctctcggctaaggcggccctcccaggcctgcccggtgggctgtttcccgcagcacggcctgggctccgctgaaaggaaggtcccggcctacggaagcgcagaagcagaaccaggccttctcactctgcccaggaaagtcaggaggtggagaataaaacccccaggaaaggatctggggtgtcgttcactgacgcaggctttcccagagagactgagccacgaggtggacgaacagcgtggtgtccacccaacctggccctgacaccagggatggtgacgctgtcgtgagcctccctctgagctgccctcaagcggcctgcacctccctagccagtaccccagcagttgtgtttccacccctctcctgcccctgcgaggcagcgggtcccagcccacagtgtgcactggactctgcacactcccggcccactccctgccgtccccacgctggccctcccgtgtcagaactcagtgggaagttccaggggcctgaccaccctggatgtgtcacagacagagccccgtggtacccacccgcgtcgggctcctgcgctgtgagctaggaacttctgtgggcctcggcttcccggtctggaaagtggggcagcagcggtgccctcagggctggctgccgtgaggatccaatgcagggcctgggtgcctctcactgcatgtgactctgcccccgcctggtatggagtaggtgttcgatcaatacttgcccagggaatgagcactggaggacaggcactttttgtcctgtaagtgaagtggtggcaaagccaccctccggcattgacaaattgtagagtttaggtcctttccgtccccaggggcctggggccagcctgggaggtgacatcggttgcctggacgtggatttctatgaacactggatgccatgtctgtgataatagccgggcaatgttccagtggcttctggagggtctttagcaacaacgacctccctcccctgcacagcagggcaggaagcagaggtggggctggccagaggtgcagacctagagcagccgggatgaggctggccttggggctccatgacccaggcagggcagaggtcaagttctcccacccgtgccctgaccccagatgggccccagggcctgtatccaggtgagggcttttgcacctacagtgctaaccccgagtcatgaccgagccctcagccaccagatcccccagtcccttgggggtgctcaggtgctctaagaatgtggcccggcaggctggggatggggaccgacagcacaggcaaaggaacgcccgggcagggctggacagggactgggcggggctggacaggggcctggagacactcgctgcggcccgccgtcagactggctccctgcatgacctgtggagtgactgtacctctcccggcgtcggagacggggaacgctccacggccctcgtgggtgttacagggacgcgacagtgcgtgtaagccccagcgctgttgtaggctctaagacccacccaggaaggctccacgaccctgtgagcaggagacacaggccacaggcaggcagtgcagcaagtgcgggccgggagagcagccccatggagacgccagcgccttcacctgtggcaccaataacaaggccctgctagtccctccatgctgggtctgaacacccgcgtggcacacacggcactggggcacgctgaagttgcttctggttcctccctgccagggaaggaaattcagagccacttaattcaagcaccatccttccaccctggcactgtgggaggctgaggatgaatcagaaaaccccaaagtcaacctgctaacggtgcagcagggaaggggggaggccagcggagagccccaagatggttccagaagctggcagggaaatgcctcacccacctcacaccctccctgccaccccagaggcggcagcggcgaggcccggccctccccactgcagccctgagggctgggatcttggggattagtgacccagcctgctggcagcatctccagatcctcgcgtagggagaaaaattaatttcttccagtcatgcagaaatgaaaatacgtggagccaaaccagagagatttcctggaggtggtaactgaattacgcagatagcgggcggcaggggaagagctcaggggggctcgggcggctggtgtgtggcttcgtagccccagagggttctggaaggcgatgtctggggaaagccctcccactcaccagccctggcttcacaggtggtgacagcacggccccagcaccacgaaccactcatgtgaacttcccttctcccctgtcactagaggatcccagcacatcccaggagagatggagcctgccggaagactgatcctgatgcgacactctcttccctccctgagccccaatctcgggtggaggccacatctgttcctcctgctctgggcgcttcttcctttctgtttccctttcagtgtggaagagtggccgcttgcccagcaggacggtcccaaatagcatggcttttccaggcacggtgctgtcggccgcacagaacaggaccctcccggcagctccggcttgcacagcatccgcctgtctggcccctgtggaagtatctgactcccaacgcccagactggagcgggggcaaaggacacagcccgaccccagaggcacacagagccagccctccacggaagaacgtgcccaggaactgtgggctgggccttcctgcctcctcccctgccgcgaaagcgatgccaggggcaggtgagggtcggacgcgctcaggcccagccctcgccccttcaggtctgggggacacagtggagtcccagcctcaagaagtttccccaacctctcagaaacttgaagggcaatgccaggtaccgaaaaaccggcccccgccccttatccccggccgacccgtccgccgaggtggctgccctgggaacctcctgttcctcgtccaggagaggaaacgcacacccgggccggacgcacagaagccgcaccctggctggggccacaagcctgacagctaccgacaagcccccacccacaggagcacgcgacgtgctctcttttcaagggaaaggtttttcttcctgggccctggaatgggcctgaagtcagccggcctcagcccacagggtgaatgaggggtgggcacagcccggccgcggccccagcacacacgggcggacgcaggggcgggggagcgccagccccgcagtgtgttcggagcccagcggctctgagtcgccgccaccagcctggccgccttctgctccacgtaagtgaagtcagccgtctagggctgcgtttccagccatctgtccctccacagaggctcacacctccctccccgctgttcccacagcctggctcggggcctgcccaacacagatggacgcttcccaaaggctgtgcgcgccatcgctgccacccggctgtgccgaggcccgcggccgtcaggaccccagggaccgcatgccaggcagggtccaggacccccagcgcggaccacctttagcctgcggggcagcgccggggacccgggcaggagggagaggagcaggagggagctctggacccccctccccagaccggccgccgccacctctgcctctcccagggccgccctcggcctccccactcccgggtctccgtcacgcgggccgcggggcctttgttaggaaaaccgggcggccccaggggagcccgcgagactcccagcgcccgggcgcgtcgttcccctcgaagtttcgccgcagcccccgcaggtcaggctctgctcacggggggctgcgctcagcccggatgggtgggcgctgggcgggttggctccaccctgccgtgggcaccaactttgaaaacggcccgtgcgctcggcgcggctgcggcgcagatccgggaacggcagccgcgggcggagtcggggtagagcggcggcggcgcgcggggcggacacggcacttacggtcggggggtccgggggatccggcgggcggcggacggcgcacactcgcgactcggtccgggagtcgctgctccttccagcttggtccccgcctccacgactcaggggcggctgcgcgctgtcttctggcgccgcaccgggctcaggcgcgcggcggggctggggcgcgcggggcggccgcctgggccatgccggggactcggctccggccaccccgcgcgggaacaaagcgcgcaccccgcccggggcggtctccggcctccgcggcccgcgccgggtccagccgccgcgcctgtggctccaacgccgcgcgctcgcccgagagtctcacggggccccgcggcccccgccccgcgcgctccgcctccgcctcctgccccccgccgccgccgctgcgccacctgcctcccgcccggcgcccatggcgctcagctccgccccggggcgccggcctggagaggggctccccgccgccgagagccgcccccaacgcctccgccaccggggcggcgccctaagaactggccgtgggggccggggctgtgcggagcgccgggagcagggagaggggagaggggcgcggggagggggcgacgggcgcgccgcctcctgcggggggcggcgcggggaggcgcaggcgggggcgagcgaagaggttgaggggtgcgggcgccgtggagggggcgcggctctggggggcggcccccgcctgcgcccaccctctccccctccgcaggccgcgcacacccacctcgcagcagtcggcggccgcgggcctcgcagctttagaaccgcggcttctggcggccgcgcgggaggctgaacgggagttggggggtgtggggggggtggggaggtggggagttgggggggaggtcgctccttcggccgccgcccccgccccctgccccgcgctcgcccccagcgcggcgcctggcccggcccggggccacctccgtgcgtggccggcaggggtcgcgctccccccgctcagcctcccgggcgggtccgatgcgaagccctcgcttcccgcgggtcccggggccaggtcatttgcatacactttgcattcatttgcatatcgtgcgtttcatgtccacctgcagaaacgccccgagccgctgctctgccctctccgcactttctctgccggcaggccccctcccccgcccgctttgcctttccctaaagtactttgtggcgtgtctggcgcatttgcctgcttagtacattttagtaaaattggcgccttttccctgtttcctgccccaacgcacacgtgctcttactttagacacaagcggctggggggcccaggggtcaccattaggagacacaagaggccagaccttcagagcagcagggccttggtttgcctctcatttcgcataaattttgcatgtgaaggtccgaggtccccaatccccaatataaaaatatggcaacgtgcgaaacatggcccattccagctttgtgccgcgggccttttccccccacccctcgtccctctcatggacttggctctacccacctgagctggcagaggaaggggacggaaacccagaacgggggctccgtgagggggaggacagcaccatgtcctcctgcagcccctgggcagcggtctggtcagctgggtcactaaccgcagtgtggcccagccagttcctccagctcctggctgtgggaagtgctgtctgaagccagccagactccgtgaaaattgtgacacaaacgccaagcaccttcattctcctggttttcagactgtgcgtaacatggtgcttgcccatgtggctcagcccagtccttgtggaatggaggttttcagactgtgcgtaacatggtgcttgcccatgtggctcagcccagtccttgtggaatggagggggagttctgagcccaccccacagtacagtgcgagtccccatgcggtgggtgtgttgcctaaggttaccgattttatgctcgaaatttatccatcctggctccctggcttcatggactctgaggcacagtggattttaagatgcaccattattttgtgtgccactaagaaaggaaaacattctgccggtgataatcctaaaacgcccccaggtttcagagattttacaaagcaacataaacgtgggagtgggggcaggtgggagaattcagcagcgaaccaccctgaagtcagtcgggttgtgagctaaacaatgcctgcggcagctgtggctgcccacagggcctgggagcagaagctggcctggacctgggccggaagccctcacccagcaccagcggcacgtccgtggtctcggttctctggaccgcaggcttcgggtgttaagtgaccagttgcaacatctctgacttacacagggtgctcacaaccatttgaggagtgacagacctgaaggcactgaagataccactgcagccatcagacaccacaacccaggcgctgcacctgccccaccgcagcccctcctccctactcaggagagctgtggtggcgtggtagagaagaaagggatatcgcaggcaggagggcttcctttagtgctgtgagtgggtcagcctgacgcctagcccagcggtcacagggtggtcagatggtcctggcagtagctggcacagagctgggcaccgtctctgcatttccccccgtgctgtgcggatgctcccggaacgcccattttacaggtggagaggctgagcctctcagccacaccgacttcctgctgccttatccaagaactggtttcttgccctggatgcggccaagtcacagctcctgggcatttcgaggggacatttaaggaggagactaccagccctatgtgaaagatgtctgcagtctgtccgacaaggccagcgtcacctgtgcgggagacagaccacgggcgagcaggacctcggagggccacactcagggctcgggagggggcagagccgtggaggagggagctcgagggtgtgcccatggagctcccagtgtgtcgctgtctgtagaggcaggagctcaattcacttaaaagaaaccaccacggccgggtgcggtgggtcacgcctgtagtcccagcactttgggaggccgaggccggcggatcatgaggtcaggagatcaagaccgtcctggctaacacagtgaaaccctgtctctactaaaaatacaaaaaattagccgggcgtggttgcaggtgcctgtagtcccagctactcgggaggctgaggcaggagaatggcctgaacccgggaggcagagcttgcagtgagccgagatcacgccactgcactccagcctgggtgacagagcgagactccatctcaaaaaaaaaaaaaaaaaaaaaaaggaaaccacctcccctcctcatggcatggcagcgtttccaagtaaagttgactccccatcagcatctggtgccccgatcacacacccatggaagccctgggagaccgtgcctggctctagggcccgcggcgcacagcggggcagccccagctttgctgacctgtgctgggtgtgcctctgaggccccaccctgctgccctcaggaaaacaactgcagccttctgtcctgccaactgcacttctggccatcctgatccccctccccaaagggcagcacccacatctgatttccctctcaaccacccaacagtgcccagctcaaggtttggataaagacgcagtttataaacacttgccacaggcgtccctgcactgtcacctccccgcagtcatggccccttcttctgataccaggtaagactcgctgtctgtggggccctggccaaagggcaggcgctaggccctctcatgtgccctccgtgaccctaggaggtaggtcttgccaccagccttgtttgccagaggagaacaccgggacccagaaagcttgagtaatctcagaacacaggctggtctttggcagagctggagtcctgccaggccagcgtggtccagcgggaggccaggccatcactgttgctgaccttcagaaaatagttctgagcactatagactctcaaacattttctgttataactaaaactctgcaacaaaagtttagatagctgccaagaatagaaagtctgatacactataggtatagatatttaaaaataagcgggtggctaatggattctagataccatagcaatttgatagccactgtcgttcattaaaaatatctgaataaactcgtcttaaacacctgcattttcactcagctccctacctagaacagtgagtttttaaatataacaccaaaagcatgatgcatacaataaaaatttggcaggttggatttcattaaaatttcatacttcggctctgcaaaagacactatgaagagaatgaaaagacaggccatagactgggagaaaatatttgggaaacacatatctgatgaacaactgttatctaaaatatacaaagaactcttaaaaccaaaccataagaaaacaaacagccccattaaaaatgagcaaaagatctgaatagacacctcatcagagaagagatctagaagatgatctggcaaataagcacaggaaacgatgcccagcagccttgccactagagagtgggtcagcacagccacgagaggccacgacacgcctgttagaataactaaaactcaacacacggacaaccccagatgccggtgaggatgtgaggcaacaggagctgtcattcattgccgacgggaatgcaaaatggtacagccctttggaagacagtttgactgtttcttatgaaactacacacttttaccacgccacccagcattcacgtttcttggtatttacccaaatgagttaaaaactaatgtccacacaaaaccctgcacattaatgttgatagaagtttcattcgtttttaccaaaacttagaagcgactgagaccgccttcaacaggtgaatacataaaatactgtggcatatgtagacgatagagtgttatccatgacaaaagtagtgagctatcaagccatggaaagtgaacattgatggccgggcgtggtggctcacacctgtaatcccaggactttgggaggccgaagggggcggatcacctgaggtcaggagttcgagaccagcctggccaacatggcaaaacctcgtctctactaaaaatacaaaaattagctgggcgtggtggcggtgcctgtaatcccagctacttgggaggctgagacaggagaattgcttgaacccaggaggcagaggttgtagtggcagtgagccaagatcatgccactgcactccaccctgggcaacagagcaacactccatctcaaaaagaaaaaaaaaagtgaatattgctaagaagtcaatctgaaaaggctatatactgtctgattccaactcaatagcattcaggaaaatgtaaaatgatggaagtagtaaaaaggtcagtggttttcagggggttatagaatagggaaggttgagtagggagagcagagaggtttgtttgtttttggaggcagagtcttgctcttgtctcccagactggagtgcagtggcatgatcttggctcactgcaacctctgcctcccgggttcaagcaattctcctgcctcagcctcccgagtagctgggattacaggcgcccaccatcacgcccagctaatttttgtatttttagtagagacagggtttcaccatgttggccaggctggtctcgaactcctgacctcatgatctgcccacctcggcctcccacagtgctgggattacagacacgagccactgcttctggctgagtttttttgtttgtttatttttagacagggtctcactctgtctcccaggctggagtgcagtagcgtgatcacagctcactgcatcctttgacctcccaggctcaagcgatcctcccatctcagccccagctaattgtatttattttttgtagagacagggttttgctgtgttgcccagactgcacagaggatttttagggcagtgacactattctgtatgacagtctaatggtagacgcaagtcatatgcttgtctagacacatagaatgtaacaccaagagagaagcccaatgtaaactatggatttcagttaatgaaaaggtgtcagtattggttcatcggttgtaacgaatgtatcacaccagtgccaggtgcaatgtagggaccccccactagggaacaagtcggaaagagtaatgagaactcggcgctttccgcccagttgtcctgtaaacccagaaccacgctaaagaataaaatctattaacttaaaaaattcagcagacaaaaatgaggatatcaatgacattttatttgccgtttaaaagacagatacaaacagactcttctgcagcgcctgaatctctacatggcccttctctcccttaatgcctccttccattctacccagccgatttttatcctaatatgttttcatgtttgaaagtcttttgattcccctatcgtacaaaactaggtacatagttggaatgtcaagatttaaacattttcctatgttaaaatttatttcctgggctggattatcgttataattattggtagtatacaaccgatacaaacaatgtgaatgtattacacattttgagaactaataaggatacaaagtaggctgggcttggtggctcacacctgtaatcccaatgctttgggaggccaaggaagtagtatcgcttgagcccaggagttcaagaccagcctgggcaacatagcaagacctcatctctacaaataataaaaaagttagccgggtgtggtggtgcgtgcctgtagtcccagctactcagggggctgaggcagtgggattgcttgagcccaagaggttaaggctgcagggagctatgatcacgctactgcactctagcctgggtgatggaacgagaccctgtctcaaaaataaaaataaagatacaaagtaaatttttgttggaagacatctcgtaaaaggagggaggggcactttttggtagtagtttgtgtattcatgcatgaataatactgccagaaaaagacaggatttgacattaattccattcccgtggtgggtgtttaatgtgaaagccagagaatcttcagtcccataaataactcgatcagaacgggagctgtgtcctaaccatctcactgtgacctccttctgagagtcagatgccgcaagccacgtggtgattggtcatcaaagtcatttttaataactatcagctgacaaatcggttctgtcccccctcaattctgtttcatgcaaagacaagaaatcagcaggttgcagcagagacacattcgtggcgagtggggagctgggggcaaggcaccaggctggccccaggcagagagacgttggtctttcttggggaactgggagagggtgactgtgcaggggtagctgggaaaaggacccacactggcccaagcaggttctgccttggccgtcagcctgggccgtctggtgtgggcaccagatgacgcggcttcaagttgcccacaaggtcaaggagaccctcccggaggcagggaggaaccctaaagcagagggagtccgggctccggacaggaggcttccctgcctcaggagtgtctcttggctttctcccctgactcacatcggcatcgctgcttttgcagaatgaggttcctaattgtgaagtggcttcattcacgtattcatttctttcttccttcactctccatatccaatagaaagcaagttactgaagcttgccaaacctcagtttttcctgtaaaacggggctaagagctggctggcctacacatttgcaatgtggctcaaagacaagttcagagttctctcttgtctttgttgaagttcacacgagaaccaggccaagcacaaacagttggaaatcggaagtgtcccgtaggaaaagcagccggtgctcgtgtgtaaaagggaatgtggatgggattgaggtggcatttaaaatccctggagaagcacaaactccccagtagatggtgtcaggacaactgccccatgtggggaaaatgaattatatactccttacttcacttggaaaaataaactccacttgggttaaagaataaaatgtgaaaaactggaacagtgaaaggattaggagaaaaaagcagagcaatttatataataccagtttaaaattaaggcagccgagaaactctgaaaaaattttaagaagctggaggggtttggccgtgtaggcatgagcaacttccatgtcctgaaagagacaggggaccccgataagagatgggttgggaggccgggcgcggcgcctcacacctgtaatcccagcacttcgggaggccgaggagggcagatcacttgaggtcagcagttcaaaaccagcctggccaacatggcgaaaccctatctccaccaaaaatacaaaaattagccaggtgtgatggtgtgtgcctgtagtcccagctattcgggaggctgaagcaggagaatcacttgaacccgggaggcggaggttgcagtgagctgaaatcgagtcacctgcactccagcccgggtgacagagcgagactctgtctcaaaaaaaaaaaaaagaaaaagaaagaagatgggctgggagtgggtgtggggacaaacgacagtggccccagcacacaaacattgctacagagaagaacaatacaagcactcaaaataacgctcaacaaacttcatgagtaggcaaatcccacaagaagaaaacaaaagggaccagacacagtagctcacgcctgtaatcccagcactttgggaggccgaggcaggcagaccacttagggtcaggagttcaagaccagcctggccgacatggcgaaaccccgtctctactaaaacacaaaaattagctgggcgtggtggtgggtgcctgtaatcccagctattggggaggctgaggcaggagaatcacttgaacccgggaggcagagttgcaatgagccaaaatggtgccactgcactccagcgtgggtgacagagattctgtctgaaaaaaaagaaaagaaaacgaaggaacgaaaacccccgccactctcgaagtcacacggcttccctgcttctcttcctcatgactggccccctctcctcctctcccgtctctcttcacctctctttatctggatctgtctctgcttgttctgcgtttccctgttctccagggcaggaaccacatcggtctgttcacccctcccctggaccggcaccgccacagagggtcagagtgttggcacctgtcttccaggtctgttcacccgtcccctggaccggcaccgccacagagggtcagagtgttggcacctgtcttccgggtcagttcacccgtcccctggaccggcaccgccacagagggtcagagtgttggcacctgtcttccgggtcagttcacccgtcccctggaccggcaccggcacagagggtcagagtgttggcacctgtcttccggatctgttcacccctcccccggaccggcaccgccacagagggtcaggagtgttggcacctgtcttccgggtcagttcacccgtcccctggaccggcaccgccacagagggtcaggagtgttggcacctgtcttccggatctgttcacccgtcccctggaccggcaccgccacagagggtcagagtgttggcacctgtcttccggatctgttcacccgtcccctggaccggcaccgccacagagggtcagagtgttggcacctgtcttccggatctgttcacccgtcccctggaccggcaccgccacagagggtcagagtgttggcacctgtcttccggatctgttcacccgtcccctggaccggcaccgccacagagggtcagagtgttggcacctgtcttccggatctgttcacccctcccctggatcggcaccggcacagagggtcagagtgttggcacctgtcttccggatctgttcacccgtcccctggaccggcaccgccacagagggtcagagtgttggcacctgtcttccggatctgttcacccctcgcctggaccggcaccggcacagagggtcagagtgttggcacctgtcttccggatctgttcacccctcccctggaccggcaccgccacagagggtcagagtgttggcacctgtcttccggatctgttcacccctcccctggatcggcaccggcacagagggtcagagtgttggcacctgtcttccggatctgttcacccgtcccctggaccggcaccggcacagagggtcagagtgttggcacctgtcttccgggtctgttcacccgtcccctggactggcaccagcacagagggtcgagtgttggcacctgtcttctgggtctccatccctccctttgtttgttgagtgactgcatgttctcatttccttatcatacaattctttgagaggtatcattagctgcgtcttattttattttcaccttcttttctgttacctgtatgtttgaattttcctataagtatttttgtttcatctttgcttttttaaattaaaaaatcagttttaaaattgcacctgcagtacaaaatcagggtggcgaccgggttgctgccattccctcccctcgggtctgtggcttctcagctccagctcgggtcacagacctgctgccacggccccagggtgggcacagggctagcaggacagtcatgcaggcagccgcggccccagcgattggtccaggaggagggcaggtgaccacacgcggccaatcacaatccttccctgggagtttttgaactggaacaagagaggaaggacctcttctttgatctgcgtgggaggcaagcccagagtggcctggacagccgctgggaagagaaggtgggcagagcggcggagggtgtgctaatggttgggtctgtggggcctgaaaccggtgcccctgcccatcctatagtttggtgcttgagccagcacagtcccaggtgtccctgacgcctccgagctgggtttctgtcactcgcagctgcagcattctggcacagacccttggcccaggacccctgtgcagaggtgggtttgggtctccccggccccagcagccccaggagcctgtgagatctaagccggaagctgctctgggcacctgagtgctgacagcccgagtgatgggaacaggctcgctactatgcagagacagagagactaatttttatcagccagatacctggccaggccccagggtggacaatctccaaaccgcatgcatcccggcactgacaaagccgtctatcattgctggagccaggacacccggggaggctgtgccaggccacggggtgagggagctgcctccctccagtccttctcccgtggggcactgagacggctttcagcaagacaaatgcccaggccacagggtgagggagctgccgccctccaatccttctcccgcggggcaccaaaatggctttcagcaggacaaatgcccaggccatggggtgagggagttgccgccctccagtccttctcccacggggcaccgagacggctttcagcaagacaaatgcggccctgccactccctgaccgagataaagtctcagctcctgagcctggggtgcctgctgctcgcccccatcgcctctctgagctccagcctcacaggcacacaccgctcccctgcccagaacattctgcccacaaactcctcttagcctcaggtccctgctgagtggccattcctgctgggaggcaggaattccctgatctacccttcctgagtctgggagagacgcctcccatacccccatgacagcccatcacaattgttcacggatctctgtgttctccctcaacaaatacttggcggaccccctggagccacagctcaaggcttccttcccccccacccccacaccctggggacagcatgtccaggacccccacgcagggcctgtgtcgagacggcatgtccaggacccccacgcagggcctgtgtcgagacggcatgtccaggacccccacgcagggcctgtgtcgagacggcatgtcccgccatcgggtttgctgctgaatgagcagatgatctaatgagtgaccgtcctcacccacgagaaaaaacacaacctggtctccgtctgccggttagatcggcccccagtcctgctggccccagcgatgacagaggaggaggaatgaggagtgccgtgcctgggctgggccatcgcctctctccctcggctgggtttgtcatgctcagccagacccgctcccggtggagaggccgagggaccctcatttctacgtttgcatccctttcttccagggcctgcggggctgacaggcacacagccagtggtgaaggttcacggaagaacgaaggaaggagtgagcgtggggagagccagccaggctccccatgtccacccagatggtgagctggccctgccctggagacactgtgtccagaggccagcatagccctcaaaacggttcccacagctcccagcggagccctcaaaatggtccccacagctgccgcccactcttgggaccctgagtgtggggaggctggggttgagcagtggggatcaggatctggcaggatcggaatgtagaggcctgggggctcccggctggggacagtgccagcaggagtggccgggacgatgacgaggtgaggtgtctgctcccaggctgtgtgtggcttggatgccaaagcgccttttgctgtattcggcaccctgagacccttatgtctgcctattgaaggcacagtttactcccgggaaaataaacatttgggtttatttcgctgtgactgcaccccctgaatcttaatcatatgtgtctctgggtttcccttaagggggatggctccccttaagatgactttggggctgccatgggccttgtcacctgcattgggctggtgaggacagggacagagatgcccacagagcaggtgggctgtgctcctgccctgggcaaatgagggcaggcggcctctaacagctgacaccatgtcaggacagtggctacctagcaggaagctctttcatctagagtcctggtccttcatgcctgggtgtggtcatggcccctctacagctgccagtcagagaactgcccaggagctcccactcctcctctgaagaccccaaatctcaccactgaccaagatagccctctgaccacagtgggctcccccagccaccacgatggtaccccaactgctatgaaaggtcccctgaccacaacaggcaccctgaccaccatgataggccggccacccatctactctgacagcccccttcccctacagccctgcccaagtctcctgacccacccaagggtcctgaccccacccaaggctcctgaccccagccaaggctcctgacctcacccaaggctcctgaccccacccaagactcctgaccctacccaagactcctgaccccacccaaggctcctgaccccatccaaggctcctgaccccagccaagtgtcctgaccccagccaaggctcctgaccccgcccaaggctcctgacctcagccaaggctcctgactccacccaaggctcctgacctcagccaaggctcctgaccctacccaaggctcctgaccccgcccaaggctcctgacctcagccaaggctcctgactccacccaaggctcctgacctcagccaaggctcctgaccctacccaaggctcctgaccccgcccaaggctcctgacctcagccaaggctcctgaccctacccaaggctcctgaccccacccaaggctcctgacctcagccaagactcctgaccccacccaaggctcctgaccccacccaaggctcctgaccccagccaaggctcctgacctcagccaaggctcctgaccccacccaaggctcctgacctcagccaaggctcctgaccctacccaaggctcctgaccccacccaaggctcctgaccccatccaaggctcctgaccccagccaaggctcctgaccccagccaaggctcctgaccccgcccaaggctcctgacctcagccaaggctcctgactccacccaaggctcctgacctcagccaaggctcctgaccctacccaaggctcctgaccccacccaaggctcctgacctcagccaagactcctgaccccacccaaggctcctgaccccacccaaggctcctgaccccagccaaggctcctgacctcagccaaggctcctgaccccacccaaggctcctgacctcagccaaggctcctgaccctacccaaggctcctgaccccacccaaggctcctgaccccatccaaggctcctgaccccagccaaggctcctgaccccagccaaggctcctgaccccgcccaaggctcctgacctcacccaaggctcctgactccacccaaggctcctgacctcagccaaggctcctgaccctacccaaggctcctgaccccacccaaggctcctgacctcagccaagactcctgaccccacccaaggctcctgaccccacccaaggctcctgaccccagccaaggctcctgaccccacccaaggctcctgaccccacccaaggctcctgaccccagccaaggctcctgaccccacccaaggctcctgaccccacccaaggctcctgaccccacccaaggctcctgaccctacccaaggctcctgaccccacccaaggctcctgacctcacccaaggctcctgaccccacccaaggctcctgaccccacccaaggctcctgacctcagccaaggctcctgaccccacccaaggctcctgaccccacccaaggctcctgacctcagccaaggctcctgaccccacccaaggctcctgacctcacccaaggctcctgacctcacccaaggctcctgaccccacccaaggctcctgaccccagccaagtctcctgaccccgcccaaggctcctgaccccagccaaggctcctgaccccgcccaaggctcctgaccccagccaaggctcctgaccccgcccaaggctcctgaccccagccaaggctcctgaccccacccaaggatcctgaccccacccagggctcccgaccctgcccagggctgccaacccccaggcctgccgagttcctgctccctgaggctttgggaaagactcaaaggctttgggaaagactccatgtcagttgtctgccaggagagccgtggagggcagccgcctggccccagcccgaggccatgtagagcctccagacagaatggccaggaaactgagtcagagcctgtttatcacgcgtgtgacggagggcgaagacctgcatcacgggagaaccccacgcacacggagctcatggcctgtgccagggtgggcgggagaccttcacccacccgccgggtccccgggacacagcgtgtccgcctgctcttccccaggggtctcagggctctctgctctttgagcccaggatgaccctgctcccccaggctcagagcccagcagctcccggagggtggagggtagaggaacgcggagcttctactggcctcacaggcatggccccattcatttagttccacaggtcggggcttcccagcaggggacatggaggcccagaaagcatttgtctagagtcacacaataccgtggcagagggaggcgaggctgggacccataggctctgtctccattaccccaacctgcagctgccccacctggcctggtgtctgttactggtggaccctgctggcggagccctgggagaaagaggcgctccaggcgtgggcggcgggggctggcatctgctcctcggctgctttcctgaccgagtttggaactggaccgcatggcccttgccctccctctgtgccttctccaggtggcgtcacaggggcctgcagcagctgcaccaagcccggcccctggggttctcagctgcctggcaccctccagtccacactgtactttgccagggcctctgaaatgcagaggctgaaccacagaagaagtggctcacccggagactgcggcagcctgaagtcggctgaaccacagaatgagtggctcacccggagactgcggcagcctgaagtcggggccctctacgtctttgtcacgctctctcccggaacaaaaccgcccttgggcttcaggccccagaggttatgcccacgggcagctgcccagcagaaccatcatcacacgagattggttgctcactcctcccccatcgacccactccccggcatcttccctctcaccaaatgctgccggtggttctaacctcacagtctggacagccagctgatggccccagaggttcctggtcagaagtgctgcctttccctgccctcgggacacccccgcccccacggcagatgccactgcctttcagggccagtagcagacatggcagagcactctccgtggggctgtcacctgactcgggataacagtgctactcacacagcacaaacggggtcggagcttgcacagagaccacgatgccccctcagcccagggaggacgacgcaaaggtgatagctagtccctccacccccagacacatccccttgctgacccccacacctgtcctcagtgtacatctgggaagcccagagagggtcagtggctcacctgagacacacagctgtggtgagacaaggttctccatagactgtcagccgagcacagataaactcaaaagcagatgcagtgcacacttattcagacataagaaggaaggcaggtccgacacacgctccagtggggatggacccagaaaacacgggcgagtggaagagctggacacaggatcccgcttacacacaacaccggaaaagacaaatccacagaggcaggaagcagatcagtggtgggcagggcagagggagggaacgggcctgactgcccgtgggcatggggtttcttttgggggaaaatgttctaaaacttgttagcaatgatggttgcacacctctggggctttgctaagtgccactgacttgtgtacttgagatgggtgagttgtaagatgtgtgggttatacctcaacaaggctgctggaaaaccacagtagacccggaacgaaagtacctgtgagctgctcacaatccctcgctcacagagaggccacggaactttgtcagcgcaccagggcagtagcgggatgggtgtcaaggccgtgcacacccacgaggccgtaggaagcctggtcaggctgtcggggcctcagacggcagaaacctatcccgagaggaaagggccctgggcacaggctatggcagaagagcttcgagagcccaaagctcccagggaagctttgagcttcctcaaaaagctattttgagcctaaaatagcttcaagagcccaaagctcccagggagaagttgaggttgatgtggtcacctcgaatggggaactcctccaggaaggaaaggagaagttttatttggggtgggggtgttagagtaatgccaggcggggcggcgggggaagaaggttctggggcggggcgttagagtgacaccaggtcccggtgcagcgctcgtgagtgccccacatccctgggcatcacacgcgtgtcgtctggagcagaagctggtggagaggtgtccttcctatttctcagatggggagactgaggcctgggtgggggcaggtggagaagcacagtcgccgcccagcagcccagcactacctttggagggagacaaactcgctcccccagggccgggggctgggggcctcggtgtggcctttggaaggagatgaacttgctctcccagggctggggcctcagggcctcagcgtagcccaggtctgcgctggctctgggctcttcccgctgcaggtgtgggtcccccgtgggcagctctcacaccacaggcctggctccctaggggtatggtcagagtgggaccctgtaccgcctctgccgcccttttccctttgcctccatggagcgggcctgagttcccagagggctgattcctctctctgccccgacccctggcaaccctgtcagctgctcattcacctaatagacaagtgctgtgtgcccgggctgtgccgcaccaacccagggccaggattcagaggggaacagagaggaagccccatcctcgcgatgccaaggtcccagcagctggaggggcagcgccctgctgattgacgcgctgaatcgtgtgcccccgtccttactggcaggcacgccacatgtgctgtgtgccatgtgttcaggtctggcctgggcctgctgtgtcctggtctcatacacgctacatggacagtcacatgagcagctgctgtggccgcggacgggtggtggggacagggcatgaccctgttgggggagcagaggggtctccttgcgggagagagttgaagtagtcctggcgatgatggtgggctcccaggagaggtggagggaacacgcatgcacgcccagggctggaggcacgtgggtgttcagggcctgtgaggaggcccgggcaccaaggcagcacccagcgcttacagagcctgcaggtcttggacagaggtgcaggcagaggcaggaggtggcatgggtcataccacctgtaaaagccaggcgcagtagagaatgttctagaaataaatgtgatgctgcgattgcctgagagggaacccaggtgcaggagagggaaggtcccggggaaaccctccttttcctcctccttcctcccagcagctgggaaaggcgatggagagaaaacgggagcagggcagagacggtatctgggattacaggaggaaaggtggctcattgtttaaaaagatcattaagcctgtcatcccagcactttgggaggccaaggcaggcagatcacccgaggtcaggagttcgagaccagcctagccaacatggtgaaactccatctctactaaaaatacaaaaattagcaggatgcagtgacgggcgtctgtaatcccagctacttggcaggaggctgaggcacgagaatcacttgaacgcaggagatggaggctgcagtgagccgagattgcaccactgcactccagcctgggtgacagagccagattttccaaaaaataataataataaattaaaataaataaataaatcattaaggttccaaggaaagatgagtctgtttccctcagatgattttcagtagaaaacaggcagagataagacaaagtccttgattcccaggtttgtctgccctcccaggacagcccacgagatgtgagtggtattgaatgactcaggcctacacctgctgggctgggagggcagggcactcttctgcctcaagctctaagttcaatgtggacggcatctgtgaaatgggactgcgtcacctgctctgctgaactcacggggccaggtgccaggtcgacggggttatgggtgcagaggctgtttgaagatagcagagaagatgtgaagaaagaagtttgaaaatcctggtgtgagaaggccctcgggagtgtcacatttgaacactattgatttgtggactggaacctaccggaacgaatccatttgtcatggggcataaacagaagtcggctgagtgaggcctccacaagaatctcaattttccttatgaaaagaggctggcctagtctttgtcctctgccccttcttcctccttcctgcctggaatgcagacatgatgcctggagcaggggcagccactttgcagccaggaaaccataagcaagaggatagtgaagctgaaagagcagaaatgccaggtaccagacagtgtcgttgtggcactggcctgggccacccgcctctgggtttggtcatgtagaaacaaaccttgtttacacccccgttaggttttctgtgatttgcagctgacataatcctattggctacagggatcaaatccatcacagggaggtctgccagattttggagattacagatgcagaatgcctggttaaatttgaatgtcagataaacgataactgatttttagtgcatgtcccaggcaatatttgagatacgcttacgatttaaaaatttgtttatctgaaatttgactttaactgtaatgctattcactgatgaagtcacagaatccagagaggctgtgagacctgtctgaggtctcgctgtgggcaggtggtggatggggctctgccttctgtcttccacggcctctccttgctttgatcctgatctggtgtctctagagctttctaaacctgctgtaacagatctgtaaagaagggggcctgtggatgccgccagagcccgtgagaggtggttcccagacagggggcgcacggggagtgacggaaccttctgtaggaactgacacacagcactggagatttccactgcatagtaaccgacactcacccctgggcattcccaccacatagtgactgaccctcagcactgggcattcccactccatagcaactgaccctcagcgctggacattcccactccatagtaaccgacctcagcgctggacattcccactgcatagtaaccgacagtcagcgctgggcattcccactccatagtaaccgaccctcagcgctggacattcccactccatagtaaccgaccctcagcactgggcattcccactccatagtaaccgacactcagcactgggcattcccactccatagtaaccgacactcagcactgggcattcccactccatagtaaccgacactcagcgctgggcattcccactccatagtaaccgacactcagcgctgggcattcccactccatagtaaccgacactcagcgctgggcattcccactccatagtaaccgacactcagcgctgggcattcccactgcatagtaaccgacactcagcgctgggcattcccactgcatagtaaccgacactcagcgctggacattcccactgcatagtaaccgacagtcagcgctgggcattcccactccatagtaaccgaccctcagtgctgggcattcccactccatagtaaccgacactcagcgctgggcattcccactgcatagtaaccgacactcagcactgggcattcccattccatagtaaccgacactcagcactgggcattcccactccatagtaaccaaccctcagggctggacattcccactccatagtaaccgacactcagcactggacattcccactgcatagtaaccaacactcagcactgggcattcccattccatagtaaccgacactcagcgctgggcattcccactccatagtaaccgaccctcagcactggacattcccactccatagtaactgacactcagcactcggctttcccactccatagtaactgatactcagcactggagatttccactgcatactcgtacttttttacttttacaaaagcatcaattgccaatggatatttattttccacaaataacatgagacgccatgaaccagcctcgaaggtgaatgcacttcccaggctgctgtgtccactgtgtctgctggggtcactgtcctgtgggggacgctgaggcttcctctgtgctcagcaggaaaagcattgtgatccattacccatgcctgtcgtgagtcccgaaggagaggcccagggcccaggccactctgcaccctgagggcacgtggtggggccagatcaccaaagggcacatttgggaggactgaacacagatgccgagtcccctggaccacgtttcggggggagacagccacgtagccggagccagtgccttcccacccagcacctcctgtggtcctcacggtgctcggcccagccacgaacatgggtgtctttagatgtcgcctggtgggaaaacagggggagcaaagcctgctgctgctttctcgtctgtgccccgaaccctggagatgaggggcgctgaccctgcacggcttctgagcaccgacatgaattcccaggtccactcggaagggagctgggcaaccccaccccgcgtgtctgaaaacttccacttgcttgatttccacagggcctccaggagggcacagggcacgccaccccactctgtggtttgcagaggggagataacggaggttgggtccaaagccacatcctcagcacctgagctgcagggacacagtcagtgccaggggccctgggcagatgcgtagctgggcctggcaggatgctgggggtgcttcttcaaatctggagggggagctggaagaagcagacacaggcccagggccggagggagagaaggtgggggcttggacagaggctgtaaggagtttctaccaaagtccagggacagtgggggaaggccaggggtgggcgctcatcttctgccaggggtgggcgctcgtcttctgccaggggtgggcgctcatcttctgccaggggcgggcgctcatcttctgccaggcttttttttttttttaagaatgttaagatcttttaaaaatttgtgataaacagaacataaaatttactattttcaccattttaaagtgcacaattcagtggtatttagtacactgacaacgttctgcaaccagcgcctccacctaactccagagcacatcatcaacctcgcagtgaatcccggccccaggagctgtcactgtcttctccacaccctccccatggtgaccccaaatccactctgtctctgtggatttgttatcgtggacattccataaaatgggaccagaccgtatgcggcctcttggctctttcacttagtgtgatgttctcagagctgaagcaccgcgctgcagtgcgcatcaggaatagattttagcggcgtcatgcctggatttccctgctcagctgacacttcgtgagccaggcacacagcggcccgaggagagccgcattctgtgactcagggttctgcgggatcctggaatgcagggaggctcgggtccgtgcacgtctgaggcaggaggcctggcctggccacacgggcgtgggttcctcatccctctgagcctctgtctcttcgtggtgacttaggggactctgcatctcgcttgcagtgcatcttgagaaagagaagagctctgtctgcagtgaggagaggacagagagctgcccagagctcccagccctgcacctgtgaggtaggtggcacagctctatgggggtctttaaagggccacgcacacaagaccatctgcatacctgggccgatcggcttaaaggaatccatatgtgggtcttcaccttccagattgttctgcaaacacggcttggggtcagctgtgtgctgctcctgcctgctcttcccccaattcatgggttgcctctctctagcatgagtctgatgacagggcttcgacccaccagtgaaaacctggggcaggccccatgccctgcctgcctcctgttcggaaaccacagacccaaaggtgtaaaaaatcacgttgacttctggccctcctggtgttagccaggctgccaagggcccagtggcctcttttgacttttaatttactgctggtgaggcttcagttagggttagggtgcagaaaactgacaagttgcaagctacttgttgttctgaagaaagattgcacttcactaattcccactcgtcaggttccgtgtggctttccttcttcatggggtctttaatgtccctcgtcccctctgaatcacctgggctgcccgactggctccctcatcgcggaataatacacctttcacacatgcttactgtatgtgtgtataagaactatgtttttaagatttgaaaaatatactttgacctttccttcctgcttccttacctttttatcttcccatccatctatccacccaccaacccatctatccatccacccactcatccatccatccacccatccatccaccatctatccatccagtcacccatctattcatccatctatctatccacccacccatccatccactcacccaccatctatccaactgtccatccatccatccatccaccatctatccacttatccatccatccatccatccatccatccatccatccatccatctatccatctatccatccatccacctaccccacccaccatctatttatccatctatccatccatccacccaccacctatgcacttctccatccatccatccatccacccatccatccatctatccacccacccatctatccatccatccatccatccatccatccatccacccacccacccacccacacatccatccatctatatcacaattagaattcaaagtgaggcatttggatcatttaataacatgcttatttgaattaatatctgacaaacatcagtctgggcagattgtttttcagtgaggaccagttctgccctttgtttttaaggcagcatttctataaatcaagtgagctaaatgtgcagattttcataagaccagatgccaaacactggtaacatattaggtatgctagaaaatacagtttttgagactgtttaatcaatgtttagaggctgcaaattggcccatgtggcaccattgccaagggtcctgtgtccagcctttggtttagaaggatacttggtgcgcagcgccagccacaggccccgaatcctgcttctacaacccagggggctaggtccctgcggggcagagagtttgcagaacaggtgtgtgccacggccaacacatgcctcacacactgtatgcagctgttcttctgtgacccagtggtgaggttgcggggtgcagctgtcaccttatttattttaacaacgtcttgtccacagatacctgtcatgtttgaaaacctctctagtggctcctgggccaccattatctgccaaaaacgaagcagcataaggtctgtgtgtggccaggctgggtgaggctgctttgtaagcaatttcatcttataggggaacttggcttgtcaaaaaaaagttttagggagctcgcaaacaaaagcattaaaagcccacagaaccaccggctttgagaatcgggcctggtgcttggcacctgacaggtcctctccactgtgcccggtccctcctctgtgggctgatgtcaggggaggggacgggggcccattcggcagcaggaacagagagaccccacagagcatgggtgcatacagagttccccctgggccactccttggccagggaaagcagacctcgcctcctctcgtagctgcaaggtggggcccctctggacggagtgggctttcccggtttgtgtgggtcgctctgctctgagggtcactctgctcactggcctgcacagtcccaggacttccccgacctgagtcacagcacggcttcctgaaacacatcttggccacattaggccgtctctagggacagactccagagcagccagctaacagggctgccattttaccctggtccttggcaggagtgaggcctgtgccggggtaggggggtggcagcccctgtgagtgcccacagaggagagcagagcgggggatcgcgagtccacagacctcccggcccctctcccacctgtgcagcatggctgggctacctcccctgccacaccctcatcccacctggggtgaccaccaaacccatgtccagacgaggaccaggcccaatcaacctctggcctcccatgaactcagtagtggaagcagtagaagcacccggtgccaggccctgcccagcgcccagcttcccagcctcccttggaggccggccctggtttccacaaacaaggaattcctccaggagcaatggacactcttgacctccagaaccactgcctgccatcaccaacacctgcgctggacagaggcctttctgaacacgagctgggtgggttggggtggggggcgtctccagtgactcccgtgccctggccctgcctggcttgcagagccacccagatggaagtcggatgcagcacgcccactgctgcccctcagagaccaggcgctcatttcccccaggaagccgggatagggcccacacccaccctggactctggaagcccaggatgagaacttcgtatcacactctagtccctgtggccaatgtcttgtgtttgccttggagaaaccatgtgggccccaggggacgagggaaagcatccttgattgaagcattgtttgtagcacgggaaattgacgcactcaacctctctccatagggaagctgagaacagtgcgctggtgtgtgccacccccaacccccaacccccgaggtgccactcggccccgacacgcggcagcaccatgccaccccccagcccccgaggtgccactcggccccgacacgaggcagcgccatgccacccccccagcccccgaggtgccactcggccccgacacgaggcagcaccatgctcaatgcagtcagcctcgcaggtgtcgagagaggaaattgcaaaggaaaatgagaattcgatgccttttctgtaactgtgcgagacacactgcctgggagcgacggggacggggcaggatgcctggggacggctttccacaccctaagtgctgccatgcgtccacctgttcagttttcacagatgtgccggagacggggactgctattgccccatttaccgatgaggaagccgtggtggggtgtggggtggctaagcctctgagctaggtccccccaaccccttgatcccatctcgccgcccccaggtggggtggccttccgggctggggacactggacctacaggaattcctttctataaagaagagggaaggaaggagcaggccggggacggggacggcgtgctgccctgcgtggctcccgcgacctggcttctcctggggggttaaagatcagccacagagcacaggggtgagggtcaggcgcacactgcctgggggctcgtcgcggctcagccctcacactgccccttcctgtccagggcaccggggaactcaggacgccccctgccccggagcagcgcgtccagcgggggtcggcgtgagctgtgtggaggcgcccaccctcccttgcagccagaggtaggaagtagaagggaaagaggagaggtcgctctgtggcctccagaatgtcaccattttcacacatgttcagtttataaacttttaagctttctgcatccttcttttcgcaccatgactaaagtgactgaaattctgtgggttcgacgggtcatggggctgagttgggaccatgtgaccacagggctttgatgaggaaccccccataccgcccatgctggggcccacctggaggaaataggcccagagaggcacgccctggtgagaggccgaataagggtggaccacaggggactgccaggggccctggccgcaggactgcccgtcccagctgtctctggccctggggaggggctcagtagggaggggcgggaagcacctggcagtttcagtttcgccaggaagcggctgcctgctgtctcccttcccacccgccgcccggagagccccccaggtggggacggccccttgcactgcagacgaggaagccccagctgaggggccgcaggacaagcctcacggctcctggcagtggggacagagccaggcccagcctcagctgcgtctcaggaggacctggggtgggagaagcccctgggggccgagagcagatgagggcagatctgactggcatcttctgtcacctgctggtgaccttttagaacacgtggtcccaacccttggtctagaatatgctgccgtgttggaggggcagaagcagctgagacggctgtccgtcccccgcctgtcagtccgtctgtctggggctgggggtgtcaggacaacacccaccactgcaggcccccttgggaataagcggcaagaagcttcggggtccagtttgcaccgagcccctccagcggggacgcctctttcatttctgcaccctgcgcctggcacggaggggtgtgcggtcagcgggtgggggctgattgggtgacttgcagtgacagggtggcgaggccctggacctgagtgccatgtgacccccatggaccataacccctctgagctccagggtctgcagcgctgcaggcctcacacaaatcgggggccaggagcctaagatctgctctctaaatctgggagcccagccagagcaagccctcagcagacccagccccagtgtgcggcctggtgcccccgttttgaggaatcccccatcctctcgtgagcagtcggctgggtcaggctggctccaccggctctgggattcggctgcagcctggcccggatgccgccggggtcaccgccatctggagtgaggggctgcagcggacacggctggagggacggttgcaaggtcccctcccccactctgtccccctcaggtctgtgaagtcgggactttctagacactcaaaacacacctggacttgggagctcaggaggaagctccgggagcccacagggtggggtgaattctccagttccttctctactgggctccctcccggctggtgcctcctggccttggcaggggtgggaggcctggtgtctgcagggccagctgcgggggtcgcaagagcggggccccttgggaaggagtgccaggaagagggtctttcctcaccaaatcccaccccagccttcaggaggggctcgccgccaccccgttttacaaacaggagacaggctggggtcagcgtggccggtggacagcagtttccattcccaccatggtcgggtccagccactgcccctcacagaccagggagccgagggagaggggggcggggccggcctgacgacgcacagacctcagcaccgcccgtggggctgcatcttgcaggctcagggcagcaggccaggcttggctgccagggtgcgagtggcaggtgccggggggcaggtgctggggctcccggtgggccctactagagggcaccgtggacccggtccagttagggtgagcatggcctggggggttgcgatttggcagagcccccgatcttctgcaaggctgtgggttcaccccatccccctccacaggggcctcccaaaatgagccccagaagctgtggctgttggaggcttctgccatgtcttctcaggagggcatgccttctggccccactcctcccagggagaaagccacacttggggccctcaccccaggagtcctcgtctccacaaagggggcgcctggaaaagctgatggaaattcacgtcagtgggaggcaggcctgggggaggggttggcccactctccaaaagctgccagtgaaacggctgctctgcagctgtcctgggccgagagaggatttcactccaggaggcggtggcggcggccccaagccggcagccttgctgtgtgatcagctgggtgtcaggatgtgcttgatccaggggtcggcgacgcgggtgtcaggcagcacctgcgtggggcttcctcaggtgaagcaaggagacggagaggtgggttcggaggggctcagctgagggcgcggctctcgtctcagagcagggcgtgcagtggggtccctctcctgagatgcgacctcagctgccttgcctctgggagggtccctggcagagatgcacagcctgggaggacgtggcccaccccagccccgctgtgtgagctcggctggtttcctgacctttctgatttgtgtcctcatctgaggtcagcgatgcccttgaagtgttgccgggtgaaagccgggaagggattgccgtctgccccttccctccggggccacagggcctgagttcctgggaaaactgtggagccagtccctgcctcagcaccagcaggatgcacacagccaagtaacaactgaaggaccaggagcacggaggcctcgcctcgcctggagatggaatagactcacgccttccagggctcagcaccctcctgggccagcaccgtctgctgagggccctgctgcaagcaggcaccagagcccctgtctcgtgcagccgacgctgggggccgggggatgagtagtacgtaagggggcagctggtttttctcatggggtgacagattgaaggagaggaacaccgagggaaggaggtcggtcgggagggggctcctcggcgagggcatagcacaggcacgggctcgggaggcttgtggagccgccaggcagccggggctgtgagtgccggaggccgacgcggtggggtcgggccgggagggctgggccgtgggtgtgcgcaggtgtgatgtggctgacgtgttttcatcaactcaattttcctttttttttaaagacacggtctccctctgtcatccaggctggagtgcaggggcgcaatcttggctcactgcaacctctgcctcctgggttcacacgattctcccgcctcagcctcccgagtagctgggattacaagcacccactaccacactcagctaatttttgtatatttactagaggcagggttttgccatgttggccagactggtctcggaatcctggcctcaagtgatccgcctgcctcggcctcccaaagtgctaggattacaggcatgagtcacggcacctggccttgatttttcaaatgacatggtgacccagccactctctgcccacctgagagagctgcctggggcctggggtgggcagagctgggagaggaagcccctcggtggggtccccgctgtggacctgtgtcctgggcaactgcccgacaggcctgggagcggccgtcctgggggtggacttgggggttttgtgctgagaacttcattggcgcctgctgcaggccggcctctggctttgtaacagtcgacctgagtgacccagtccacagctcccagctggagttccttcaaagggtgggtgggcggccctcagacaggcctctcttttccctgcttctctccagctgcccctggccgacgtctcctcggaggagcactggccggcgagtcctggctcagctgtgaccaatcggcctctccctgaggccgctcttcctgcctgcgcctccccggtcaactgcagtcacggaagtgaaagtgccggaaaacccctgcccagcgcccaggcaggttaacgggacgcactgcttctcggtccacatgtggtgagaagtgaaagttgtcttcgcctaaagagtggcctcctagagccgcccccatggggccacttcctccaggaagctggcccggattgcaccctgaccctaggcaccgcccctgtcttcctaggtgctgattcaaggtctttctgctggacaggaggacatggctggttgctgtccttgtgtgtggggatgggctggtatggggaaggagcggagcattccagcagccactgaggcctcagggaagcagtgccacgcttactggggagggagggagggaggtgcacttatgggacctggaaagctggctgcacctggcagtgaggacgtgcccagagcccctgctccctgctctgtgccagtggagcctccggtggggagatagttgggggggagtcaggctttgtcccaccgtccactctcctgaggacttcctgcctctgtggatgcccctctctctattactagctcatccattcctcttcaccctctggccccagagctctgcactctgccgcctctgtctgaccttcgtaaatcctccctcatggagctgtccatgcactggcagccctgtccccttgcgatgctgctggctttctgccatgactgacccaggagggattccagggcaagcttccctccgagcctggggctggactccacggtcagtctgatttcacagcagcaagatcctcacatctccagcccatctgcctctgccccacagggtcagcagagcctgctgtgtgcctctcagaacctcagtctcttcttctgtgatagcagtaacagcagcactcccaggctggctccccgacatggagccccccaacaccatgtggtcaacaaaaggggggacaggaggcgggaggtgaggtctgagggtgctggggaccttgggatgatggctgtgatggcactttgctcacagacacaggtctgacagctaccatccggcccctttgcaggcacccttggggctgcctgtctgtctgtctgtggcctcagacgtcttgtcatgcacacactgacctccctgcctctggctggagcccacagacaccctggccgagctctgcatgatccaccagctccaaagcccagcagacacagggcctgcggctgaaggaggagtcgggctgagaccgcccggctgctcatgtccactccccctcccaccgcgcccccttgatggggcacctcccataaccggggctgcctgcagcctctccagtgcctccctgtgtcccaccgcctggagtgcagagtgagtggctggagctctggcctagggtgggctgggccttagaagaaggaggcagaggaagatttgggagggaggagacggccttgcaaagacagaggtagtggctgcggcacggcggccacagcccaggaacacctgggaccagcaggacctggagaaggcaggacctggaggagcacggccatctgacgccttagtttcggacttccagcctgcggcactgtgagaacagaagcctctgttgttctgagcccccagccagcttgcagcccatccttactgcagccccaggagatagaaacacccggggagggcaatccagacccagaacattccagacccagaaccttccaatgcagaatattccggacccagaacattccaaacccagaacattccggacccagaacattctggacccaggacgttccagacccacaacattccagaggacagctgggcctggatggccacttgaggggatggaggatggagagtgagtggtggcaaagcccagccccaagggcaaggtcgggtagagggagcccaggctgaccgcaggctctggacgtgacccctttgccaggtgggctccagccagggctcaagcttcctgcacggatggtgccttcacagcatctgcccagtccccataacatctgcccgccttgcccggtccccataacatctcccgccttgcccggtccccataacacccgcccgcctttgcctgcacccctccactgatagtgctcaccacctccccgagatcccacgtcgtccctctaaggtgacaccaggcaggcctgactcagtttctcccccatggaggtcccagcacatggcactgaaacttctctgcctcagcctacacttgccaggtggatttcaaaatctctgtccctggcaccctcctcgggtgacctggttcccatccctctctcctgaggcagtcaggtcacctttctgacctccgcctcttcttctgcaaagtgggcttggggggacaaggcggtgagagcctgcacagctccgagcacacacagcgggcgcctcgtaaacccagcaccgcaagcaccgtcttcaggggttccttctgcaccactgggcccaggggtcagtgaggatccagaccctccgcgtgagggggctggtgaaggagcccagggaaggggtcccggcccccagacggcggcgtgtgctctgtggccatcttctgattgcttacacctcagcccccaggacgctgtcagaggagacgaggggctgaggtcctcccaccccctgcacagcacacagacgtctctcctgcccgccaccaaacgcgcagcaacacagccctgctcagtacgcctttggtctaaagacaggaaggttcttctacttcagcttttagaaatattactgttctccccagagtttaaagccaatcggcctgttttcaggcctcaaaggttttaggaactcttgggaggcctgtgtgcctgacagccacacagtggggctgaggtgccctcaggtctgtccaggaccccccgcagttcccatgccccccatggcccccgctcctccagccaggcgaggcttgatgccgaggctttctggcatcacaaggctcccacatctgtcccctgggggccttgggaggcccctggggtacaggatgagaagccccaagtgctggtattcacatgtaactctgctgcctgatgtggctaaggctgtcccatgggtaccctggaatagggccgggtggttgcacggacagaagcccctagaagccaggggcaggaccccgcacccaagtgagaccctgctccctcctcacattgcagcccctaagcaggggctccctgggggtgggcacagtggctgggtactctgtgttagaggccaccctggccctctgctcctgacctgcagccatgtcagaggtccaccctgaccctctctgctccacatctttagccatgtcagaggtccaccctgaccctctgctcctcacctgcagccatgtcagaggcccgccctgaccctctgtttcatgcctctagccagcagcccctcgcatgactcaggcacggggccacctcttggccctaacctccttccacggtagacacccccgtccttccacagtagacgcccccatcctaacaaagcggcggctctccatgcgcctcagagcccgtctctctccgcgccggtgagaacctgctctcacgcggggagcaggtcggaagggtctgaaccatgaggaaactgaggcccagggaggaagcacccggcccaaggccactcagcgccaggggatagacagggccgctccagagaggacgggatggcagatgccagggccagtgggctggtgctgccttgaaggtggctctgagtcacccattcgggagaaacgaacagtagcactggctgtggtgaggtccggcctttgcattccgggcacccggggttgggaagttcctgctcacatctggggcccttgtgggggatggccctggggccccacgggcagctgcaggtgggaacagcctcaggcagccgccgccaggacctgctcagggaatgtggtctccagagatggggacacccctcggtcccgggttctgtgtgtgagtgtcaggggtgcagtcagaccttggacctgacggcctcagtgagagccccgcgagacgggagactgtgagctcctgaaggttccgacggctgctgggagtgtggccacgagggccactgggaatcggggccaccagcctgcagctgcagcccccagcgtccggggatccttgtcctgggacttcgcaggctcgggtggggggtatcagcaatagctggcgtcctgctggactggacccctccccagagcccgaagcccccagaagggcaggcccaggttccccgtaaacccccactgccctggctggaatcgttcctcggacaggggcccagggttgggtccatttcctcctcaccggggtcttgggccagtgccctcccctctggcctcagtttcctcatccaacctgctgtgaggtgtcacacccggagggcatcccaggaggaggagggctctctttctaggacccccccatcacttcccggctgcggccctcccacccccaggagaacacagcccaccctcctagacggggctgagcagcccggcctccagcatctgcctctgggtggggctggggcacctggctggcacctgccaaaccctcaccagcccacctgccccagctgtgcaggacctgcctgtggggtggccctgttgatatctgaggtgagtcaacacggccatccgtgccggcactgtcaactaagctgggcaggccccgcgaagctctaaggagtcacagccccggcaccggctgccgctctctgcccccaccccaccaccttcccctcgagcctcttacctgggccgcccttcctgggaccccggggtgcggagcagccggcagatgccaggaggccgctctccagcacagggtgcgtctgggacatggagccacaggtggatcccgaggctgaactggctgccctgtccctcagtcttgaagccggcatgaggagggccaccctcaggggccaacctggagcccaggacaggcctctaccaggactgcctttcccgacctcctgcagccttgagggaaagaggaggggctgggccagctggggcgtcctggagttgggcctctgtccctggaaagccgaggccctcccggccaccaactgggtgtcctctgccctggggagggggtgggagccctggggctcatgtgacgcggggcgggcctggggctgcaggctggggaaggtctccctgcagcctgcgggtgaggcagccagctgt

SEQ ID NO: 414 - DNA, 17230 bp, Homo sapiens
tgtgggtctgtagaaatgaattttatttatttaattcagatctttgagaaatttacacaaaattgcagtgaagatgaaggcaacaaaatattttcaaactgaaacacccagccgtcagctattgtggatactgtcgagagcaaaaaccaccagtgccagtcagcatctggtaaaggaggttttccagctcggtccaatcccttcattttcttggcaagtaagaggctgtctcccatttttcaggcaaccttttcatcatttctcatctcttctttcaatgcaccacaagagggcagtgttttatcatattctccttgaattatataataccaacagtggaatgagatgacttccagaagtagaaattgactattatgccaaaactgttcaccaaagttgataaaactctaggtttacaattgtaccccaaggtcatgggactggaccccatcccatagtaagtcatcagtttagcaatgataaagaaaataaccttctgaaaatttgtatagatcagaaataaagtattttttgtggaagactatttttaagtattgaaggtactatttcctttcttgaattcatattgcagatgtacggtgtggatttattggtttatctctgcaaaccttaaagtagaagattgcaagggccaggtgtggtggatcacgcctgtaatcccagcactttgggaggctgaggtaggcggatcacctgaggtcaggagtttgagaccagcctggccaacatggtgaaacgccgtctctactaaaaatacaaaaattagtcaggcatgatggcaggcgcctgtcatcccagctactagggaggctgaggcaggagaattgctggaacctgggaggcagaggttgcagtgagccgagatcacaccactgcactccagcctgggtaacagagcaagactgcttcaaaaaaaaattttttttaattaaaaaaaaagtagatgactgcagcaaagaagagatttattagctcttcctttcaaggtatctgtgtactgtatataaacaacaaaagctgaccaagagtggtacttgtgctaggcatattagtaactgctttgtaattgaaagcaagaaatatcataaacaagcattagatggctaactaccaaacaagttaagtcccttagggcaggtagattcagtcttttccttctctgagcaattcccttctgccataaactacagagaggtgattaatagaacattggagagttgaatgatacctagccaaactgtaccctaaaactttagccctaaaaagaggaattaaattgtgtagatgcctttaaagaacatttttctagcatctttctacatctttccctaagtggcctcttgagcccagtcggattttggttatatgccatgatagtaatcataagaatcagttaaaaatgatccaaaaatgcacgaatacagtcgattccctctcatttattccttgtggaaaaagaaaaacacaaatcttaaaaactaaagcaagtcagggaagcctggaaagatacccagatttgataacatgttagaaggaaatccaggctaaggaatctcattttctagctttgatctggttgtcagttgggatggacttgcccaagtgatggcccacagaaaggccaaatttcttgtttttctcctcatcctgtacctcttttttcattaagaatcctgcctggaagtttaggtcaaagaggctgcttggagcaaaatacagtggtgtctcatcccaaatattctccaggcgtttcttccatccttccaggatttgaattcgggcgtctgctggagtgtgcccaatgctatatgtcagttgaggttctaagacttggaagccacagaaatgcagaatgccactctgaggatacagaaagcacagagaggtaagtcaaccaattccatgcagttgtactataaacaacagaagttggtctgggcttctcagtaagacactctgataaggaggcctcaggcacactagagaatcagttcagagctagcgtctctctcttaccctctacctagccgttaccaattttagccttctcaggtgtgttcttctttaaatgcataaaccttgaaactgtgccaacctggatcctttgccaagaaggctggaagttctgttactttagggagtctcagtttcttggcaggtgactcaccaagacctgcgtgggtgcatttctctgcctctccatataactagatgagtcctttttttctttttctttttttttttttttttgaggcagagtctcgctcggtcgtccaggctggagtgccatggcacgatctcggctcattgcggcttccacttcctgggttcaagcggttctcctgcctcagcctcccgagtagctgggattacaggcatgcgccaccatgcccagataatttttgtatctttagtagagacagggtttcactgtgttgaccaggctggtctcgaactcctgacctcaagtgatccgcctgcctcagtctcccaaagtgctgggattacaggcccagatgagtcttgataaatgattttcataagtggccactcactggctcttctctccaacctccctctttatagaaattatcttgagggtttggtaacaccaataagcccaccccaggcttcagttttatccatgtataaactggctggactaaattatttcctttttcttcgaaacagggtctcgccctgtatcccaggctggcatgcagtggtgtgatcatagctcattgcagcctcgaactcctgggtctctcactttagactcccaagtagctgggaccacaggtgtatgactacacccagctaattttgttttttttttttgtagagatgaggtcttatatgttgcccaggctggtctcaaagtcctgggctcaagcgatccttctgcctcagcctcccagtaaatcatttcttaaattgtcttgggctctaatagtctatgggactgtatcagcaacctggagaaggacaggaaggctggagagagatgtcagtcatctggtgagaccagggcccacggctatacaaatcaagagtagtgattcacactagtccttggctgggacagaatgctgtttgaacacatgcacacgcaggtgtgttcacacacaggcacctgggaaggcaggcaggttcttaaaggaggctcccatcattctgaattatgaccatgctttcatcttcacaactcaagatctattttcagatgctatcttgaggttttgaaccccacgaaggctcaatgaatgaattcccctgaaggttcgttgaaaatgaggtacctggccaggtgcagtggctcacgcctgtaatcacagcactttgggaggctgaggcaggagaatcatttgaggtcaagtgtttgaaaccagcctggctaacatggcaagaccccgtctctactaaaaaatacaaaaattagccgagtgtggtggcgggtgcctgtcagtaggctgaggcaggagaattgctcgaacccagcgggcggagcttgtagtgaactaagatggtgtcactgcactccagcctagatgacagagtgagactccgtctcaaagaaaaaaaagaaaagaaaagaaaatgaggtacctgaattggccagagaatgacattcatgtccccgtggatcccttgcagagagtacatggagccactgccaccagtggtgatggaaagcactgccttcttactctgcaaaagaaaaagcaataacaaacttcacttccctccacatccccttggtgacaagaagttaatgaaacagctccagggaaaagaacacacaagtctgtcctatttgctgtttatattacttcatactttggctcccctgagctacataatatgactctgcaggagtgccagcctagatggtctacagaccggtggcctggggcaaatgaaggattccaaacccccacatgtggcttaggacgaggctgtcaccatatccaaaatcagtgctggctgctggctgcctaggtggagttattggttgttcttatccatcctcccacgggctaggcatggcgtaggacaagctctttcatctggaaggtctcgaagggttccctgtgcaggatttgggcctccaaaaaatgaagacaggccttcttttgtttttattatggaaatttttaacacatgtaaatgagaaaatagtgctgcatctatcactcaccttcacctctcagtattctgctattctagttttagctcgacccatgaccccctttttctctggagcgttttattttattttattatttcattttttttttcctgtgagacagagtctggctctgttgcccaggctggggtgcagtagcaccatctcaaccaactgcaaactgtctcccgggttcaagtgattctcctgcctcagcctcccaaatagttgggattacaggtgcccaccaccacatccggctaattttttttttgtttttgtttttgatatggaggctcgctctgtcacccagcctggagtgcagtggtgcgatctcggctcactgcaacctctgcctcccgggttcaagcaactatcttgcctcagcctcccgagtacctgggactacaggcacgtgccaccgcacccggctaagtttttttgtatttttagtagagacggggtttcgccgtgttaggcaggatagtcttgatctcctgaccttgtgatccgcctgcctcggcctcccaaagtgctgggattacaggtatgagccaccgtgcttggccttttattttttaagatggagtcttgctttgttgcccaggctggagtgcagtggcgcgatcttggctcactgtaacctccacctcctgggtttcaagcaattctcctggctcagcctcctgagtagctgggattgtagatgcccgccaccacacccagctaatttttgtatttttggtagagacggggtttcgccatgttggccagactggtctcaaactcctgacctcaggtgatctgcctgcctcggcctcccaaagtgctgaaattacaggcgtgagccactgcgcccggcctctggagcattttaaaacaaatcccaaacatcatgtcattccatctgtaaaaacttgatcatgcgtctctcccgaaggacctggagcctaggcttaggatctaattgtgctcaaaaccctgcatcagagccgggcacagtggctcacaccggtaatcacagcactttgggaggctgaggcgggtagatcacctgaggtcaggagttcaagaccagcctgaccaacatggagaaaccccgtctctactagaaatacaaaattagccgggcatggtggcatatgcctgtaatcccagctactcgggaggctgaggcaggagaatcgcttgaactcaggaggtggaggttgcagtgagccgagatcccgccactgcactccagcctgggcaacaagagggaagctccatctcaaacaaacaaacaaacaaacacccctgcatcaggacagaccacccagaagctggctgtcagagcattcagaaccatccacctacccggaagggtcctttgtcatacatggcagcgtaagtgtaagcaaactctcctatgaacactcgctcaaaccagcctttcagaatggcagggactccaaaccactgcagggggaactgtgggacagaagacatcattgaggtaagaccaggggctccccaagcccagaaggtggctcggagtgctgagccgctccccatgatggcactgtgtgggaagcccctcttcacacctttcccattcctcctggggagttagcactttaaggaaagagatcattattgtccttggtcagccaacttgacagtcttctttttccctgaaaatgcaaatattgagtgggtccgagtaaagctagatacacagaagacttgttgatatgaaacttgtttgtatgaaatcacatttggcagcaaagtctaaatagcaaggattgcaaacaaggtttgcttcatgctgttgcttcaatcagtattttcccaagagtttgctttagtaggtgtggtatcaacaatatgactgttggccaggcgcagtggctcaagcctgtaatcccagccctttgggaggccaaggcgggtggatcacttgagggcatgagtttgagaccagcctggccaacatggtgaaacctcatctctactaaaaataccaaaatcaaccgggcgtggtggcgcacgcctgtagtcctagctactcgggctgttgaggcaggagaatcacttgaacccgggaggtggaggttacagtgagccgagatcgtgccactgcactccagcctgggtgacagagtgagaccccatcgtggaaaaaaatgtaggccttcttcattttatgactgtcccttgttatcgtggatgaaaaatcatatcacttagaataaacaaaatcactcaaaaatgcaaactaataatcagtgtgatggctgagtgtggttgctcatgcctataatcccagtattttgggaggccaaggtgggaggaccacttgagcccaggagtttgagaccagcctgggcaacaaagtgagactttgtctctacaaaaaaatttaaaaattagcctgatgtgatggtgcacatctctagtcccagctatatgagaggctgaggcaggaggattgcttgagcccaggagttggaggctgcagggagctgtgatcaccactgtattccagcctgggtgacagagcaagactccatctctaaataataataataataataataataatcatcatcatcatcaacgtggctaggtgcagttgctcatgcctttaattctagcacttttggaggccaaggtgggtggatcacttgaggtcaggaatttgagaccagcctggccaacatggggaaaccctgtttctactaaaaatacaaaaagtcaagcgtggtggtgcatgcctgtagtcccagctacttgggaggctgaggcaggaaaatggcttgaacccgggaggcggaggttgcagtgagccgagattgcaccattgcactccagcctgggcaacagagcgagactccatctcaaaaacaaataaataaataaataaaatgttaaaaaataaaaattataataaataataattagggtgactaaggttcatcagggacttcccatgagaaagtcttgtctgacctcttatcctaataaaagcagagtaaggactataccaggaggttttcttatccttgattcatgatttaaagatatgaaaggcacatgcctataatcccagccttttgggaggtccaggcaggcagatcacttgagcccaagagtttgagaccagcctgggcaacatggtgagaccctatttgtacaaaaaaattaaaaaattagcagggcatggtggtgtgcactgatagtcccagctattcgggagactgaggtgggaggatcatttgagcccaggaggttgaggcagcagtgagcagagatcatgccactgcactccatcctgggtgaccgtgagaccttgtctccaatttaatttttttttaaagccgtcctttggggtactggctagtggcatgtggctttgattcttagcaacaggcctgtgggtaaaataaaggacttcaaggattggatgttttgtagctgattgaataactaaaaaaaaaaaagagagagagagagaaaaaaaaaacacagcctgtaccaccctcctcgtggtttccaggatcatatacattctatgttcaatatcaaaagactggctggaattgtaaaagcaaagtcattgagtacagtcacatttataggaaagatcactgacgagatgcacgcacaatcccagcattgtctgctaaacggtaaggcagcttcccgaagaagaaaggccgtggtttgctgcaggaacacattcagcagggtttcaaagcccccttcagctggcaggctacaatggcagagaagtcaatgtctcatggattattctacaaagtatttgggattcttatggagaaaggaggagaactgcaaattttgagagagtccaacaggaatcgctaaccgcaggattcgctaactgaaggaatcgctaactgaaggaatcgctaactgaaggggagactaagtacctggaagaaagcaagctcaaggactgtacatcatctctgcagctgcatttctttctttcttttttttttttttttgagacagaatctcgctctgtcgccatgtcaccaggatggggtgcagtggcgcaatcttggttcacttcaacctccacctcccgggttcaagtgattctcctgcctcagcctccagagtagctgggactacaggcacatgccaccacgcccagctaatttttgtacttttagtaaagacagggtttcaccatgttggtcaggatggtcttggtctcttgaccttgtgattcacctgccttggcctcccaaagtgctgggattacaggcgtgagccaccgtgcctggccttgcagttgcatttacacatgcaacagtaatacagccagattcccaatatctgtgaaatccatgtaatactgcacctttaaagtaatcacccttatttgcagagaatgcagtaaagtgggtaactgtttaagatctcatagctaattaggtacatgtctaggacaataagcacgcaaatgtccctgacaccccttccgatgtccccccatacctggaatatcacaaggtctgcggcttccagcttcttttgttcagccacaatatctgggctcagatggccttctttataagccagaacagactcggcaggatactgaaagttcgcagggtccttcagtttacctgcagagaagaaaaagagaggctggggccagaggggccaaagctgggccagaggacccacaggcaaggagatccgcaaagaactaattaaagaggggaggaggaactcctcctacctgtgatgtcctttctggaaatgatgggattgaagttcatggcatagaggtccgactccaccacctcccatcctttcttcttcaaagccgctgcagcagcctccttcatggcatagttgaaggacgtcctctctgagtgagccagtacgatcagtgctcttctgcctacagagacacacacaaagcacacacggaaaacccattaccaaccagcaaaccttcagctacaggggagttgcagtctgtaaaggagggggcggctttgtttgacattaggttattgcattccatctcctgtagccagaaatgtattttccccttaaaagcactgaagattaaaggaagcatttaaatcagtggctgatttaataaataatgttgacaactgggctctgtggctcataactgtaatcccagcactttgggaggccaaggtgggcagatcacctgaggtcaggagtttgagaccagcctggccaacatggtgaaaccctgtctctactaaaaatacaaaaattagctgggtgtggtggcaggcacctgtaatcccagctacttgggaggctgaggcaggagaatcacttgaactcgggagggggaggttgcagtgagccaagattgcaccattgcactccagcctgggtgacaatgggagactccgtctcaaaaaaaaaaaaagatgctctgcgtgacctgtcaggaaaagcaaaattaaaatgagacatttacccattcgtttacatgggtactgtgtttacatttaccgtgagtttacatttacccacaaaatgtaaaacaaataacacccagggttattaagattgtaccaacagaaaaattggcaccttactggtggggataagaactgcctcaacctttagggaaagtaatgaggcagaatctcttgaaactttaaagacacataaatcttttatctcgctctccaatttgggggaatctgttctacagactaaaagcttcaggctataagagcaaagatgtgtattacaccatgcttttcactggcaaaaattagatataacctgattgtctatggggaacattttaagaaattatgggtacatccacactacaggatattttgctgttaacaagaatgagttggccaggcacggtggttcgagcctgtaatcccagcactttgggaggctgaggcgggcaggtcacgaggtcaagagatcaagaccatcctggccaacatggtgaaaccctgtctctacaaaaatacaaaaattagctgggtgtggtagcgggcacctgtaatcccagctattcgggagcctgaggcaggagaatcgcttgaacccaggaagcagaggttgcagtgagctgagatcttgccactgcactccagcctgggtgacagagtaagaccctgtctcagaaaaataaataaattaagataaaagtaaaaaatatataaaaaagaatgagttaaactggctgggcacagtggctggagcctgtaatccagctacttggaaggctgaggcggcaagatcccttgaggccaggagatggagaccagcatgggcagcatagtgacaccttgtcataaaaaaaaatttttagagactgttgaccaggtacggttgctcacgcttctaattccagcactttgggaggccaaggcgggaacattgcttgagcccaggagttcaagaccagcctgggcaacatgacaaaagcgaaatcccttctctacaaaacgtacaaaaattagctgggcatggtggtgtatgcctgtagtcccaactactcaggaggctgagagatggaaggatcacttgaacccaggaggttgaggctgcagtgatccgtgatcgccgcactgcactccagcctgggtgacagagggagaccctgtctcaaataaacaaattttaaaaattaaaaaaattaaaatgaattaactatatgtagtgactcaaaaagatatccatgctatattattaactgataaaaaagcaagtgaatatgaacccatttttatttaaaatgaaagaagtgagaggaagggagagagggaagggaaggaagaaaaaagaaaatacaaaaaaaaaagaaaaaaagaaatgacatatatttgtatgtagacttgcagcaccttggtatgagggggaaaaatgtgcagtgatcacattaaacttttttttttttttgacagtctcactctgttgcccaggctggagtgcagtggcatgaacttggctcactgcaacctccgcctctcaggttcaagcgattctcctgcctcagcatccccagtagctaggattacaggtgtgagccaccgtgccaggccaatcacattgaactattaacagctcagcttcctttataagaaatggcaaagaggtacaggtagaagggaaatgggcctcttttatattaacaaggttgtcagaggcagcatgcttcaatttgcaagaacagtatttagtggatccttagtgctaggcactgccctaagtgctttgcattccttttttttctttttctctttctgagacagggtctcgatctgttgcccaggctggaatgcagtggcatgatctcaggtcactgcagccttgacctctcaggctcaagctatcctcccacctcagcctcctgagtagctgatactacaggtgtgcaccaccacacctaattttttttttttttttgtagagacagggatttgccatgttgcccaggctggtcaaatttggagccgtgttgcccaggctggggcaattttgcctgcctcagcctcctacaatgttgggattataggtgtgagcaaccacgcccggcctgcactttcttcctttgtcaggacaacctgctatgttttaaacgtgtccccctccaaaattcaggtgctgccaatgtgagaggattaacagatggggcctgtgataggtgattaggcgagggggtctccttcctcatgagtgggattaaggccctcataaaagaggcttcgcccagcacggggctcacctgcccttccaccttctacctcccaccgtctatgtaaggacgcagcattcctccaaatgcagctctcaccagacagccaaacctgccagcaccttgatcttcgacttcccagcttccagaactgtgagaaatcaatttctcttttttattaactacctagtcccaagtattatgtatggcagcacaaaatagactgagacacaccctatgaggtcaataccatgagtagccccatgttacagatgagaaaactgaggcacaggagagaagcaagttacccaagtgtgtagtcattaagtggtgaagctggaataatttaaaaacacagagagtggctgggcgtggtggctcacacctgtaatcccagcactttgggaagccgaggcaggcagcttgcttgagcccaggagtttgagaccagcctggctaacatggagaaaccccgtttctaccaaaaaaaaaaaaaaaaaaaaaattagctgagcgtagtggtgtgtgcctgtagtcccagctacttaggaagctgaggtgggaagatcatttgagccagggaggtggaggttgcagtgagccgtgatcacaccactgtactccagcctgggcgacagtgagacttacaaacagtgagaaatacaaacaacagcgtacaagggcatagagcgaattgccagagaaaggacgcttacccccacagttgctcctgataatgtgcgctgctacttcataccctaccatgaacagtgggtggagctgggagagaaggcatctgcaacttttttggcagggtgggggtgggggcgggggagatggagtcttgctctgtcacccaggctggagtgcagtggcgccatctcggcttacagcaacttctgcctcccgggttcaagcgattctccttcctcagcctccgaatagctgggattacaggcgcgtgccaccacgcccggctaattttttgtattttttgttttagtagagacaccatgttagccaggatggtctcgatgtcctaacctcatgacccacctgccttggcctcccaaagtgctgggattacaggcgtgagccaccgcgcccagccggcatctgcaacttttttgcaccatctgaataactagaaataactaaaataactagaaaggcacatttaaaccttaagctctcttcctgcttttattattgaccacatctagcaaggcaagtgcctcttgggctaaattcagcgaagtgtaactttcagggcccaatatgccaaaccaggggatttccaaacttggtcctagggttttggactcttaaaactaagactcagtggaataggtgtctggtgatgatttcaatgcgctggaagtgattgacttgcttgggatagcttggaaaaaggaaaaggaagctctgaggctgcctcaacaaattcctacctctttaacccatggatttaacatgattgggagggaagtgagcatattcagctctaacaggcattttctttgtaacttaccttgccattagtcttatcaatgtttactgatcgccgctctgacagtttttgtttgtttgtttttttgagacagagtttcgctctgtcgcccaggctggagtgcagtggcgcgatctcggctcactgcaagctccgcctcccaggttcacgccattctcctgcctcagcctccagagtagctgggattacaggcgctcgccgccacgcccggctaattgtatttttagtagagacggggtttcaccgtgttagccaggatggtctcgatttcctgacctcgtgatccgcctgtctcggcctcccaaactgctgggattacaggcgtgagccacagcgcccagccaacagtttttattttattgacttctcatcaatgttaacaagcattttctaagtagtaagacagtcaaggcacttctcagaaaatgagcaaatcaggatatccatctcttgctctttcaaggagctcagactctaatagctataagcaggcctgtgactttacaatttttcatgtaaggcaacacacaagcaggaataatatatttgcaacaaatataaccatcaaagtgcagtacctggaataggtagatccccaaaacaactcaaaagaaaaatgatcaaaagaaggttgtgggtgggtcgcggtggctcacacctgtaatctcagcactttgggaggctgaggcgggcagatcacctcatgtcaggagttagagaccagcctggttaacatggtgaaaccccgtctctactaaaaatacaaaaaaaaattaaccaggtgtagtggcaggtgcctgtaatcccagctaatcgggaggctgaggcaggagaattgcttgaatccaggaggcggaggttgcaatgagccgagatcgcaccattgcactccagcctgcgcaacagagcaagcctctgtctcaaacaaacaaacaaaaagatgcttgtgaataggcaatttaaaagttttctgggccctggagggttcattttcccttcctgccacttaactagctgagcaacatgacctgggaggagttagactattagagtttaccctgagagaggccacaagatgcacacacggataacctcttcagggtacaatggcattagtgtgttaggagaggtaagggacaaagttcaacagaaggctgggtgtggtggctcatgcctgtaatcgtagcactttgggagaccgaggcgggtggattacttgaggtcaggagctagagaccagcctggccaacatggtgaaaccccgtctctactaaaaatacacaattagctgggcgtggtggtgggcgcctgtaatcccagctacttgggaggctgcagcacaagaatcgtttgaacctgggaagtggagattgcaatgagccaagatcacgccactgcactacagcctgggcaacagagtgagtgagactccatctcaaaaagttcaacagaggaaaacttcaggacctcagggctggcccattcggaaaggccctcagaggagcttgccatttgagctgaatcttggtcttgaactcctggcctcaagcagtcctcccgcctcagcctcccaaaagtgctgggattacaggaatgagccaccactcccagccaaaattttttttttttttaattagctgggtttcaagttcttctgctctgaccaaaaaaaattagctgggtgtggtggcacacacctgtagtcccagctactcgggggcaaagatgggacaatcacttgagcccaggaggtcaaggctgaagtgagccctgatcatgccactgcactccagcctgggcaacaaagcaagaccctgtctcaaaaagaaaaaaagaagtatgataaagataagcctttgtatcagtttcatgcattctccttctgccttctcttctcacttgagtgctccagggaacatgagtgcaaatcagatgcatctattagttgcaaacaaaaaacctggatgctttagttaacctcaagatttggttagctgggtacagctaaaactaattatacaagatccaagtcttcccttttcacctcattaccaccgcccttttttgtgtttaagctacacgtaaatacagaacattctgtaagattgaaaagtcaggaaatagttcctgccctagtattggaggagagggtgccagtgcctcgacgctgaagaatgaaatacaagggaaacagcaaccaccgtgtatgcggcaagcctctcagctgtcagaatctattccctgctgtctctgccagtaactcatgctgggctaccaatccccagcttagtccctttctcagagatcctgataatttcagtttgtcaactgcaagggcagtctgttcctccactcactttgaccaagatgggcttctttgtgtacaggcgcatttttagaggcaggaccaggtccacagggaaggaaattacaaaacacaggattctgccccagatgaggcaacagctttctaaatcttagtactgtccaatctcagagtgagattatttgggaaacagctctcaatccctgcagttgtctcagctggttatttatgccttgggtggagctggggtgacctctgagttcccctagggtcgatggccgagtgggaaggctctatcactgaagtggacccaatactagaaacggatccagtacgatctgatcaggtttgcctaatccaagggcctcaatggaaaatgcctcccaaggccaggcacggtggctcacgtcagtaatctcagcacttggggaggctgaggtgggtggatcacctgaggtcaggagttcaagaccgcgctggccaacttggcgaaacccgtctgtactaaaaatataaaaattagccgcgcatgatggcgcactcctgtaatcccagctactcgggaggctgagatgggagaatcgcttgaacccgggaggcggaagtttcgctgagctgagatagcgccattgcactacagcctgggcgacaagagcaaaactccgtctcaaacaaaacaaaacaaaacaaaacaaaacaaaacctgtgcctggcagcctggagccggttctggtctccgtcaaaccaaaggcatcagtttcctccactcctgtccaccaatcgccagatattctcattttcttcagaagctcggaatccacatttttaagtgaaatcacccattttaatgttagcaacttatttcaaagtgttttagatactatagaccaaaagaggtatgggctgtgaccgtaagcctgatttggcctctgacggccagtttctgaccacagttttggagggaatttctgcttccaaggtcaagtttctcctaaatgcccactagagttcgtggggtggagtgaggaaggatccgcgacaccggatacaaacagaagctctccttctcccggagtccgatcaaggctcatcccaggtccctaatctcttccctttgtgggttttgagtcaaggaacaaaattcagggccaagcccctacaacctcctccacaggcaccagtgctcgagagacgaccgccaagcaccccgccctttgcagcactcaccgaccatggctctggtgcagtccggggcgctgattggctgggctcgtggttgccggggcgaccctggccggaactaggctctcggtgagctgggcggctccggctgcaaccttgtgggagtcgcgtgtgtagtgcacggtgcattctctcttatatatcctgtccggcccgtttgaggtggacagcctacaagggcgg

SEQ ID NO: 415 - DNA, 17230 bp, Homo sapiens; identical to SEQ ID NO: 414

SEQ ID NO: 416 - DNA, 17230 bp, Homo sapiens; identical to SEQ ID NO: 414

SEQ ID NO: 417 - DNA, 2517 bp, Homo sapiens
gcagtggaaagttggagctgaggtgtgtggcaggcagatgagggagcagagaactgctgaacagagtgagactcagaggacgtggttgagcatggctgcgaccctgcagttcctggtttgcctggtggtagccatttgtctcctctctggtgtgactacaacccagccccatgcaggtaccaggcttcagggtgggtggagaggagccaaggctgctggctgacagcagttaacagttggctctatttgaggctagtcgggcatagaagcgtgggcatggtgggtaccaggctgatgtgtgctgtggtgggtgacagtgtgggccccacccccagaactggaaaggtacaggtgacacctagggagatagccctaggtgctcttaatgctggccctgggctcattcccactgatgcccaaagcagggtctcttgacctgcctgggcttggaacaaacattgcaagggtgaggcaacaccccaaggtgtgggccggacggagctgccacagacatcctcccctgctctgtcctccctgcctcacatcctcccctgccccgtcctccctgcctcacatcctcccctgctctgtcctccctgccctgtcttcctcctccctcccttactgctgaggaggagcagggagagtaggctctttccaaagaggtctttgtccttgggagagtcactggcactgttttaggtgactttatcctcagatgactatagggaggggaggagggtggggaagggtcttgtgacccgttggcctggagctctttaacaagggcattgtgcaatttaaaggaggtgtcctgggcatttgccaacatggtaactgggcttggaatgatgcttttgagatcagaggacctatgcctgggagggtgaatgtcaatgtgcatgtgtgtgcgtgagagggaggggaaaggagggcatgggatggcattcctgcccttttgtagaatgatgaagcactcgggacctctaccaggcagcagaggggcacttctgggaggctggggtgttcatggtgtagcatggcaggggcctgactcctctctgctgccccagggcagcccatggacagcaccagcgtgggaggtggcctgcaggagccagaggccccggaagtgatgtttgaggtctttcctcccagcctgggacatgggggtgggcacgtccagaggtccctaagctcagggttgggaagggggatgtctcagggtggacctgctagggttgggtggggcaagccagcatgcgtcctgctgcctgcttctgccccttcccccagcccactcttgctccctgccctgctccccaggccacagcccaccccttacatggctccccttgcagctgctctgggctgggctggagctggatgtcatggggcagctgcacatccaggatgaggaactagcgtccacacacccaggccgccgactcagactcctcctgcagcaccacgtgcccagtgacttggagggcactgagcagtggctgcagcagctccaggacctgcggaaggggcctcctcttagcacttgggactttgaacatctgctcctcacaggcctgtcctgcgtctaccggctccacgcagctagtgaggctgaggaacggggccgctgggcccaggtcttcgctctcctggcacaggaaacactctgggacctgtgcaaaggtttctgcccccaggaccggcccccttccctggggtcctgggcctccatccttgaccccttcccctgaccctcctcttttgttctttcacctgccattaccccctcccatctcctcctcaaccccccaggcagacccatcttgcgcaggggcttctgtctggcatctgattcttttcaccgtgttcagatctctgggcttggcttgcaccctggacaccccctctctgcttaccccgaccagatcttgtttcctagatcttgagaggctaagaacccaggctctgggtcgcaaggagtgcgcaaggagtgggcacagagctaagggcacgacttgcaggcagtgtgtgtgtgagtgtgtgtgtgtgtgtgtgtgtgtgtgtgtgtgtgtggagatcaggggtcagggttgagaagtgtgttcaagagatgctgaagggaagctgccccaagtaaggcctggtcagaccttccaactcctaccctggcagtctgtgacaggtcctgtggaattcacaggaatcctctaggtgctgagcatccccttttaggcacaaccaaggatttggggtctctgagcctccaagttcccatctgggttgggagaatcgactttttgagttctgtcagttggaagagtggagggaagcagggggagggaggaacattatctcttttggggtagggaggcaatatctcaacaagcgtcgggtgaatacctcagaggggggagtaaggctgggagaccaaggagagacaagcggaggtgggctggagcaggtgtggccctgattctgtgttgctcttctcataaaatgttctgtttcggc

SEQ ID NO: 418 - DNA, 4746 bp, Homo sapiens
gcctgggctgccgggcgctgcgcgtgcccgctttccgctttattggcagagtccaggcgcgcccggaggccgtggcgctcgcgcgggactttcgagcctccggcccggcctggcatgcacgcccctggccctcccgggctcttctctggcccggggctcacagtagctccgaggccccgaggcccggcggggcggcgggggcgaggtcggggtacaccaggaagccggagaaggtgatgtacttgccgtggttgctgtaggcgccgtagccgtcgtggtcgtggctgagcagccagacggcgtcgccgcgccgcagggccagcatcacgctctggctctgcatctcgcggcgccgcgacgcgccgtcgtcgtaaatcatggcctgcacctcgtcgcggttcttcatcagcttaaccgacagcgtcttacgcggcagcttgcccagcgtgaaggagaagaagtaggcgccgggcagacggcagcggaacacgccggccgccgcgtcgaagtcgccgccaatgttgacgaactcggtgtcgaaggcgagtggttggtgccgcggcccggggccagcgtccgagcccaccaagctgcgcgtgcgcgccgccgagaaggccgagcgcggctcggggggcgcgggcggcccgcgcgcaggcgcgtcagcgtcggcgtcggcgtagactaggtagccgctgaaggtggcgccgggcgcgcctagcgcgtactgcggggcgccatgcagccgcagccacactgtgtcgccgtagtcgagctgcagcatggcgctctggctggctgcgcgccgcgcgcctggccgccgctgctcgtcgaaggccagcgcctgcacctcgtcgcggtttcgcaccagcatcaccgacaggctcttgtgcggggccttgccagccgtgaaggagaagaagtaggcgccgggcacgcggcagcgaaactggccggtggccacatcgaagtcgcccccgatgttcacgtacaccttgtcgaaggtcaccgccatctccgacgtgccctccaggggggtggtgcgtgccgccgagaaggccgagcgcagctcagaggatcccgggccgggggtcgggcccagggcccagcaggccgctgggcccagcaggcccagcagaagcggcagcatggcgcctgggagggagacggaggggcgagagtggagtgttggcaggggcggcttccaaacgcccggctctccaccgggagacaagggttctcttcccagccctgcccttgacccacaagtaggtttcaattttcctacatccttggattctcaaactctagcgagcctcactgtcacttggagggcgtgttcaaacatacatagttgggccccatcaccagagttcattcagtaggtctgtgatgggcctgataatttgcatttctttgttttgtttgtttgttttgagatggagtctcgctctgtgaaccaggctggagtgtagtggcacgatctcgtttcactgcaacctccacctcccgggttcaagcagttctcctgccttagcctcctgagtagctgacattacaggtgcgcaccatcacgcccagctaattttttgtatctttagtagagacggggtttcaccatgttggccaggctggtcttgaactgacctcaagtgatccacctgcctcagcctcccaaagtgctgggattacaggcgtgagccatcgcgcctggccttgaaaccccgccccccccccttttttttttgagacggagtctggctgtgtcgccaggctggagtgcagtggcttgatctcggctcactgcagcctccacctcccaggttcaagcgattctcccgcctcagcctcccaagtagctgggactacaggcttgcacccagcacacccagctaatttttgtatttttagtagagacagggtttcaccatgttggccaggatggtcttgatctcttgaccttgtgatccgcctgcctcggcctcccaaagtgctgggattacaggcgtgagccaccgcgcccggccgaaacccctttcttaagtgaaagcttgaacacagactagcagaaacactctggttaaagaggcctacagccctgtctgctgggcttgcccctacacctcccatttgacactcaggggccctggtaacccgggggattcaggggagtctctgagttcccctcagctccagttggctgcattttcctgtggttattttatggtccttggtctgccactcacgcaggcactggctctctgtgtcaacgctctgcatgaccgttactgtttaagccccatctgagcaggaaaggaaatcgctgctccctgacccctttcctggcctcaccaggggcccttcctgcacagaggaggcgagaacagttgggctttgaggtagcttcctcccccttgaaatcagagtaaaagagaaggtgactcctttctctttgcttggaggctggttactcagaagaaggagtggcgagccaggggctactggggatggacagggacagcaacaattccagcagggctttggcaaggctgtgaagtcagcagctttgttccttgggagtgatggattggagaggacagatagccagatctgggttcaggtcctggctctaccactcacactgtgaaaccttgggcaggttccctaacttctctgggcatggcttcctccatgtaaatggggaagagacctcacacacaggcttgctgtgggggtgtgctgagataggtgtgaacatggtttgtcaacggcagtgctgaggtgtgcagatgcttctgtcggttgccctgacaaaagtgatctggtccagttcttgacgtaagggtttagggactcagtcactcctacccctgagagcttggtgaaggcactgcttaactcaaaggagtcactctctgatgtagggattccatcctgcttcctagtagggcacgtgctttggggcttgaatacccaaaagccctgatgtggaaacaaaacaggaaagaaatgagctggagacagcctgggatgtgggctgctttagaaaatgccctgtatgtgtagctctgtgtctcttagagacagcagggacctgctgagaagggttgtcaggtgtagatgtgcagaacgtcccagctagaatctagctcacactccacatgttagagcagcacctggcgtaaagtatgccaccttctcattctcatactaaagaccccaagttgctagccaactgaatgctgtctccttccagaggaggtgctttttgtaattctcacaaaggtgtcctatggattagttaggtgtcccttggttaggacagggaggagggaaggggccatccacagtggtgaagatggcacctcacaagtgtccagtgcattcccttttacaaagttcttttagacacatggtcttggcaaacctacaagacaggtgggccgtctcccattttatagatgagaaagctgaggcccaacaagggaaagcattttggcccaaggtcacccatggagcactgaggttttttgactcaaattccgtatgccttcctgtcactcttccctcctagacacaggtatgtccagccaatttgttctgtgcctcagtttacctttttgcaaaactaggagaggagatcagaggaatgagtcttgggatccagggtgaggaagacagaaagcaaaaccaaacaaaagcaagcaaacacattctctagtgttttgtcttctgggaacacggaaaacagctcagcttttccataccgctgctttcctagtgggtcctgccccagaagcagctgcccagcaacctcctgaccaaggctggtgcaccccaccagtgccaagggtcttcctgtgcacccagtacccagcctccgtttcacccacactgcccaattcccagatccctggatcctcgtccttccctgaacccccttccctgagcaggtcagaggtgtgggagggtgtgtcaggtgggtgtcatagctccagggaaggaaatggctgttcctggctctgtccaggtggggttcaaaatagtcatcttcaaagagaaaaactgggacacagagctggagagacccagagccccggagccaaggcgggaggtgcagcgatgtcaggctgaggggatcgcagagttcccccttgccctgccactcaccagttaacccttccctcaagccctgccagagccccctccccaacctaccttgaaagcccctcatccttccaagaagtcccactttcacagaagccaattaatccttatttttaaaaaacaaaaaccaatccctctcccccgagaccttccctccatccatccatccctttggaatgaaagcccttgtgcctgtttcacgaaaaggctcccaggtcctcctttcaaggaaaaaggacccaatttccccgcgcctccccagccctcgcttccagtaaagggggaacctcggctccctgcctcccctcagctgccctcacctggctgggggcggcggtcgagtcgggttcggtctgagcccgcgatctggctccgggctgcgggctgcgggctgcaggctgcaggctgcgggtgccgggctgcgcgctgaccgcccgcgctgcggcaggggcggcgggggctccggctgcttttcccggctctgaggcggcagcggacagggtgctggggccaggggccgggcgtggggaggcgtgagggaaagggaaggtcagctagagagggagccgagcgagagcgaag

SEQ ID NO: 419 - DNA, 25349 bp, Homo sapiens
taaacatggcacattttcccagatcatctttacttaaagattttttgggagaaaaaggtaggcagcaaacatttttatattaaaacaaatgcagatagtaatattgaaatagtatataaaattgacattactttttgagacaaaggaagagacatcaaagacattttaagccgagctcctcatgagcttcctaaaccccaggggagggaagagacccctgcattctcgttctgtctaatattatcagtggggctgttttgacagagaagtctcagaagcagcgaattaagtgcttactcatttggcaatgtcccagtgagttatataaataagtgaaaccacaggctttctcattttagagcattttaacctgctttttagaaggcctgagtaaacagaagctttatgcttgagttgaattttattttctcccaaagtgatttttttcctcctataaatgttaacatgcttaactgagggtatggcatgtgaggtggtcagtgtcctaagacccatgtcgacttgggttggcattaccagacatggagttacaaatatactttccaaggctgtcatcagaaatgcaaaactactcaccttcggcaacaataacaaaaaggaaacaaaacaaaaaactgaagaacaaaagattatatataattagaactgtatggtgtaatttaagcactggcaaatacttggctcttaaagaagggggttactcctgcaggatctgcttttcatattttatgtgaaaacaagaacttcctttgaggaaaaaagtgccattatacttcctttccaaatcttgcttattttctgtaattgtctttttctttgttgttgctgaccctttatcttatttattttttttcaggtagcctcttgaactagagtaggctcagaggctccctgtaggtgacattttattactttgcaataacagactgaaggggcagatcctcacacagactttctagggtaatgtagcaatgtactgtccttttcttgaagtatgagagacaaggtcaatgaaatgtgcttagaagcataatgggagtcagattctggtgcatgctactgacattttagggtctacccaagaaaaagtaattcataacctcccatatagtttaatttagtgattttgttaagttttacaaaattatttctcatttttcttggaattctactcttcattttacaaagccttaaattgagactcaaaaatcacatgacaaagtgcctgtagcttcaggaaaatacaactttttttcccttctggttaagtaaaataagaatttggagcaaaaatatcctaattcagaataactaaagggggagtatcagtggtaagttatgttgtgctggaaaaaagaacaaaaaaggcagacaccaaacacctgaattttcccaagattaaatgattattaaaaaagcgcgccacactgtatagaaatcaacattctctcccataattctgtgcatctgggactacagaaatgtcactgtccctgccccacatcttcaaattaacattttcaggtcacaacaataagtcttcccaaaggggaccttccggaaaaataagctatttcctcggctcatattcccctggaaaacaaaacaaaacaaaacacaaataatatctagcgagatgagatcagccaatccaaatcagcagagaggtccaattgggagacgtgactaaatctaggacaaaactgggactatcactacagaacaaggattagtattctctgaaaggctgagctactatgaactaactacaatttctccttattaagttcttactctgggcagacagaacgcccaggttggattctggctttgccactttccagctggcttagcaaatgagtcatgtagaacagtgcctaacattcagtaagtgctagctttcatttatttctttgtttttcttttttgagatggagtctcgctctgttgcccaggctgtagtgcagtggtgcaatctcggctcactgcaacctctgcctcccaggttcaagcgattctcctgcctcagcctcctaagtagctgggaaaggaacgcgccaccgtgcctggctaatttttgtacttttagtggaggtggggtttcaccatattggccaggctggtctcaaactcctgacctcaagtgatccgcctatcttggcctcccaaaagtgcagggattacgggtgtgatccaccatacccggcctatttatttcttaatgaaatgaaatcatgtttctaaggactacttataaaatcttataatcaaagtaataacaacctggacaacatagtaagaccccatctctacaagaaattaaaaaattaaaggccgggtgtgatggttcacaccggtaatcctagcactttgagagaccaaggcaggaggatcacttgagctcaggaatttgagaccagcctgcacaacatggcaaaaccccgttgctacaaaaaatacaaaaaattgggcagacatggtggctcacgcctgtaatctcagcactttgggaggctgaggcaggcagatcacctgaggtcaggagttcgagaccagcctgactaacatagtgaaaccccatctctactaaaaatacaaaaattagccgggcgtagtggcggacacctgtaatcccagctactcaggaggctgaggcaggggaattgcttgaacctgggaggtgaaggttgcagtgagccaagatcgtgctattgcactctagcctggatgacagagcaagcctccgtctcaaacaaaacaaaacaaaacaaaacaaaaaaacaaacaaacaaaaaacaaaaaacaggggtgaggggggagggatagcattaggagatatacctaatgctaaatgatgagttaatgggtgcagcacaccaacacggcacatgtatacatatgtaacaaacctgcacgttgtgcacatgtaccctaaaacttaaaagtataataataataaaattaaaaaaaacaaaaaacaaaaaacaaaaaaatgagctgggcttagcggtatgtgcctgtagtccaagctacctgggatgctgaggtgggacgatcacttgagccagagacctcagccaggaggcagaggttgcagtgagccaataccatgccactgcactccagcctgggtgacagagtgagaccctgtctcaaaaacaaaacaaaacaaaaaaattaacaggacatggtggaagcatgcctgtagtcctagctacttgggaggctgaggtaggaggattgctttaccccaggagtttgaggctacagtgagttgtgatgccaccactgcacaccagcctgggcgacagagcttgtctctaaaaaataaagaaccaaataagtaaataaaaataaagtaataatgttctgagtgcaactgagtacactctggagtataaatctgagccttcccaaatataggccatgtgaccttgcattatgtaattggcactaaactgctctaagccccagtttcttcatatgtgaaatgggtgattaagaatgacacctattctcacacagctgttttgaggattacatgagctgatgtaagaaaagctcttagcatgatatctggtatacagtaaatgcccaatcaagatttgctgttgttgtaagcacctacaggaacaactgttcctactttaagtgtgtttgacaccgtaatccattctctgtctgctttcttcctataacagagtgttagtcagaaaaggaaggaaggaaaggccattttttccatttaaacagggaccacactgtacaatagagagtaaaactcagaatgaaatgcacaatgttcatagtaggtctgtactgaaatcattcaagtattcaagcttggattcacagaggggctttgtgggcacactaagcaagagcaactacaaacaacacttaggccttttcattcagatttcaaaggcctttctcttatatatcactagtgctataaaataatgcaacaaagagcttctttatacgctttcttctacaatcttttaagaagtggaccccccttcaaaaacagctttaaactgataatcattttaagtgatcctgtgctaaatttagcccacagccaatccatttgttgttgttattgtcttttttttttttttgagatggagtcttgctctgtcacccaggctggagtgcagtggcacaatcttggctcactgcaacctccacctcctgggttaaagcaattctcttccctcagcctccccagtagctgggactacaggcacacgctgctacgcccagctaatttcttttgtattttagtagagatggggtttcactgcgttgcccaggctggtctcaaactcctgacctcaagtgatctgcccgccttggcctcccaaagtgctgggattacacctgtgagccactgcacctggcctgtagttttttgttaagagacacgtctggctgtgttgcccaggctggcctcaaactcctggactcatgtgatcctcctggctcagcctcctgagtaactggaactataggcatgagccaccatacctagccgttattttattttccttttttggatacagggtctcactctgtcacccaggctgaagtgcggtgatgcaatcttggctcactgcagccttgacctcctgggctcaggtgatcctcccaccttagcctcctgggtagctgggactataggtgctatgcctggctaagtttttgtattttctgtagcaatgaggtctcatcatgttgcctcaactggtctcaaactcctaggctcaagcaatttgcccacctagacctctcgaagtgctagaattataagcgtgagccactgcacccagcccattattttattttccaataaagctttgcctagataataaataattttttgttgcagattatacacctcatagtaataacaaaccctaaattggtatctaggcaaaatcatccactaacaagactctagaagtataagaccagctctgtcaataccactgtgacaaataagtggttatgaaaggtgagtttgggggaaaaaaagagtctaaaatcaaggccatcattttaccaggataataatctacctggatcgtatttgtaagttgaatgtgggcactcaaatggcttctaggtctcatctagggattctttcttcttcattactcctgctcatgatttctaaacatcacattttactattatgccaaagtgaaaacacagaacactgtaaagtgtacattaactggcagactagactaactctagctaaagtgagctacaagagttaacttgggattccagagacaatatttaagaaaacaaataaataaaaataaaacaaaataaaatgagagagacagagaaaaagaaatacctctttttgtagcatgcaccaacagtctatccaagacgtatatattggggagtaaggagggcatccaccagcaagactaaaatagaaaaaaacatggagctattcatgttaatattaaccattctcttgagacgttgataaaccttgtcaaaatattctgctgcacagaagattccctgagagatcattttagttcaatgaaacaaatcatattgaagcaggggaacgatcaagcatccaaaagagaattcctcccctatatttaggtttcaaataaataaataaacataaacttcaaccttaatttctaaaacatttagacttttcctttgtggacaaatgaaactccagaacacagcatttacatgattaaagagcagggaaaggtggccgggcacggtggctcacacctgtaattccagcactttgggaggccaaggcaggtggatcatttgaggtcaggagttcaagaccagcctggccaacatggtgaaaccccatctctactgaaaatacaaaaacatgagctggcatggtggcgcatgcctgtaatcccggctacttgggaggctaaggcatgtgaattgcttcaacccaggaggcggaagttgcagtgagccaagattgcactactgcactccagcctgggtgacagagtaagaaccagtctttttttaaaaaaaaaaaaaaaaaaaaagagcagggaaaggagatttaaaaactaactggtgttcacaaagatactaaacatgaaaacggatataaacagtagatatatatgttcctacttaggtataatcacttcatcttgaaaaaactgtaaataataataatacatttaattcatccttcaagtttacactgtgctaaaaaatggcagttgctctacgtatcagaaaacatcacagcttgccaggagtaacatgaaacaaacaaaaccagaaaacaaacaatgtaaaatgttcaaaactccacatagctatctgatcttatttgaaaacagtaacatgtttaatgatatgtcaggtaccatatgggaaaagaattttgaattaaacaaaaaaggcaaggctgggtgcagtggctcacgcctgtaatcccagcactttaggaggtcgaggagggtggaccacttgaggtcaggagttcgagaccagcctggccaacatggtgaaacactgtctctactagaaatacagaaattagccgggggtggtggcaagtgcctataatcccagctactctggaggctgaggcaggagaagtacttgaacccaggaggtggaggatgcagtgaaccaagatcgcgccaccacaatccagcctgagcaacagagcaagactctgtctcaacaataacaacaacaaaaaaatacaaaaaattagccaggcatgctggtgggcacctgtaatcccagctactcaggaggctgaggcaggagaattgcttgaacctgggaggtggaggttgcagtgagtcgagattgcaccactgcactatagcctgggcaacagagtgagactccatctcaaaaaaaaaaaaaaaaaggcaaaattttgcccaactcagtagagtcacttggcatctagaatttggaaatcaatggagtctaccactataccaaaacctgcccttctaaccaatacagagaaaaggtcatcaaactttccatagactaaatatcctaattctggttctttaaaactcactttctccataaagcccctaggaaaaacaggtatggattgtcatttaatccctgatataccttttgtcactttcatagaaaagataaagatttaaaataacaatatgttggctgggcatggtggctcacccctgtaatcccagcactttaagaggctgaggaaggagaatcacttgagcctagaaatttaagaacagcctgggcaacaaagtgagaccctgtgtcttcacaaaaaataattagccaggcatggtggcatgcacatgtactcccaactacttgggaagctgagatgggaggatcccttgagctcaggagttcaaggctgcagtgagctaggacttcaccaccacattgcagccctatctctaaaaaaattaaaaataaataaaaataggccaggtgcagtggctcacgcctttaattccagcgctttggaagtccgaggtaggcagatcaccggaggtcaggagttcaggaccagtctggccaacatagcaagaccccatctctactaaaaatgcaaaaattagcccagcatggtggcacatgcctgtaatcacaacttcttgggaagctgaggcatgagaactgcttgaatccaggaggtgtctgttgcaatggagcgagactgcaccactgcactccagcctgggtgacagagtgagattctgtctcaaaaaacaaaaacaaaaacaaaaacaaaaactataaataataatagtaattggcctggcatggtggttcatgcctgtaatcccagcactttgggagactgaggcgggtggatcacttgaggtcaggagttcgagaccagcctggccaacatggtgaaaccctgtctctaccaaaaatacaaaaatattagctgggcatggtggcgaatgcctgtaatcccagctactcaggaggctgaggcgggacaatcacttgaatccaggaggtggaggtcgcagtgagccgagatcatgctactgcactccagcctgggcaacatagcaagactccatctcaaaaaaaaaaaaaataataataataattaataaataaatacaaattgaggctgctgctgcatagggcatacaaagaaaaaaattaggaatcttctaatggtatcaattatacttttcctccccccctttttaaaaaaataccaatcagagattgatactgatcattcatctttcctaaatttctacaaggctgctccgcctgtcagcatacagtcaaccacctactagaataagaaatacaaagtgcttacccacagttgttgacagccataagattggagacaagcacaaagggataggtcaacatactcgcaaaaaactgtaaaatggaaacaaggcagctgttattagatcattcctagtctttattctcctttcctttaccttaaaggcctagtgccactgcggtgagacactctaacacttgtctcgcttcatcggtaccctggaaagacaacagttacagttttgagcctggagatgcttcttcctcttagcacaccactgcatccaacattttaacaaaaggccagaagaattctctgatcctgagtagctgggactataggcgcacgccaccatacccaactactttttttttttttgagatggagtttccctcttgttgcccacgctggagtgtaatggtgtgatattggctcactgcaacctccgcctcctgggttcaagcgattctcctgcaacctccgcctcctggggttcaagcgattctcctgcctcagcctcccaagtagctgggattacgggcatgcaccaccatgcccagctaattttgtagttttagtagagatgagatttctccaaattggccaaggtggtgtcgaactcccgacctcagcctcccaaagtgctgggattacaggagtgagccaccgcgcctgccccagcttttttttttttttttcacttttgtagaaatggggtcttgctcagttgcccaggctggtcttgaactcttggcctcaagtgatcctccttccttggcctcccgaagtgctgggtttacaggtgtgagccaccatgtctggcctgaacaatattatttcggaggaaaggcacgccccttatgaaagctaagcagtaccaaaccatgcaggatgtgaggcaggggttctgccttactctctttattttcacatgtgagtctgtggttccttcgaaaactgagttattctctctttttttttgagatggagtctcactctgtcgcccaggccgaagtgcagtggcgtgatctcagctcactgcagcctccatctcccaggttccagtgattctcctgcctcagcctcccgagtagctgggattacaggcatgcaccaccacgctcggctaatgttagtatttttagtagagacggggattcatcatgttggccaggctggtctcgaactcctgacctcaggtgatccgcccacctcaccttcccaaagtgctaggattacaggcatgagccatggcgcctggccgaaaactgagttattcttacctttgacaaatataacaaatttcagggagatgtcccagtgagacatctggttatcttaaagcagtgatgacacaagccagatttaaaaggaaaacaaaacaaaacacaactattcctagaaggttaaaaggattttaaaaaactcactcctgtgacagcttgagaataactcttcatttcattcatggtagaaacctaaaataggaaaagagccttaaattaattacctacaacactacaacacatcaatatattcttttttccttttcttttcttttctttttttctttcagacagtgcctcactctgtcacccaggctgaagtgcagtgacctcctgaagcacacatcaccacgcccagctaatttcaaaatattttttaagaaatggtgtctttttttttttgagataagggtctccctatgtttgcccaggctggtctcaaactcctgggctcaagagatcctcccaccttgacctctcaaagtgctgagattataggcataagccactatgcccagctaagagacggtgtcttgctatgttgcctaggctggtttcaaactcctggcttcaggcaaacctcccacctaagcctcctgagtcgctggaatcataggctggagctactgtgccttgctctccatgtcaatatagtctatctctaaattatcagtttgacagcttgaaaattaattttttttttttttttgagacaggatctcatctctcttgttgcccaggctggaggtgcagtgagctgtgatctcacaaccttgacctcctgggctcaagtgaccctcccacttcagcctcccaaagtgttgggattacagcatgagccaccacacctgtctaaaactaattttgaggacaaaaccataaaacactgattattagaataataaggcagtggtcaaaatgatcaacctgattcaatattaacagacaaattcatattatactaaaatgctttagggacgaatgtaaaaggatttcaaatactaaagaaaatgagattgataaccttttcacacatcctagaaatacagtccctggaaaaccacatttatagtatatctaagggacaattcactacctttgttttacacagctagctttctaccagatgcgttgaagaaaatccctctctgtactcaagaggtttacaacatggatttagtcatataccctgtgatgtgttcaatttatcatcatgctatggagctgccgacatacaagaggccccacaactgctgagataagaaagacaacttctagataagactgattctcaaaaggctgaggtttctagaaagcccaatacaggcaccctcttaagtccagattagatgaaaagcccccgatacaccataaagatgtcctgctttcccaggttctctcaagttaagtatcagtaaagaagtgatctctttaaagccctgaagtaacacagggctaagtctcttgggtatactctgtcacatcttacggacttttaacgtgtatcgttctacagtaaacagtatcgttctacagtgaacagtatgctcatttcattagcatttgaaaatttgactgataatttttagctatataattgttcagtctggcatgtagcaaactgtcatcttgtttatttatttattatttattttttgaaatggagtctccttctgtcacccaggctggaatgcagtggcgcgatcttggctcactgcaacctccgcctcctgggttcaagcaattcccctgcctcagcctcccaagtagctgggactataggcacgcaccaccacgcccagctaattttttctgtatttttagtagagacgaggtttcaccatgttggccaggctggtctcgaactcttgatctcaggtgatccgcccacattggcctcccaaagtgctgggattacaggtgtgagccacctcgcccggcccatcttactttaaaagctaatctagctgccagattaaagccaaggtgagcacatctcacgaaggtcacaacctaccccactgtccagtgcataggtattgacgaggtaggccagtgagttacacagccacaaagaaaggatgtcacctagaaggcgaggaacaagacccctacatgaagaaacaataaaaataagaaccaaaaaatgtgatcagtaacatgacaggctcttcagtacaaatgtttgtcaaataattagaggtcacaaaacattctagggaagtaaaaaaggaatcaaacaccagaatccagcccgcatacctagttcattctcgttaacacagctgtacttgaagctgatctccagtgacttttgttcctatgtttaaaatgcaggtcggctataccctcagtggctcaccttactattcataactgtaagcagggaggcaaaagatttgcgaggtgctttgcagaagagacttaaatattgttttgctttgactagcttaaaaaaatgattttgctaagctatctgatattcatatttggcagagcaaaagacgagaaaaattacaaagcaagaatggtcccaagtacagatacagatgagaggcatcaaaaaccacatttctagggtctgggtgacctaggtgaggcagcatggaatagtgggaagagcatttccccacggattgaagaccagcttcaaatgccagctccagcactcagcagcgatgtgacaggcagcagatgaaactctcagagcatcaatgttttttaatctctaaagtgatactaattatagctgtcctgcctatctcacagggtatttatgatattcaaaatccgtatggggagatactctgaaaattaaaaaaaaaaaaacaaaaaacaccatttcggtaatgatgcaaaatttttcctcatagaagaatgagggtagtagtctaagttcttccaaagtaaattcaagccttgcaaaaacttactcttttacggtaaggaaaatacaagttaagatgatttccccatttttcaacatttaatttttctcattttattatctatatagaattgggagtttactacaagggtagaaacttggaattaagtcctttgttaaaaaaagaaattccttatttatttattaattattattatttttttgagacggagtctcactctgtcacccgggctggagtacagtggtgcaatctcagctcactgcaacttccacctcccgggttcatgcaattctcctgcctcagcctcccgagtagctgggattacaggcacacaccaccacacctagaggtggggttttaccatgttggccaggctggtcttgaactcctgacctcaggtgatccaaccgccttggcctctcaaagtgctgggattacaggcgtgagccaccacgcccggcctcaaatgttttaagtatctagaagtaaaggtttgggatctttacaagataattctagtcatatggggcctaaatatgcctttctgcagagaaaaaagaaaaaaaaataaggggcctaaatagaatgtaacgtgaggtaagcccagggagtacgttttccccaaggattaaacaaagactcactattcttactttcagaaaacgtttcccactcatgcaaaaattacacactaatcaacatttactcacgcgaaaaatcctagaatgccctcttcccgatagatggttattatggaatcacaaagtccactacgtacacaagaagaaaaggtaaaatatattaagattcttttggagctataaacaaaataatttcaattatcacattggacaaggtcaaatccacgacctccttccctcacacttttctagcactctctcactctgcaaagatagctaaatttggagatagaagtgaaaatattaactacctaggggtatagtcatatggagtcaggggctctgcaacttactctgaaatcctacgtaggctactaaacctgcctgggtatattttctcccattttattgttttttgtgcagatcaaatgacatcagatacgaatttgttctacaaattgtaagggtatcataaaaatacaaagtagtattattctagtactttggcttcaaaagatctccttgagtatgtgaaaacaaaaatacttaccagtacttggattctctgccaatgaactgtaccatagatctcagagtgatcactgtggaatatagagaaaagatgtttacaactatgttaaggccaggtgcggtggctcacacctgtaatcccagcactttgagaggccgaggtgggcggatcacctgaggtcaggagttcaagactagcctgaccaatatgatgaagccccatctctactaaaaatacaaaaattatccaggcgtggtggcatgcacctgtaatcccagctccttaggaggctgagacaggagtactgcttgaacccggaaggctgaggttgcagtgagccaagattgtgccattgcactccagcctgggcaacaagagtgaaactccgtctcaaaaacaaaaaacaaacaaacaaaaaaaaactatgttaagatagattttgatagccctgggaaaaaaaaagattttccacctaaagacattttgctatctggataaattggataaaagccaaaacaagcaagcaaacaaaaacatgcaggcaaggcattttagtcaactcccacgtcaacctatctaagtggtcaggagagatcaggttataaaagaaaggtcagttgtcaactgcaaacataccatggaagggatgtgtgatgagggtagcagcagaacgagcgatcatctctcgagttgtctagaaacaatcaacacacacttctgaaatctaaacaaatgacactcaaatgcctgtgagaaggaatgtgggtggatatcgtggtataggataagaaagtgaatgacacagccctcctgccctggctggagtcaagaagagtttgaatgggatgtgaaagatctcattcattgtcattttatcatacttttcactcatggatctcaatgttctattatagttacttctcaaaatttctctgcaaagcaggcttctgttgttttctcaattttacaggtaagagaaaaaaataaagaaacaggaaaggtcaccaacaaagtcattaagctgaaataaaaaatatgaggcctttattgagattattaagttgctctcttattggtaagtgattttggagagtctgacatcattctagataaatgacaggctccatttagtctctactcacatttttgggagaagagaacaattttgttttgtgactacaacccagtaactgtgcagtatcttagagctgctgtgtttttcctagtttatctttctactctagggctctgtaaggaagtaataaagaaaattaaattataatctttgcatttaggttctgggattgcaaatgtaagcaggtctaccattggcttttgcattttttttttttttttaggacagtcttgctctgtcacccacgctggagtgcagtggcgcgaactcggttcactgcaagctccgcctcccgggttcacgccattctcctgcctcagcctcccaagtagctgggactacaggcacccgccatcatgcccggctaattttttttctttgtattttttagtagagacggtttcaccgtgttagccaggatggtctcgatctcctgacctcatgatccgcccgcctcggcctcccaaactgctgggattacaggcatgagccaccgtgcctggccggcttttgcatttaaacagtatctttatggtcactgagttttttcttttctttttttttgagacagagtcttgctctgttgcccgggctggagtgcagtggtgcgatctcagcttgctgcaacctccacctcccaggttcaagtgattctcccgcctcagcctcctgagtagctgggattacaggcacacaccaccatgcccagttaattttttttgtatttttagtagagatgggatttcgccatgttggccaagctggttttgaatgcctgacctcgtgatctgcccgcctcagcctcccaaagtgctgggattataggtgtgagccaccacacccggcctagtcactgagttttaagacagccctcaccccttctccaagggcataagatcctatgggactggatgggcaaactaaggaaaatactaattgcatagtaatacatgtatccctgctttttttttttttttgagagggagtctcgctgtctcccaggctggagtgcagtggcgcagtcttggctcactgcaagctccacctcccaggttcacgccatgctcttgcctcagcctcccgagtagctgggactacaggcgcctgccaccatgcccagctaatttttttgtatttttcgtagagacggggtttcaccgtgttagccagggtggtctcaatctcctgacttcgtgatctgcccgcctcggcctcccaaggtgttgggattacaggtgtaagccaccacgcccggccgtatccctgcttttaagcaaactaatttcatgaaaatttacagaaaatagagctaatttatctggtttccagacctttagtaatgtttgttttggaatatatatatatatatatatattttttttttttttttttttttttcttgagatggagtctcactcctgtggcccaggctagagtgcaatggtgcaatcttggctcattacaacctctgcctcccgggttcaagccattctcctgcctcagccccccaagtagctgggattacagacatgcgccaccatgcctggctaatttttgtatttttagtagagacggggtttctccatgttggtcaggctggtctccaactcccaacctcaggtgatccgcccgcctcggcctctcaaagtgctgggattacaggcatgagccactgcgcccagcctttggaatatgtattttggatggctgcatttcctggataattgtgacttcattaatgacaattaagacaatgtgaagacttaagtaataagagaatagttctgaaagccaggcacagaaacacctatggcagcatatgggggtgggaaatgggtgatgaggaacttttcagagtcagaaaaatgtcaaaagagcctttctgcatagatactatccaacatacaaagggcctggtcgctattttaatacttttttctaaagacaaggtcttgctctatcacacaggctggagtatggtggcacaatcatagctcactgcagcctcaacttcctgggcttaagtcatcttctcaccgcagcctctcgagtacctgggactacagatatgtgccaccacacacctagctaatttttctattttttttgtagagaggaagtctcactatgttgcataggctggtctctaactcctggggtcaagtgatcttcctgccttggcctcccaaagtgctgggattacaggcgtgagccaccacacctggcctattttaacacttttattcctgaggttttcaacactattagaagactttcagtattctaaagacggaatgtgtgggcaaaatgagttttcttgaaatgcatctattctgaacagcaagcactgatcctctctctttttaatgttatacatgtagtaaagcccaaattaatttgaaggtttaatttcatttgggaacagacactgaacacacaggcctgatgattctgattccatagttgcaacaccacagtttgatctgggcaaacagcacaggatgtaattcatctcttacctccttgataacgtggtcaaaggaagatgagacttctttctgtacatttccaggtcctaactcctggaaatcaaaatcaaagaaaatagagatcttgatttttttttttttttttttttgagacagagtctcgctctgtcgcccaggctggagtgcagtggcacaatctcggctcactgcaagctccaccgcctgggtacaagtgcttctcctgcctcagcctcccaagtagctaggattacaggtgctcgccaccacgccctgctaatttttgtatttttagtagagacggggtttcaccgtgttagccaggatggtctcgatttcctgacctcgtgatctccacctgcctcggcctcccaaagtgctgggattacaggcatgagccaccatgggcggccgatcttgacggtttttatttcttttgagatagggtctcgctctgtcactcacgcggagtgcagtgatgtgatcatggatcactgcagtcttgacgtcctggactcaagtgatcctctcacctcaacctcccatgtagctgagatacagaggtatgtgccaccaggccccgctaatctttgattttctgtagagaaggggtctatgttgcccaggctggtctcaaactcttagatgcaagtgatcctcccaccttggcctccgaaactgctaggattacaggcatgagccaccatgcccagccatcctgatggtttcaaacagaactgtccaaactggtggccaccccataggacaacactcactgagatgaataggagactgactacttggcttttctccaaaagaggccccaaaagcagtaacaacttgcaagggaaaggccctcatgcttagaaatcagctccaacatacctcacccttgtcactctcctggtaatgctatagaaaaaaagaaaaaggatgattagggttattacagtgtcatgtgaaagaagacataaaatgaaaactctactgacagaaagtaaattagctgaagttttttttaaagtttttgtttttttttttaagctgcaaatcttcagttaacttctactcattaatcaactggaaatatggatctccaagataaacttgttgctaagtttaacatattggtcagttggaagaaaagcaaatggtcatgaaaactcttctttgaaaaaagaaaaggggacaggtgtggttgctcatgcctgtaatcccagcactttaggaggccgaggtgggcagatcacctgaggtcaggagttcaagtctagcctggccaacatggtgaaaccccatctctactaaaaatacaaaaattagcggagcattggggcgcacgcttttaatcccagctcttagggaggctggggcaggagaatcacttgaacccaggaggcagaggttgcagtgagccaagatcacgccactgcactgcagcccaggtgacagagcaagagtccgtctcaagaaaaaaaaaaagaaaagggaaggctgggtgcggtagctcacgcctataatctcagcactttgggaggccaaggcaggtggatcacctgaggttaggaatttgagaccagcctggcctacgtggtgaaactccatctctactaaaagtacaaaaattagctgggcttggtggcgggcgcctgtaatcccagctacttgggaagctgagacaggagaattgcttgaacccggggggtaaagactgcagtgagctgagatcacatcactgcactccagcctgggcaacagagcaagactccatctcagaaaaaaagaaaaggggccgggcatggtgcctcacgcctgtaatcccagcactttgcgtggctgaggcaggcggatcacctgacgtcaggagtttgagaacagcctggctgacatggcgaaaccccctctctactaaaaatacaaaaattagctgggcgtggtggtaggtgcctgtaatcccagctacgtgggaagctggggcaggagaattgcttgaacccggtaggtggaagctgcagtgagccgagaccatgccattgcactccagcctgggcaacaagagtgaaactctgtctcaaaaaaaaacaacaaaaaaacccaaaaaacgaaaagggaacatgcgcagtgactcacgcctgtaatcccaacactttggaaggccgaagagggaggactgcttgagcccaggaattcaagaccagactgggcaacatagtgagactttgtctctaaaaaaataataataaatttaaagaaataattacaaaataagaacaacaacaaaaaagaaaattcaagaactctgtttttttttttttttagatggagtttcactcttgtcacccagctggagtgcaatggtgcaatctcggctcactgctggagtgcaatggttcaatctcagctcactacaacctctacctcccagattcaagcgattctcctgcctcagcctcctgagtagctgggattacatgcgcccaccaccacgcctggctaacatctgtatttttagtagagacagtgtttcaccatgttggccaggctggtctcaaactgctgacctcggctgatccacccgcctcagcctcccaaagtgctgggattacaggcatgagccactgcgcctggccaagaactttcagttttaacagaaaataagtcagtaaaaacatagcccagggttcccacttttctcatggaaaacgcatgaccaataccaaattagggcaagactcttttcttccctgcataaaaggacagagaattgatattaagactgaagagctgaaatcgcctcactttctcctttgtatctgatggtttctaaaacaagcaagaggttttttttttctcttctagagaagagatcatgaatactgccagagcccagagaaaaattcttgcaagaggaattttttgtggcgtattttggaaatagaatgtgagctaggtgaaaataaaattatcaattgagagctccttcttgtgtaaccaccagttttattgttttcttattttttaatgtcagttttattattttctagccatatcagatttcaaaaatagacaacattttctcttgtaaaaagaattgtgtttaaaaaaatcacgggcaagagaacaaatgtgaagataaagcaaagtaatgtattttggccaaattccaggtccttggctagaattaattctaatagcttcaggtctctaaattttcacttgtttctatactttgttatttactccatcgatataattatctaacctgtcttctacatttcctgaatttcattttaattcttgttcagtttacaaaattatttcttgtaaaggttaataattttctcagccctgcatagatccttcttcttgactgtacaagcagctttggatgctaagtgtagtaccaaccctgtaatatttcactggactacatttggaacatattcagggtacctggttacctcaagtttgtcttactttacagttacataaagtaacttagtctcaagcagcactttctctttttctctaagtctatacacaaacctctttggctagatgacaactgcctttccatatgtaaatttcatggaagtaacagcaacaatttcactgagtcccgccgggcgcggtggctcatgcttgtaatcccagcactttgggaggccgaggcgggcggatcacgaggtcaggatattgagaacacggtgaaaccctgtctctactaaaaatacaaaaaattagccgggcgcagtggcgggagcctgtagtcctagctactcaggctgaggcaggagaatgacgtgaacccggcaggcggagtttgcagtgagcccagatcgcgccactacactccagcctgggcgacagagtgagactccatctcaaaaaaaaaaaaaaaaaaaaagaaagtgtttttcaagaggaagaaaggacagggttataaatgtatcttttaaattgctcttgatatttagaacaaactatgcataacaggtaagcaacatctatgggaagattgatttaattttcctcttacctgtaaaactttaccatggaccacagttccaaggactcccgaacacagtcttggagttaagcctgtgaacaacccgcgcctcccatcgatactggcaatgtgctgagctaagaacacaagtcagagatgttgtcaagttctggtcaagagaaatggatatactacaatttcaaagaaacaagctttctatatattttctttcaataacaactcctgcctatcacagtcctcaacgtcatgcaaacccaaataaatcaaaggcacttaccataactaaagagaccaggaagctgacacacttgccgcccaaaaatatttcgtcctattgttggaggaagaggctcatatcccacctttaaaaacaatggaatatatcaatattaaagcaatatttccagaaatgtcttgcttgcaaggtcttgaataaagaacacaatttgggttatttttaaacacaagtaaaaatgcagcataggttttccaaggcaatgatgaagcatcattcttgtaggtttttcttctgttggtaatactgagttcaataaactccaagtttcattttggttcaaattctatgacgtaaaccatgtagctgaaataggctaatatcaaactgaaagaagggaacttttgcgttaggaaagctacagtttactaagggggctcaaaaataccttctaaataaaatctaaggcacattttgtatttgaacaaaactagaagacatccattacgccagcatcagctgcatatttggcaacccagacaaaacactcaaaaggcaaatgcagatatagctggataattcacttaggaaagaattacaagctaacttcatgttagaagaacaggctgtcggtcgggcgcagtggctcatgccttgtaatcccagtactttgggagaccgagggggatggatcacctgaggtcaggagttcgagaccagtctggccaacatggtgaaaccctgtctctactagaactaaaaaattagccgggcgtaggggcgggcgcctgtaatctcagctacttgggaggctgaggcaggagaatcacttgaacccgggaggcagaggttgcagtgagccgagattgtgtcactgcactccagccgaggccgacaacagcgagactccatctcaaaaacaaacaaacaaacgaacaaacaaaaaaacacaggctgtcattaacagctaatgaagtccattttatatagttaatgattaccatggtctttgtacaatatacccaggatttttaacactacagatacttgacagaatgaatgctgtaggacatagttttgattattgttgtgactcttaatctgtcctattaagtaactcctgggctggcgtggtggctcatgcatgtaatcccagcactttgggaggccaaggtgggcggatcacctgaggtcaggagttcaagaccagcctggccaacatggtgaaaccctgtctctactaaaaacacaaaaattagccaggtgtggtggcggacacctgtaatcccagctactcaagaggctaaggcaggacagtcgcttgaacctgggaggcggaggttgcagtgagccgagattgtgccattgcatgccagtctgggtgacaagagcaaaactccatctcaaaaacaacaacaaataaataaacaaataactcctgtctgagctccctgaaagtgctaccaagtaaccatttttatttttatttagttagttatttattttttggagacagagtttcgctcttgtcgcccaggctggagtgcagtggcacgatctaggtcactgcaacctccatctcccaggtttaagccattctcgtacctcagcctcctgagtagctgggattacaggcacccaccaccacacccagctaatttttgtatttttagtagagagggggttttgccatgttggccaggctagtctttaactcctgacctcaggtgaaccgcctgtttcaggctcccaaagtgttgggatttacaggcgtgagccaccgtgcccggcccaagtaactatttttacaactgagcatttgggaatttcaccaaaactcctgggctacttggcaacacatagatgttgtgaaatcagaattaagaatattcaaagtttttggggcaagagctctgaacatcattagaaaaccccgtctcccagagaagtattgagtagtgggttcttttttgttttgttttgtttttttgaggctgagttttgctctgttgcccaggctggagtacaatggcgcgatctcggctcactgcaaccttcacctcccgggttcaagcgattctcctgcctcagcctcccgactagctgggattacgtgcacgcaccaccacacctggctatattttgtatttttagtagagacggggtttcaccatgttggtcagactggtctcaaacatcgacctcgtgatccgctcacctcggcctcccaaagtgctgggaaggcgtgagcgaacgcgcccggccccaagggttcttactatatactgcaacatgctgtcacctccgatgctatctagccccaaatgtgccaattctgttttggatgttacagtacattctaatcagtctttgttctaagtacaaagaatttatttgcaatagcctttaacatatggaatctgaattcacacaggtctactcagcaagaaataatttggattcccaacaactcaagaataagaaatggggccctctctagtgtcttgcctattttttacagaaaagtagacggcgagacaggggttctaaaaactgttccattcctaggcacagtgcatgaggtaattatgtcaactctcagtaaaagcataaaaaaaagaatgacctgcccattacagggatatagcaaaggaactggaaacactaagtctatcacttacttggcctacctgcatgtgaatataaaataccatgtaataattatttgacagtagattagaaactaactcccatgtttaaactcgctaaaactcagcttcactaatttccagctctgacaaatgtgattttcattgtcaggagccacatgggccgctgctggaaagcgctcaatgcatccttccgaaatctgacagagcaaccccttcattaacacttctgaatgagctccttgtgtttctctcagtatctggtgcgaaaacctcggaacagaaaagcagtagtaacagtagcataaaaagaaaaaaaaaaggaataaaaaataaaatgttggttcccacctaacttcacatttgtcttcaactgagtatttcgtgttttgcgtctgagattttggggggagtagtggtgaatgtgaatttcggaggggcgagagggagggttcggaagcctttggtggcgaccggccaggatccacctcagtgacgaagaaccaaagttcagaggatccgccgggcagggcagggccgggtggcggttggctaagggaggagagggcctcaacgctgggcggcgaggcgagggctcggcgaggcccccaagcggggccgcgggactgaggaagctgtccctgcggggaggtaaagggcagcggaggagcagcagcatctcgggagaatgaaaggcccgcaaggctgagccgatcctcaggcgccctgagcagcagcgaccgaacggggcgccgggcggggtagggagcggcgacgcctcatacctggatgagcactttcacgtacatgagcggctgggacaggatggtgagaccggagcccaggagcacctgactggccgcgtccgccatgatggcacccgcgggcggacggacagacagacggagccaccaagcgacccggtgagccggtcctaggtcacgtgccagggccgccggtttcactggcccgcccgcggcgcgcgcgcacgcacgcagcagcacgcgcctctccgcccagtccccgcccccccgtcccgccccgagaaacggcaggcgctc

SEQ ID NO: 420 - DNA, 122707 bp, Homo sapiens
tttcatcctggcgtttgcctgcagcaagatggcggcggtgtcaatgtcagtggtactgaggcagacgttgtggcggagaagggcagtggctgtagctgccctttccgtttccagggttccgaccaggtaatagaattttcacacttttcttcaagcttcttgggtccctccatttttgcggagtctctgctggctgagttccggaggaggcctcggggaaggcgtcctctgttgacccttttctcgggagaagtcgggcggactagggactgtctgctatcaatgggcgttggccaggcgagtgagggcgtgagtgcgaggccggggaggaggacctgtggttttctggaagctttcgtattcggcttgtcgctgagggagagggtccgtggaggttttgcctccggagctgcaagctgaaccttagccctcagagaaggggaggagtctcactgatttctgtttccactttctgcatcccttccatttgtcacctgtttgcccaccactccagtccttacagaagggttaaatcactgtatcccttccatggttttaagtggttttaatttggtttctgcataggaagattgtttattcatcagtctgcttgggaggaaaacttgtttggaattcagtgttagtaaaaatatcactgctagtaatattggaaggtaatttttaaaaggctggtggtaatgcctggaggttttctagggattttgttaaagcctcacaataattcagggattgaattgagttgttgagggctctttgcgtccttgagaacctaaagtagtacttttccaaagtattgtcagattcagttgtcagttgattgagttgttactgtttttccttgaagcatttttgtgatgatttttttttttttggctgtattaaccttccattttctatttttcagaatttcctggagttttttaaattatagtactaatgctatacgtacatacacacacatattagaacaaagattggaaagactggatggagagatttgaagggggtaggaggtggatgcaagtggttaaaagttgaaaggaaggtctagtagaatgctaattgatttagtgttaaatataaatggaatgcagagaattaggatgagttaattcggaagaatttttaaggatgagttttattaaggtttaaatatagtgggtgttgggtgggaaagaagagagtgtcccgtagggtccgtggcttatgaaaaggcttgaaagcattagttaaacgattactaaatacatagaatagagtcactcaaaagtaagggtgctaagattggggaaaggcaaatgatgtttgtaattaagtgttccatatatggaaagtatttttcctttttctttctctttttttttttgagatacattctcactctgacgcccaggctgtagtgcaatggcgtgatcttggttcactgcaacctccgcctcccgggttcaagcagttctcctgccgcagcctcctgactagctgggattacaggcgcgcaccaccacacctggctaatttttgtatttttagtagaggcggggtttcaccatgttggtcaggctgggttaagtatttttctaaggtaaaatacttcactggttaacttagagttaatatagcggtgaccaagattagcccttcctcccgtacagattatagggattaattgtcattcccagataataatgtactcatggtagccccagaactgaaaacaagtttgaagggaccactggtttatggctaatcaaaacatggctgtaattttaagtcaaagccattttgtcagcaattatagtaattgaagttgagattagatttttgaaactctgatgataattgttactacatatccaaacttaagagtttttgcctgcaaatgtaagagatttgaaaataaatcatttaatcttgaaaaaaaatcttaatgccagggaagacgttttttaaatacaaattaacacatttatttgttttctgtgccacatttttaccctaagagcttgtcatgttcatcctaatttgagggaaatttatagaccctctcccttacatattgtttgttcttcatccttaagcattctttttccattatgatttgatagtaatgaggatctgaaaaaggtgagtagaaagaaccaattaatgggaaaatctacatctaaaattcattttattgtaatgcttagaaaaacatttgcaaatcatgtaacatttcagatcatttgaatagaatatgggaagtggaatcagtaaggtaaggagtggagtagggaactgaaggaaaggaagggccgggcgcggtggctcacacctgtaatcccagcactttgggaggccgaggcgggcagatcacaaggtcaggagatcgagaccatcctggccaacacggtgaaaccccgtctctactaaaaatacaaaaaattagccaggcgtggcagcgtgcgcctgtagtcccagctactcaggaggctgaggcaggaggatggcgtgaacccgggaggcagagcttgcagtgagtcaagatcgcgccactgcactccagcctgggcaacagagccagactgtgtctcaaaaaaacaaaaaaaaaaaaaaaaaagaaaaggaaggatgctgttagctgctacattaacatattaattcaattatagtatatcatcagtgaaaagcaaaacaaagaatgcaacaacacatacacacaagagagaaaaaatctagtaatgtgggtgattgagctgatctagttacttactgagcttgtgctgtagtgttggtctcagtttccatgtgcttctcatttccctgtaccgaatgtgaggaggcaaaaaaaggggttaaattgtctacattttttttttttttggagatgtagtttcgctcttgtcacccattctagagtgcagtggcacaatctcagttcactgcaacctctgcctcccgggttcaagcgattctcccgccccagcctccagagtagctgggattacaggtgcccaccacctcgcccagctaatttttttatttttagtagagatggagtttcaccgtgttagccaggctggtctcaaactcctacccacaggtgatccacccgccccggcctcccaaagtgctgggatgacaggcgggagccaccgcgcccatccctaagttgtctacatttatccttactttccctgactttcctaagagattttccagggtaaatttaactattctaaatgcatttatcagccagatgaaatggcactctatttcaaaatagctatacttaagatatttgatgcagtgatgtttttattcacttatttaagtgtgttcatgtatacttatctcaccttagtatttactaggtcttgtgttttcctcaaacaagtccttagggtgttaaatcacccagagggttttaattaatgactggtggggactgagtgtttgggacctgtttgtgaggtctcttttatgccctgatctgtggctttattctgttgctgtgtttggttcttcagcattatataagctagcatgaaattgagtcttcaattcgatggggaattgaatttgaaccctccaaatagtaagcagtccttaaggttgacaagaattctgtttgttaacaccttgctgggaaataggctaagctcaaatttaggacacttaagaccaataggttcacttctacttcagataaactaaataaattcctctcctaggggcagctatttttgctatctttgtaacacatccaagccaaagtttgagagcttgaaagatttctaatatgttttctgataggtttatttgttttgtttcttttcctctttccaaatgcccatacttagttttcatcagtagcagacatcttcgttgaatttttgttaggaaaataattattatattttgagacagagtctcattctgttgctcaggctggagtgcagtggcgcaatcttggctcatgcaacctccaccctctgggctcaggtgatcctcctgccttagtcttcacaggcagctgggactgtaggtgtgcttgccaccacgcccagctaatttttgtattttcagtacagacggggtttcacactggtcttgaacacctgaccccaagtgatccgtgtgccttggcctcccaaagtgttaggattacaggcatgagccaccgtatccagccggaaaattaaatattttaatatgtaatgtcggcatatagtaagccttccctagataaatggtaattttattattggtttgaatggcctgaatgtttttcatttctttaatcttggttgtaagtattgtgatagattgtgttattgtttaaagtattcactaccactgtctgcaacaggattacatatccaaaaaccactggccaaatgacttgctttatccagtgaaatgttagtggaaatgatataccatgtcaaacaggagctttgagagctctcctgtgttttgtcatattccttttccctctgatgtgaggtaggtgtactccaggtggggtctgctgttttagcccacatcttggattgtagactacatagtgcaaagcagaaactgattcttattgcaagattttataaaatataaattgagtgaaaaataaacctttgctgtaagccacaaaggtgtttggattggttacctcagcataacaacctatgctgactctattttatatacactcatatttgcaagtgagcaggttttagcacatggaccgatatatcagcagtgaggtcgcaagctttttgaggacacaaccacatttttgtttatttgtgtgtacttcatggcatctagtgtaatggcttgcatgtagcaggtaaatgcttatcttacagatgaataaatacatatttagagatgagcgattgtgaggaaaagcagggagcattacgcagtgtttcttttaataccctcatcagtgatagccaggtaggcactaacctttataaatatgaagataaactatctacaacacatattctaattatttgcagtggtctgagtgtaggatattcacctagaactctgttaacttttggattgaagttgtcttatgaatagattttgtattcatacactttgacaagtgttcagacacttcttttgtattcaaatttaaaaatgcaagaggaaatgaatgtttgggaaagggtacccttggaacatgagaacttttttggagtaagagtaactatgcgaagttttaaaaagtcagtaatacggccgggtgcggtggctcacgcctgtaatcccagcattttgggaggccaaggcgggtggatcatgaggtcaggagttcgagaccagcctggccaacatggtgaaaccccgtctccactaaaaaatacaataattagccgggtgcggtggcgggtgcctgtaatcccagctactcgggaggccgaggcaggagaatcgcttgaacctgggaggcggaggttgcagtgagccgagatcgcaccactgcactctagcctgggtgacagggcaagactccaaaaaaaagttaataatacacggaacttaagggagaaagatggagcaacttggttcctgtataatacttgctagaagagatctgtttggggtgaggtatacatagaatttagtcagaatacatattgtctgtactgaatacaaacaatttcaaatggaagagcttctaaaacatgtcccttggtagaagttgagaatcgtttattccaagcaaaattaattccaagtagcatttgtttttaatttactctgtatcagctactgtgccaaggatttcacctgtattatctcatgtgtttcccacagtaatcctatcaactcaggtgttgttatcctcatttttcagatgaggaaacaggtacagaagtgaaattactgaagtttacattgccaggaaatgtaattgtctcttggtatccatgaaagattggttccaggactcctcaaggacaccaaaatccacggatgctcaagtccttgatttaagatggtgtagtatttccatataacttctgtacatcctcctatatactttaaatcatctctggattacttatgatacctaatacaatgtaaattctctgtaaataactgttatcctgtattctttaggaaataatgaaaagaaaaaagactgtacatgataagtacagatgcagtttttcctcccccaccgccaagtatttttttttttttttttgaggtggagtcttgctttgttgcccaggctgaaatgcagtggcgtgatctcggctcactgtgaactctgcctcccaggttcaagcaattctcctgcctcagcctcccgagtagctgggattacaggcgcgcaccaccacgcctggataatttctttgtattttaattagagacggggtttcaccatgttggtcaggctggtctcaaactcctgacctcgtgatccacctgcctcgacctcccaaagtgctggaattacaggcgtgagccactgagcccagcaccccttaatattttaaatctgaggttggttgaattatgatgtggaacccacagatgcagagggttgactgtagtctgatatagcagtctaaatgaatatgttcacttttgcagtgaggaatattatgtctggtaataatcagttcaaaccctaatgtcctctctgttttttctgccttttagccaagtgtcttctttatttgagagaccatggaatgctcttatctttactgttgctgcatggttccatttgtacagtgagagttaccaaatgcacaattagttgtttacttttttaagctaatgattttttcccctaaattttgtaattatttttggtaagggacttttcataggtgacttattatacttttttacgctcttaaaaaatatatataacaagatatactggacattttttttttctgttttcttactgattccagtgattaggaaaaacggttgtattgtgttgtctttaaaaacgattcagtgtctgctatgctttctgagttctcgtgtctgctttttaatagtgttatattcttccttgactggtctgcttccctttagcagttttagcacccctttttcatttattatggatttgaatgtcaagcaactaaacctattagaattttgtataaaacaaagtatgctaaatgaaattctgatgatggcagaagtttactttttatgattaaagacttgagctcttttaaggttaacgaataattatatttaatatatgagctcttgtgacttttcttttctagcttgtagaagtccatagatcctgatggaacctttttgaacctgaattatgcagtgaccacattcttcataacaactttcatctaaacatatgaataatttaataaactattataaattttttcttttaataacagagcaattcagaattcttgtttcaagttctattttgttgtctgttactaagtattttggtaggtaaatatgactttaggttctttagaactagttagttgctcaaaggtaaccttttcttcttgtctgtactcactagacttaatttttcttttatgggctcattctccagttcactggtttttaaacccttgtgcatcaaaattatctgttgggtgcctaaaaaattcagatgccttgccccccagtctatattggttcagtaagtttaggttgaggcttagctctatggtgattctaatgggaagctagggctgaaaacggattaaaaaaaaagtttccatattatatcttgtaagacttaggaaatatatttttccttgggagagagttcagggagatttccagaaacaaaaattcttccatttttgcatatttttctattctaaattaagttttatgcttttcacccatgcacataagaggtattttcttggggaaagtttccttagagggaaaaaaggcattttgataattttggagaaagcaggccatattactctctctctagagactcttattcttccttttggaagggctcaggtttaatatagcacagctgttgaactctgcccttcaaaattttaagaaagtgttttatcctttaaaatggaaaaggcttttttaggaaggtggtctttcactggatgtagttctctaagaaagtttcatgcttctctactcttttgtgtttgaatcgtttcaaatgttgagagaactgtctctgggagtaaaatctggctgcttttgcaatatattttctgtattcttaaacaaagctatatgaagagtttatttctttgtgttttctaggactcaaaaatatgttttttcctttattcagccacttcacacataagtaaatggtccttgaatagggcttactggacaaaagattctgttctagatgactgttcagcaagccatatgcttctcctaaaaatgtcagtctgtcttgatgagctttaaagtgaatacagatgttttggctcttttgaggactaccactctttgtatggaaagagtacttctttttcaagtgatctcttcaatatacttacaggaatttgcatgaaatttatgacttttgccttttaagtctaataagattagacttagacatgtgtaatttgaatttaattttaatattcgtagtacaaatgagatttggggaataaaatacatttcataatatggctttttgttcagattttgtattcaaccttttaaaaaatgtgaaagtgctttgtaatatttacttttgtgcaataaaaagtgatattttggcaggcaaggttacctttttagatgttcagtgtcttctatctttgtaggttaactctggagttatagttcatagatttatgtaatatttaagttggaagaaaactctagaatcattaagtccaaccctttatttaatgcaagaatccctagaacttcctgcttcttgattatctagttgttgaggaagtttggtgactttctgataaccccagaaaacacactatacgtttagacttactggtaagtgatgtttttctttgaaactgtatagaacaagtttaaccccgtatacacttgtcagcccttcagataattgaagacatttgtcatcactcattcttccttcaagtctgtgctccaggcttagcacgtccagtttgtttactctttattaatgatcaaatttcctgacgctttactacctcttggtaccccttaggatgttttccattttgtcagtgttgatctttgaactatgtactgtacttttatttaaatgagattatcagagatgatagtttcatgagctgagattgaattaaggaaaaaagttgactctaggttggatttattttatattatttttaaaattataaagaaaaattaactgttttccttttggtgtatacttcttagagttttaacacatgtatgggttatgtgtaaccaccaccataatcctagtacagaatacagtgtaatatgcagataactgttttactgtattgtttcagggtgcagaataccaaaagacttcattaccccaagactccctcatgttatccttccctgaccgctgtaatccctgtccacagttatcttttttcatctttatagttttacagttttgagactgtaatataaatgtagtcatatataaccttttgagattgtctttttttattcagcctggtgcctttgaacttcatataagtttcatgtatcgacagtttgttcctttttactgctaagtagtattccgttatgtggaggtaccacagtttatccatttacctattgaaggacatatgaattatttcaggtttttggcagtgtaaatagagcttctgtacaggattttatgtgaattatgattttgtttctctagagtaaatacctgggtagaagattcctgggtcatagctaagtgtatgtttaattttataagaaactctcagaccgttttccagagtggttgtaccattttgcttttcaccagcaccatatgaaagttttagttgttttgcatccttgttaacatttgtattgtatttttttttctttttttttttttttttgagacagagtcttgctctgtcacccaggctggagtgcagtggcacgatcttggctcactgcaagctccgcctcccaggttcaagtgattgtcctgcctcagcctcctgagtagctggtattacaggtgcatgccaccatgcccggctaatttttgtatttttagtagagacggagtttcaccatgttggtcaggctagtctcgaactcctgaccttaggtgatctgcctgcctcggcctcccaaagcgctggaattacaggcatgagccacggcgcccggctgtgttttttattttagccattctagtaggtgtttaatggtatttcattacggatttttattttggaatggctttatttagctataatttatatattataaaatttactcatataaagtatacaatttgactggttttcatatattcccagaattgtacaaccaaaaccacaattttagaacatttccatcactcaaactctgtacccattagcagtcgcttctcccccagtcctagataacgactaaccttctttttgtttctacagatttgcctattctggacattttatacaaatgcagtcatataatatatggtcttttgtgacaggcttgtttcagttagcataatgttttcaaggtttatccaagttgtagcatgtaccagtactttattcctttttattgaagaatagtattctattgtatggacaaaccacattttatttttgagggacatctggattgtttctaccttttggctacatgaatagtgttctgtggacattcagatacaatattttatgtcaacatatgtttttattgttttgggtatatacctcggagtagaattgcaggataatgtaataactctatatttagccttttgagtaactgtcagactgttttccaaagtggctgcactattttacattcccaccagcagtgaatgagggttccagtgtctttgtatcctctccaactttgttattatctatctttttgaagttataactatcctagtgagtataaggtggtacctcattctggttttgacttgtacttctatgatggctaactcattgtggttttaatatgcatttctctaatggcaaatgatgttgaactttggtgaagtatctgtttatgtcttttgcccatttttaatcatgttattttcttattgttcagcttttatagttcctaaaatattctggatacaaattctttgtcatgtatgggaaaaaatatatctctctaggttcatggttgagccccctacaactaaagacagatgaagaagagaaaagcatacacatgtatttaatataaatttgtgtaacatgggagctttcataaggagataaatatccaaagaaacagttaaacttgtatatttttatgcttaggtttggtgaagagtagatagggagaaatatgatagaacaaaggggatttggtatatggtaataagctgggggaaacagcaaagccagtttgttctgattcgtctctgactgaccatttgtcttcagagataacaatgttcctttctttctgatatagggaagacacctctcacatgagagttttatagggaaggttagataatcctagattttataacctacttcagagaagaagggatgggggaagaaggtcaaaggtaccttcctacttcggccgtttttcagtattacaaggtggcacattttggggtagcatgtcctgaactctaccaatcagatgtgtaattttcaaatattttcttctaatctgtagtttttctttttcattctttaacattatctttcacaaagtaaaagttttaaattttgatgaagttagtttactagtatttttccttttaatgattgtgctttcgttgttgagctctttgcctaaccccaggctgtgaagatttttttctgtattgtcttcttgaagttttttttttttttggcggagtctcgccctgttgcccaggctggagtgcagtggcgcaatcttggcttactgcaacctctgcctcctgggttcaagtggattctcctgcctcagcctcccaagtagctgggattacaggcatgtgccaccatgcctggctaagtttttgtatctttagtagagacggggtttcaccatgttggccaggctggtctcgaactcccgacctcgtgatccacctgccttggcctcccaaagtgctgggattagaggcgtgagctaccgtgcctggcctttgttgttttttgttttttttttttgtttttttttttttttaagagaccaggtcttgctctgttactcaggctatagggtagtggtatgataatggcttactgcagccttgacttcccggactctagcgattctttcccacctcagcctcctgagtagccaagactacaggtgcataccaccatgcctcgctaatttttatattttttttgtagacatgggtgtctccctgtgttgcccaggctggtcttgaactcctgggttcaagcagtcctcctgcctaggctccccaaagtactgggattacaggtgtgagccactgcacctggcccatccttctttttgaaaattgtagctattttagttcccttccatcatttagaatcagctcttttataactatgaaatcctgctagggttttgattgtattgcattaaatctatagattaatttgggaaaagttgacatttctgctgtgttgaatctttcaatccataaacatggtatgtctctttatttatttatctaatcagtgttgtagttttgagcgtgcagatcctgtatatgtttcgttagatttatgcctaactatctcaatttgggggagctgtggtaaagagcattgcttttaaaattttcttttctttattttttattttttagagacagggccttgctctgtcatccaggctggagtgcagtggtgcaatcatagctcactacatccctgagctcctgggcttaagcagtcctcccacctcagcctcccaggcagctgcgactataggcatgtaccactaagcttgactaattttcttattttatttttttgtagagacaggttgctatattgcccatgcttgtctcaaactcctgacctcaggtgatcctccttcctcggcctcccagaatgctaggattatagacatgagttattgcatccagcctaaattttattttgaaattgtatattgctgtatatagaagtgtgattgatttttgtggttgactttgtatcctgtgaccttgccacatttatttgttacataaagttatataagttttttgtagattctttgggctttctaagaaaataatcatgcagtccgtgaatagggaaattttgtttcttcctttccaatcactaggtcttttatttctttttcatttccaggaggatgttaagaatggtaacagcagacattcttttcatttaccaatcttaagggaaagcattcagtttttcacctttacgtataatgttagctaaaggttttttgtagaaataccctttattagattgaggaggttcccttctgcttctgctttgctaacagttttcatcaagaatggatgtgtctaatgccttttatgcatcaattggtgtagtcttgtttttcttctttagactgttaatgtggtagattgattttcaaatattgaatcagcttgcattctcaataaaccccacttagttgtggtgttgaattcttttcgtatactggcatatttggtttcctaatactttgttgaagatttttacatctgtgtttatgaagaatactgatctgtagtttgtttcttttttattttggtactgtgtttagatttggtatcagggtaatgctggactcataaaatgagctgggaaatttttcatcatcttttcttttgaattgctttagtttcatgctacaaattaagatatgttgtattttcatttggttcaaaatattttatttcccttgagacttcctttttgatctgtaaattatttagaggtgttttgtttaatttccatgtatttggatgctttcttttttttgttatttattttttgtttatattatattcggagaacccaattccctggggtttcctttatcaatgtccatccagaaaattgtggctatcattaagttgcactgtagttgcacctaaatcagggactaagggactagaggacagagagagaaaaaaacagaaaagcaatgggtgttggccccaccttttcagaaccacagctccagcggacttagaagaagaaccctccttcagatttttggctcccgcacatttccattgttgccaccgcatgtggctataggattgcctatggctgattcatggtgtatgagagaaaagagaagaaaatggggattttctatcatttctctgagcacttgtttcttttcttgctccttgaggccgagtgcttctggagaattgctcatttcatgtttccagccgcatttaagttcaggctggggacattcaagggaaaagctatttcagactcactgctagttcagtggtcctttgagttctgatgatcttccctgatctgcctgctatttccttttcagagccttcaaacagctgctccatgcatcctttccagatttcatggttgcattcagtgggagatacagggtacagtgtgcttgctacatcttactcaggacaagcccatcctaggatggattatttttaaagctaaacgctaacatttcttgcatcttagcacatctgaatggatttaaaggatctaaaatgactcaaaatattctttatatgatcagattcttttttttttttttttttttttttttttgcagacagagtcttgctctgtcgcctaggctggagtgcagtggcatgatctcggctcactgcaacctctgcctcccgggttaaatcgattcatgtgcctcagcctcccgagtagctggaattgcaggtgtgcaccaccatgtctggctaatttttgtatttttgtagagatgggggtttcaccatgatggccaggctggtttcaaactcctggcctgaagtgatctgcctgcctctgtctcccaaagtgctgggattacaggtgttagctaccacacctggcctaaatgatcagattcttaaccagttgattctcaactgtggtgggagaaagggaggaattcacataccataatcttggaaatggcataaagaaagggtttcacaatacatgtacttgtggttgaaaatcatgacttttatttaaagatgttgcccatgtaagtgatgcagaggcaggaaaatacattgaatcactggtttagaccatcaaacaataaatcttctttgagagggtgtagaggtcagagatctatttagagtaaatgatggaagttttggtgacttttctctagaaatagatacagtcatatgtataaaatcagagtgggggattaatggatcccaggctttgtagcccttccatagatagtattaggtcttatacagtgttttgtttatactcgtgttcaagttcttgtgttaaacctttctcacaagttacagaaacctaaaatctcagatggctggcttaggcaagaagagagaattggtttacattaccaagcaatggaaagggtaagggtgcacctagctagtctcagggacctaagctagaaagccaccaggttctttttctagtttgtctctgtctgtctctgaatgacagctactatttcagattgtttttttcccatgtggtagatactataactgatagaaatttcttcaggtttatatctccatagctttattaccagggagggactgaaaatccctttctctgataccaagtttaaaaatcctggagaaatacttgatttgagtcagattaaacacactaagggtttacaaaaaatactcaatgtttgtaattcttcttatactgctgtatcgtatgaatatagatcataggaaccttgagagtgagatgtaataaaagctgggacctcctagtcaaaaatttagaacaggaatattttgtgtagtgttatcttcgggaaacaaagtttgtgtatgttttatgggttaaactatcttttttcctaatgaattctgagactttgctaatgtttgttcacccattcaacaaatatttgtatttcttttctagcttcaaaggctgcatttctacagacttgagtaggatgtatgctcttggaacatctgttttgaggattagcagtgttcaagcaaaggccaaatactcatttctcggggtttgtgtagggcttcaccttagtttgtcttctccttgagtagagtctgagacaaagacataagcctaggtggtttatttgagagcttgcctgggaagtaggagtgagaagcctggggagtgagagagggaacaaaaaagtatgatgttgcgattgttgctgtgagcagtagagaaacctcctgagcagtgtgtagaatgctacccagtattacccatttgaaaggtggaaggcttgaccatttatccataagttctcattcccttttgattaaaggtgttaactcttttgtgctttaagctatacttgtgcttctgaagatgttgaggcgtaatgggctcacttgaggtgggatgctagaggataatgggagtatgaattcctgcagctgtggctgaaatgacacatgggccaagggagtgtgacatgagcttcaaaggtgtctgttacaggaccttataactaaagagtctctatagtctgctattttttttttttttggtcctagtaaggggtctaatatctattgtttattgtgcacttaggcattgaggtaattactttagatatattgtttcatctcactaaagtaaacatctaattttagatggtctcttggtgattatattatagtttgatattttcccagggttgtaaaagaattcacccgtattggaatttgttttactcacctgttctgaagggtatgccaaaggatttggaaattgaggtcttccaactcacttaactataaataataatctcatgggaagagatagtttcttctatataatgttatgtttaaggaattcatgatagcagaatattcctatgctatgtgccagggtagttgacccgggattgtgtataacatcccagctaacaaagatcaacctacagttttctttgaatttggtatcctagatgatctaattctccagatgagcatgtattttctcttcagtgatactgcctaaaagacttagggtagttaagagaattttcttcaacagctgccttttagtcttgctcctgtcccactttcatctctgactgattatcattgtgatagtcttgtcttccattttattaatgtctcagcataccattttagttcatagttcgtactagaatggatacaacatgcatctgagtttatttaacaaattttagattcttctttccttagttgagactttaaacattgttattctgttgctgatgaagtccatggtttatgtctgtcttagttactgcttgtaagtggccccttattaaggctcaagtttttattttggttctagatttagttttttggcttaaagttcaaattcttattgtggccaactcccttaatagactcttaccagtgtccttgaccctagctttgggaaagactactttctagaaattttctgttggctcacgatattagccatgctgtcaggctgtattcttacccttctcatacttgagctactctattggacccgtcatgtcagtctagcagactagttaagaacacacattttagagtcaactctacctacatttgagttcctggtctgatacttgctaactgtgctttccttgtttctgtgtcctgttccgtaaaatggacataatacttcctgttttgtaaagtatataaaatgcatagtacagtgctcggcatatgctataagtgcctgaaaaattataaaaagaacattatcatcactgtcctgctcctcctcgatgtcatcatcattattctttcttttgtagcttcttttcctttttgcttctttctccctctctacttttcttactttcttttttctttcttttggtaaatcttaactagattccaatttcgtgttttggtttatcagaacatcctggatttcgtcttacttatttgcagtattttatgcataaatatataatagaattttgtgcacctggctttttccaaattgtgacctcccgtgcactccccaacccacaacaatctatctttagcatctaccattccactgaaatagctttgatcaaggtcagcagtgaccctgttgctaattgaatattttcttctcagtccttatcttacgtgacctttaccatccaaagagatgactgtctcattcttgaaagattcttcccttgacttctgttttggctttactccgtctcagttttctttcagaatacattatcttttgcccattcattgaactatcattgtttcttaagagtttgatttatacctttttacgctttctaaaatgtttcaaattagataatattttatatacacatgaatatatgtatcatatatatgttaggaaccataatagccaaatgaattcttgtgaacccaccatccaatttacacactagacaattaccagtacctttatttttgtatattctctgtgaggctgaataatgacacagccacccaccaaatatgttcatgtcctaatccccagaacctgagaatgttaccttatatggcaaaagggactttgcatgcctgggcaacatagcaagaccctgtctccaaaaaagtaaaatcaaataaaaatttagctaggtgtggtgtcatgtgcctgtagtcccagctacttggaaggctgaaacaggaggattgcttgagcctagaagttcgaggcttcagtgagctatgattgcgccactgcaccccagcctgggtgacagagcaagaccccatctctttaaaataaaagggaggggaggctttgcagatgtgataaagttgaggatcttgagatgggaagattaccctggtgggcctgatgtaatcacaatggtccttataagaaggatgcaggtggagtcagagaaatagtgtagagttggaagcagagattggagtgatgtgactacatgtcaaagaatgccaacagtctctaaaagctagaagaaacaagaaacaaattgtcccctggagcctccagaagagtccattcctgctgacacattgatattagccctgtgagactgatttccaacttctgacttctagatctataagagaataaatgtaataaatgtgtgttgtttcaatccacaaatttcgtagtaatttgttactgcaactataggaaactaatatactctccctgtgtctcattatccaccatgacttcatttaccatctatttacactaaagcctaaatgtaaatgatttatttacatcatatgtacttttcacttaagaaattcaacacatatacgtggcaactacaaatgggtagagaattttttaaaaacagttaaaaatgcaagttaatactcttatttttctacttaatgatcatttaggactcaactaaagaaacggtagtttgttctagtgctagacgactggcttattaagagatagtatgtgagtctcctttggaggggatcttcctaaattagaatttccaaagatgatttttgctatttgcagttgttgcctaacactgactttaggacctgctcttcatgaaagatgtgattctgtatcttttccatgaattctaggtgcatagatctaaccaagacatcctcatcttggattttgcacaggcgtctcaaatccagcatacctgaaacaatgttacgatgatgacttcctccacaacttcgcttatttattttctttctttctttctctctctttctttctttctctttcgtccttcctttcctttcctttcctttccttttccttttccttttccctttcctttcctttccttcctttctctttctttctttctttctctctctctttctttctctttctctctttctttccctttcttttcttttcttctttcttttctttccttctttctttcttttggagtttcgctcttgttacccaggctggagtgcaatggcacagtcttggctcacggcaacctctgcctcctgggttcaagcgattctcctgccccagcctcccaagtagctgggattacaggcatgtgccaccgtgcccggctaattttgtagttttaatagagatggggtttctccatgttggtctggctggtcttgagctcccaacctcaggtgatctgcttgccttggcctcccaaagtgctaggattacaggcgtgagctactgtgcctggccacacttattttcctttttagtaattgtcaccaacacccagccagttgtctaagccagaaacctgtgtattattcttctctccttcctctcttaggcttcatatcagctagtcattaaattctagtattcattttcctaactctgaatcaatttccatctttgctacagctattgctatcatcctgcctcctaactgatctccctctcatcagtctcagtttgttctccatgttgggtacatgttgcaaaagtctaaacttcccagcatgccacagagtccttcatattccctgctcatttcattcttgggcattcatactttcatcagtcccctcctgacccaatctccagctgtacataaactctatattttagtatttctcaactgcttgcaacccctaaatgttttctctcttttctgtaattaaggctctgtctgcctagactatttcttctgctttcctgtctgtgccttctctgccccggcctacccccaacaccctttgcctatttaagtcctgtttatccttcaggtggcagtttaaccatcattttctttgaggagcattatctgaactcacaagtttagattaagtacttatctgtgaagtcttagagctccctctcttacctcatcatgtttttggaaactgctactttaagggaaacaatgtataaacaaaaccagtttaaccgtaggctaattgatataaaacaagagttaaaaaagatcatcacatttctaaataaaggcccaagcatttctaatattaatcattaaaataaatgtgagctagggctgggcgtggtggctcacgcctgtaatcccagcactttgggaggccgaggcaggtggatcatgaggtcaggagattgagaccatcctggctaacacggtgaaaccctgtctctactaaaaatacaaaaaattagccgggcgtggtgttgggtgcctgtagtcccagctacttgggaggctgaggcaggagaatggtgtgaacccaggaggcggagcttgcagtgagccgagatcgcgccactgcactccagcctgagcaacagagtgagactctgtctcaaaataaaataaaataaaataaaataaaataaaattaaattaaaataaaaataaatagctatatacacatttaagaaagatgaataaaaacaagtaagatacttatccatttatttcagttcagggtcaagagtggccagagccagccctgatagctcagagcacaggacaggaaccagccctggacaggatgccatcacattgcagggcacactcaaacatacccacactcactcagaccgtggccatgtatacatgccagttcagctcacatgtacatccttcggatgtgggaggaaactggagtacacagagaaaacccatgtgaacatgaggagaatgtgcaaactccacacagatagtatccctggccgggaattaatttcgttttttctttttcatcaacatataacaaaatgaccttgaacaagctgatattattcaaagacctgctgtacttactatgcttcatcatgatggcctgtttacttgtctgtgtttctctttagacttaagttcttcaagatcaagaactgtttcttcacctgtttgtttttacaggctaacacagtacttagcgtgtaatagatacttcatataatagatacttggtaaacatctgtggactcatttgattatggaatcatatagaaatttaaaactaatgcacagcagcatctccataagcagtatagcatatattttttttgagtcggagtctcgctctgtcacccaggttgaagtacagtggcacgatctcggctcactgcaagctctgcctctcagcctcctgagtagctgggagtacaggcgcccgccaccacgcctggctaattttttgtatttttagtagagatgggctttcactgtgttagccaggatggtctcgatttcctgacctcatgatccgcccgcctcggcctcccaaagtgctgggattgcaggtgtgagccactgcacccggccttatatatttttttcttatgaaataactgtttgggttttcaatatagccatcatggacaatgtcagagattaccaaaaaatgatgacttttatagctttatgatgcttcttatttcatactattgaataatactattgcaaactttatcttacggcaatatttactaaaatgtatatgtggagtcctgtcagaaagacagctttccatgtgatttgggttattagaactctaaagttgttcatgaaggaatggacatgtattgcaaatctaagtaacttccaattgtaatttttttccgtaataaatagctgtatagctattatgtgattttagaatagcagaatgcttgatatgcagtataaacccagactttggaaatagaagattatacattctgtttatagtctgcattaaatataccgcatgattttatttggctaaatttgttcaattctatgtattttggaaataaaagcaactcaaaaataggaatcaactagagtttaagggatttttaaatattataggtattgttacattttattatttcaattactgggagttgatgggtggcaagataagacgcactggtgggagtaaatttgggaagatgaagaattcatggcttttcaaccataatttaagctactggttatgtggtactatacctacatttaaaagttgccaagtgttgccaaccgtggttgccaagactgtactgcacataataagtacaaaatgtgtgaaagaattcaagtaatatgttaaatgtttaattcccttttcaatcttgggatgttggatgatcaatgaaaacagaagtatctggcaggtacaggcaacattgttaagaaagcttttccttacagtcctgctgcatctcacttacacctcccactccccaatgcacagttatttctccatgcatagaaaagtacttcatatgtacctttttcatagaaattaccatttgcattcaaactattggcattgcgattattgtttatatgtctgccttctcgcaataaactataaaatcttgaaagcaagttattattgggtttagcattgtgcgtaagacataatagatatttcatagtagatgtttggtgaattgagaataggaattagaatcttggtatacattcttaaatatatatggttgacggagttcaactgagcttcttttttttttgagatggagtttcggccttatcacccaggctggagtgcaatggcgcgatctcagctcactgaaacctctgcctcctgggttcaagtgattcttctgcctcagcctcccgagtaggtgccaccatgcccggctaatttttgtatttttagtagagacggggttacaccttgttggccaggctggtcttgaactcccgacctcaggtgatccacctgcctctgcctcccaaagtgctgggattacaggcgtgagccaccatgcctggcctcaaatgagtttttaaacataggtatgccaatttgtagttaataagtattaactcttgttagatcttttaaacttctcttcagagtattttattgcctggatatttaccagcataactaaaaatgttttctgtttttgtttttgttttgagatagtctcactctgtcgcccaaggtggagtgctgtggcgggatctcagctcactgcatcctctgcctcctgggttcaagtgattcctgtgcctcagcctcccaagtagctgggattacaggtgtacgccaccacacccagctagtttttctatttttagtagagatggggtttcaccatgttggccaggctggtctcagactgctgacctcaagtgatctacccacctcagaaaagtgttgggatttcagacgtgggccatagtgcctgaccaaaaatgttttaaagttaaaaaatcttaggtgaatattttaaaattatgggatattatgaaaagtcagttgaagaagtactggttttgtgtctcgttttcttgttgattaggttggttctgtgattaaaagcaaattgcctatataattctgatagtacttattaaaaagtcattgacttaggcttttaggtaactattcataatttataagggaagccagtgggagttttaattacttgttctgttctagtagtctgcagttttattgactcgatttggatgaatcttacaataaataattgttgagtttttcctaaacagtatgagggcctgtaaaagcataaattgaataacaagcagactattttcttcattaagctaaccacaatgaaaatttttgtgccgggcttggtggctcacgcctgtaatcccagcactttgggaggctgaggtgggcggatcacctgaggtcaggagttcgagaccagcctcaacatggagaaaccccttctctactaaaaatacgaaattagccgggcgtggtggtacttgcctgtaatcccagctacttggaaggctgaggcaggagaattacttgaacctgggaggcggaggttgcggtgagccgagatcgcgccattgcactccagtgtgggcaacaagagcgtaactccgtctcaaaaaaaaaaaaaagaaaatttttgtgtgtatgtgtgtgtatacacctgtgcctgtgtgtattgtaatttatttttatgtgtccttttgtgcttttatgcatatgttttttgttatgttacatttctgagttgatagttttttcttttgttttgaaactattggaattttctattaattttaagcaaattgccaagtacattaaatttgtagacatccatttttaaaattgtattttaaaatggcattgctttgctgactagtatagaatattttcagtttttcttttattaacaaataatatcggccaggtgcagtggctcacgtctgtaatcccagcactttcggaggccgaggcaggtggatcacttgaggtcaggagttccagaccagcctgactaacacggcgaaaccccatctctactaaaaatacaaaaattagctgggtgtggtggcaggtgcctgtaatcctagctactcaggaggctgaggcaggagaatcgtatgaacctgggagatggaagttgcagtgagccgagatcacgccattgtacttaagcctgggcgacaagagtgaaacttcatctcaaaaaaaaaaaaaaaacaaaccaaaacaaaaaactcaaataatctctagttatagtaacttattactaaatctttccttgatttgaatctgatttcagaaaaatgattgcattagaacaggccataggtagcaaactttactgtagttgttcaggaaaatgaattgtttagttagttagttagtttgtttgtttgtttatttatttattttgagacggagtctcactctgtcgcccaggctggagtgcagtggcgcaatcttggctcactgcaagctccgcctcccaggttcatgccattctcctgtctcagcctcttgagtagctgggactacttgcgtccaccaccatgcctggctaattttttgtattttttagtagagacggggtttcaccgtgttagccaggatggtcttgatctcctgaccttgtgatccgcctgccttggcctcctaaagtgctggaattacaggcgtgagccaccgtgcccagcctgtttcttccttttttttgagatggagttgtactcttgtcactgaggcaggagtgcattggcacaatatcggctcactgcaacttccacttcccgggttcaaatgattcttctgcttcagcctcccgagtagctgggattacaggcatgtgccgccatgcctggctaattttttttgttttagtggagacggggtttcaccatgttggccaggctggtttcgaacttcttacctcaagtgatctgcctgcctcggcgtctcaaagtgctgggattacaggcgtgaaccattgcacccggccgagttatatatatataaaataaattctaagagtctccttctctatcccatctgctcatttaccactgcttaccccactcccaaaaaatcattattagtttcttatgcttggagtccgtttatgcatatttaagaaaatatattattcttgcccatttttccacagaggaggcatactaattgtaattttcatgttgctttcaattttttaactttccattaaaattttcacacatgcagaaaagtggagtgctgtgaatctataaacctaccacctagatttaacatggttagtggttagtattttgctggttttgcttattttgcatatatatgtatataaatgagcaaaaggcatatatttgagtatgtatagattagcaacagacaaacacatatattgatctaagccatctgaaactcaattataaatatcatggtattccatccctaaatactttttttttttttttgagacagcgtctcgctctgtctcacaggctggagcatgtggtgctatcatggctcactgcatcctccgccctctggtctcatgtgatactccacacctcaacctcccaagtagctggaaccacaggcatgtgccaccatgcccagctaatttttgtgttttttggtagagacgggatttcaccatgttgcccaggctggtcttgaactcttgggctcaagggatccaccggcctcagtctcccaaagaactgggattacaggtgtgacaccatgcctggcaatacttcacttttttaaggtaaattaccactcagtcaatgaaggatttcaaccaaaagagtcacatgattgggtataataattacttgtttaggttgaaggtgcctttgaggaagagaagactagaggcagagaggccaattattaataagtgattgttgtacaggcatgctttggagatactgcaggtttggttccagaccaccactagattgtgcaaataccatggtaaagcgagtcacacaaattttttggtttcccagtgataaaagttatttttccaccacactgtagactgttaagtgtgcagtagcattatgtctaaaaaacagtgtacgtaccctaatttaaaaattctttactgctcagctcaagaatgttaacgatcatctgagccttcagtggggttctctttcctctcttgccttcctatgaattggtcctgcttgtgactagagggaaagaagtgaacatttgtttctccgcacaccagctccttcatgccaattacttaactagttatttaattctaccagtaattatttgcggtattattatccttatttttgcagatgaggaaattgaagtgcagagttgtgaaataatttgttcaagatcatattgctcttaagtggcagatctggaattttcacgagtctgactgactgtgaagttactacatgactgttatccagtttgtttcatgaagtgaaaaatatatgaatgctggtaatttttgttttcttctgcatgtattcattattcttaatgatgtgatcatcagccttttaaaaaacaatatgtcagtccatttgcaaatacaccactcttaggcactttatttttgaattgaagtatgcaacttgtaccaactagctttccctttgatgtaatattgccaaacaatgaaatatcatgtcttatattgtcaccatattttatttttgaattcactttttattttatttttaatatattttttatacaaatgtaatctcagtggttttagggctgatacagagaagttttagaccaaaagattcctaaaccgaagcaaaaagtgacaagttggaacacttgaaagtgaagagaaaatgcatagccatcttaaaaaaaaaaattaggaggtgatctgtccaagatgacacagtagcattagagcagttgtgaagcagatcatctaatggctttttgaccccttctgaccttcaaaagcgtaagaaaataaattattctgcccttaaagaccaaaacgtaggtttttaagagcaacatcttgattcatttgaaaatagtaaactctcaagctgtaacactcccaacctcagtcaatgtaaaacagacatcatacaatttaaattctcgtatggtagtccctagagaagcacttgaatagagaattgcttatcaaactgtgtcagtcaggatcctaaaccccaaaatacctgtagcttaaaataacagagatttatttcttgttcatgttgcatttcccttgtgggacagtcaggaatgctactccgtgtatcctcacttgggaactcagactaactactgttggttactgggatgtaggaaaagaggcagttaggcattgacttctaaagctactgctggataatgtcatttccccttatacttcactaatttaggtaagttacgttcctacacctaaccaagaagtggcaatgggagtgtagtctcaaaatacgattagaaggagaatatgattaatactgagtgtcaccttgattggattgaaggatgcaaagtattgatcctgggtgtgtctgtgagggtgttgccaaaggagattaacatttgagtcagtgggctgggaaaggcagacccacccgtaatctgggtgggcaccatctaatcagctgccagtgtggctagactgtaaagcaggctgaaaaacatggaaagactagactggcctagcctcccagccatacatctttctcccgtggtggatgcttcctgcccttgaacatcagactccaagttcttcatttttgggactcgggttggctttccttgctcctcaacttgcagatggcttattgtgggaccttgtgatggtgtgagttaatacttaataaactcccttgttagttgtgtccctctagagaaccctgactaatacagagaagaactggaatatgggtgcccagctggaatgactaacaagccttttgaggaatatagagaattacgcatgattgattggtagaatgatttttttaaaaaaatgccaaatagctttgaagtaatcctgttttgattgaattaagggtcttgttgctgaaaggtgaactaggcagtttagccagaaatgtccagtagaggagtaaactggttaattggacatccttttccttgtgttttgtctgttacattttcataagcatatttaagatttgctcttatgtgcttgcttataacataaatctattaataaagattcacagttatcaactatttttatgtagaacatgttggataatgatgctatgcaaagtctaaaaaatcaagaggttaataattggtaggacatataacaaaaactatctcatattttgtgttacataggcaagcactagtagtttttaaaaagtatataatttgggaaaatttgttccatgaggcagtacaaatgaataatcatattgaagttcaacagcttaattctggacttctgaaattttccaaggagatgagtgattaatagatacaaacatactatttttatgtacatatgtgaagagactgtctctaggcagttataaatcttcttcatctttgacaaacttttgcatatgtgtctttattggtgttgtaaaccagggattatctgtttcttcacaaggcatgctctttttaaaatattgtcgtggtttatacatactatgaaatttaccattttaactatttttaagtatatttcattggcattaagtacattcacattgttgtgcaaccattaccatcatatatctccagaactttttcatcttctaaaactgaagtctgtacccattacacagtaattctctattcttctctctcataagcccctggcaactaccattttactttctgtttctgtgagtttgactactttagataccccatataaatagaatcatatactattcttttgtgattggcttatttcacttatcacaatgtcttcatggttcttccatggtgtagcatatatcataatctgcttccatttaaggcaaaataatattcaattgtatgtatataccacattttgtttacacattcatctgccagtggacagtagggttgcttctgtcttttggctgctgtgaataatgctgctataatcatgagtgtacagatatctgttctagtccctgctttagtttgtctgaatataaatcccaaagtgaagctgctggattatatggtaattttattttaaatattttgaggaatcacactactgttttctgtaatggctgtgtcattttacattcccaccagcagtgagcaagtgttccattttcttcacatccttgccagtacttgctactttttgtttgttttttttggggggggggggtgataataactatcgtaataaatatgaagtggtatcttatggttttctttttcatttccctagcactcttttgcatgtttttgtgtggacatatgatttcagctcatttgggtaaatacctaggagcacagttgctgatcctatgttaaaactatgttttagctttgtagaaaactgccagactgtcttccaaattggctgtaccatttcgcattcccaccagcgatgaatgagacttctgttctcttcatcctttctcaaatttggtgtggtattttggattttagccattctaataggtgtgtagcactgtcattttaatttataatttcctaatgacatatgatattgagcactttttcatatacttatttatcatctgtatatcttctttggtgaggtgtctgtttagatcttttgcccacttttcagttgggttgtttgttttcttattgatgagttttgttgttgttgttgttttgagacgggatctcgctctgttgcccaggctggagtgcagtgtggcgcaatcttggctcactgtaacctctgcctcccaggttcaggtgattcacctgccacagcctcttgagtagctggaattacaggcacgtgccaccatgcctggcgaattttttgtatttttagtagagatgagggggtgtggcagatttcaccatgttggccaggctggtcttgacctcctgacctcaagtgatccgcccgcctcggcctcccaaagtgctgggattacaggtgtgagccgctgcgcccggcattgttgagttttaagagttctttgtttattgtagataaagtttcttaatcagatatatagtttgcagatattttctcctagcatgtggcttgtcttttcattcttttaatattaatagtatctttcacagagctaaagctgttaatttcaatgaagtccaacttatttatttttcatggatcatttttttggcattgtatctgaaaactcagtaccaaacccaaggtcacctagattttctcttacattatctttgagaaatttgattgttttgcttcctacatttaggttcatgagccattttcagttaatttctgtgaaaggtgtaatgtcactgtgtagattaagtttttgcatgtggatgtctggttgtaccagcatcatttattgaagagactgtcattattggattgcccttgtttctttctgagagatcagttgactatatttgaatagtctatttctgttccattcatctatttattttatagctaataccacagtccttattactatagctgtgcagtgtgtagtaagtcttaaagtcgggtaataacagttttctgacttcattcttcagtattgcattggctattttgagtcttttgtctttccatatgaattttagaatcatgcctggaataaatcctgcttggtcatggtatataaatcttttcatgcattgttgaatttagtgctaatatctgttaagaatttttgcatctatatttataagagaattagtctatagttttcctttcctgtaatgcctttatctagttttgatgtttgggtaatgctggtcccatagaatgaggtactacatgcttctatttcctagaagagattgtagagatttagtgtcatttcttccttaaatatttggtagaattcaccaggaaacatctggacgttatggtttctttttttggaaggttattattgattcattatctttaatagatataggcctgtcccgattattgctccttgtgagagttttagtaattcctgtttttcaaataattagcccatttcatttaagttatcaaatttgtgagcttagagttgttcataatatttccctgtttttttaatgtccgtgggatcaggagtgatgatacctgtttcattttatatattagggctttgtctctctctctctctctctctcatctgtctgtttctcttttttgttaacctgactaaaggtttatcagttttaatgctcttttcaaagaacagcttttggttttgtttatttttctttaccaatttcctatttacaatttcattgatgtttactataattttttttatcttcttcttgccttaggtttatgttgccctttttttttttctagtttcctgtggtggaagcttagattattgaatttagttagacctttcttcttttctaatatatgcattcagagctataagtttttctctaagcactgtttttggtgcatcccacaaattttgaacattgtattttcattttcatttagttcaaaatattttaaaatttttcttgagacttttttgacccatgagttatttagaagtgtattgtttgatctccaagtaattggagattttctagttttctgttactgatttctagtttaattccattgctgactgagagcttgcattgtgtggtttctattcttttaaattagttaaggtatgttttatgtcccagaatgtggcccatcttggtgaatgtttcacttgagtttgagcagaatgtgtcttttgccattgttagataaagcagttgacagatgccagttatatccagttaattgattgtgctgtttacttcaaccatattcttaactgatactctgtctactggctctgtcaattactattcgaagaatgttgaagtgtcccacaataataatgcatttctccttgtagtttcatcagtgtttgcatagcatattttgacattttcttgttaggtacatacacactaacgattgttacatcttgttggagaactgacccctttatcactatcaccttcttcatccctgataatttttcttgttctggagtcccgtttgtctgagattaatttagctgtggaagcaagatttgactagtgttaacatgctatgtctttttccatccctttacttttagtctgtgtctttataattaaaaatgggtttcttttcagtaatatgtagttgtgtcttattttttaatctactccgataactctcttttaattggtatatttagactatttgcatttaaagtgattattgatatcattaatattaatgtctattgtgctcatatcatctgcattccctctccctttttggaatgatttttcttttgctttgtaagcattttttatgtatcctacagattagtcttttatctactatatgttttacttattatctctgatttttcctttatatgaatttgttgttcagaaattatttttcattcctagtttgtggatattttgccttaatttggaagactttaaccactcaaaagttattaaaacaaacctcttttatacattatctcagtatttttttacacacagatacacatacattgcatttgtatatacgtatgtctgtgtttgtgtgtgtgtgtgtgtgtgtgtgtgtatatgcgttgatttttaaatccatctggaattctttggtacatgatgtaattcttttagaaagggattcagacattatgcttccatgaaaggatggccagttgtctcaatattatttattgaatagcccaccttttcaccactgatttaaaattgtatttttattatgtaataaatctacagatctgcatagtctgcttttgtactctgatctgtactatttgtttaatgtatatgtctgtgcctgggcatatacaggtattttaattacagtagtctgttacctggcaaggaaatcttactttattattgtttttcaaatttccttggttattttttatgaattttttcttctcatgagactcacctaattttataaaaattctattaggatttgtattactattgtatttaatttataagttaataattgacatctttgtggtaaattgtttccagttattaataacacatgtcaaaggatagcaacacagtttcttccattaaggcattccaagccagtagacgtattcttctgtggccaaggtagctcaatgatttgaccttcttaaatgtgaacatttcatatgttccttgtgttttgtaatataattactgtcatcaccatgacatctttatttcttattcttctctcatgtatatttattttgataacctgttgctataaatgtagatacatttctttctcctttacattttccgtcacaccctccggtttctttgttagcatcctccagtatcttgcccacattctcctacttattactcttcaattccatttcagagtctgttacgtgaacataattacccttatccctcttgcacaaatctttctttaatctgttggatgactctgaaaggattagtttcagtttggggcttgagctgtgtccagacacacaactgctattagttcctaccatagttctacctggttcagaagaatgagaaaaataatccttactttttcctcctctatgagcaggaggtgcttactttttactgatttgaccagctgaacattttaagataatattcagtactgtagatgaagattagaaattactgcaaaaactttaagtgagaataaaagaatttatggtgttctaaagagattttaaacaaattatcttcactattgttttctctaatttaaacaaagcatttgtgggttcttttcttttacttttactcagtctgtctttccagaatgttaaaatggtcccttaggctgggctcggtgtctcacatctgttatcccagtgctttgggaggccgaggcaggaggattgcttgagcccaagagttcaagaccagcctaggcaacatggtgaaaccatatccctataaaaaaaaacaaaaaattagccgagtgggatggtgtgtgcctctagttccagctactcaggaggctgaggtgggaggatcgcttgagccaaggaggtcgtggttgcagtgagccatgattgtgccactgtactccagcgtaggtgataaagccatatcctgtgtcaaaaagtaaataataaaataaaataaaatggtcccttgaccttttatctttaattttcccattaacagttggttctctcttttttctatctaatgaatacagtatgctgaagacagtttaaattttctttattgattcaagatattgaaaagcttcaagattattaacttgaaagttttcaaaggtttaatatcaacacatttcaggtgtgaggaaattactgtggcatggagaatatgtatatattttatttcaattaaaactctcagtaatatttccttatggcttagcatggaaatactttatgatataaggtgagtctgggttaatttaatttgtaataaattgacaacaaacgtaattagttctaatcaaaaggctaaagattgactccataatggtttttataagattaggagttttattttgtctaaaagtccaacacattatttctggtcctttgaaattactggttcaattttaatgtttataaaatcatattcagttatttatagggatgtttttaaatctatagctggacacagaccatcccaatagttgcttaaaacaacagtagtcttctgttttgcttacaaatgtacaatttgggcaggttttgccagggaagtttgtctgctccatgtggtgtctgctgggatagctcaacttccactagaggtttcatgtccaacatacctcacccacatggctggcaaagtgctattggctgtcaattcctcttcacaaggacctctctgtgggacagcttggtcttttttacaacttggtggctgggttccaaaagtgaaacatcctaagaaacaatattctaagagacagggagtgaaaacagatagtttcttaaggtctgatgctggaaacacacataacctcagtttaactttctcatattgatcaaggaatcacagagctccgattttaggagaacaggatacagacttcagctcttaatgggagggaggagcgtcaaagaaatttggagtcacagtttcaaactgctacaaggaatatgggaattttactaaattattcttagttgataggtagtttcaaaagggacatagtattagtacgttgggtcagtagtgttgtttagatactatttttcagtgtaatgttttaaaaatcttcactgtttaagactttttgaaaagtgtattttgaagtgttaaaaacaatatttacaagatctatatgaagaaaattagaaaactctgaggaaggatatcaaagaagatcctaatggatacatggataggaagacgctaagcatcatccatgaacgaaaaatgcatcagttaggcttcattaagattaaaagcttctgctctgtgaaagacactctaaagagaatgaaaggacaagccacagactaggaagatatatttgcaaaacacgtatctcataaagaactatatctacagttaacaaataattcttaaaattcaacaataagaaaacaagcaacccaattaaaaagtgggcaaaagatctaagcagataactcaccaaagaagatatacagatgactaataatcatatgaaaatatgttcaacgtcatatgtcattcgggaattacaaattaaaacaacaatgaaatagtactacacacctgttagaacgactgcaatccaaaatactgaccacaccaaatgctggcaaggatgaagagagcaagaagtctcatttattgttggtgacaatgcaaaatggtacagcactttggaagagtctggcagtttcctacaaagctaaaacatagtcttaacgtatgatcagcagttgtgctcctgggtatttacccaaacaagtggcaaatttaatgtccacacaaaaacctgcacatgaatgtttttagcaaaataaccccaatgttcatcagtggatgaagaaagaaagaaaatgtgtatatgtatggttttgaaagatttttttaaagaaaaacagattattatgtgagttgggtgattcttgcataggatttccacgggtttattaaaacaaagtagaactatcgtcagttccacttactagaatcaaatagactgtcatcactagaagaaactttagagcaacaagttcctcattttatgttttcaaaaaataaaatataaaggcagaggagttgagattttctcatctacagcaaaagatgtttatataaataaatatactgataaaaatttatctcatattgttatcaagctgtatgtaaaagacaacacaataaaaaagacaaaaatctcaccaaactgttttacttaaccagagttagaaataaggtttattgataaaaaccaggattagaaataaagtttattgattttcattttcaggatatctctttttctttcaggaaacttatacagaaaaacagaataaatggcttgtacgcttataattaccttgaccagtaatggtaattaataatcacaatcacaaccctcagagtttatcctttgggctgagaattaagaatgatactttacaaacctggaaatgtgagcaggccaattaacaaaacaaatagatggacaaaaataaaggcaaacccatgaggcaaagaatgtttttaagtttgtcaaaaatgaatattaaacagcagagtgagtaaaattaccatttattttctaatgattacacattagtcattgtttctacatgaacacttactactgagaacactgttttactgggtacattgcccagtaaaatatgattattaatattttggctgtttttgcttttggctatttgaaaaatgctgctataaacattggtgtacaaatatttatttgagtcttcacttttagttcttttaggtatatactcagtaatggaattgttggatcataggataattctgtttactttttgagaaactgccataccattttccatagtggtagtaccattttacattcccataagggtaccaatttctatacgtttctgttaatacttattttctgtttttatatactaaaatgttgtaaaagggtgtaaaatgctacctcattgtgttttgatttgcattgctctaattagttctgttgagcatcatttcatgtgctcattagccatttgtatatcttttttggataaatgtttatttaggtgttttccccatttctaattgggttgttttgttgctgtttgagttcttcttttaaaatttagaaatgaccccctacttacttgtacaagttcttttacctcttttagatgttgattccttactgttctattttgtattattttcttcttgtctgtcttacacttcacttacagtatatttagttttgatgtttttggttttatgtaatagcttctgtcattttttcctttatgctttctaggctttatatctttttttcttaacaaggtttttgtactcttaatattttccttccatctaccatttcactgatgtgacattccttacaggctaatcaacaaacagatatttactgtataattcatgtgtagtctaaaatttactatagattatactttgtaggtataatttttatttatttatttattttattattattttttgagacggagtttcattctttgttgcccaggctggagtgcaatggcacgatctcagctcactgcagcctccacctcccgggttcaagtgattctcctatctcagcctcccgagtagctggggttacaggcatgcaccaccacgcccagctaattttgtatttttagtggagactgggtttctccacgttggtcaggttggtctggaactcctgaacttaggtgatccgccatcctcggcctcccaaagtgctgggattacaggtgtgagccggcccgcccggcctatttttattttttgtttattcattttttgagacagtgtctcactttgttgcccaggctggagtgcagtggtgcgatctcggctcattgcaacctctgcctccaggttcaagagattctcctgcctcaacctcctgagtagctgggactacaggcatgccccaccaagcccagctaatttttgtatttttagtagaggtggggttttgtcatgttggccagactggtctcgaactcctgacctcaggtgatccacccacctcagcttcctgaagtgctgggattacaggcgtgagccactgcgcccagcccggtaggtataatttattaaatgctgtgttcataattgactgtggaccttcgttgctaccttaactgtccagaattggagaaaaacttttctccacatctgatatttgagtcctttaataattgttttctgcttagagggtagtttcttatcacatgatataacttacacaagcacacgttttaatttaggcaaatttttctgaaataattattgttttacataaaaattaaaatcactctttgcaatctaacctatcttaaatttttttacaaaaaatttttactgtaactttatggtaggattgttttacttaacatttttgtcctttttattgtattatcttttacatacagcttgatataaatttttatcagtgcgtttgtttataataaatttttttttttttttttttgagacggagtcttgctctgtcgcccaggctggagtgcagtggcgcgatctcagctcactgcaagctccgcctcccaggttcacgccattctcctgcctcagcctccgagtagctgcgactacaggggcccgctgctacgcccggctaattttttgtatttttagtagagacggggtttcaccgtgttagccaggatggtatccatctcctgaccttgtgatccgcccgcctcagcctcccaaagtgctgggattataggcatgagccaccgcgcccggctacacatgtttacaaaagatgttatataactttattattacaattagttggaggttaacctaaaattattaaaataaacctatccttaaagtaaattatatatggttttataaattaagaactttactttggattacaactaatatatactaagattttcttaaacaattaggacataatcgttttaagttaaatcccctttgtagtaaaaaattgcacaaaatgggtacagagttttaatctacctaataatttgcactgttttcatctaacaggtctcttcatttgagaaaatatagtgtagcttttcacggttttagttacccacggtcagctgtggtccaaaaatatgcagtggaaaattcccaaaacaaacaatttatgaatttaatatttgctccattctgagtagtgtgatgaaatctcatgccgtccagctctgtctcacccaggatgtgaatcatccctttgtctagtgtatccaggttgtataggatacctgcgttagtcagaacttagtagccatcttggtgataagattgaccgtctcagtattgcagtgcttgtgttcaagtaacctttattttacttaattgatctgttttattattagttattgttaatttattactgcctaatttgtaaagtaaactttatcataggtgtgtatgtattagaaaaaacagtgtatgtagggttcagttctattaacaattttaggcatccactgggcgtcttaaaatgtatcgtacaaggatgagggggagctacttactgcatttagaaaatgtgataacattttctgatatttcagattctcatgagttcacttatcattacccaatgtttttcttgtaatatgtggatttgtttaaaagtatttaaattttttaattgccatgttactgaccttaatgatttccaaaataaaataggtattaagagttgcttaattatacttctttaatataacaaccaggacatgtattttaactttgtgtaaatcatctagagttatttccatgttagtacattttgtgtaggtatatttctgagtggggcatttacagtgataaagaattacataataccttaaatttggtaaataattgacagatattttaaagtatattcataaagcagtaaaacctcttgtattatgttatctttaaattataattaagaaggttttctatatggctgtgtacacattatcaaaattgaacttttagcacaaaaagttcaactatttgtatcagttatttttgtcaattattggttattatgttgcattaaaactatggtagtgaatatattgtattaaaaaaaagaaaggaccaaatgccatatatttggggtggaaatttgagccacagttgtgtatacttacttttgcaatagaaatctatgtcagatagcctaatagtttggaaaactcttaagatgctaaaatgtcacagcacagtcagggatatgtatgacattcagtagtataaacaacaaagtgtacatgaaacgtccgttaacgttaagtaattggagtgagagtaggaaaatgctaatataaaggggctagattctctgcccattttacgtctaacttaatattttcattttaactaattttatttctcccattttgtgaatgggctacaggactaaactaataacattagttatacaaatcattcctatgtaaaatacttttggtgtgaaattagagtgaataaactttttattatgattgggatttttttcttttcgtttctgatgccatccgtttaagaatcagtgttccagaacaattggtatagctttgcatgtttctggctggtcgtgacaaatcagccactgtacactcatagacagcagtacagtacttgtcactggtggcctttctgtgacagagagcctgaagactgacgtaaagcgcagcctgttgtgaactgtcaagtgagtctgccaaaaactcagcagacagaactaattgcagagaaaaaggacttttgtgccctcttctctttctttcctttcctttttttttttttttaataagacagatattgttaaagtagcttgtttatgtaagatttgtctgtctctcctctcattgcctggatccttttttaacttaaagtcttgcactgcaggtcgttgaggacttccacatggagattggcacaggaccagactcaagacacacaactcataacagttgatgaaaaattggtaaggattttctactacacactgctatggttctgccttcagggttatttttgtactatagatattcagtatggtgttccaggttttcaggaaagtgatttgaatttgaatttctagattatacctaaattttaagaagaaatatttgtcatcaaaagataatttatattaagcattataaacaaatacaaaaccatatgcaaatattaataaattaaaattatgaaaggttttcatttttgtggtgtttataactagcagaacattcattactttttgtaatgaatgttttgctttttattttctcagttacactcctatttaagttgtgagatacttgctagtactatctaaaactaaatatattaggttttcttggaagcatgcaacatttattatcactatatgtatatatgtatatgcatacaaacacatacacacacattttatttcttcatatgtatgaagaaataactagcaagcaactagcaaacaactagcaagaccagcaacaaatgagtaataatgttttgtgaatcagtaacaaacagaattttggcagccatcacttataaaatattttagagtgtggtctgttactttacatgcaactttatatttatgcttcaatagcatacattttgtaatgtttccaaaacttctgatagaaatgagtaattgtatatgtgtgcttttcattttatatctggtttaccattatcagtgtttcttaactaccccctttattattgtacagtattttatcactcaactttgagcctgtaagcccaatctaagtaataggtcacacttaaatttctatttgcaccattaaagatacagacaaataaatgtataagtaaatagagacagtttggaaaattcacatcttgtgctgactggttttattttaaaattatctcttcagtttacctactgacattgtcatcatcctgatctaggttacatcatctttcacctagatttctacagtagtctttgacctgatctccctagactctttaatcctaatctgattaattttccttaggatgccaaaatagtctttgaaatgctggtattgtcaccctcttttcgtcctttggtgcttcctgttgcccttagagtaaacactaaaatcctaacatggtctttgacgtcttgcctgatttagctcctgccttcctctctaggtttatcttgtaccactgtgttttacattctgtggtctagccacaccaagcctggaacttgctactctttttcctgcttcaaggcatttggagttcctgttcactctacctggatgcattttaactaatcctgaggacttcatccggtcaccatctacctattcttcaaatggtaatcaaacaccacttgcttagtcaagtataaaagaaatgaggggcagggcatggtggctcatgcctgtaatcccagcactttgggaggctgaggcgggtggatcacgaggtcaggagttcgtgaccagcttgaccaacatggtgataccccgtctctactaaaaatacaaaaaattagctgggcgtggtggcgggtgcctgtaatctcagctactcaggaggctgaggcaggagaatcgcttgaacctgggaggtggaggttgcagggagccgagatcgcaccattactctccagcctgggcaacaagagtgaaactcagtctgaaaaacaaaacaaaagaaatgaggcagttatgtgtgtatgaagtgaggatgattttcacatcctgtgtgttcattaatgagagcactattattttaatttttcctatgagcatctttttttaactctcaggaggttgccttttctataaagttttcaaattttagagttcactaataactcttctaagttctcttctttctagtttgaagaatgagtgagtcagccagtaatacattgccctaaacagagtgctatgaagcatacaagagaggtagacagactggattggtttggtatttttaattatatgtcataaaatcggttgcatactgttgaattttcttgccctacctagattttccccagctttgttatacctttcttgaagtaatagttgtccctcagtacctgtaaggggattggttctaggactcccctcaagtaccaaaatccgtggatgcttaagacctgtgttagactgttctcatattgttataaagaaatacctgaggtgggacgcagtggctcgtgcctgtaatcccagcactttgggaggctgaggcgggcagatcacaaggtcaggagatcgagaccatcctggctaacatggtgaaacctcatctctaccaaaaatacaaaaaatttgctgggcgtggcggtgtgtgtctgtagtcccagctgctgaggaggctgaggcaggagaatggcgtgaacctgggaggcagagcttgcagtgagccaagattgcgccactgcactccggcctgggcgatagagcgagactccgtctcaaaaaaaaaaaaaaaaaaaaattagccgggcatggtggtgggcgcctgtagtcccagctactcaggaggctgaggcaggagaatggtgtgaacctgggaggcggagcttgcagtgagtggagatggcgccactgcactccagcctaggtgacagagcgagactctgtctcaaaaaacaaaacaaaacaaaacctgagattgggtaatttataaagaaaagaagtttaattggctcatggtcctgcaggctgcacaagcatggcaccagcattgctcggcttgtgaggaggccttaggggaccttttactcatggtggaaggtgaagtgggagcaggcacatcatatgacaaaagcaggtgcaagggacagggtggtgccatacactttctgtcatccaggctggagtgcagcggcgcgatctcggctcactgctacctccgcctcccagttcaagtgattcttatgcctcagcctcccgagtacctaggattacaggtgcccgccaccacgcctggctagtttttgtacttttagtagagacggtttcaccctgttggccaggctggcctcaaactcctgacctcaggtaatccacctgcctcggcctcccgaagtgctgggattacaggcatgagtcaccgtgcccactgccatacacttttaaataaccagatcccataagaactgactatcactaagacagcactaagctctgcatgagagatctgcctccataacctaatcacctcacatccgtccccactttcaacattgaggattacatttcaacatgagagttgggcagggacaaatatgcaaactgtatcaagtcttatatcaaatggcatagtatttgcatataacctatgcatattctcccatatactttaaatcatctctagattacttacaatacctaatacagtgtaactgttatattgtactgtttagagaataatgacaagaaaaaaggaggtatacgttcagtacaaatacaaccatactttttcttttttcaaatattttttacctgcagttgatttaatccacaatacagaaggcacagatatggaggcctgactgtagatcagaccagaatgtcactatggttttccagctgaaatcaattggttattatctttggtacatggcagacattttcttgaaaatgaacctgtcacttcaaggaggtgttgcccatgatacacttcaagcgcagtgatagtttttcaaccgttgtgcccatctctccttcccagaacggtctttaaatactagaaagatgtcaagctcaatcacatccatggcagaattaagttctataaaaattctaacattgtgtactatgctcaatacttggttgatgggatttatctgccacaaatctcagcatcacaaaatatacccaggtaacaaacatgcacatgtacctcttgaatctaaaattaaaaattgaaattctgtaaaaaaaagaaaaaaaagactgttctagtgggattggtaatgacactaacggatgtgatttttgatactgtgtaatgcaatatattaacgtttggaatatctatatacctctatgaactagtatttttcgtatgaccagtgcatgatataaaatcatgcatgggtaaaagtttcctttaaagtacaaaatagagcaatggattttaagtaatcaagtatgaaaatattaaggctatgaatattttgctcctttttctaactacatatctgtatgataatgagttttcttcatatattgcaataaaaacaatccaccaaaacagtttgaatgcaagaacagatgttagaattcagctgtcctccattaagctagatagtagattttcaaacgagtgccaaaatgcaaatgagtgccactcttctcacttttcagttttcaaaaatagagttttttaaattaaaatctttatattattacataactggcttattttacattaaatttatattgttttcttcattttaatttattatgtgatagatatttatggatatacaggcatactttgaagatattgctggtttggttccagaccaccacagttaagcaaatgccacaataaagtgagtcatgaaattttgttttggcttcccagtgcatataaaagttatgtttctaccacactgaggtctgctaagtgtgcattagcattatgtctaaaaaataatgtacataccttaattttaaaacactttattgctcaaaaatgctaacgatcagctgagcctttagggaatcgtaatcatttgactggtggaaggtcttgcctccatggtggtggttgctgaaggttggggtggctgtggtaatttcttaaaataagacaacagtgaactctgacacactgattgacccttcctttcatgaaaaatttctctgtagcatgtgacactgtttgatatcattttactcacagtggaacttctttcaaaattggaatcaagcctcttaaaccccactgctgctttatcaactaagtttatggaataatctaaatcctttgttgtcatttcagcaacgttcacagtctttatcaggagtagattctgtctcaagaaacgacttagctcatgcatgagaagcaacttctgatttgttccagtttaatcatgagattgtagcaatttaatcacttgtttaggctccacccaccacatctgcagtgacttcctccactaaagtcttagatccttcaaagtcattcatgagggttggattcaacttctttcttttttgtttttgttttcccatattgaatcaatatttatttcaggacatgccatgtcaaaataaaacaaagattcaactcttgcctttaacaattgtattgtattataaaagcactttacaactccatcccatgtttaagtataagttactggcatgtgggctaatgattatctgtaagcatttctctattcagatccataatctaggtgctctctgaatattacaaggtgacaataagtgggaagtggaggaggaagaggaaagagaggggactaaggttctcccagtttaaggttttggactcagtttctttcaaacgcgtgctaatgttgctattttcatctcctatgagtcacaaatgttcttagtggcatcttgaatggggaatcctttccggaaggttttcaatttactttgttcagatccatcagaggaatcactatggtagctatagccttatgaaatgtgtttcctaaataataagactcaaaagtcaaaattactccttggtccacgggctgcagagtggatgttgtgttagcaggcatgaaagcgacacccttgtacatctccatcttgggtgaccaggtgcatggtcagtgagcagtaatattttgaaaataatctttttttctgagcagtagatattgacactgggcataaaatatttagtaaaccatgctgtaaacaactgtgttgccatccaggctttgttattcatttatagagcagaggcagaagagatttagcataattcttaagggccctagggttttcagaatggtcagtgagcaccggaattgcattagcctctaagagtcagcctgtcctttgaagctttgaagccaggcgttgacttctctctagctatgaaagtcctagctggcatcttcttctgatacaaggctgtacattgaaaatctattgtttagtatagccacctttatcagttatcttatctagatcttctggatcacttgctgtggcttctctgtcagcacttgggccttcaccttgcacttttatattatatagatggcttcctccttagacctcatgagccaacctctgctttcctcccctctcagtcttcaaagaattgaagagacttagggctcctggctctagattagactttgaattaagggaatgttgtagctggtttgatcttctatccactgaaactttctccagttagcaataaggctgtctctttagccttcttatcattcatgtgttcactggaatagcatttttaattttcctcaataacttttcctttgcattcacaacttggctgtttggtgcaagaggcctggcttttggtctgtctaggtttttgacatgccttcttcacctagcttaatcatttctaaatttttacttaaagtgagagacatgagactcttcctttcacttgaactcttattgttgggttattaactggcctaatttcaatattgttgtctcagtgaatagagaggcccaaggaaagggtgaggtacgaggaaatggcttgtcagtggaggacacacacaacctttattaatttagtttgctatctaatatggacgcagtttgtggcaccccaaaacaattacaatagtaacatcaaagatcacggatcacagagcaccataacacatacaatgcaaaagtttgaaatattgggagaattgtcaaaatgtgacacaaagacttgaaatgagcacacaccagtagacctcaacagagggttgccagaatccttaaatttgaaaaaacaaaaacataaaaaaacaaaaaaaaagaagcaccattaatctgtgaagcacagtaaagcaaagttcataaaatgaggtatgcctgtatcttttataaacaaaaccttggagtcccagtagtttttaacagtataaaggaatctcaacatcaaaaagcttgcgaatcattctcctaagtcttctcttttctgggttaaacatcgccagggctttgatttatttcatatgagttccagttaattaatcatcttgattgccatccagtttgaatctcttttaaaatgtttttgccagaatttttcatactacagatgtggtgcaggttgtggtggggattattgcctttattccttttaatcatcgcagttctagtaaggcaactttaaatttaggttgtcatacttatgtggatttcatggagagctaaaacctcagattctctcttttgtgtgctgttatcaagtcgtgtttcttttcatccatctttagtatatgatcattatttttaacatattcacagagtcactcataggacatcttacccagtaaagcttattttatttttttactgttacattttagaattttctatacagtatacaataaattacaagaattttcatagtactttgtggatgtcagtgctaatacaagtacaaagaaaaacttgtggtttttttttttttctgggcatcaattatgtatcaacaacatgtatcttatcttttttttaggcataaaatgtagaaaggaaaagtctgcttagcattttctagtgcaagaatctattctttcattttggaactatatacaatgttaacattgttgagtacaaatcttcagataataaaattgtggcaaatcctggattattgttaataaagaatatggcctcagagtactttctatgtttctaattagtcaattttagtttgttgtgtataaactgctaacctttttacccttgaaactaacaagaatgtaaatatcaaaagagtagatgacagcatctgaaaataatcctgtaagcttatgtttagaagcacaatgcttaaaaaaaaaaactttttgtggactgtaccattatttcctaatatatgatacttcctacagatactaaggagatcttataaatggttgtttgcttggcccttggtttttgttgcaggaggagctgtgccatgaggttaggtgaagaatgtctttgcctttgtgctttattatgagggtaacttttttttctttatgcctccctccacctcagtctcctttcaggacatttgatgaatacgcaagtccaatgaacatgttgtcttttttatattcacttcagctatacaaaagagagaagttaaatttgcaatgctctttaaagattttgagtaggtactcccctaaaaaacaaccaaaatattaattagtcctacataggtataccttcaatttgctttctgatcatttttttagcccattttttacacactgattcctataactatttagtacagttaaaatattactaagaaaatagaaaaataccctcagaaaatatagtagtttcaatttattagtaaaaatgacacaaaataagctttaatagtttagacattacatatattgtttttatataaattatgttggctgctatctctccttcattctttgtttatttattcaataaatacttacatatgccaggcactatgcttcagtgttgtattgacactttacattgttttcatttatatgctaagttattttgtttaaaaactattaagcaccacctgttttaacttttacaaaggtagtatagttagttagatatgcatcctcaatttaaatatatgtgaaaaaggaaactttttatttagcaatctgtaaaacttaaatcttttgggagtgtgtggagtgaggaaggacatctattatttcaaaacttttttgagaaattatagcacaatgctattaatgtaaaatcctaatagttttgacatttttagcactctaataatatctttatttaaaaatcaggtgtgcctgtaaaacaaatgttgtcagtattctgaatgttgccaattggttgtattttgctacttgaaaatttcttccaaatagcaattaaacagcacttaagctttggtacttgctgaggcttgcaataaataaatcgctgtttgattaattagcacacggtactggtagcatgctcagccgatgaggttttaatattgctgtgttagaatgtctgtaagcagcagcaagttatttaatacaatttttttgtcaatttgtaatagttaaaaacattttattactcgaacttattctaagaagtttgtaaaattgaatggtttttgcaagtcttcgaaaataaaacaactacgtttgctgtacaagtatttgttggttttatgttgttttttcttcctgacatactaaaagtttatagatgaaaacttatataagtctgcaaacttgaattaaaaattgatcattaagaggtgacctacacaaaaagataaccttaagttaaaggcttacttttgctttgactgtttactttttttttccccctctaaggggtcagttttcttttggtgagattactttcttttggtgtatggcagtgctatctctgctagattactggaaggagtagtgtctgcgattggggttatacagctttctagcatctcaagtgtctgttttgtctggactttactcacgcagcattcttgtgcaaaaatttcaaggctttagtctggagcactgggtcaaaggatatgtctctttgaagggtagacaggagttttttatgttttattcactaagtagtatttcattttacatcaaagaatagcagcctttgagaacctaccatggtggcagtttagcgtgtgggtttttttctttaagactttcactaaatatgtataatgtttcttcaagtgtttcatcctacaaaatgcctatttttattcttagatgaaacttctaatataaaaagagaagaatcatgactaaatataaatgtttgttgcaataaattttgttttaaaagcaactatagtttttttttttttacaatgtatttccctgtgtcagtttttacactacccacaagctattgaaaaaaaaaaaaatggatgaatagcctttaagattgcagcaatactgttgcttaaaattctaaggaagcagtaatgactagtgattttggaagtgtagatttcatagtgaaatggtcattccttaattgttccttttttagtactgtcatgtgtgtatgtaggagagattgattttgaaaaataccagactcaagtaatggaaaatgttaagacttcttgaagctagaaggaaagctcttctttttgtactttttgtgtaagttaatcagtaaataatcatataaaaagtgattgctttacatgtttggaagattattacattgtatttcatatttttgtctcatgacatgtatctataaacatgaactaatattaaaagttttttatgtttataaataaaacatgctcttaaatagttgaaagtttatcaaaacagttaatcatttaaaatgaattttttctactctccttgatgtaattttaaaacctgttatatttaactatgatgatcattaaaacaagtcagttattatttttcaaatgtaattatttctaaattctttagataaataaaattctgcagaactttgttgtttaaaatatatgcttattgaaatgctatttttatgtagtatcaagctgtgtaaaacttacatgtactaaatatcacaaagaaaatgaatgttaagtattacagtttttatatacagacaggaaccattaaaacttagagaatgatcgttctatatttaaattgtttaaggaacaaaagatctttcccctacagtattcagccatctctattatctgtgattcttcagcaattaaagcagatttatttccctctttgttcctacttggaatacttgaacaatactggagaattgaactgactgaaatgttttatctttcaaaaggtttaaagttctatgtaccaattagcaaaatacagtaaaggtttaaactgttaatagccacaacatctttaatgcatagacctgtagtatgctagtgctgtataacagttctccattgtgtgtctcttttaagcagagtaactgtgtcagttcttttcttgctttactacctgctgtgtatggaaattgtgtatcgtacttgacacttgctttcaagaatttaaaattcttgcatgttattatgtaggaaactttggctctcaagaaaatagaattgataatatttcatttgtttggattttaagtttaggttttttgtcatattctagagagtactcatttatatctgaaaatacattattagtctattactcattagtgaatttgaagtacataaactgtatgttatctccttgaaaattgcttatctaatttttttcatttaactgaatataattataaagaaaccatcaaatttatggtagggtatgcagatagatccctgatgctttattttacactctatttgaatttggttttgggttttttgttttgttttgttttggtctttttggtagtaaatagtactttgtttttaaagttatagctcttgaattagccagcttgccagataagtttataactcaagaattaatccaaatacttaaacttgttaaagccttatatctgccattttgtagtaagttctcaatgaaggtagggtgagaggaggtaaagaaatagaagtagtatcttttggtgacaattatattttctttttatatcatgtatctcagaatagaattagagcaaaagaaaggagaacgtagactttaaaatttgagactagcaaactttgattctatttctgtgttcaggttttctaattttatatgacctagtgtctgcttctattctactcttcaaaataccacctgcaagcatgtgagatattcatgttttataagatggggaagtttgaaaaatagggcagtgatatggaagctttactgtatgcagtatactatgtctccacaaaactgcttctttataaggcatacttttctagaaatgtgtgaataggctttttgttcagttgctgtttcatgtttaatactttacttctaaaggctttcagcatatttcatgttagttgatgagggtttttaaaatgttaatgcttccaataaaatagacatgaaaaataaacttggctttctctaaacaacatataggatacagaaatataccaaaatgttgggctgagaatgctaacttaaagaactgaggatctgattagtgtaccgatgtacatctattccagtgattactgagtatatattgtgtaaattaagatgtatccattaaagataatttttaaacctaattgggtagtttaagatttgacatccaaagaattaaaacaagatttctgatttagtatgcattataatatcttaaacattcaaatatggcagctatagcctgtgcctaggttgctctgagattagaagtcctctagatctagtagttttcatctaggacaatctgtagttgtgaagatcattcaagatatttttttacttgtctcttatttataatgtaaaatattattatcctttccttcattcattcaattttttttttttagcatattctaggccctggggatgtagctatgaacaaagcacaacaaccatgtccttagagcttatattctcatgcttaagcatatgccagctttattcataaataattatggtatttttcatagattatgaatattatggaaaaaacaaagctaggtgatgagacagagaatagctggggtttgggtggaataggggtcatttaagtagggcagtcaacgaaacccactttgagatgttgtgctgtgtgaattaagatctgaattgatgagaaagaagcagctgtgtgagtatctaaggtaagagcattttgagtaaagggaaaagctaatgaccaaaagtgtagctggtagtagtcaaataacagacggaaagatatgacataataagaaaggaggagaatgatataaaatgagatcagagatgtgggcaggagctggatcaggtaagaaggctctttaggcccatagtaagaaatttgaatattatttgaattataatgagaaggctttatataattctaagtagaaaagtggtttgatccgatttacttgtaaaagctagaaaattactaagctattatggttaagggcaactttaaagaagctcaaaggaaatggttagtttgctgccattttaatttgaaggaacctaatttttgtctttgcataggttttatatacgatataacaatttggtgattttttttctattaaagaatcttctgaatttgaaattgctttttgagaaaggcagtattgggaccaggaataataaactcatctctctaattctccatagcccttctttctctgccctgcccccttctccaccaagggaaaacatgttaaagatttgtcatagtggtaaaggaagataagaataaattggctgaggtgctgtccaccagtttggtgctgatagcttcaaatatatttgagttctgcaccttgcttttgccagtggcatgggttgatggtgatagttgtctgtcttcatcttaactttgactgcacttcctcttgttctgcctctcctttcccccctcttactctctgcttcttgaaatctctcttcacagtttgtatggcttttcccctctgtcttttgacactctgtcttttgctgactatgtagctgtaggtcatctctctctccctttctggctacatgtgttttcctgataccaccttattcccttccatttttttcatttttcctgccttcccttctgtctctctctagttttggctttctgagtcattctttggccgtcattttttcccccactcccctgtctcttctaccgcccgttttcttcttccttccattctttttattccgtacttctgttccttttatctttcttcttctttctctcactttcccaaaatgactaaggagcaacatcaaaactagtgggagagacaaaaggtgccccaccctctaagcacttttttaaaaattgtcatatttcctcttttgtaaatatataggacttttagaaacatttaataactgaaaaatggtttatacattattacattatttgaaatgttcactctagtgagatacatgggataatggcaagatcatggactaattataaatatagccttagatctttagtcatctcttcttttagctgtataacctgaagcaagttatttaacctctgtgagtgtcctcatcttataaaatgaatatacctttttatatttgttttgaaagttaattgagaataccaacactaaacaagaggagagcctggatgcagtggctcacaactgtaaccccagcactttaggaggcctagttgtgaggatcacttgagcctaggagtttgagaccagcccaggcaaatggggaaacctcgtctcttccaaaaaaaaattagccgagggtagtggcgcgtgcctgtggtcctagctacctgggagactgaggcaggagctgaactattaatactcaggagattgaggttgcagtgaggcgtgatcatgccactgcactctagcctgggtgacggagtgagaccctgtctccaaaataaataaataaataacgcattatgttcattattcactaaaaagtgtttttcttcctttttttgctacttggagttgttagcctggagagagaagcaagctggaattataattattattcttaatcagttttgaattattatggagcccattcttgtgaatcaaatctgcagtgcaggtactaagttctagggcaccctggagcacaatattggcttcacagtggtcctgtgttagtcatgtgtgtatacgtatgtacatgtatagttggtaatgatttttgtcatgtaacttgccttttctaacagcctgtggcactaatatcatctgtgatattatctctcaatatacagtttctgacaatcaactatgtaattctttaattggtagataggtgtattgctatataattatccttccagtgagaaatttctttattctttttaatggtggaaatttgtaactgtattacttcaaggaagtttccaaagtacttattcctattattatatttggtcattaaaccctgtgtaattaaaaaattactggttttaggctgggcacagtggctcaaacctgtaatcctagcactttgggaggctgaggtgggtggattgcctgagctcaggagttcaagaccagcctgggcaacatggtgaaaccccgtccctactaaaatacaaaacattagctggtcgtggggtcacgtgtctgtagtcacagctactcaggcggctgagacatgaaaattgcttgaacccgggaggcggaggttgcagtgagctaagatcgcgccactctactccagcttgggcaaccgagtgagactgtctccaaaataataataataataataataataattactggttttaatagtaaggcatagacatatcaaaaatcacattagaggccgggcacggtggctcacacctgtaatcccagcactttgggaggccgaggcaggtggatcaggagttcaagaccagcttggccaacatagtgaaaccccttttctgctaaaaatttaaaaaaaaaaaaaaaaaattagccgggtgtggtggcgggtgcttgtggtggcgggtgcttgtagtcccagctacttgggaggctgaggcagaatcgcttgaacccagaaggcggaggttgcagtgagccaagatggcgccactgcactccagcctgggtgacacagcaagactctgtctcaaaaaaaaaaaaaaaaaaaaaacacattatacatcataaatatatcaaattttactaccaataaaaaagatacatattttttaaaaacatagtaatatgtacatgttgtggaaacattaatttggaaatgaagaaagcataatgaagaaaattaaaatcaccttaatctcagtcttggtgaatttacttcttttttatatgaatatttaaacacactaatatctaatgtatttatatgtaagacaaattgttttacagttttttatcctgtttttcactttattataatgtgactatatttctttaaaattattcaaaagcataattataaacgaatgtataatctttcattgtatggctgtaccataataccttagccatcatgcagtttttgtactgcaggttgtttacaattttttgcaactatacgcaatgctagaatgaacatctttatacctaagtctaatctttgatgacatctttattttagtatcaattctttgaagtggaattactaaattgaagggtttagtatcaacattttaggccaggcgcagtggcaaggtgggaggattgcctgagcccaggagttcaagaccagcctgggcaacatcgcaagaccccatctcaaaaaatgtaaaaaaaaaaaagtatcaacattttaaatattttttgatacctagagataattgatacagaatgcttttagagaagattttaccaatgtaactttagagatatggctttatttttaatatacatggcctagttctgtggatacttttcagactctgacacagggggcatgtagcaaattctacctaatagataaataccatatatctaagaattagagtataataaaaatacttaatacattaatgatgcaacattgatttagaagtacttcaaggcttagtatatatatcctaaggatcaacttacaaatttatgtatcattgtactataaattggtggatattgctggttgatgagatttctatcacaaatctctgtatactaggccaatgcatagcagttagtgctacagaagcattaactattgctgctgctgctacattagtaccactgttactattattttataaagcattataacagagtttgtggcataatgtatctgaggaagttatgaaactttctacctattcttacattcagtctatgtttttgttttgttataaagcctttccaaaacaatgcaaggtaaacatcatcctctgaaatatctacagtacttcatcatttatttggcgaactacattattactgatttcaaatttaattctgtagtcagcaacatactctatgatttcaattttcagatttcttgagacttttttatcgcctagtgtatggtctgtcttgattaatgtttcatacacattttgaaagaatatgcattctccagtttttgggttgggtgttccaaaaatttcaattaagttttaagttgactaatagtgttactcacattttgtatatctttaccaatatttttgtccacattttctgttagttcttgagagagaagagttaacgtctcaaactataattggtatctttcctgtgtgtgttggatcacatttttgcttcacttattttgaaactactgttggttggtgcattaacattgaaaattgttgtgtgttcttgataagttgttgctttattcttatgtgatgtccctctttatcctggtgctgtttctttttctgaagtcgaatttgataataatatataactgcctcagttttcttattcttagttttgtatggtacatcttattctcatttgtgagtttatatttaaagtttgacctttgcgattatatgtgggtcttacttttttatttagtttgacaatttctgtcttttaattttgtgtttaaaaaattatgtgcaaaatatttattgatataattgggtttacatttaccatcttgctgcttgttttctatttgtcctatctgatttcttttttctttcttttttgttttaacagttgctttagggattacaatatgcatccttaacttttcatagtctgccatgaactaataatgtattacttcatatgtaacataagaaccttaaaacagtacttccacttgtcattccagtcctttgtgttaatgttgacacacattttacttccatatttgttataaacctcatagtaaatttttttttttttttttttttttttttttgagacggagtttcgctctgtcgcccaggctggagtgcagtggcgcgatctcaactcactgcaagctccgcctcccgggttcacgccattctcctgcctcagcctcccgtgtagctgggactacaggcgtgcgccaccatgcccggctaatttttgtatttttagtagagacggggtttcaccgtgttagccaggatggtctcgatctcctgacctcatgatctgcccgtctcggcctcccaaagtgctgggattacaggcgtgagccaccgcgcccggccgtaaattattatttttgcattaaacagttgtcttttaaataaatttagaagtgagaagaaaaatcttttgtacttactcacaaatttatcatttttgttgctcttaattattatacttcatgtagataaagtttccatctggtatccttttcctttagcctaaagagccttatttaacatgtcttacagtgctgttctgttgggcagaaatctctcagcttttgtttatctagaaatccctttattttgactccacttttgacagaccttgtcttagctcagggtgccacaacaaaataccatagactgggtggttcaaacaacagaaatttagtttctgacagttttgaaggctagaattccgaggttaaggtaccagcatggtcgtttctgttgagggctgtcttcctagcttgtggaaggccacctccttgatgtgtctacatggccacagagagagagaaaaagcaggtgagctttgtcatatctcttctcataagggcactaatcccattatgagggccttactcatgatctcatctaaccctaattacctcccaaaggccccatttctaaataccatcacatttaggattagggactcactatacaaattttgggagaatacaaacattcagttcataacagaccttttcattggatatagaattctaggttgaagattggaatgacttaaaaatgtcattccagtttccttttttgaaaaattatgttaaaatatacattgcacaaagtttaccatttttaagagcacaattcagtggcattaaccacattcataatgttaagtaatcatcaccactatttccggagctttttcatcatcccgaatagaaactctgtacccattaaatattaactgtcctttatgctctcccctgttcctcataacctctattatactttctgtgttatagcatgtgtcagaatttcattccttttaaaggctctacataatagttccattttatgtgtatatcacactttgtttatccatccttctgtcgtcgaacatttggattgtttctagggctattgtaaataatgctgctattaatatggatgtctaaatatttgttcaaatctctgctttcaagtttttaggaagatgccccaaagtagaattgttggatcatgtagttattatacgttgagcattttgaggaactacatactgttttccatattggctgcaccattttacattcccacagcaatacacaaaggttccagtttctctgcatcctcaccaacatgtgttattttccattttcattataatagccatcctaatgtgtgtgaagtagtatctcagtgtggttttgatttgcatgttcttaataaattagtgatgttgagcatctttttgtgtgtttatttgccgtttatgtatctttggagaaatgtctattcaagttctttgttcattttgaattaggtgtttgtttttttgttgagttttcagggttttctgtatattctggatcttaatcctctatcagctagatgtcctttgatgcacaaaaattttaattttgatgacgtctgatttatctgtatttttttgttgcatgtgcttttattgtcatatccagtaattccttgccaaattcactgtcgaagatttcctcctatgttttcttctcaaagttttacagttttagctcttccattgaggtctttgatctgtttttttgtttgcttgtttgtttgttttgagacggaatctcctctgtcacccaggctagagtgcagtggcgcaatctcggctcactacaacctctgcctcccgggatcaagcgattcttctgcctcagcctcctgagtagctgggactacaggcgtgcaccaccatgccctcctaatttttgtattcttagtagagatggggtttcaccatattggccaggctactcttgaattcctgacctcatgatctgcctgcctcagcctcccaaagtgctgggattacaggcatgagccaccacgcccggccctttgatccatttttagttaactgttgtatatggtgtaagacaaggattcattttcattctttagaattggatatccagttttcccagcaccatttgttggtgctttccacatcaaatggtcttggcacttctttaaaaaaccaattggctatatatgcaagggtttatttctaggctattttatttcattggcccatatatctattctctgtcataccaaactaattattgtagctttgtagtaagttttaaaatcgggatttatgagtcctccagctttgttcttcattttcaagattgttttgaaacaaagatttcacgtgaattttaggatggatttttctatttctacccccaaaatgtcactttttatagggattgcattgaatctgtagattgattgctttgggtagtattgtcatcttaacaatactgatgtttccagttgatgaacacaggatgtcttcccacttacttatgtctttaatttcttttaacagtgttttgcggttttcagtgtacaaatctttcgttttctaagtttgttcctaagtattacattcttttctatgccattgtaaatgggattgtttttgtaatttactttttagattgttcattgtgagtgtatagaacataactgatttttgtatattgattttatatttgcaaccttggtgaatttgtttattatctctaacaggtttttttggtggaatctttagggattttcacatatgtcatctgggaacagagataattatacatctttacaagtttggatggcttttatttctttttcttgtccaattgctctggctagaacttccagtactacattgaatagaattagtaaaagtgggcatcattgtctttttcctcatattagaggaaaagctttcagtcttttctgggtttgtgttgttgtttggtgtgttttgtttgtttgtttgtttttgttttttgagatagggtctctgtgcagtggcataatcttgtctcactgcagccttgaactcctgagctcaagagatcctcccacctcatcttcctgagtagctgggaatataggcacacaccactatacccagatagttttggctttattttttgtagaaatggggttcgccatgttacccaggctggttttgaactcctgagctcatgcaatctgcctgcctcagtctcccaaagtgctgggattacagttttctgttttcttttatcatcattactgtgtaggtaatgtgtctttcttaagactacttttatgataattatcttatctttaaacttcagaaattttgttatactgtgtttttgtgtggttttctttacatgtatcttggttagggttcattaagattcttggaatttttgattagtattcttaaaaattggaaaatttggaaatttttcttcaaaaaacatttctgcttcaatctttcatcttctgtaactataacacttatattgtactgcttaatattttccagccagtcactgaggcccagtttgacttccagtctttttccactatgtagtgcaatttggttagtttctattgtcctgtcttcaaatttactgatcttttcttctgttggtgtccaattttctattaatcccttacagtatttatcattttagatactatatttttcagctctagaatttctatttagttctttaatatagtttccattattctgcagaaatttttgaaatgttcactcattttgtccatcttttttcttgaaatcttttaacatatttatagtcattatttataaacctacatcatttcagggcctatttctattgattattttgttattgtagttgttgtttcccttttacatacacatttaatgatttttttaaaattatactttaagttctggggtacatgtgcacaacgtgcaggtctgttacataggtatacatgtgccatgctggtttgctgcacctatcaactcatcatttacattaggtatttctcctaatgctatgcctcccctagccccccaccctctgatgggccctgggttgtgatgttccccgccctgtgtccaagtgttctcattgttcaactcccacttatgagtgagaacatgcggtgttaggttttctcttcttgtgttactttgctgataatgatggtttccagtttcatccatgtccctgcaaaggacatgaactcatccttttttatggctgtatagtattccatggtgtatatgtgccacattttctttatccagtctatcattgatgggcatttgggttggttccaagtctttgctgtcgtgaacactgccgcaataaacatgtgtgcctgtgtctttatagtagaatgatttataatcctttgggtacccagtaatgggattgctgggtcaaatggtatttctagttctagatccttgaggagtcaccacactgttttccacaatggttgaactactttacacttccaccaacaatgtaaaagcgttcatatttctccacatcctctccagcatctgttgtttcctgacattttaatgatcgccattctaactggcatgagatggtatctcattgtggttttgatttgcatttctctaatgaccagtgatgatgagcattttttcataagtttgttggctgcataaatgtcttcttttgagaagtgtctgttcatatccttcacccactttttgatggggctgttggttttttttctcataaatttgtttaagttctttgcagattctggatattagtcctttgtcagattgatagattgcaagcattttctcccattctgtaggttgcctgttcactctgatgatagtttcttttgctgtgcagtagctgtttagtttaattagatcccatatgtctattttgacttttgttacaattgcttttggtgttttagtcatgaagtctttgcccatgcctgcatcctgaatggtattgcctaggttttcttctagggtttttatagctttaggtcttacatttaagtctttaatttatcttgagttaacttttgtataaggtgtaaggaagggatccagtttcagctttctacatatggctagccagttcccagcaccatttattaaaaagggaatcctttccccattgcgtgtttttgtcaggtttgtcaaagatcagatggttgtagatatgtggggttgtttctgaggcctctgttctgttccattggtctatatatctgttttggtaccagtaccatgttgttttggttactgtacccttgttgtatagttaaaagtcaggtagcatgatacctctagctttgttctttttgcttaggattgtcttggctatgtgggctcctttttggttccatatgaaatttaaagtagttttttcgaattctgtgaagaaagccagtggtaccttgatgggtatagcattgaatctgtaaattactttgggcagtatgtttattttcacgatattgattcttcctgtccatgagcatggaatgttctttcgtttgttcgtgtcctcttttatttctttttgcagtggtttgtagttctccttgaagaggtccttcacatcccttgtaagttggattcctaggtattttattctctttgtagtaattgtgaatgggagttcactcaagatttggctctctgtttgtctgttattggtgtataagaatgcttgtgatttttgcatattgattttgtatcctgagactttgctgaagttgcttatcagcttaaggagattttgggctgagaccatggtactttcatgatacacaataatgtcatctgcaagcagagacaatttgacttcctcttttcctaattgaataccctttatttctttctcttgcccgattgccctgaccagagcttccagtactatgttgaataggagtggtgagagagggcatccttgtcttgtgccggtttttaaagggaatgcttccagtttttgcccattcagtatgatattggctgtaggtttgtcataaatagctcttattattttgagatacgttccataatacctagtttattgagagtttttagcatgaagggctgttgaattttgtcgaaggccttttctgcatctattgagataatcatgtggtttttgtcattggttctgtttatgtgatggattacatttattggtttgcatatgttgaaccagccttgcatcccagggatgaagccgacttgattgtggtggataagctttttgatgtgctgctggatttggtttgctagcattttattgaggatttttgcatcgatgttcatcatgggtattggcataacattttctttttttgttgtgtctctgccagtttttggtatcaggatgatactggcctcataaagtgagttaaggaggagtccctcattttctattgattggaatagtttcagaaggaatggtatgagctcctctttgtacctctggtagaattcggctatgaatctgtctggttctggactttttttggttggtaggctattattgccccaattttagaatccgttattggtctattcagagatttgacttcttcctggtttagttttgggagggtttatgtgttcaggaatttattcatttcttctagattttctagtttatttgcatagagttgtctatagtattctctgatagtagtttgtatttctgtttgatcagtggtgatatccactttattgttttttatttagtctatttgattcttctctcttctttgttagtcttgctagcagtctatctattttgttgatctttttaaaaaaccagcttctggattcattgatttatttttttgaagggtttttttgtgtctctgtttccttcaatcctgctctgatattagtcatttcttgccttctgctagcctttgaatttgtttgcttttgcttctctagttctttaaattgtgatgttagggtgtcagttttagctctttcctgctttctcttgtgggcatttagtgctataaatttccctctacacactgctttaaatgtgtcccagagattctggtacgttgtgtctttgttctcactggtttcaaagaacatccttatttctgccttcattttgttatttacccagtagtcattcaggaggaggttgttcagtttccatgtagttttgtagttttgagtgagtttcttaatcctgagttctaatttgattgtactatggtctgagagacagtttcttgtgatttctgttcttttacatttgctgaggagtgttttacttctaattatgtggtcaattttagaataagtgcgatgtggtgctgagaagaatgtatattctattgatttggggtggggagttctgtagatgtctattaggtctgctcggtgcagagctgagttcaggtcctggatatccttgttaattttctgtctcgttgatgtgtctaatattgacagtggtgtgttaaagtcttccagtgttattgtgtgggaggctaagtctctctgtaggtctctaagaacttgctttatgaatctgggtgctcctgtattgtgtgcatatacgtttaggatagttagctcttcttgttgaattgatccctttaccattatgtaatgcccttgtttgtctttttcgatctttgttggtttaaagtctgttttatcagagactaggattgtaacccctcctttttttttctttccatttgtttggtagatctttctctatccctttattttgagcctatgcatgtctttgcctgtgagatggatctcctgaattcagcacacaaatgggtcttgactctatccaatttgccagtctgtgtcttttaattggctcatttagcccatttacatttaaggttaatattgttatgtgtgaatttgatcctgtcattatgatgctagctggttattttgcctgttagttgatgcagtttcttcatagcgctgatggtcttcacaatttggcatgtttttgcagtgtctggtaccagttgttcctttccatgtttagtgcttccttcaggagttcttgttaaggcaggcctgatggtgacaaagatctctcagcatttgcttgtctgtaaaggattttatttctccttcacttatgaagcttaatttggctgggtatgaaattctgggttgaaagttcttttctttaagaatgttgaatattgacccctactctcttctggcttgtagggtttctgctgagagatctgctgttagtctgatgggcttccctttgtggttaactcgacctttttctctggctgcccttaacattttttcttcatttcaaccttcgtgaatcctacgattatgtgtcttggggtcgcttttcttgaggagtctctttgtggtgttctctgtatttcctcaacttgaatgttggcctgccttgctaggttggggaagttctcctggataatatcctgaagagtgttttccaacttgtttccattctccctatcactttcaggtacaccaatcaaacgtatatttggtcttttcacataatcgtatatttcttggaggctttgttcatttcttttcattcttttttctctaatcttgtcttcttgctttatttcattaatttcatcttcaatcactgatatcctttcttcagcttgatcgattcggctattgaagcttgtgtatgcttcacgaagttctcttgctgcatttttcagctctatcaggtcatgtaggtttttctctacactggttgttctagtcagcaatttgtctaaacttttttcaaggttcttagcttccttgttttgggttagaacatgctcttttagtttggaggagtttgttattacccaccttctaaagcctacttctgtcaatttgtcagactcattctccgtccagtttccttttcttgctggtgaggagttatgatcctttggaggagaagaggcattctggtttttgaattttcaccctttatgcactggtttctccccacctttgtggttttttctaccttcggtctttgatgttggtgacctatggatggggttttggtgtggatgtcgtttttgttgatgttgatggtattcctttctgtttgttagttttccttctaacagtcaggcctctcagctgcaggtcagttggagtttgctggaggtccactccagaccctgtctgcttgggtatcaccagcgaatgctgcagaacagcaaatattactacctgatccttcctctggaagcttcgtcccatagaggcacctgccagatgccagccagagttctcctctatgaggtgtctgtcggcccctactgggaggcgtctcctggtcaggctacacggcagtcagggacccacttgaggaggcagtctgtacattatcagagcttgaatgctgtgctgggagaaccactgctgtcttcagagctgtgaggcagggacgtttaagtctgctgaagctgtgcccacagctgccccttcccccaggtgctctgtcccaggggaatctgggatttatttgtaagtccctgactggggctgcttgccttttgttcggtgatgccctgcccatagaggtggaatctagagaggcagtcagccttgctgagctgtgatgggatcctcccagtttgaacttcccagcagcattgtttacactgtaaggataaaactgcctactcaagcctcagcaatggcggactccactcccaccaccaagctccagcatcccaggtcgatctcagactgctgcgctagccatgagaatttcaagccaatggatcttagctttcatgggcttcatgggcacgggacctgccaagccaggcaccgatgggaatctcctggactgccgattgcgaagaccatgggaaaaagcacagtatctgggcagaagtgtaccattcctccaggtacagtctgtcacagcttcccttggctaggaaagggaaattccccgaccccttgcacttccctggtaaggcagtgctgtgttctgcttcggctcgccctccgtggtctgcacccactgtccagccagtcccagtgagatgaaccaggtacctcagttggaaatgcagaaatcacccatcttctgcatcagtcttgctgggagctgcagaccagagcagttcctatttggccatcttgccagaaaatacagttaatgatttttaagtgtgtaattgatgttctgattgctttgttactgggagcctggattttactgtcttcctttatacagcatttagatttgtttcagcagtctactactgctgatcagcttaatccttttagtgattgatattaagcattgtatgggcagtcatagagttgctcttcttcttacgttttacctttcttgtgtctcaatttaatgcccagagtgttcagcaaaatctttactctgacttgttagaacttctcattacttgtcccacttcacagagtctcattgtagacaaagactgtgcagatttctgaaactccttttttgcttaactcctcttcagaactctgcctcagaaatgtcatttgactcagcatgcctgaatgccaatccctaccttttctgctctgtgagattgctttgttctgcttgggatttacctttctgtaccatagtctgatatgtgcccccatgcatgaagctgagacaattataggactgcatcttgagttttccttctttcagggaacacagtgctgtgctttctgttatcaggttgtccaatacctgaaaacagttgcttaaaataactttcctagttttatagtttgtaaaggcaagagtggtagtctgatcccattatggattgcagcaggatccatatactacactgtgacaattcttttgcaacagtggctttgttaatgaatctttactttttaaaccaacctttaaaaatgtgctcagttattgatgttctcaattctctttataaaacatacctactaacacccttgacatactacatatgtggcttaattaaggcttcattttagtatattgccagacttcagctttcagtcattgagtcgtatgctttatcaagactcagcgagcttacttccatacctgtctctgccagttatacttgacattgtaattcataatgtaactgagtgctataatctgcttatatgaggacaagagagtcctttctgtaacagttctgttgaatactttgagaagatgataaaggtgaatttctaatgatagtgttcaagacatggaaccccacaatatggtgacttggcatattgaatattttatgaagaaggcagaagcaaaaaggtcactgtgaccttccccactccctgtctcttatgaggtaagttgtaaaacctaggaaggattttttgacctttccctgaccatacaaccttatgtgagagttgccttacctatacattgaggaagataaaggatcacagagaagaatctgaacaaaaagccttgctaagtttctgcagtctattaccattagatcacacctcctttatcctatcatatttctgactacccactcttcatctagcctacgcataaaaacacacaggtttaactcttttttgggtcttcatttccgtatgaaggcttctgtgtcacataaaacttatattaaataaatttgtatgcttttctcttgttaatccgtcttttgttttgggaccctcaaccatgaacccaagatgggtagaagaaaagatattttgtctccttcatactaataattcctgtcaaagtatgttgagtaaggcaattgtaaaaagattgtgtgtggtgtaaaaggaaatcattaaattctaggcagattttggactcagattatttcacaaacatttttatattctcacttcacatttacaaaactgaaactataaattgtagatggtgtattttcttgatggtttatggaaaaaacaccacttgggattttgataaatggacctatactcaaaaggtattgcccaaatcagattattaaaagaatacacgtgtacattcttgcattataatataatgtttaaggtttgtgtatattgcttacttaagtgtttccctggttttactagtatgttcaggcaactgagctaggaccagttcttaacaacagaaaggaaacttctgttgcatagttttttattcttatgctaaattgacaaggaatccccttacacttttttaatatgccttcttgcaatctagtttgacttgcacatcattgcctcatgaatatttcattattaaatctgaagcgttcagttttcaatccattattttctcttatttccagtgtccttttcagatgtaattaagttcctttattgcttaaaaccattgcttgattttaggaaatttatgttctggccctttgtcctgatatttgtttatttaagaattatttcatctttagttctttactgccataccttttgttttcataactcttaatgtatgctatgtgttctttagcctttttaatttattaccaggagatgaagagtactgtttaattaagaaataatagattggttctgttctgttctgttctttctttgcttccctttcttttccttcccttccccctccttcctctccctcttccctttttccttccctgtgggtcttgctttattgcccaggctggtctcagatttcctgtgctcaaacagttcatttgcctcagccttctaagtagctgggattacaggcatatgccaccttatctggtttagactggttcttttcaaaaggtaatgttatataagttccaggtaccttagggccagactttttttttttcaccttttattatagcttctgaaaagctgccaggtatcctaagataggtacatgacttgatgatttaaaaatctgaaaaatctggctgggtgtggtggctcacacctgtaatcctagcactttgggaggccgaggcgggtaaatcaccttgaggtcaagcgttcgagaccagcctggccaacatggtgaaaccccatcactactaaaaatgtaaaaattagctaggcgaggtggcaggcacctgtaatcccagctacttggaaggctgaggtgggagaattgcttgaagccaggaggcggtggttgcagtgagctgagatcacgccattgcactccagactgggcaacagagcaaaaactctgttaaataaataaataaataaataaataaccaaccaaccaaccaaaaaatccatccagacatggtggctcatgcctgtaatcccagctactcagcaggctgaggcgggtggattgctggagttcgagaccagcctaggcaacatggtgaaaccccatctctacaaaaaaaaaaaaatgcaaaaaattagccaggcagggaggcatgtgcctgtagtcttagctactcaggaggctgaggtggtatgatcacctgagcccagaaactcaaggttgcagtaagccatgatcatgccactgcaccctaacctgggtgatggagtgagatcctttctcaaaataaataaataagtaaaaataaaaaagaatcctgaagtattgggttaaaaagcaaatccattaagctgccaaaaagttgaaattattaaatgttatacttttgtaattctaagtattaaaaaatgtattagtttaataattttcaaaatgcttctgttaaacatactggttttcatctaggcattgatccttcatttcttcgttaagcatatttttcaacgatttcagttgttccaaagtttgaacttagaaaacaaagatttttaagttttccttataaaaatgcaaaaaggtgttctaatagatttttcttatttgggggaaaaattgtatcttatatcatttttctaaaattgcatttcatcataaaatagtttcttagtagacttgatttggttatgtcatatgtcaaatcatatactactattagggagaaaatcttttgaatacccgttgcaaagtttatggctgacactgctataacaaaagacagattaacaagaaaaaaatgtaacaaatgttttacttattatttattttttaaagagatggggtctcactgtgtggccctgactggtctcaaactcctggtttcaagcagtcctcccacttcagcctccctaggagctggtattacagatgcatgccactgtatccagctaacagattttttaaaaaaccagttttacaggcagtggcagtctgatagattttcctggtttgcagtctgaatgtcacaaaggttgtctacacatgagttgtgatttctctgaagtttctatcaatttatccagccacagtttgtaagacttcaggaaaagggaagttttaattttagtaattccaagtcaaagaaacttgggagaaaattggaaacattagtttggagagctgtagctagatattagaagaaaccggaagaattcaggattcatttcagtttgtaggtaaataacaaaacttcaaaaacaatgtgctgggatctaataataggtgcactgtagttttcttctaaaatgtaatttttctttctacagtcattctcatttttatcaaagataatcaaactaatttgtttgcaaaacaagtttaatcttattaaacttagtgatatggttcggatctgtgttcttaccaaatctgacgtggagatgtaatccccgacattggaggtggagcctgttgggaggtaattggatcatcatggtggttggtccttctcgaataggttagcaccatcctgtctgtgctgttcttgtaatagtaaatgagttatcatgagatctggttttttaaaagtatgtcgcatctgcccccttctctcttccttcagccacgtgaagatgcctgctctggctttgctgtaaaaagtaaaagctctctgaggcctccccagccatgcttcttgtacagcctgccaaactgtgagccaattaaacctcttttctttataaaatacccagtttcaggtattactttacagcaatgtgagaacaggctaatacacttaacctgattatttacattatgtgcagcataggctctttttaagtctgctttgctggaacttttcataaggagtctcagattggatttgtaaaagcctctcgagactagaaggccaagccaaggactcttcataagactttgcattcgtagagatgaggtgaattcctgtttgaggtccccaagtatcctgaggttcctaggccttccaagaagtagcattccttactcacctagctgtaaggcaaccatacaaccatgtattcaagttaccaggccagtttttttacccctaaggggcttttattggctccataaagtcaaacttagtttcttaaagttatttggttgtatttgaaaataagacattctagtcaaagccttggtaatataagcagtaaatacacaatttcctgttacaagaacagattcttcctgaacttgtacaagtaactatattgtataaaaataagaatacttgcttatagttcctggattctagaaggattatgcagggggagaattttttccatttttgtttataaaagtatactttgccaaattgctgtaagctgtatagatagcttaaaagaaaagaaaaaagaatttccttaaatctggaaaacaaaacattaaagacccacaatgtttcaaacaacaaaaaaaaattatcctcattagttcattcaccctcatgtaattcttgttctgcttgattttgatgagcagtttcacgaacccattagtttcttcattcgagttctggaaattcttatgcagtccaatggtataatctgaaagttaccagaaatctgtgttacagagtacttgtcagtctttttcattaatccccttgaagatgaggcaacttagactattgctcactgcaaacactttgagagaagaatcaaaatatatagtaactgtcttatgaatgacagaagatttaaaatggccgtggttaaaagtctgatgagcgttcattattataatgatgcagttggcaaggaagttcggcagttttttggtatacaaaatgttaacatactagccagaattatgactgatagcattacaccagaacatatcagaatttttgaaatgtcaatttatggaacactcattaataatatactcatagataataattttgagaagtctaaacatcacttattatttgacagttcttcccatataatttaacttatcaaatgagcctaattaatatctccaacagattgagagacaaatcctttgagactttccagggaccctctggaaagttccaaaatcagaggtttaaaagacataatttagaattttactttaagaagtaaaaaatgtcaaaaggtttaaagcatttgattaaataggcccatagggcactgtgaaatattaccaaagtgacaaaagattttaaaggcaaacacagaaaactacatagttacaaatatgtggagctaaataatgagaacaaatggacacaaagaggggaacaacagacactggggcctacttgaggtaggagggtgggagaaggtagagggttagaaaaaaataactatcaggtactatgcttagtacctgggtgatgaaataattgtccaccagactcccatgatatgagtttacctatataacaaacttgcacttgtatccctgaatctaaaataaaagttaaaaaaaaattatcttgataaaacacaaaatctttgtttatttggccagttacttaacagataaaggaaaaccttcactttcttaaaccagtactccaggaaaactttgtcattttaacagagaagaccaaatttctagttttgcatcagtgtactattaatactatagctatagctaatgttaataaaactatgtaaatgaattcattcagtctcagccatctttgaccacatgagataagatttttttcccccaagattccttttccataagccttttttagtcttgaaacaaatatccaactgctttctcttcctgcttttttctcttattctggcaaaccagttattttactttagcacagaattaatttactctcttttttcccataatggaaaatataccctcatgctttagaacttctcttaccaaaaaatacatcctttattgcattttttttgtataaaagttgtttctcttcacccttcttaatttcttgtagcttaaactatatatatatattagaattttaatacttagcaattgtgaattgtcatgtaataatattctgtagattaatactattatgatttctagaaacatgcttccttatagtacaatttctcatttttattaacagaccaaatatgtttagctactctatagtgtataaaagcaatattccaaaagtatataaattcaaatttatgttcagcaattaatgtttcagcattttattttactaagaaatgacctagacatttaatgaatatctgttacttaatcttacttaagtataactttaaggttgcaagttaccaaaaagattttggaacctctttttaagttgacatcttgtataaaatgttattattgaagagttcacttacaaatttttactccagttatatttatttaacttgttctcaacaattaaactgctcatgacaacttcttgagacattaaacaaagctaagcatcattttatttttcttgtttaaaaatcaggcagttataaaaaatatcacagaagcaaagaaactaaaaagttaaactttgtttaaacttgtttcttcctctctctttttttcttttgataacagttacctccctgaagtttgtatttctaaaagataactattgagttcaagagaagacaggtaggaaatttacatctcaaaggcacagaaaaagaatgtaagttttttccagggaggagttttataacatatttgcctattatcaaatatttttcttatggaggctgtggatgaaatttttaggtgagttagtgactgaggaaacatctagcagttgtcttaccccagagtccatctaagtgaacaaaacatccatttctgttttcagatagtttttttttttcctcttctcagcattacgtggttgcttttgggagaccttgaatcccttgagagtaggggtacttaaagttcaaattactgaggggctgaagtggaaagtgaaggattctggcaggggtagacggaaggatgttaaagtaggaacttgaaggggaacatatcaagattcaaagttactttatggaatatcaaaaggaggaaaggggagcagaagaaaatggaagaaaaaggtccagaaggaagaggaaggagccagtgtgggcagtatcttggtccatttgtgttgctgtaaaggaatacctgagactggataatttataaagaaaagaaatatatttggtttatggttctgtaggctgtgcaagaagcatggtgccatcatatgcttctgatgaggccttcaggctgattctactcatggcagaaggtgaaggtgaaccgacttgtgcagagattacatggtgatagaggaggcaagagagagagaatgtgtcaggctcttttaaacaaccagctcttggaggaactcttgcagaaactaatagagcaagaactcacccattaccacaagggcagcaccagaccatttgtgagggatctgctccaatgacccaaaaacctcccgttaggccccacttccaacattggggatcaaattttaacatgaaatttggaggagatagccctttccaaagataggcaaaaagaaagaaaagactttgttgctatagtggttatggatctccagtttcccatggaatatgacatgcctgtaatcacacacacattaatctgtgacattaaccatatgactgaccagctaaggttgagatgacagaatccccttaaagaccgggacctttattacaaacttccctgagagctggtgtggttggacagagaatgtcctttaaaaaaatgtttgttattttcttgaggacagagatcatgttttcactgttgctcattgtgttcagtgtctaatatgtagtaagtgctaaaaaatacgttgaataaatgagaaacattctttttgttgccgaaggtaaccacttcacatatgttatttagtactcattttggtatagcaaactgatttcatacatgatgaaaaaggagtctattaatttgcccaaagttgagaactgggattccaacccagttttgactcagccctttgcttttagccaaggctttcctgctcagaaggatctaggagtggtaaaaatagtttgtgagattgaaaaacatgtctctaattattagttttgtactccttgtatgattagtagcatcatttgcatgaactatttctatcatattatccacagcagttcattcaaactacacttttggctcaatgatagttttgcccagtatgcaaaatataacagatgtcacattccaacacttgattcattgcctggttggactccaacatcaatttgttactttaacaaacaaacaaaagttggttctaatggcacaactcaaatttatttttatgttttttattgtatctgaatctatatggcccctaagtttttagaagtgtttaagttcttccacagtaagtaaatagatatgataatgctatctgccaactctttatattttttaaactgtaaaatttattttgtaaaatgtccttatttatgaaacctttaatgagtttcttgctttaagtatctgtgggttagttgaaagaaagtttttattacaggtctaagacttgcttttctttgaacatcttttatggttgaaatagaatgtaaactcagtcatcaaatttagattagttttagctgtaaataactaatagtctgcggtagaacaagtttctataaacagtatttttaatgtttcaatatgtgctctactaaaactgttcagcattgatccatactaacatgcaatttagtgaacttactaggaaaagcatgataaaagttttggcttttctgggcgtactgagagatctagcaaaaatgcatcccaaagtgcaaaaaccttacatttatttctcttcatgacaagtgtaaactgttaaggttaagtgggtggggcaaccggaagtaattactaaggccagtggcatttttgtggtttaataaaggcagaagctaattattcagtttttatttaagtgaaatggtgccaaaaaggaggttcctgtggagcagctgcactccttcagtgttgccctaatttaccaaagacacaactgtcacaaacaaaacttttaaacttgatatatagccacaaaagtaaggaggcttttgttgggagtgcatgcagaagaactcctttatacaaatcaaccggcagatgacggacaatgatgaaaatttgattctttgaagtcataatagtcattgaaatgtgtgaaattctggtattgaaaagagagcggccagcaagactctaaatcctgggtggttgcaagaagcttgctgggaggtttttctgcattttgacaccaacttcccattgcttgttccctgcttcctttgttaaagaaaaaaaaagttgaaatcacagaagataaatggagacagttgataaccgaatcatacagttttaatatggaaaactagtattttatcatggaaattggtatttgaaagaataaagttcatatacatatactggtacattcatagtgattttttaaattttctcttcatttatgtagacttgtgaaatggcaggtcagctatcatctcctccaaaatttaaaattgttgaagatatggtgttgaaagaatgaactttggaattatgacatgcatctttccaatagcaaattttgacttgaatgcccttaatctgtgaattatcattgacttattagttatcatttattaaaatagcatattgcacataaggttgtatttctgaaactttattaggataatgacattaataatggaagcataggtttcatacttgacccaactattcaacaattaagttttaaaattcaataaatctgtgtatattacttatagagtagcttgttttattagaatttacagataattattaactggtgagtcttgaggttcttcaggtgccagcttgaaggcttttcatacctatgtgatttagttttttgaattattatttataaattatttatctctattttaccagtaaaataagaaatttgtaaaaggcaatagtgacatctttctccaaagcatttctagcttttctaaataggtttcaaaaactcacaggtgatccatattgccatacaaaagtagaaatccataaagaatacaattagttcaatataatttaaatagtttgcggattttaaatttttttgtgaaagttagatctcaggtagctccgtgtgaatttagagggaaccacacaaagcgttgaagacacaagtagagttcagcatagtgcctcatagttcttttcaagtgttacattgttttaatggaatcttggagtgggagctttagcccattgaaatgtgcttaaagaacaggttcttctgtcactagccgaagctgtgtggatgaaatgataacaatagggtgtcgtgatgcatttttaaagtgtgagaaatcaggttgtctagactgagagtgtgcctacagggactaggaattttagagcctctgtaccctttaggtgtcaagtatatgagagatgccaagcctctttattctgtctttggcagcagctcaattgggctgtagtaccttacatgtcttctgcatgcaaaaactgattctgtgtcatgacaacttgggttcccaaaatcagaaacccacttgttcaaatgccaactttaaattagggtaagataccaataaataattgctgtaattcgagaagacatggaagattggtagttatgagttcaaaatataaatagcttagcaacattgtgtagacactttttaaaaaaggttttctatatactgtcctttctactttgtagctcaaatactgttttatagtataaatcaagaaatactatttcaatttttttcaaaacttgaaaaagtttaaaatcttaagttttttaatcactttggcatatatgcatcacagtatagaagtaggtaaagtaaaagtgtttcctctaatcttcctgaggtaaccagtgttaagagtttaatgtgtttcctttcatatagttttaaaaatagacataacttacagctccagcttttatgagctcagctcagaacagaggggatgctttggaatttggaaaagatgccccaccccataattctataacatgcttatagtgtttgtttatacccagcttaagctgtagctgaggaaacgagacagattaatctaaagatatataatattaaataataaactactatggcagattgcaagtattacagtgaattcaaaggaggaattaaacattgaggacttcccaggagttgagccactttaagctcttaaatagagaatatatgcttcaggaagtcattaaatataataatacttaaactttttttgaagttgaacctgaatattagaaattaccaattaaagtatttcacacctttaaaaattatgtgccagcttcactcatttttactttaaactagatgtagggaaactttaaaaataagtaaatgtaggcacatattagaagtgcatatttgtgtaaatatttatatggataattttgatagtttctgtaaacaagctgtgacaaagtagccacacctaattattgacgcaggtggaaaggtattgtgttaaatagaggattggttgccaactaaaataactttaaagaattggtttttaatcttgtggatagagataatagtcaagtcagaaatgtgtttcgtgtttttcccactagtacgtactagctaagaatacttaccagctaagtattcttgccagttatttggttcatagcattgatagattgaaactacaaataaacattagtcttcattagggtgtgtattataatgacataaaaattcacagacgttttctagttttcacaaatttggtataatcatttttatattaactcttgtttttaccaagttatccaaaatttacgttagtaagtgaaccatgattttaaaatgcttcattaataagcatatggttgaccccaatgtgatttactttgatcagataaagtattttaccattactaaatggagatttaacccatttatgtctgaggttgcagtttttagaatttttgcaatcagaccttggcaatggccttgagcagtaggatataaataactcccacatgcttagcattccaataatggaacactaggaataaataagttttaaactctgaattactttactaatttgtgtcctgactgctactatgttttgataaatgtatctactctggggcatcaaaattctgtgcattttcaaaatgagcatttgttactggataaaattatagaaaaatcgagttaaagttaccattgttttcatctcacattttggcaaaaattatgccactttttgggattacttttgcagaatgtgtttgattgtatcattctctctttagtaggtttcaccaaaggggggagatacatcacaatgctaattaaagttgttaaatttacaactttacaaaaaggttcaggtttccctctcaaggtaatgccttgtgggtaagcaatttgacacagaaattataagtaacagattgtcttctatttaagatttaaataaacatgcaaataaggatttactttttatatccccttttcatatttcctttgtattttttctcctctgactagttcgcacttgctcacaaagtaagagcattgttgactacaggctcttctgcgagcaaacagtctcttcagaaaataccaatgctttgttggacaaaagggcgtaaattttttttacgatccttttccactgtctccactacgtccccctaaataaaccatttacaggtatctaaatagtaatttacattgtaaagtatcagaatggtagtgaaataagccagaaaatttatctcaatttatgaacaaatctgaatagagttgcatgaatataggaaacaacaaaagtacattagtgtgtatgtaggctgtttgaaacgtgtttttttttcttgtttttctgtaggatatcactactttaactggagttccagaagagcatataaaaactagaaaagtcaggatctttgttcctgctcgcaataacatgcagtctggagtaaacaacacaaagaaatggaagatggagtttgataccagagagcgatgggaaaatcctttgatgggttgggcatcaacgtgagtactttattttaatgtgaatattgtcagctatctttttctatgtagatctttcttctaaatatgattttcaaactcttttatgtacaatatgcttatgacagtactttttgacgctgttaagtaccactgtgctcaaagatacacattatatatttagatattcagataagtgtggcttagcacagtaaactatgacatagtctttttcagagtactacttactagataaaaatgactgaatttcagagcactgttatggaactcaaagctatgtatacagcagtccccccttatctgcagttttgctttctacggtttcagttatccgatggacagtacaataagatatttcgagatagagagagactacccttaatataacttttcttatagtatgtaagtgttataattgttcaattttattacaacttattgttaatttcttactatgcctaatttataagttaatcataggtctatgtgtttaggaaaatataggatttgatactattcgtggttttaagcatccactaggggttttggaacttgtcccccctcagataagggggaatactgttttatccaagatactgtaagaatggtgtttataatatagtgacactttaacttgttttaaaattacaataaacttctttgtaatatatattatatatatatcttttttctttgtaaggggggtaggaactaggtcaatttagaaattagctaacttgagggaaacttataagttcctgagatattgtgattaataataaataataataaattacttttaatttttatttattattttctttagagatgtggtcttgcccccttgcccaggctggagtgcagtgatgtgatcctagctcactgcagccctgaactctgggatgatcaagcggtcctcccaccttaatcccccaagtagctgggaatataggtgcatgccacagcacctggccaatttttttttatctttttgtagaaatggagtctcgctttgttgcccgggctggtctcgaactccgggcttcaagcgatccacccacctcagcctcgaaagtactgagattacaggtgtgagccaccatgcctggccattaaattgctttttaacagtgtattggaataaattcttgtggtactaatgaagtcagtgacctaattctccataatggaatagggcccaaatgttaagtaggagggctgattctagttaaatttaaaaagctgtcattagagaaaacattaggcagataagctagaaaattgtcattcgtattgaaactctgagaacattatgtccggtctccagttgaaggtagttataaacttaaattagaaaatgtagactgtcttgttctagaaaagtataatattcaacatcattgcctgttgattacttgggagactttttttagaaaacatctgtcatgttgcagtttaaatagaattatattttattaggcaaatgatatataggcacaatttcttagtttttttcttatgttgcagtttaattaatttattaaaatgagaaaaaagtcaaacaatacaaattcaattagaacatcacaaaaatacaaatgtacttccacagatctacaaatttgttataagattagttataattcagtgtgttataaaattaagagaaccaaaatgaaacactttgctaagaatattctgctttatcaaaccacctaggtagagtcttgagcactcactggtaataaagctgagaaatagatacttacccaacttagtctttggagtgaatctgtatatgtgagatgagccgccatgtcatggttataaggaagggatggaatcggctcatgtccctcaaagcccataattgtcatgtctcctgtagtagtagtacaagacctggcctggaaattgttagaaaggggaactaccaaacagaaaactgaatctacccagtttctggaaaacaacagatggaggaacatttggcttccaaactttttcatatgtaagataattttcctaagtaatcttgctctaatgggttgtatattctcagtacttgtcaagaaaacagaagtctcccattaactctagcttcaaagaataaataccaggtcagatttcccaatgcaccttattgtttcaagagattcctggtggtgcctgcatctgtaagaatggtcatatacagacaaaatcagtggttctcaactgagggtgcttttgtatccttaaaacatttgccagtgtgtggagacattcctggttgtaataagtggtggcttctgctgacatctagttaataatggcaatactatgagacacaggactgccctcctttgcaaccaagaaaaaattttctggccccccaaaagtggaagatgctgaggattaaaagccccagtatcaaggagaatactttgagaccatttttttttccttacaaaaacacaatatccccaccaatgtgagatgttggatcacatttttgtacaagggtggttgtggtaggtagaattctaagatgccccaggatatctgcttctttgttacaactctaatcatcctcttccataaggtatggctacatctgtgacttgttctagacaattgattatggcaaaggtgaggggatgctctctggcaattacttttccttatatcagaaacaataggaatctatattttctttctatcttgtgtttgttttcataataaagtgatctagagtatccccctgttcatggaaattttgccctttagtctaaggcccttcatacataattgaatattgttcttttttaaattttagatccagggtgtacatgtgcaggtttgttacatgaatatattgggtgatgctggggtttgggcttctagtgaactcatcacccaaattaagtaaacacagtgcccagcaggcagtttttcaactcttgcccccttctccctctcccctctattggagttcccagtgtttattgtttccatctttacgtccatgtgtacccattgttcagctttcacaaatgagaacatgcagtctttgattttctgtttctgcattaattcacttaggatgatggcctccaccttcatccatgttgccacagaggacatgatttgattcttttttattgctgcgtagtattccatgatgtttatgtaccacatttctttatccaatccattgttgatggacacttaggttgattccttgactttgctattgtgaatggtttctttttgataaaatgagttatttttctttgggtagataccaagtagtgagactgctaggtcaaatggtagttctgtttttagttctttgagaaatctccatactgtattccataggggttgaattgctttacattcccaccattagggtataagcatttccttttctctgcatccttgccaacaatagccattctgactggtatgaaatggtatttcatggtagttttgatttgcatttctgtgatgattagtgctgttgagcatttttcgtgttcattggccatttgtatgttttcttttgaagagtaggtgttgtgttatcctttttattttatgtttcatataatatatagagtcattttgtaaaccacatgcttctagaagctgaaggaatttataaggaaaaaatttgtcccgatccagtgattgaaatgttaatgattactgtttttcaatcacatgagatttttacatgttcatctattccccagactcaccgtagtaatacattcccagcaacattcagtaataaatgattatttgagtacttgtgccttgtatacgctaaattgttgatgagtaaaatactttatataagaatatacatttgagtggtatagaggagaaaaagtaatatcttcctcacatctattgcaaggtttgtggctgagacatctataacaaaagatagtttaacaagagactagcatacaatttcattttgtgtaagttttatgtgatacaggagacttcagaaatgaagacccaaagaaacagggaaatctgtgtatttttgggcttagttttgatgaagagtggacagtcatacagaaagatggttggacaaagtttatgatctaatgattataaactaggaagaacttagccagacctgtttgttcagattcttgtctgtgtctctgtcttcagaaataaggacattccattccttctgttatagggtagacagttctggaatgagggtcttaggactgacttcagaaggtcagataattctgttatgtcctacttcaggggagagtgtcagagagaccttcctgcttctgctgttttctcaaatgccaagctgccatattttggggatagtgtgtcctggaagcgcattagtggattgtttaaataaatacagttttactttgctgtgcttgcacaaaggttcacacaatcattattatagtattgcttagtctggaaatagcatattaaatgttgaaatatgtagtgatttaatactctgatgctttaagacaaaactgtaacctattgtgcataaatatggaaatgctgtttttattacatattgattgaaaatgagatatactatatgtttgggaggtaaagttctttttcaaaacgtagttttgccgaagtaaaaagttttttgaagcaatagaccttgtctgcaattggtttatctgagacattgttttgaatcttgaataattttaaaaaacattcattaattctttttgttctggtgttaacaaccagtagcatgaaaaaatataagaataaaattattatttaaaatatttacttatttgatttgattagaacagagaattgctactctttttttagcattttaatgacacaaaaatagtatgtaattttactgcttggacatattgaattctgacttctctttgtgaaatattttaaatctttttctaaaattgttagaattgtaagctgaaggtttttcatgatcatctaattaaattttatcacttaactaagaaataaacctgtgtcccagataaattaatgagttgaccatagtttgggttctcagcctgcttatattttattttacaactatatataaaatactaatatgtagaatattaaaaatataaaatatttaaaacctggctagataagtccatatagacttgtattttttttaatcaggagaattactgtatttaatggagcaaagagaatgttaatattttaatgtgttttttgctgtgggtcaaagaatgattttaggatgtgctaaaagagaaatgactatccatcctatacctagaatatatttgtttccaaagccacaaggtttcctaatttaggggatcttgggcttaactttattctttttttttttttttttgagatggagtctcactctgtcgctcaggctggagtgcagtgggcgatctcggctcactgcaagctccgcctcccgggttcatgccattcttctgcctcagcctcccaagtacctgggactacaggcacctgcaccacgcccggctaattttttttgtatttttagtagagatggggtttcaccgtgttagccaggatggtctcgatctcttgacctcgtgatccgcctgcctaggcctcccaaagtgctgggattacaggcgtgggccaccgtgcccggccaactttattcatttcttctgatagatactgtctaggtctatcatattgatggaatggcttggagggtttaacagacatctaaccctgctgatgtaagagtattacagagggttggaagtgtgcagtataagaaatatgacaaatgtaacacctgcagagattatttttatatacctttggaagggttttttttttctttttttgctatcttgctgttaaatacacaggaaaggacatatttcattgagcagcagaggcagtgctaatggaaaaggtaattttacaaagttacagtaattttttaattttacagtaattttacagtaatttcacagtaattttgtgacagaaatttgaaatcttaaatgttttcccatatgttttcctcagtggggattgaggggaaggatcctcattgtgaaaatgggcttcatgactgtaaacatggttttattttttaaaaatatagtgaatacatttcattgttatctgcttatctacagtattttttgaaaggccactttggttcacatgtaggattttaagataaatgtgtttgatctttgtttttagatttctaaattcatattttaaagtactatatttacatttcttttctcatccaaagtggagcttttcttatgctcttttaattacctgagtctttaaatgttagaactcaaaggtaaaagatttatctttgtgtaaatatgaaaaatatcttaaggtgcaaaattatcctttgggtttgacccaagtgtttttactttttaaatctccttgatcctgtttcagggagacagcatgacttatccttgtttaatattgtagcaagttgccaaagataactattggttattaatctcttttttttttttacaatcttttatcttttaggttagtaaatgcttacttttcatttatttctgtaagcaggactttaattttgattaaacctaaaaatgatttatttttcctcagctgtattaatgtacattggtcattgaaactcagtgatcattggactcagtactttttgtgttaatcacattctgaaaatgtgacttctgtgttaaattttaaaaatgttttttttgttagaaaattatgaatctgtcattcagcttctggaaacaaggatttgttccatgtcattgtggacatagaaggtcaaatagtttaagcagacatgtgcacaaacgtagatgttgcgaattctctcatcacttgatcctcaagccttaagtcatcaaagtggacatcttaggttggcagatagttcttttgattatgagtaagtagcaaacagaagcattgcctgtatcatctttcccctttacactgttctaacacattgccaaagcacttctaaaatttgctttaatcaggtggttcagtttttttaattgaatttaaataagaattctgtctacttttcatctcattactgacttttgaacaagtaaatgactgtgcttgcattgtagatttaaactatagatacatgtttccatatataacatataagcgaggaatgttaccagttactccttttcctcccctgcttactaccctctcaccagtatacccgccctccctccatagaagcccccacaacaatttggtatatatccttccagacttttttcagtgtatgtatatgcatatatttaagtttatatgtcctttggtgaaatgtcatgattttcttagtataagtttttcacatttcttattaaaattatgcctagatattttagttttatcactatttcagatgaagtttcttcattacattttctagttgagtattgctaatatttaaagttgattttgcatataagccacattatgtactgtctctttagttgtcatggtttttcaagggattcactttgattttctagttatataatctaacaatagtggcagtttgttttctccttatagccaatttctctttcttgccttgttgcattggctagaatttgcaaagttgagtatcattcatgatattcaacatccttattccctttttcttctttagcagaaatgtttctgatataataaaatggacaaagttcttttctaatcttgatctaccaataattaaaaaaaatcaggaatgggtattaagtattaatgtttttgtaacatctgttgaagggcattttctgtagtgaatttcagttacctattttctgatccaattatatgttttataattggatatgtatttactatttttaagtaatatgtatttgttaatatgtatttaacatttttgcatccacccaatctgtggaattggcctgatgcagggtggagggagtgtgcacacataacttctatagcagaatataatttttttttgctcagctatttggcatttcttacctcagaaatattttaaaataacaaaagtgtttattaaaatattggttttaatattacatattttttctctacggtcttcattatgtatatctcctatttgcagaaagatgaccacctgatatttctgaatggtgctaatcaaactaacagcatttagagccacttataactgctactgatacttaaactaaaaaataaacaaataagctaagcttcccgagaagaaactcattcacttgccgttctgtgccattcagagggcatctaattaaaattctcagtgccaaaatgtttcaccaataccttttatgcatgaatagttctcttaggtaaatcaagagtcagttataatgctaatttttacattgtattgatacttagatctgttttgaataatattaaataggctttgctcataagcagaaaatgatcattgaaattcacaaatggtaagtatcttcacaaagtctgttttatggtgtagaacaaaaagcaatctgccaaccaatgttggacattataattatgaaacaatttttgatattttattggtttactgatgttcattagtgtctagtaaagtatatgaaaatgatattggaggaaaaatatctaaaatcaaccttggaaatgtgtacaacgtattattttgccaggcttaatattgctttttaaactttattgaaatatacattaagaaaagtatacagatcagaagcatacagcttcatgaatttttacaaccggaacacacatgcatgtgagtagtacccagatggagaaacagcatttccagtatctcagaagttcccatttcatcccatgcttttttcagatttcagccttccagaggtaaccaccgttctgacttctaacaacatagattagttttgcctatttttttttttttttttttacttaaagagaatcatcctttatgtgctcttttgtgactggcttttttgcttaactttgtgagattcatccattccatgctatttattgatggttatttgtgtaaatttctgtttgggtttttatgtataatacagtactaaaatgaagaatctcgtatatatcttttagtggatatgtggctttctaatatgctaattagtccctgaaatattagtcactagttaatattcaaacaattaatatagagataacaataatctattaattatctgatcccttatgtttctcaagttaatgacagtagcaacttgataagttttgttccaacagacagttaaattactgatagatccaccttgaacttgtggaggattatgcatcattggagtggatctgtttcagttttagccttagtcttggaacctagtgttaaaaaataaaaaggcacggcctttctgaagttttgatggaaagcacaaggtgtttacccacattctcccttcagactcagtctcccctgtaacaggcagctgctgaaatctttgctcaattctttcagccttcccagcttcattttgaaaccttgctgaatcatgtacagttcaaaagctccctgctctgtggatactctcttccagctgctctggcaatcctggactccgtctccaggctccttgcactgagattacggctttctgcttgagttctcgatgctcctagcttgtctagactagagaataccttatgggaaacaccgtataaagttggatctaaatccaactttagattggttccttttttttaaagattgaattctctagaagtttattttttttttctattagtcactctctggtctctgaaaattatttttctgttttgtccagagtttatagttaggcagataaatctgatataatattctgccattacccaaattggaacttcagtaattgagaaatgagcaaataaagtctaaaaataaaagaacaaattatctttagtggaccaggttgaaagagagattgtatacagttggaggagggtaggatatgaaagacttcatggaataggttggtattcaaagtgaagcatgagggattatttggatggacttccatgtgcagagagtaggagagcatttcaagaggaaggaacaaattgaactgatgggaaagtacaccttgcatttataaaaacaattagcaacctgatttgactagttggttacttctcaggggagtaattaaaaagaaggctagaaagtagttctgtccatattatagaagtgcttaaatgccaaggtagaagactgaagttaatgtgatagacagtgaaaactgtttgaaatttttgaactgggcagagagtgagtttgggatttgaactttaggaagacatcttggtgaagggtggattggagtcaaggaggcagaaagattagttaggatggggttatgggaataatgaaaaagagcttaaactggtggtgacagcatacctaaaaaagaactacaaaatacaggaaatgaaggagaatgagaagggtagaaactgaatggctggaagaatagtggcttcttccagtggatgaatgttgttactattggatatattggatataagttgttactatttgatttctatatgtatgtattcataaataaagtgaggataataataaaggctataccatctttgcaggaaacagagttctgatctcctggcttctgtcttgtttcttattctcaactaagccaatgtgcctgtcaacacttatcagattactgcatcatatttatgttgatacttctgttctcagtatatatactttaactatcaactggaaaatcgtgtgcgctttgaaaaggaggaaccaatataaaattatgatattattagtactaatatagccagccatatgaagctcttttgcttacaaagggtaggggtgggttatgataagaatatatataattataggaatctcagagtagcaaccatggtctgtgaccagaacattggcagcagtaattagtgggtcttcccgtcagtgagaggtactccccatttattctcttctttctatatctcatatctttccccatccaaattaccttttgaatcctcctttctatattttttacttccacatttctaagcaatgtttcatagaatgctatattcacctctgagagattcacaataaacatttgtagcaaacagtgttccaccttgttataagaataaaagtggggtgggcacagtggctcaaacctgtaataccagcactttgggaggctgaggcaggtagatcacttgaggtcaggagttcgagaccagcctggccaacatagtgaaaccccatctctactaaaaatacacaaattagccaggtatggtggtgcatacctctaatcccagctacttgggaggctgaggcacgagaattgcttgaacctgggaggcagaggttgcagtgagcccagatcacgccactgtactccagcctgggcgacagagtgagagtccatctcaaaaaaaaaaaaaaaaaagaataaaagtgacatttcttgaagttggatttcctaaagagcctatgtagatttgtaaacattaacactgtcctacattgaagaattcaattggatgtcagatcttagagctttatttttttatgctttaaaagaatattgttaatgatggaaggtttgtcaggagtgagcgatcttcaaaaaggagactcagaagaagttaatttaaaaaaagaatgtgtattgttgcattttcttgagtaatgataggactagcaattttacacatcagtaatcttgatagtaaattttaatttccatttaagaatcctcttgggttttaaaattcatctcaaattgtttttttagagtggaataaaattattaaagactaacaatgcctttgcaattatgaattttattatttgacaatacatattagaaaatctcccaaatttaacacagaaaaaggtattccaactaacagttttaaagaaattattacaaataaaatattccatcaataatgtacttatttgattttatagtagctgtttattttaaatattgattttgtttctcagctaaagcttaatgttaaatcttggaaaaaaatttgtttcttacagggctgatcccttatccaacatggttctaaccttcagtactaaagaagatgcagtttcctttgcagaaaaaaatggtatgtttggtctgtttttgacaaagtcaagataatgattttatgttcttaaccttaattaaaaccaattaagtatacagaatttgagttggaatccagtggtttcattgtatctaatccagtggtttcagactttaactacatcagaacacccacctccaaaaaaaaaaaaaaaaaaaacctaaattggaatgctcatacaacatgtaaaagacagactgctctaatttgaagtaccaacagggaatgaaactacttaacgcctaccttgtgtatgaattcctctgtaaaattactaacattttgttgaacttcaattgaacatatatggcagcctattctagttttgacacctctgtttaccgttaagttctttcagccaaacgtaatgccaaaatctagtctattaatctatttaataactcaattatttgaaaatattgtcttattgcctgtaaaatttcccttcagtctaaatgcccacatttgctacttttctagatatagtgggcctaataccaagcctaatctcaactgtataataatattaatgtggcctaagagtatatttgcttttggggcagccacctaacatcattgggttatgttgatcttgctatcaacaaaaatgcaaaatgtcttcctttttccttattttctgctgttaagccaacatagtatagtgaaaggaagttttgcagtcagactaatatggattctaatcttggttatgccactttgaagctatatgattttggattaatttcataatggacttaatgtttctcagttgaaataagggtacctacctcatgaagtgggtgatagctgatacataatagatgttctgcttgatacctcatgaagtgggtgatagctgatacgtaatagatactacttgataactattagttctgaccttcacctccctccagccagtatttctgctgtttgtcttccttagattcaaatgcactactaaacatttgtacctaatgtatcctgttattctagtttctcaaattgaatttgtctctttaagtgcattgttactgtaaggcagtatataaaaataagaaattagtgttctctaacattacctgaaatacaaatgtgaaagcactataaaggttataatctaacatatttgcttttctttttcacctagtattgtatagcttatgattaaaagtctgaagtcaacctatctgcctttgaatctgtatgtcactacctgtatgactttatacttctatttcctcatacgtgcaatgagaattgctgtggtgattaaatgagttaataaaagtgtttagagactagggtctgacaaatactatatgatagtatataagtataccctattctgttattaatagactttttttttatttaagttttagggtacatgtgcacaacatgcaggtttgctacacatgtatacatgtatacatgtgccatgttggtgtgctgcaccgattaactcttcatttaacattaggtatatctcctaatgctgtccctccccccaccccacaacaggtcccggagtgtgatgttccccttcctgtgtccgtgtgttctcattgttcaattccccacctatgagtgagaacatgcggtgtttgctttttttgtccttgcgatagtttgctgagaatgatggtttccagcttcatccatgtccctacaaaggacatgaactcatccttttttatggctgcatagtattccatggtgtatatgtgccacatttgcttaatccagtctatcattgttggacatttggcttgattccaagtctttgctattgtgaatagtgccgcagtaaacatatgtgtgcatgtgtctttacagcagcatgatttataatcctttgggtatatacccagtaatgggattgctgggtcaaatggtatttctagtactagatgcctgaggaattgccacactgacttccacaatggttgaactagtttgcagtcccaccgacagtgtaaaagtgttcctttttctccacatcctctccagcacctgttgtttcctgactttttaatgatcgccgttctaactggtgtgagatagtatctcattgtggttttaatttgcatttctctgatggccagtgatgatgggcattttttcatgtgtcttttggctgcataaatgtcttcttttgagaagtgtctgttcatatccttcgcccacttgttgatgaggttctttgtttttttcttgtaaatttgtttgagttcattgtagattctggatattagccctttgtcagatgaccagattgcaaaaattttctcccattctgtaggttgcctgttcactctgatggtagtttattttgctgtgcagaaactctttagtttgattagatcccatttgtcaattctggcttttgttgccattgcttttggtgttttagacatgaagtccttgcccatgcctatgtcctgaatggtattgcctaggttttcttctagggtttttatggttttaggtctaacatttaagtctttaatctatcttgaattaatttttgtataaggtgtaaggaagggatccagtttcagctttctacatatggctagccagttttcccagcaccatttcttaaatagggaatcctttccccattgcttgtttttgtcaggtttgtcaaagatcagatacttgtagatatgcggcattatttctgagggctctgttctgttccattggtgtatatctctgttttggtaccagtaccatgctattttggttactgtagccttgtagtatagtttgaagtcaggtagcttgatgcctccagctttgttcttttggcttaggattgacttggcaatgcgggctcttttttggttccatatgaagtttaaagtagttttttccaattctttgaagaaagtcattggtagcttgatgggaatggcattgaatctataagttaccttgggcagtatggccattttcacgatattgattcttcctacccatgagcatggaatgttcttccatttgtttgtatccgcttttatttcattgagcagtggtttgtagttctccttgaagaggtccttcacgaagtcccgtgtaagttggattcctaggtattttattctctttgaagcaattgtgaatgggagttcactcatgatttggctgtctgttagtggtgtataagaatgcttgtggtttttgcacatggattttatatcctgagactttgctgaagttgcctatgagcttaaggcgattttgggctgagacgatggggttttctagatatacaaccatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgtttccagttcttgcccattcagtatgatattggctgtgggtttgtcatagatagctcttattattttgagataagtcacatcaatacctaatttattgagagtttttagcatgaagtgttgttgaattttgtcaaaggccttttctgcatctattcagataatcatgtggtttttgtctttggttctgtttatatgctggattacgtttattttgtgtatgttgaaccagccttgcatcccagggatgaagcccacttgatgatggtggataagctttttgatgtgctgctggattcggtttgccagtattttattgaggatttttgcatcgatgttcatcagggatattggtctaaaaatctcttttttttgttgtgtctctgccaggctttggtatcaggatgatgctggcctcataaaatgagttagggaggattccttctttttctattgattggaatagtttcagaaggaatggtaccagctcctccttgtacctctggtagaattcggctgtgaatccatctggtcctggactttttttggttggtaatctattaattattgcctcaatttcagagcctgttattggtctatttagagattcagcttcttcctggtttagccttgggagggtgtatatgtccaggaatttatccatttcttctagattttctaatttatttgcatagaggtgcttatagtatattctctggtggtaactaagatcagttctgccctgatcttagttatttcttgccttctgctagctttttgaatgtgtttcctcttgcttctgtagttcttttaattgtgatgttagggtgtcaattttagatctttcctgctttctcttgtgggcatttagtgctataaatttccctctacacactgctttgaatgtgtcccagagattctggtatgttgtgtctttgttctcgttggtttcaaagaacatctttatttctgccttcatttcattatgtacccagtagtcattcaggagcaggttgttcagtttccatgtagttgagcggttttggtgagtttcttaatcctgagttctagtttgattgcactgtggtcttagagacagtttgttataatttgttataatttctgttcttttacatttgctgaggtgtgctttacttccaactgtgtggtcaattttggaacaggtgtggtgtggtgttgaaaaaaatgtatattctgttgatttggggtggagagttctatagatgtctattaggtttgcttggtgcagagctgagttcaattcctgggtatccttgttaacttcctgtctcattgatctgtctaatgttgacagtggggtgttaaagtctcccattgttattgcgtgggagtcttaagtctctttgtaggtcactcaggacttgctttatgaatctgggtgctcctgtattgggtgcatatatatttaggatagttagctcttctcagtgaattgatccctttaccattatgtaatggccttctttgtctcttttgatctttgctggtttaaagtctgttttatcagagactaggattgcaacccttgcctttttttgttttccatttgcttggtagatcttcctccatccctttattttgagcctatgtgtgtctctgctcatgagatgggtttcctgaatacaggacactgatgggtcctgactctgtatccagtttgccagtctgtatcttttaattggagcatttagcccatttacctttaaggttaatattgttatgtgtgaatttgaccctctcattatgatgtcagctggttattttgctcattagttgatgcagtttcttcttagcctcgatggtctttacaatttatcatgtgtttgcagtggctggtacttgttgttcctttccatgtgtagtgcttccttcaagagctcttttagggcaggcctggtggttgcaaaatctctttgcatttgcttgtctgtaaaggattttatttctccttcacttatgaagcttagtttggctggatatgaaattctgggttgaaaattcttttctttaagaatgttgaatattggcccccactcttctggcttgtagagcttttgccaagagatcagctgttagtctgatgggcttccctttgtgggtaacccgacctttctctcttgctgccgttaacatcttttccttcatttcaactttggtgaatctgacaattatgtgtcttggagttgctcttcttgaggagtatctttgtggcgttctctgtatttcctgcatttgaatattggcctgctttgctagattggggaagttctcctggataatatcctgcagagtgttttccaacttggttccattctccccgtcactttcaggtacaccaatcagacgtagatttggtcttttcatatagtcccgtatttgttggaggctttgttcgtttctttttattcttttttctctaaacttctcttcttgcttcatttcattcatttgatcttgcctcactgataccctttcttccagttgatcaaatcggctactgaggcttgtgtatttgtcacgtagttcttgttccgtggttttcagctccatcaggtcctttaaggacttctctgcattggttattctagttagccatttgtctaattttttttcaaggtttttaacttctttgccatggtttcaaacttcctcctttagctcggagtagtttgatcgtctgaagccttctgtcaactcgtcaaagtcattctccatccagctttgttccattgctggtgcagagctgcattcctttggaggaggagaagtgctctgatttttagagtttccagtatttctgctctgttttttccccatctttgtggttttatctacctttggtctttgatgatggtgacatacagatggggttttggtgtggatgtcctttctgtttgttagttttccttctaacagtcaggaccctcagctgcaggtctgttggagtttgctggaggtccactccagaccctatttgcctgggtatcagcagcggaggctgcagaaccgcggatattggtgaacagcaaatgttgctgcctgattgttcctctggaagctttgtctcagaggagtacctggccgtgtgaggtgtcagtctgaccctactggggggtgcctcccagttaggctactcaggggtcagggacccacttgaggaggcagtctgtccgttctcagatctccagctgcctgctaggagaaccactactcttcaaagctgtcagacagggacatttaagtctgcagaggtttctgttgccttttgtttggctatgccctacccccagaggtggagtctacagaggcaggcaggccttcttgagctgcgctgggctccacccagttcgagcttcctggctgctttgtttacctagtcaagccttggcaatggcggacgcccctcccacagcctcgctgatgccttgcagtttgatctcagactcctgtgctaacaatgagcgaggctttgtgggcataggaccctccgagccaggtgcgggatataatctcctggtgtgccgtttgctaagaccgttggaaaagcacagtattagggtgggagtgacccgattttccaggtgccatctgtcacccctttctttgactaggaaagggaattccctgaccccttgcgcttcctgggtgaggcgatgcctcgccctgcttgggctcacactcggtgtgctccacccactgtcctgcacacactgtctgatgctccccagtgagatgaacccggtacctcagttggaaatgcagaaatcacccgtcttctgcgtcgcttacgctgggagctgtagactggagctgttcctattccaccatcttggctccaccttaactcttaatagacctttaaaaactttttaaaaagaggttcttaagtgcaattccttacttatactttcttggcaagttccaaatttcttaattacataattgttttcaaaagtggtcttttaaaatactattttgacttaaaataacattactctctttgtgaactgtaacatagttatgaaaaacagttccattaatttttttatcttttcagcctattatatttcatgtctgacactttgaaaattattcatttgaagtctgtcacatgagtttaataacaggaaatctaattaaatatttaaatccctggttagtctttctctaagtggtcacaaggactgcatgactacagttgccatgtgaattgccagtgtgagctcaccactgttcctattaaaatcaagtgcctttctatctgacttctacctccccgggaaagaaaactgaggaacactatcaaagtctatagaaagtgtaactttaaaaagccttgtggttagtgacataaagttgtaggctaacagtgaatcaggaattttaacctttaagatagcagaactatgtcctatcttggtcactgctatgtgcctagcacctagcacctagcacaaaacctgacatataatggacactcagtatctggtggaataaatgactttctaaaatatatttctctgactgggcacagtggctcatgcctgtaatcccagtgctttgggaggttgaggtgggtggatcacttgaggtcaggagttggagaccagcctggccaacagcaaaaccctggttctactaaaaatacacaaattagctggatgtggtggtgcgcacctgtagtcctggctactcaagaggctgagacaggagaatcgcttgaactcacaaggtggaggttgcagtgagctgagatcataccactacactccagcctgggtgacagggtgagactcagtctcaaaaaataataaataaataaatagaaagaaacatatttctttactcaagaatttgaaaccattctcctctcctgggaaagtccttaatgattattccactcttgatttcggtatagtacttatgatctgccttatttatttaacatgtagcattctatgtccttaaatagataaatcctgtttcttcagctacagtggaaggaagatctaaataaacaccattgaagcattacagaagtggaggtggggaggccaggcgcggtggctcacgcctgtaatcccagcactttgggaggctgaggtgggcggatcacctgaggtcaggagtttgagatcagcctgaccaacatggagaaccctcgtctctactaaaaatacaaaattagccgggcatggtggcacatgcctgtaatcccagctactcaggaggctgaggcaggagaatcgcttgaacccgggaggcagaggttgcagtgagctgagatcgtgccattgcactccagcctgggcaacaagctccagcctgggcaataagagcaaaaactctgtctccaaaaaaaaaaaaaaaaaggtggaggtgggggatcttttccaaattccacagcatcctcttccttctgacttgcccctcttgggtaggtaaatagtagtgaaggacatgcaaatggatcctccctatccccacaactaaaatcatttgttgtcagctagtgctattgaaggttgagtgaaccgatgttctgataagttaaggcatttaaaaaaaaaaggttcagatgcactaatatgtaaagactactggattaagaggctggtaactaagactctcattccacagtggtctacatcacaggagaacttgaacaagtcatgcttcactacacttagccttttagaagcatatttcttcatctttgaaatgagaagttggattgggtgatgtccaaaaactatagacttaaggatgttaaagcccatgggctagttcgtctttatttctttgctatctagcccagtgccttactcatatgctgtatagggggaaatgagtttttgttaatacagctgattctgtgttaatagtaaaatatgacaaaggttatacgtttatgggcattaatgcttgcctttcagtagtatctagaaataggaagttagggtaaaactgccacatacctacacaaaagatgatttatgtatcacttatcaaattgtattttatattaatgcagcctaaaagtatattagcttttgacagttatttgatttgtatatcaattatcaaatacaatttgttatcaattgtatttgagatacagttgattatttgtatatcaattcagggactattctgaagataaaagcctacctgttatctccttagttttttcatttcccttttaaatgtcaaataaaaagagaagtcatgagcatggtttcccttgacactaaagattgtagaaaatcaatacatcaaggggagtaagattttcagattcagttgctttctggaaaaccttttttttggaggggttcggggctggagacagagtctcactctgtcacccaggctggagtgcaatggcatgatcttggctcactgcaacctccacctcccaggttcaagcgattctcctgcctcagcttcctggactacaggcatgcaccaccatgtccagctaattttttttttttttttttttttaaagtagagacagggttttaccatgttggccaggctggcctcgaactcctgacctcaggtgatccacctgccttggcctcccaaagtgctgcaattacaggtgtaagccactgcacccagccttacaaaacatatttaatgccctctaattatattttgagacttgggtaataagtattgtcaccacagaaagtaacaaacactaaatcatgagccaggcactatgctaagtgcttttcattctcatttagtaactctgtgaagcaggaacagttatctccatttaattgttcaaggcaactgaggtttagagacattatgtcacattaagtaacagggacacatacaaggaggtgaacaagttttatttgaacagtcatgtttattcatttatatatagtctatgactgctttttggctacagtggtagaaaagtagttgtaatagagactatatggccccagagcctaaaaataattactacttggccctttacagaaaattttaggtgacctctagtctaaactgttacgtatactgcctcaatactatgacatttgtgtaagtcccaaaataccctttattcaaacatcttcaagagtctgtgtttaatagacaaattcctcaactgataattcaaagttcttcacaatataggcacaaacttactaccaaagcactaacaagttttgtctgtgttccaactcttactttctgcccttacattccaaacctactacaccttcctccctctacaacctcgttaatactgttctcattcttatccctgcctatgaaactctaacctagtcttcatttcatatgctgtctcatttcttcatcccttttcttattcccctccttcacttgcacctcccatctactactggatgaactcctctttcttccttttaactttcacaataatttgttcctttcttgcagctcttatagtatggttttctcttttaccttttttgtactgcactcagtcagaagcatgttgaacacaccctattgtatgtcagcgctgtatggctaggctctggggataaataaggcatagttcttacactcaaactgtaatattttatcctgcctattggattataagaatttaccagggaagacaagtcctatttatcttttaatgtgctcagtaaatattggtgaatttagcagcaaatttagtaacgttgtaaatgattctccagattatgctttaaacttttctttaaatcaccttaatttggtgacttgttctttttttagaagaactgttgatctgttaattccctgtaattagaaacctgaagaaagaaagctatagtaggatgattaacaatttcttatattttagtgtgtttgtaaaataaaactaatgaatgttttcctgtcaagttaatttggagtttatcctgagtttattaaggattagcatcctgaagtgtattgaaacaaaatgattatttcataatgtttgaattgcttccaaactgcatgttatttattctaaactctccctctgataggataccgagacctagagaagttaagaaaacaagccccagatcaatcacattgctcctgacagcacctaaccttctagattccaagtccaatggttttcctggtactatgatgctagtagatcttaaaaaataataatctagatctacactatccaatatggtagccactggccacatgtgattttagctcttgatatgtgtttaattcgaatttagatgtgccgtaagtgtaaaatgcacactgaatttcaaagacttagtatgaaaaaaaaaagtatctcaatttttattacatgaagtgataacctagaaacactggacgaagtaaaatattataaaaattaattttacatatttccttttatttaatgtggctactagaaacttatgtatggctcacatatttctactgaacagcactgatatatttggcaatatacagggtatacattatatatatatatatattctatgtaaatagttcattaaataattcctatagtaaatatgagaaacaggaaactcatatccaacttggaaaagttcaaatataatacttattaagaaatacagttctattcttcaggtactcttacctagaatgaattaaggatatgtagaaactcttatgttacttataaaataataaagagatactgtaggtctctacagagatactatagtgtccctatagtacctctagagtatagtatagagatactatagtatctctttactatatagatatatggaatagactatagagtatctctagactatatattatttatactctactatctatatagtatctctatatagagagataatatatatactccatatagtatactctagagatgctataagtttctgtagtatctttatagtagagataatagggagggataatagtatagggacgtactatatacctatagtatctctataagtacacaagttcccccattaatcatctgttttcagttgttaaccaaataaggtattatgcaggctcatctttttatataagaatactctactcttgtttttgagatgaaaagaagttctctttctcctgctattgataatttctgcagctgtcccctcagcttatatcttttttgcatagctctctcttctttacctcacttcttatggaaggctggtgttctgaaattggggagtggaaaagaagaaaagactgaatgctccctatgacttcattttctccctgttcccactaccatgtccccaaacatactgacacacaaagaaaatataaatacccctgattcttttagccttaaacttagggcctcatcctaaacatcttaagctcagcatctattccaaaggaactctttaatgataacgtttctttgtaaagagacgaatatcatctggggtttcctctgaaatgtagatgaacctcacttcagttctttgtgtactaaaaagacccacccttctcacccatgtggcttttgtctttccttgtgttatgtaataagtgatggggtagaaggatggggggtggaggaagctacatcatggagagaggaggtagaagacagctgtggaaaatttggatggtggaagactagaatctactaccatttacatgctaatgaaaaccagaaatggtcttttttcccccgtttgatctgatttgaaagtttgtgacttttgtctagtatgtcattttaccccctgtgtttttctcattgttgttagctataaaaactctttgaaattctcaaaataaaggaaggtttctttcaggaataggagggctgaggacaagctgtgaaactgcattcttcatagtgggtctattggggtggaaaacccgcctctgaagtaatagaaggtagaagcacggaaggaaacaggtctggccctggatccaggaaaataaagaaagaaataattggagatgtagcttagtacttagaattatcccagaagtgaacaacatcagtaaggtctgggcttccacctaacgtaacctcttatgagggtctcaacctcacatccatatatcttttaaaaaaacaaaacaaaaaaaaaaactttcaaaacaaaggcaagaatcatgactttcatataggtataaattgcaagtaaaaatttattttactcatataagggaacaaggcaggtgttacaaccagttcagagtaaaagtcaaaacagcactaattcatgtgaaataaaaaaacgtagtgaattgcaaatagaggcaaaattgggttttggtgggggaggtctattaagtagaacacaggacagaaattacatgtgtatcaattgtgtacaacctaaaaagagttgccaagtagctaaaagataaggaactgatctaaaatctgataatctagaaggggaagggtgtgccagagacaatgcacagttttccattgaaacaaaggttttttttttctattccttctccattttgattaggaaataatctcagcaagagattatttgtgatcacaaaataacattggtatgatatttagccttatttacataggtgtagcaagagtgttaatttgtcatatatgctttcttgtatgctttggtgaaagtttttacaaggaatctctgattggactttgaagtctcttgagctaggaaaccacaccaagaacttgccactagatttaaaatctagtaaaaagattcagtaagtctggagtatggcctaaatatcggtatattaataaaactcagataagtgacattgatttccagttgacatttactggcctagaagatgcaagatttaaactacagaagtaaagatgcaaccaagttaatatttttaaaaataacaaattatgactgataaactatactgtaattatttgctgggcaaagcagtacaaggactcaggtaaatagaacacatcttgagcagtgaaggcattgataattccccaggaacttaccatatagcatacaattttggttaataacactttacccatgaaatttaaccttgggatggctaaacatcttttctgcattgacaacttttctcatagttgacaactgttctcaagtagcttgttaataatagcatataaaataaacctaattattttttagcacctctcttttcacaaaatgaaagaatgtatctttgtgattttccagaggccctctagggaatctcagagataattctaggtgcaatgatatcctgaaagttttattttacatttaggattcagttttgggaaggtaaatatcaaaagttgtccggagatgtgaacagttagatatagaatcataggtacctgagaaatgatatgtggccactcattgcaaagtcacagtaaaacttaaatatagaaggtaatatgatggtaaagaaagaaccttagctcttacaatgataagacattctctttctctttctggcacaatcagtcactttacttgaggacataactattctttttcctttaataaacaaaaacacatctcataaccttgcattgcaaagttttacctctctgccaccatttctcctattccagtttcatttatgtgtatcttttaaccaaagtgactgattccatagagaaactgggagatggagaattgaaaatggttacacgtcagcattttagtagactagcagatctcataaatacacataactttctatagctatatgcattccttatactccaacttctccaggtggcaaaaatgaacatgttcattaaccaactcagagatacagcctctctgtagcatatgaaaataagtagcaagagtttataaatttaaaattttgcctagtaattatagtggagaaaagatgtcttttctcacccatcacataggttcgtctcctataataaaagacagttaaaaatagaaaagcacatatttatttaatgtaagttttatgtgatacaggacgctttagaaatgaaaacccaaagaaacaggaatacttgtgtattttatgctaaatttgaagaaaaagtatattgtgtgtggaaatatgactggataaagaaggtatgatccaatagtaataagctagagagaacttagctaggcctgtttgttcagattcttctcttaagtccatccctctgtgatattccttgcctctgggtgatagggcacatgagtgtcttatgacttcttccacgggaaggccagagaattattttatggtctacttcaaggtacaagggtgggaggaggtcagagtggccttccttctctgtttcttcaaatgccaaggtgccattattttagggtagcatgtcctgaaccctatcattatcaatggattagtattctgtcttacttagaagagatctagggttcacaactaattgatcacaaccggttacagatatcattattccttttccactcccacagcttgactccactagccttaaaaaataattaaaaaaataagagatctggatatctaataaatatctattaattacctgacaatcttggaaattaattttgaaggtgacatattacaaaacataattattgttgaaataaaattgtcaataatgaatcaatttggttaattgtaagtttacattttttcttgactaaacattaaacaagtaattttggcttatttgatcagtaaacatgtataattaaaaaaatacgcaagtggaataaaagtctgtttatatatttgacattgataaaccagagaaaaccttgctgttttattaaaccaaaattattagtcttgtttgtcaagatttacctacacgatatgaacttgaagtctcaaaatgtttgttagttgctcttagagtactttttaagtactcttaaaaagtacttgtagcttaaaataatttctagcacactgaaaagattagaagttccattttcttctctgaaaattttaagattactcaatttacataatcacttacttttctctataagctaatcagaacagagttccttttttttttttttttttttttgaggcggagtctcactctgtcacccaggctgaagtgcagtggctgcaatctcagctcactgcaagctctgcctcccgggttcatgccattctccagcctcagcctcccgaggagctgggactacaggcgcccgccaccacgcccagctaattttttgtatttttagtagagacggggtttcaccttgttagccaggatgttctcgatttcctgacctcgtgatccgcccgccttggcctcccaaagtgctgggattacaggcgtgagccaccacgccaggcccagagttccctaaaaagactttataatctaatcagtgccacctgaaggtagaaaagccttatctacacgcacaataaggcttttctctatacagacattgatagacatacagtcacacagagtttataacttcagttctaaactttcagccatgaattaataatacaaaatgatgaaataccaaagagctgttcttttctgaggacaaattattaattgatttgagtccaaaatagattaacaaactagattctccattttttctcacccaatagagaatagacctctataaaccattaatccatttacagggatcatcagatggtcagattgcaaaaccaattccccagattagtagagagcaaaagaccagagtcagagtcagcagagttctcttactgctttggattcaccttttagagccaagaaaagaggtatgcaggcttaagcataaggtacaccatttcttcgatgatgaagtttgcctgcctttggttgataaatctataggatgtctcaaggggacctccaaaatggttaaaagaaattttccagaaaaagatacattgactctagcatagatatacaataaacatgtattgaaggattttactcatctgatataagggagccaggcaaatgttataaccagttcaaaggacaagtcaaacagcacagatttatgtagggtaaagaaatgttgagatgagttgctaattgagacaaaactgatttttccaggactgggttgagaggggagtcaaatctatgagagaggacagactttatgtatctctcaattatagttgttctccttattcacagttatgttctttaaagtcactatgaaacactaaattagcaagaattcttatccctcgggatatacatggttaggttcctgcaggcctctggtcacatagtttgtcgtctgaccagtacataaccttgttttatatgtgtttttgtttaaagacaccttatttaatacagttaattcatcaacattgaactcacagccaacagcactataactcatgcctaaacaaagcgtatctgaaacacatattggcacatcacagctttcttggaacactagataacatttcagcagtgtttggggaccattttaaacagtgaaattaccaaaaagcagcacagaaatgcaaaatactggcactaaatagagcacaaaaagtatgcttgtttacagtatgagagctaaaacaagaaggcagagcattatcctgcttcacctcatttagaaatgtatgttacgggactcaaattttttgacattctccacatgtcacaaatgaccacagaagcaccatgggcattgatttaggagtcacaaataaactttacgtgaattcatgaaagattttttttttcatagatagctttttcctcccaatgtttaatcctggatcctgtctgtagctagggaagtactgctaaggcgcgagcacgagagagaattatatatggtggcttactgacgttcctggtatattataggttaaataggattctgagactccctatgagtagcttgcaaatctctggaagtggtttttggctatttgtgtagtttttttctccagaaaaatgtgttctaaatttctaatggctgattttcagatatacttttggaacacaaaagctggagtaatggattactaccttggtttgttttgtggcaaatgctgaatagttccaactactgctttgaaaataatagaaatattacatagcaagtatattatttgaaaagataaaatttcaaggggccgttgactgtcacatcaaagcagtaatttggggtttgagaggtggcaatactctacagcaggtgtagagtattactaatctaacaaatatttcaggtgcctcatgttttcaccttatttgcttgtttaaatcactttatataaatttcatggaaagacttgctttgccagtgtatccgaaacctctgttatttctccatagtattttctatagaagatctaggatacttttacattattctgaaccatttaccccctactgtaccccacccccatattatgtacctaattggtaatttcaaagtaaagagacttttaaagtgaaattcctaaaaagctatttttcttttctccttcttaaaattatatgttagggttatgctccgctttcagccagatataatatgggtacatagcctggtgaagaatcttgaaaccttccaagtaccagtataccttgctttggcctcccaaagctttgctcttctgatcccatgcttcagttggaagtgactgtcagttacgtcagtttgtgccaaattatgtggtagttcttgttctgtgtacaaatggagagtaggaaaaatcatttagctgttcacttccaaactcatgtcagggtttgagattaggttattagagaagacagacctttcacagaacgtcaatcaaggttacttgagataaaatatttcacaagcaataaaagaactgatggatgtttgtatttttgtattactgaaccataaatgaaatgattctgtataaaaatgaatgaagttgattttatttttctgtcttatatatggaattcataagttaattgtggcctggttttgttcagaggttggggttttttggcatttgaaaagtatatcatttatatcataggaaatagaatattccactcacaatgtggagatctacaaaataaactgtcatatttcagaaaaagaaattgggcatgggatgttaaagatcacattttaagtttactacagcattttccaaaggtacttctctgatactagggcttaaagttcagactattttgtgaaagcgtttcagtgtgtgaaacagcaaagggagtcagcttctcatcatttaggtgctggtagttgggtttgtggcaaatctgtgccatatggctactctcctctagaaagtgacggcagcactgggagctttacctatccctagggcagctgtcttggactccattgctttgatcttcttctgtcgcacagctgagaagagcaaggggctggttttcagtaccctaataggacaacatatgggaccattatgattgtagactataccttcattttatataagcattcttcagagagtgcaagtattttcacttccatattcccattcagaaaaataagtttgggctctttcttttaaaaaaaattattttagggttaaagaaagacattcttatagaaatttaaacatttaatatctacattttatttcttgcaaaatacatcctttttagcaacaagtttcaaataggaagtagaaaagatgagtataattcgtctaacttacccattcttaagcatacatgcttaatgtcctttcaagtgttgttattcttagagttttatctttttagctcagcttccctgtttgctcaagtaacctttacattcgagtatagtgggaccagtaaatttgttcatccaggtactgtaacaaacaccttggaggaggatgcttggaaatgtgatcagattcttaacagtacctcaaaaaacagcaaatttttattatgatgacagccctacatagcagaaaagttttctgaataatgaatagaaaatccaaagagagatgtatgtggattcttactttagttttagtctctattgtgaattgtcattggacttcctcatatgctcctttgcgtttagagaagcacagttgcatgtgcaactttggaaacaaagttgtttgccacagaaaaacgggaagataataaattttttttccctacacatcctaacaatcatgagtggtcagtggtaattatatagagatggatcctattagaaaatgcatgcttcttctctgtgtatttttgtttgtttttcacagggtgctttgcccatccacattccaatctctgtcatgatacttctatttatgttgttatcaccatcaacagcaactgtaatctggctcacaattcccaggagccagctcactccttagttaccaggggaaaacccaaaccagttgttcttttcttttatatgtataaaacttcattcttctcacattgcagtgaccctgaccacattttggaactccataaccagaatagatattagaactgtgtctgagatctgatgtagtacagagaattctacctggcggctgaaagggtaattgagtgaatgagagagtgattatcaggtttgtgtttgtgtgtatattactatttcctagatatttgagtgctttctcatttcttctgcagtttctttcctaatgtctttattgacctggagagtgtgtgttgggaggtaataagaggagagagaacttaggtttcttacctatcatttggcaagaaaagaatatggaggtcttgggttaattttccagctatcattataaccacatacagaatctacactagaaaccatttccttcctcacaattgtgggagagcacatggggaacatatatttattttacaggattcttaaaagtcttttcaacatattttttcaaataaaaggaaatgaatgaaatagataaaacttgcaattgcgggatatttttaaagaaatgcagttttattaataaagtacttaggtgttaacgtccatcttggttaaaatcctggttttgcaacttattagccctgtgaccttaggctgtttattttctcgatattttttcctttaaggtaatgtaaaattaagatatatattataatgccttccttatagccatgcaacctataaactctgtacataaaatttcaataaaaatacatttcagtgtggcgattcctcagggatctagaactagaaataccatttgacccagccatcccattactgggtatatacccaaaggactataaatcatgctgctataaagacacatgcacacgtatgtttactgcggcactattcacaatagcaaagacttggaaccaatccagatgtccaacaatgatagactggattaagaaaaagtggcacatatacaccatggaatactatgtagccataaaaaatgatgttgagttcatgtgctttgtagggacatggatgaaattggaaatcatcattctcagtaaactatcgcaaggacaaaaaaccaaacaccacatgttctcactcataggtgggaattgaacaatgagaacacatggacacaggaaggggaacatcacattctggggactgttgtggggtggggggagcggggagggatagctttaggagatatacctaatactaaatgatgagttaatgggcgcagcacaccagcatggcacatgtatacatatgtaactaacctgcacattgtgcacatgtaccctaaaacttagtataataataataaaaaaatacatttcaagcactcagcatggggactagaacatactacctagtacaccaggaatgctcttgtctcagggcctttgcagttactgttctctgcctacttctcagggagggaggtctcccctgtataccccatctaaagtgttttctcctaggttagattatagctagctatacccgaaacaacacaaattcaaatttaatgggctctaatgtaatggaaatttatatagagacatgttgctatgaagttgtgaatcaaatttgaggaccaaataatacttaacatttattgagtgcctactataaaccacaagagacaatgtagcataataggtaagttgtagcctccagaatctggccgtctgtgtttaaatcctgattctgccccttctttgctgagtgaccttatgctagttacctaacctctctgagcctcagtttactcacctgtacaaggggaataatattacttcatataaaggttttaggaaaagttctttctcatagaactcaataaatgattgttaagtcagggtgctttctaagcactttacatgaattatcacatccttatgaagtacaagacatgtactttaatcctcatgacaaccttatgaaagacaaagttttcttatgccctttagtaaattttttgaaatggagataactacttgttaatgtacgtactttgtaagtccacattctcttaaagtaagctatagctttgtaactttaatggataagaaagttctcaaaacatattttctactctgtgaaagtaaggttatgttgaacaagtaaattaatattttctctcctggattctgatgtttcatttgctttcctgcttccccatttccttatagttattggactttctttggagatggagttccagcagttgggaatgtaatattctcttatggataaagtagattaaaagtttaaattaaaatacgctgttaaatgttgttactttcctttgtgtacagtagtagtagtatactttgatgagttgagttccataggcttaacttttgtggtaaaactgaatactaactaagggactattgaaatgtaagctttgtggcagaaagtactatacttaccgagatcaagaggctcacttaattagactatataataaataatcacatttgggacattttgtacatgactgcatgatacagccatgaattagatgtttcaagatgttatttgaataaagtcctgagagaagaataaattacaggtgtgggaaaatggattttatgaagaaaagtgaatgttataggggttgcctagcttagggaataaaagaatgacttaattatatttttaaggaggaggatgttgatttgtttcccatgttttaggagaactaaagaacaggactagtgcagaaaatgtagacatacatatacccagttttcagaattacaaaatgctgaaatggctttggaaggaaaatataaatactcagaagagaatagacagacacctttgattagcggcccttacttttttatgcataaaaatctcctggaattgataaagtgtagtttcctgggcccccaccagagattctgatctagtgggcctttggtcaggcctaacaatttgcgctctttatcaggtactcccatctgagtccaattagtgcagatagatagccattgaaataaatgttgaaaatcaatttttgagtttaatcagtagcctgtccaagtccaggggattgaaccaagtaacctctcatggtccacttcaactatagtacacacatgcacccatacacacgtacatatatatacgtttacatatttttctgtatccctttggaagagttccaaactcttgtaaagaaaccaacttttagaataatagtgagttggttataatgttcatcgctcttcattgcaactattttaaaggcctatgttaaaccacatagagtaatggaaatttttatgtaatacatagatatcagtaattgagcaaggtgaaattgaatcatagtttacatctttaacaacttgagatatggtaaataatctgcaggcaatcttttggacccttttctcacagaggattgattataagggaacaaatagtaagtatatctcagatgtgttgacatatactcttgatgataaatgaacattaagttaagttataaaagctagcctctgcttgctgtgcttttcaggtatcctctttaattctgtttctgtggatttgtctttgttttttcctcctaggatggagctatgacattgaagagaggaaggttccaaaacccaagtccaagtcttatggtgcaaacttttcttggaacaaaagaacaagagtatccacaaaataggttggcactgactatatctctgcttgactgtgaataaagtcagctgtgcagtatttatagtccatgtataataaatacatctcttaatctcctaataaattggacctttaaactacagat

SEQ ID NO: 421 - DNA, 303476 bp, Homo sapiens
aacttgcagactgtggcgcaactggtcttggtagcggaggcacccgaatgctgcccgggtgaggtaagtttcctgtgcgtccccggccccttcccactagacccttctgaggggcttgcgcttaggggctctgcatctctgctgaaacccgtcggtctctctacccttccactttgcctgtctgcgttgtgctgggggtgacgtggagagggcgcccgtggccaccgaagcggaccttcgttccgcgggggccacagctgcgcgctcccaacggacacccacccgctcgtcacccggatccccggggccgcagtgacactcggagatcactctgggttcacttaaataggagtactctccccttttccggggaacctgcagagtttggcagcggaaggaaaggtctcccaccaccctcccccggtacgaaacagcggtgaacttgttaggcgccctggtatctcaagaggggcttgcgagttggtgttctgctcatttctggcgctggtgccggattgaacaggtgcggtatggttccagtctaaatgcagcaacagacttctgcgtttcccaggctttctcccccagcctggtcaacgtgacgcttcaacatctggggcaggggctgggagtgtaggggcactggggagggagaatgcccgggtttgatttactatgccggtgccaggagtcgccagaacagaagaaaacaaatgtctgcttatctggcatctatgcagatgagcgtgttgtcatttcttatcccccccaacccccagctctcttgtctggtgcccagcgtggctgagtagaaacctattccggagaagttatttgggtagattgattaattctttcatcgaatctactgaaatcagggctccgaacaaggcaatcctagttactctgatgcttttttaaagggagcgtgttacagatcagaaataacacccactatcatcactacctctctgtgacattctcagatgcaggaggccctagctttaaggggaatgatccttaagggaccggtaggacctcagaatgtgttaatctcgtgcaaggaagaagcggtctctgtgtcagtacttctgagtctcggtttggggaaccccttttgtccctctaatgaagcacattcagccagagacttctcccctgttctgcgaagagactgaagcgttctgcagctgttggagtggagaaaggcgaaaggattggtttcattaggactctaatgtgatgaagtaaggatgggtttcattaggactctaatgtgatgaagtagggtagtgttcatggaagctttgctagagcattcccagctgaaaggagacgctgggaaaaaaccttaatcggccaagtgtaaaccagtgggaggttgagtgagtttcatgtgtgatctctgagcggagggaaacggtggttctgatatggtcctgtgggcagagacttatgaggactgatgagaaagctggtgagtttgagactgatgtatgatgacatcttacctgagaaggaaaactgtgaagcactaaatgatagaaccacattacatttttgtccacgttaagactagagagatttaataataacaccttacatttgcatcagtgtcttgcaatttgtaaattcttttgagtgttctcacctaattccaaacatttctgagggaggcagggcaaagactttttaccatgtaaacacagaaggaacatgaggctcacagattcagagatttatcaaggtaacaagtgctggtattagaatcacagttaggttttctgtcataaccaggtgcctgctctgtacttatataaggtggttttttaaatggcagagttcttctgcatttattgtggtctgcatagtctcactgtaaattactgtttacattttacagatgaggaaactgaggtttagacaagcagtgggagttttccatggatttacatctcatttagtggcatttgcaagactagaacttggatcttctgatgtccagtccattgctttgtgtattctgccatcatttcagttctgatagcaatgaggacacatcatggaaactgcaatacacaaaggactgttaagcatgcccccagtgacctgggttctagttctgggactacatttggccgtatgacctgggccatcatatcacttccaagtctcaagtgtctcacatataaaacaaaacgtttgtatgaaattatgttttttctttccaactttagcattttgtgatgtttaccaatgtgtttgtaatccaatgttatcattttctctagaggaaggagacctttgtaccccacatcacctaagagacctagctaattactctttcacctttagtttatcccttcccccctttactacatgccacttcatcaaaggaatgaaacttaacaagtgcgttttagcttaacatctacagtatattgtttagtttactgtttgacttgaaaatattctgaggggttaaagtactgtaaggtacatgtcagggcttacttgaatattctaattgtaagctcataactttttttttttagctttatggtttgcataaagtaagtgctcagtaaatagctgttgaattaatgaagggggtgaatgaagtcattcataaggaaaacatatgctgtaaaacatagaaagcatcttaccatgtaaattcccaacacataagataatttgcctacaggcatgtgcctcctgaagctggcgggtacagagcccattgttgctctcttttctgaaggcatcatatagggaagagcttttctttctccctagacagtagactcatgtcatctatgttatgctcttttgtttgccgcccccccgcccctttagttgttagtattacagctgctgaaagatacattcctagaaattgacttgtcccattttatgaaagggtatgtcttgacatggggaaaccaaccattctgtttttaaaacagggtattgaataaatttcaggagatgctaatactgtctcgtggtttcagagggggaacctagttaacaaaaccaacctagtttctgttccttttaacaatcttctctttctactcctcctctttatatacagacaagtagtgtttttatgtttggaagaatgataagaaagaatatagtgatcttaaatattattaatggatctgcaatttacattggggattgatgtatgtttccttctgataaagaatttaaatattaattagtttagaagtaccgtttatgggtaagaaaactaaaacttaggtgaattgacttacttatggtcacaaagatgatagcaggaggaccaagatcaatgtggaattcttaagaaggttcatatttgagtttgtcccaggagttctatggtgaaggtacagttttgacttttagaaatcatagagattaacagaaaacttctgtttactatcattattagagagttagtacatttgaaaatggtttagcatttatatgtttaagttttcttgcccaagcagatgccattaaaaataacatgtttttttctctttactttttttttgttttttgagtcaaggtctcattctgtttcccaggctggagtgcagtggcccaactccagcctcaacctccccaggctcaggtaatcctcccacctcaacttcctgagtagctgcaacaacaggcacgcactaccatgcctggctaatttttgtatttttggcagagacagggttgcaccatgttgcctaggctggtctgtaactcgtggattcaagcaatccacaggcatcggcttcccacagtgctgggattacaggtgtgagaccctgtgctcggccaaaatgtttgtttttatctattcactatgattcttctggcttatgtgcatcaccagactcagaaataatactttgctccaatcagtgctgggagagaggaaactgttcaaatagaaaccaaagacctgtaatcccatgggaggccgaggtgggcgaatcacttgagcccaggagtttgagaccagcctgggcaacatagcaagaccccatctatgcaaaaataaaaaattagctgggtatggtggcacgtgcctgtggtcccagctacttgggaggctgaagtgagaggatcactggagcctaggagttcaaggttgcagtgagctatgatcgcaccactgtactctagcctgggtgacacagcaaggccttgtctcagaaaagaaaggaaaagaaacacaaatgtatgctggtattctcaacttctcttcctgatatataaagccagaagccaaaggtagccttgtcatgcagctggtaaagtcataaatatgtatacattcaatttgcatttgcattttgcttgtacttctgttagatggtgagtcagaacatttaatatcctggaaatttttttttccccctatggccagagccttcagtagattctgtaaaacatcaagtcctaaatgtatttgttgctgaaacatgttctctttgtatcaagtgcattaatgggagttggaaggaatccttcatttttttttagaagctggccagttagaactgtacattatgtagctctactgttcatttgtggtcttatcaatagagcaggatgtgttactttttgctgagtgccagagaactggggtgggaggaaacctaggcttctgttttattttttttctttttaaaaatcaactttaaacttaatttatgatgaaatttttggggtactgtgtcgtaaacaatcagctgctattgacagagaattgtattcagtcaggttccttttcatatataagattaggtcagggaaaacaggcttgcttttgtacattctattctcaattgtatttacttctgtatcgcttcatcagaggtatataaaggagataatcacacaggaaaacacaggaatcctgcccaaactagattactcttggaaagatttgaaacagagtgattgggacaaggttgcatgttcagtaagctgacagtgccttggtattatcattttaagttaaaacaaactagcactggaataaacaacatgaagtgtgtgttcttgtaggaagtcttctgtattgtttatgggactcaataaacaatgaatatgtaacatgtttgggtaatttacatgatggatgcacagtaagttcttgagactcattttctctaatgtttttagaaaatcaattgtgaaattgcaatgaaatataaagcattgagggtttggtattgctcctggttttaaaatgggtgtgtatgtctttcagtggaagttcaggcaaggattggaattgtaagtactaggggtccagagattataattatcttgaattggaactaaagttcagacaggactgcagaaagttcattcagtttgtaagagaaaaggtgatatttaagccttcaccattcagtcatgctgagcaaggggtttgtgggggaggataaaattagagcgagccataaaaatgtgctttccttgcttcgtagacagacttaagacatgcagtggattcgacatgtttcatagtgggcttttaatttaatatacactttttttctttcttttttaaaccatgcccatcattgtgctctctggatcacttgatcatatgtttggtaataaagtaaggaaacaaaacagcaacaacaattaaaaagcaatgcaacgacctccttgagggagtagtaagcacatcataggtgttcagcaaatatttgacaatggaaaaggttaagcatcatgttttatttatatttgtattcttggaacttggcactgtgtctggcaggtggtgaggatttaatgagtgtttactgaacaatttatatatccaaatgaatatcactcttcaaaatcttgggatgttccataattattctaatgattctattatttttcgaaccattttagaaatattaggcagtctgatagatgctaatgttgatagtttatagtagtcctttttttaaatcataaattatatttattcactagactacaacttttttaaccaaaatgcctaggaataattttgcattatttatcttctttaggagaaaaataaatactaaatatattctgtttttatttgaaagtattcagtaagcgtagttctcaaatgcccagagtggcttaatagtgagtttggttcagggtacagagacaagaatggactttaagcttctctaagttaatcagcttaaatatcacctcctcctggcgacttttctgttcttccaacctaaaggagaccttctccatatgttttgttcacttgtcacagggatactgatacagttttgacgtttgtcccttccaaatctcaggttgaaatgtgattccccatgctagaggtggggcctgatgggaagaatttgagtcatatggatggatccctcatgaatggcttagtacactccccatggtaatgagtgagctcttgctctatgagtttacatgagatctggttgtttcaaagcgtgtggcatctcctacccctcccttgctccctcttttacatggactcccccttcaccttccgccatgactgtaagcttcctggggccctctctcaccagaagcagatgctggcactgtgccttatgtacggcttgcagaactgtgagccaaaataaaacctcttttctttatgaattatgcagccttaggtattcctttatggcaatgcaaaaacagattaacacggatacttattcatttatgtatttcacttgtttccctgtgtccaaactcacattcaacccaagattataaactctttgagggcagaggccatggttcataacactgtttttctagtgtttggcacatggtaggtcctcagtaaatatttaaatgaatacatgaataagccccatccatcctgtcaagatgaagtgggccatcatttaggttactcaagctgaatcagactgagaggacagtgcttacgtgttagctatggcagctcctttacaatgatgaccgaaccctttaggatgagaaaaccacttgtttagatgataaattctggcatgattattaagaaaacactgtctctatttaaagactgatttcttccatttacttagaaatgaatagtagtgaacaaagaagaggaaattatcaagcacaaaacaaaacgttgctacactgttaaaatgggctctaaatgtacctaaatcataaacatattcattcctaattaagacactttggtgttcatatacaaggcaattcctatgatgcctcacataaaggtggtatttgagctggtatttatttgaacatcagctacatcaacagtcccaataccatggaagaagccagggcagtgactctgaaagtgcagtccttagaccaacagagtcatcactacctgagaatttgttagaaatgcagatgaggccaggcgcggtggctcacaactataatcccagcaccttgggagcccgaagcaggtggatcacctgaggtcaggggtttgagaccagcctggccaacatggtgaaaccacatctctaccaaaaatacaaaaattagctgggcatggtggcaggtgcctgtaatcccagctacttgggaggctgaggcaggagaatcgcttgaacccgggatgcagaggttgcaatgagccaagatcgcaccattgcactccagcctgggtgacaagagtgaaactccgactcaaaagaaaagaaaagaaagaaaagaaatgcagatgaactctatggatggaggacaggccttcgggtgattctgctgcatacccaatattgccagtacatagtaaatctgttgctccaagtataagcctcctgaagtgttcagtattcccaggtaaacccaggatgtgttgagggagtgctatctgcctgctccttcagaaatatgaggggagaaatgaaaaattctccctctgccagtcttggcttttctcagaactgtgcggatcacaggagagcaaagtattgtgaatagattgggtatctaggactttagatacaatataaaaaagcttttggtagtcacagagcctgccaagtgatgggtattatggggtatacagaaagtgttaatataaacatggtcctggctgtcaaggaggctgactgtgctgagagcttactctgttccaggcactcctcaagtgctgtttcttttcatcaccatgtgcttccaagctgcagcatttcttcactgaagagaaggaaagggaaacctagtcaggttagtagtaacttgtaccagagcacagaaccagtaagggatggcacaaaggttctagccctggcttttctgactatgaagcccatactctttttctctgtttcatggtgtagcacctcaaagtacagttttgaaataagagttttaaaaaggagaacataagcgaatctaaaatttatatctccaaactaagtctttctctgaactctagtttgcataattgacattgcgcttggatatcccaaaggcacctcaaattctacatgttcaaaaccagaatcatgatctgttttctccacatctgatactcctgcaaggttcccagctctgtggtgggcaccgctagtcaccaagtagcacgatcagaaacttgggagccatccttggctccaccctctgcacacaccacatctaatccatcaccaatgtctattgattttgcttcctgaatatctttcccattccatctgcttctcatcatttgtgcggattctatcctagcccaacttcttgtctctctgcaggactgagccagaacctctctggtatcctgagtccactctgggtctcctagaatccattacccatattgtaaccagggcacttgtgatggttggagggcacctgaggctctgctggccagatctctgcttcctgtaccctgccaaaccctcacggaagcacacaaattctgaccccagggctctccacctcagtggccttttgagctcttggacagcctctgaggacttgtttttccaagtagctttctaccctgatgtttttgctctcctggagtccagtcagaggcaggttcataactacagtcaactacttttaaaggaacaggatggaaactccagtgtagctctagggacttgcccaaccctaccgcaaataccaagttcttaagagttctccggcagttcccaaggtgcactccactcactccaacaaagaaccaaagactgctctacttccacagttgcttatactctgcccctgagttcccccaggaccctgcaatatcacatttgtggccaccatagcagagaaattcaccacctgtggtctaggaataaaatctaagcctctcccaaaaggcacctgtctctgactgttgactgtggcttatcctggcagctttgaggaaaaggcctgggttgctttgcataactggcaggatagataaagaaacatgactcaaaatcattctctctgtatttcctcataacaggaaccagttgacatgggtgcaggaaaaacttcctgaccaaggagtggggcctggggctgggggtgctggacagagagaagcacagggatctgccccagactcttcaatggcctccctttgtgcctggagtgaagatgtgggtcattgacatggttccagagccctgcacggtcctggtcctgctgccactccagtctcagatccaccactctgccccttgctgtttctgagccacacttgcaactgccagcttcacaccctctgtgcagcactctcgttgccccctttggaatgttctcagcatcggtcgaccacgcttcaggtcaattctaaggttacttttgaaaggaggccttggccacccatccccagtctaggacaggaccagtggttccctctccaggagggcttcaacagtatgattatttgactagtttcctcgcccccaccagctgctaatcatcagggcccattgcatccccatagtgtcggcacatgtagaattgtcttgagtgaataagtaaatgaataccaatacttctaccttaaaaaaatccttttcgtaaattcccactaaagaaaggaaatgcacagagatcatgaatgaaccacttcatattgccgatcctgtccatgaacttgatcttcaactttcattaccactgcctaatttcacctgtcatgagccgcatttctataatggtagctgcaggtattatccccaaggaaggttgccccaaaggcatgatataaaatatttctggaagaatacctgagatactagtgtctttgtttgcctctggggaggtgaattggctagctgaggggcatggatgggaggggaattttcatcccatatttatttgtacctctgaatttggacccatatgtgtggattacttattttaaaaattagaattgtaaaagtaaaaggaaggaaagcagagcaagagatgtgaaggaatgggaatgattatttagaggaaagaatatggacatgcagttgaaagggggttgtcctgaaaagaattcctgtcttcaaggatacagccagttacatctgacttgctctgcacatctatggagaactatatggcttcaacttaaaagggatgccataacatataacttgacttaaataggtttgtctgatctctcccatcacagaatataacatttattctaaatataaaagctaatagaacctaattatttaagagggaagcagttgttaaggaagaagttagttggaggctaaagcattctccttgaagacatagaagtgcccaagaaacatgaaaaaatgcttatcatcactaatcaccagagaagtgcaaatcaaaaccacaatgagataccatctcataccagtcagaatggctatgattagaaagtcaaaaaataacataggctggcaaggttcagagaaaagggagcgcttatgcacgattgcttggtttgcaaatttgttcagccactgtggaaaacagtgagaaatcttggagatttctcaaagaactgaaaatagaattatcattcaacccagcaatcccattactggatatatacccaaaggaaaataaattgttttatcagaaagacacctgcactcacacgttcattgcagcgctattcataatagcaaagacaaggaatcaacctaggtgaccatcaatgatggattggatgaagaaaatgtggtatatatacaccatggaatattatgcagccataagaaagaacaaaatcatgttctgtagcataatggatgcacctggaggccgttatcctaagcaaattaacacagaagcaaccaaataccgcgtgttctcacttataagtgtgagctaaccattgggtacacatggacataaaattgggaacagtagatactgggagctccaaaggggacagggaaggagggaggtaagggttgaaaaactacctgtcaggtactgtgttcactacttgggtgatgggttcaattgaagcccaatcctcaacatcatgcaatatatccaggtaacaaacctgcatgtgtaacccctgaatctaaaatctgaaaaaaagattctcttttatgatccaggtatttttagaatagaataagagactggacggtagcatcctataaaaactggttaatataagttggcataacccaagcttgcatttaatctttgcacatagcttttccagttagtcaaatttgaactgtaaataagagaaaaataccaacttgtcttaggtggttcaggctgtcataacaaagtgtcaaaaactgggtggttcataaacaaaaacagtttatttctcatagttctggaggctaagagtccaagatcaggtgccagcatgatcaggttctggagagggctctcttccagcttacagatggcaaacttcttctagtaccctcatgtgacagaaagagggagaaagagctttctgggatctcctttataagagcccgaatcccaccctatgacctaatcacctcctaataccatcatcttggggttaggattttgatatgaattttgagggggatacattcagtaccttggatagtcctttgtagcccagtcagtgtgctataagaaacacatcctgtgttgaaacctagtatatacgtagagatataaataatacatataacagaaataaaggtttcatgaaacagtacttagccataccacatgaaatgtcctctgttattttctgttgtgttccctcccaactccaacttccaccatacactggtcatgagccactgaattgactttactccctactgaagggcagagacctgcaatttatttagaaagcatgagtgcaatctgccatccccctggcactgcctatgatgtgtgtcagcctagaggtgtgcatttactgaggagctgacaggactccacatatagtgctctgtccactcctatgaaaccacagaaagttgtgagtttaaaaccccctaaagactccccttgcaaagttttatcaagaaggcatagtaaaacttggagagtagacatatgatagaactttgagttggacaaaagtgactcagatggctgccttgtctgtcataaaacatatgtaagcttcaatcatcaaacatggcctttaacctgggaaatgtctgtattttttcctatagtgctcaccctaaagttcacactaatttattttagtaagaacctaaatactgtaaggaaaacaatctctgactttaaaaatatgtgaagaataaagaataatttgacggtgtagtttttttcttcctgaaattccttcagacattaagcctgctcattttcattggccactgaagcacaaaattgaaggggctcaaaatagggaacccttggctatgcagaacctttgggcaggctgttttacttctagaaaacatttcctgattgcttgctcctttaactgccagcaattattatggccaagttttgtatagaaaattttcccagcattgtctcatctgtccctgattctttaaaagattatacagaacagagtgtgtcttttatgctactgtaaagtgatagatttagtattcattcaggaatgcaaggctctttgcccctaaaccaaatggccctactttgctgtcttctaaaatcttgtctgctttttcttgataattttttttttggccctacttctgtggctctcagcagtgagccccttcactcattgttggctattgaaagtccattgtgattttgggaaccagataaccatactgtctgaaatgtgtttgccagatagagtcatattatccattgaaactgaaattttaaaaaaggatcaaaagtagtatttgagggaggtcttcaagagttctactggtaaagcaagcaagctttagttctttcttgttcgcttcattcattagccaatagcatgttttcttctgccctgtttttgggttgttcagataaagtgataccttttcaggctgtgataggcatgctttcttttttctttctttttgtaacatattgataatgtgtttactatattatggtctaaagcaggatttcatagactttttcatttaagttaaacatagtggcaattgatgagtattttggtaacagctttatttgcaatgctttatgcctttaaaggttatagattactgcatttctcttttccttggagaaactgcatagcaaagttccccagattttcctgatttccatcttccattggaaaacaagttcaatatccacaataaaacaaggaagctgaatactgaaaaattaacttatttttaaggagtgatgtgaaccagactgttctgaggtttacgactgcattgtatgggaacaaaaagaagcaacggtgtcattgctgtggcaagctgtatttaaatgatgcccttttatttttttcaagatgtgttgttcagactcagttgtgaagattatggaaactgaaacaaatgggaaatcagtctctcctgctaagggttaagagagaaacacgacttttgtttacatttgtttataggaaacagaatggaaattcagcttttaagatgtctgtacagttgggcttcattatttagtttagcagtttctcagaaactccctctcctacatgacaatttataatgcaaacatgatgcatcatttcattttgtgtaaactttatagaaggaatagtcttttccacatatgtcaaaagacttctggaagcattttagaactgaatgctaagtatcctacacatgtgcctggaagctttagaaatgatcagcagcagcactttctgaccttacatttttgtttgtttcttcatttgtccgcctccttactgaaaggtaaagtttcacaagagcaggaactttgttctgtttactacactgtctccagcacctagaacagtgtccagcacaaagacagcctgtattattatcattgttgaatgaactcattcttaagctataaaaacaaattcttaagctgtaaccgtttttcccttgacttctgagctcccccttcctttacaaaatttcagtagcctagcatctagccttgccactgcttcaagttccttccccgaggagcagccttgtttgttgccagattacagtctttcttctgtctcttgctttttgcacctttaaaagtctagaccaatttaataaccccacgccccatggtctctttgctactcagctgattttttgatcccaactcttacctctttgaacaaactctatacttgcagctgtgcagtcaccttttaaaaattcagtccacctcccttcccaaatactgtttttatcaaacacaccctcattttttttttaacccacctttgaaattttagcactctttttactttggtcatctctgtctctgtgcagctaccaattttttaaaaatgttctcttctattctcacttctgtctccagatacgtctcttacctgggctggtgtagaaacttcccaaataacttccatacctccctatctacccgctttaagcaattgtaatactgtctcttacctgggctggtgtagaaacttcccaaataacttccatacctccctatctacccgctttaagcaattgtaatacctgctgctagagaatgattttgtcactgccgtggcaggaaatccttagatcctttaccgtgtctgaaatctgaaatgctttggtttgggtacattctggccctagttgactgttgatcattgtcatcatcattgttgtcattgtcatagctgtataacagtgatagcagctaccatttcttaaactcttactttataccaggcataacacgtatgaagcatgacatcatgaagcttgttagtgcattttggagctgtataatgtgataatgggtagggtggctgtgggtggaataagatagggctggagaggtgtatcgggccagaccatcgacatcttgtcagctgtgctaaggagtttgaacatttcttctacaggcaatgaggcaacaactagaagagtttgatggagaagtgatgaggtcatattttgtttcataatggcaacatgagcaatagtttaggggatgaattagaagggtaagagactggagatagggagactaatcacagaagagatgaaaaggacctgaagtaatgtagtgtggatagggaagagtgagtagatttgatattcaagagggagaatttctaggacttgatgaccacctggatatgagttttggggaatggtagtagtagatgattctctggcttttggcttgagtgactggagagattggggaatgatgctcaactgagagagaataccaggtagaggcatcgtacatatggtagcagaggcaggagggctgtgatgatgagtcctattttggacatgcatttgagatacctgggggctatccaggtaggatgtggctgtaagatcaatccatgatggagacactggctgtgttgtggtcatatcatctgggctgtgggagagcatgagatcgaatgagattgagatacaggacatgaaggtggagagtctaaagagaagctgtgtgtaagtgtggaagaggccatgatgaagacacagtattatgagctcttgccagcaattaaaaccatgagactaaatgaaatgttcctgaaattgtgtaagaagaagacagaagatcacttgttgatcttcacttgcaatttcatttccctgtagcgtggctcattccgttgttttcttttctctgtttaaggaaatggcatcagattttcatgatagcatgtacagcctactgtttcggaagacctctctgagcccactgatccccactctgcctccctagaagtgatttctcaggcacacattctctttggtcctcttgctcctgtgactctttgggaactttccctagaggcttctgtttcatttgttctctgcttatctctccaagcagattcgagtcctgacagcagggatcatatctttgcctgctttgtctcccccaaccaaaacctaacagctctttctttattttttatttttattttttgagatggagtctccctctgtcacccaggctggagtgcagtggtgcgattttggctcactgcaacttcacctcccgggttcaagcgattttctggcctcagccttctgagtagctgggattacaggtgcctgcctccgcgccaggctaatttttgtatttttagtagagtcggggtttcatcatgctggccatggttggccaggctggtctcgaactcctgacctcaagtgttccgcccgcctcggcctcccagagtgctgggattacaggtgtgagccaccgcacccggcccttaacagctctttctatactctagctgctcctgctactttttttttccctttttcctctttggaggctcatttgctgaccatattgttgttatttttatttcatttattataattattaattaattttatttattaccatgtatgtatttatttattattagtatatcatataatatataatagttgtagatatgtttggggtacttgtgatattttgatacctgtatgcactgtgtaatgatcaaatcagggtaatgaggatatcacctcaaacatttttcattgtgttgggaacattataattcttctagctatttgaaatatacaataaattatcattaactataatttccctactgtactataaaatactagaacttttcccatctatctgtgtttttgtatccttaaccaatttctcttcatcccctcgtctcccctacccttcacagcctctcataactatcattttattctctacctccatgaaatccacatttttagctcccacatacgagtgagaacatggaatatttgtctttctgtgcctagcttatttcaggtaacataatgacttccggtttccaccatgttgctacaaatgacaggatctcgttcttttctgtagctgaataatattcctctgtgtgtgtgtgtgtgtgtgagagagagagagagagagggagagagagagagagacgttttctttgtgcattcatccactgatggacacttacattgattctatgtgttgactattgtgaataaatgctgtagtaaacaggggagtgcagatatctctttgatatactgattttctttcttttggatatatacctaacagtgggattgctggatcaaatggtagtcctattttttttttcttttgaggaacttacatcgttttccgtaatggctgtacatctttacattcccaccaatagtatacaaatattgccctttctctacatcctctccagcatttgttactttttgattttttttggtaatagccattcttactggggtgagatgttatcccgttgtggttttgatttgcatctccctgatgattagtgatgttgagcattttttcatatacctgttagccatttgtatgtcttcttttgagaaatgtctattcaggtcttttgcccattttttaattgaagtatttggttttttttttttttttttttttgctattgagttgtttgagtttcttatgtattctggttattaatcccttgtcaaatggataaatggatagtttgcaaatattttctcccattctttaggttgtctcttcactttgttgattgtttcctttgctgtgcagaagcttttcagcttgatgcaatctcatttgtctattaatattttgtttttgttgcctgtgcttttgggtcttacccaaaaaattattgcccagacaaatatcttataagattttcccaaaatttttttcagtagtttcatagttttaggccttacatttaagtctttaatgcattttgagttgatttttgtatatggtaaaagataggtatctagttttattcttctgcatatggatatccagttttcccagcactatttattaaagaaactgtcctttccccagtgtatgttcttggtgcctttgttgaaaatgggttggctgcaagtgtgtggattgatttctgagttccgtaggtctatgtgtctgtgttttttttgggtttttttttttttgttttttgttttagccagtaccatgctgttttgattactctagctttgtagtataatttgagattaggtagtgtgatgccttcagcttggttctttttgctcaacatttctttagctattttcagtcttttgtggttttatacagattttaggattgttttttctatttctgtgaagaatgtaattgctattttggtagagattgcattgaatctactccgtatagcgatgtgcagattcaattgttaaattgatatacagatttaattgttaaaatgataagcattttaacaatattcttccaatctctgagcatgagacatcttttcattttttgtgtcctcttcaatttctttcatcaatgttgtatagttttccttgcagaaacctttcacttatttggttgagtttattactaggtttttttttgtagttattgtaagtggggttgctttcttgatttctttttcgatttgatcactgttcacatataaaaactctgatgacttttgtatgtttattttgaacgtaacccttgaaagtgggtatgcttgtcttgttccagatcttagtggaaaggctttcaattttccttctactactttttattgattatttttattctcctctagaagaataaagaaacaaagtgaacaactcaaattttgtacaggtttatatcagttgatgtacctcaaactaaaagtgcctgcttaaaatgtgtttttggctgaatgttctatttctgacttaaaaaaaaagtgaattagcaagaagatctacaacacccagtgcagaattattgtcatttatcattctcactattttaaactctatagaagaagaatatgtcttttggcagttccactacacctactatagcttctcctgagcagagtttatctcctggtctcattggtcaaacttcctgtgttttaaaatggcattttgcatacacttgcacaagttgaatttggatgcagtgagagcccttatccaagaaacacggattctgtctgactcatccggcctctctgctaacactttggtgcgccctggtcaagtgacttgaccctatttgtgcattttttctttttctcatctatggaatgaaaatctagccactggctcctgacctcattcaaagacatgttgtgaggccaaatgaactgaggacctttgaggtccttagaacaaaagcattgcacacattagagaatttattttgtaagaattgcagaaagagatcaggctcagggtagccaccattatagcccacgagtaagcaaatatgagccaagaggtccccataaaggagaattctctcccatcactaaggccaaagataggagtgggacactgctaaagtctgattagagttccagaatttaaacatcaccttcagcatggatgaggagagcagcatggatgaggagagtggcatgcttttatctttaaaaagagacgaaccctgaatgtggacgtttattgaagaaagcaaaactcatacttacttgttaaagaaaaataatgttagtgaactgcaaataattcatgtgagagggtccaaactaggacataattctcttaagtattaaataagtttattgcttattccgtttagtttgtatggtatgtggtagccaacttatcgtatcttctgagtgcctaatgctctgccttgcatacaaggatgattagtgttttacttggtgctgcccatttagatgtaatatgagaagctcctagaagtcacccagaaaacacttttaacacctatggaatctttcagtttgtttgactttaactggacatttctcaaatgctaatgaaaatcttatttaataatagaagtatttaaactaaaagggtgtgattggattgtttgtaacacaaagaaaggataaatgcttgaggtgatagatatcccatttaccttgatgtgattattatacatcatatgcctgtatcaaaataatctcatgcgccccataaatatatacaccttctatgtaccaatgaaaattacaaattaaaaaaattgaaatgattatagtctgatgacctataccaagtgacagaggaatctgactggaattacctggccaaaaatgagggaaactcatagagtataacaccattggcataagtgtcacaaaattggatctgtactcatgacattggatttataataagagccccaaatcttaattctttagttaggctggcagtgaatagagtggcacaatcataatcatacaggtgccgtttctcagttttctgcttttagaatcagattgtggactaagcatggcagacttggttatgattgcaggctacagtacaaatattagcaacctcaacaaaagaaaaagtgtagttggcaggaggtgggatgtggcatcagggaggagagggtgctaatatcctcatttcttaaaatagcaagataagctatagctgttaaaagttgctggaattccacagtggttgtgccatcttgcattctcatatgagagtttccgttgcttcaactttttatgaacacatggtatgatcgttcttttgaatttagatattcaaatagttgtgtcctggtggctcattgtagctttaaattgcatttccgtgacggctaatcatgttgagcatcttttcatgtgcctatttgccattcttatatgatttttggtaaggtgctaaactcttgtattgattctagtaaagttgttgtttttttttttagcacacatattttttatatagacaatcatgttgtctatgaatgaagatagttttacctcagaacaggtgttggcgaaaacaaaaatgaagactttagtacttaacgttgcaaataaattaaacagaagaattagaagaatatattaaacttcaagaggaggccagggcagtgtgaggagaatccttgatatgggtcaagacctagagattcaagcatggtatcaacagttgtaaagataactatcaagagactaaaacaaaatttgaagaacagttaccttgggagaatgaaactagtggcagggataggaaaagcaagagttgatcactctcacgaagtcttctatctggtttaatttattgccttgcacatacgtttccctgaaaaaagtaaattattggcatattggtaattaggacataaagataaaaacaatatgaagtaattataataggtagagggtaagactgaataatataaaataaagaatatggggaagtggtctatgtttagagttatataaagaaaggaggggtcctgaaatgacagtcagtgctgataaacgcctgacacttacttaggctcttgctgcattctaggtactttctaaacaataaacatgtgacacttgtttaataatcacagcaaccatggagtggatactattatcaccatttaatagaggaggtaaggagacgtagaagcactgatactaagtatgttatttgagttgacacagtcaggtttcagagccagctggcccagccccagagccgtctctctaccctacaaaactgcagtgtgtctcatggaaggaaggtaggtgtgataccccacagtacagacagtgggtgctccttcatcctaattaaacttggcttgttctctgaggccatcccctaaagagatacttaactttagttcattcatgattcagcaaatatttgagtgcctattaacacagctctaggtactaggactattcctttccccagtcagtggcaaagaaaaataagtgcattatttgatacaagatgctatggggaaaataaggcaagataaggagtagaatgatggtagtggtggtggtgaggtgttattttagaaaggaaggtgagagaagtcctctctaaagagctggcacatgaatattgtctttgcccattctggctgctattacaaaatactgtagattgagtgatcaagtagcttaaacaacgaacatttatttcacacagttctgaaggctgggaagtccaagatcaaggtgctgacagatccagtgtctggtgagggctcactttatggtttacagatggccatcttctcgttgcatcctcacatgcagacagcagagaggaagtgagctctctatgtctcttttatgagggcactaatcccattcatgaggactccaccctcatgacctcattattccccataggccccacctcgtaataccatcatattgggggtatggattccaatatatgaatttatgtgggggaggggggcacaaacattcagttcataacagatgaagacctaaatgaagtagagaaacaaactgcagatatggggaaaacattccaagtagaagggatgaatagtaaatgccaagtcctgaggcacagcttgtttggcccacttgagatactgggggaaacctgaatggccaaagctgagagaagtagcagaaggggaatacttgggaccaagacaagtagagctttatgaaccagataatgactttggattttgttcttagtgtgatgagaagccattagagggttgagtgaagggaaaggatatccaacgagaacctcctgccctgtgtctcatgaagaggcagtatttcaagaagaggcttaaagctgagagtgttttgctaatcagtgaagatgtgactaatgagctgctggggaagtcaagccttctgtaagtgaaagtgtttgcattcattgtactcataggtaccttccctaatggtgattgtgagccaggacactagttaaattgtagctacttagaagtggtaattcatggcacacttaatgatttcttcctatgtttaatgacattaatatgttcaatcatcatttaaaaattatctttcttagctctaaagtaataattgcaagaaatgcattagggtactggtatatgggggttgcatagggagaaagaaggaattttgaagaaaggtttaacaagaatttaaaatatttagatgaatggagatatttatatccaaatatattcatgttcttataatatccttcttataagaacttttcaaattcttctacttgaaatatataatttttaaatcactgattattgaagagtaggagtaaactcttgctttctgttacctagggcaaagcatatcttggttcatttctgggagatagaaaaaagctctagtctaattgatttttccagaatagaaaaggaaaataatttcttaacatgttcaactgtattaaaatttatattaaaaccaatataactaagattatctaaaaggcagtgagaaagggaacatatctatatctatacacacataatggtcagtatcccgaatatgtaaggtatgtgtataattatacaagaactaacctttatttggataaatggccaaaggttaggtactatcatttttatacatgaaaaggaccaacatagacaaaagtaatcatccatagtaatagtaaaagcaatacaatctgaagtaactgagtcttaagaaataaaatgataagttacaatgttggcatggctgtgtagaatttggtatttgtagatttttgttagctttcaaattagtatatacttcctaaagggtaccaacaatatttaacaaaagccatttcattgaatatacccttagatccagtaatttcccttttcaagggaaaataagtcaaaggagaaaaaaaaaaatcttgttagaacaacattcattatagtcatgaaaggctaaaaatgacttcgatatctaacatttggggaaatgattaaacaaaccataataattcataacaatagaatattacttgcagatagaatattatggagaagtctgtgtgaaattaagtgaaaaaagagacataatgttgtgaaagactgtttataagcaagtacactgatcaggatgaaaaagcatagaatggttacatacaatttgcattgatgattttgtttaccttttaattgtgtatttggctgcatatgaatatggcatgaagaacagaagaaaatataattcacttaaaggaggtatatcataggatatagaaaataatatccagggtcaacaagatttggagcacctgatacgaacagccaggaaatgggatgccaatgagggtctactctatgcttccaatgaaagtgaggatggagtaattgaagaaatactcctcaagactaattgaaactaacattcattcccaaaaagtaagccatgtcagcagatgagatttatttttggattaaaaaataacttcacagaaacttttagatctgttatcgcggcccatatccagttacaacattaaatttttttctatatagaaacagatttctaaattcttaacagatatcacactttgagtaatgtcatatacaagtaaattgcagaaaagcagagaatttcagccaacagaagtcactgtagtggactttgacctggactttgttgtgaaataaaactcttgagcttgtcacaccaagttgtattggaatgggacaataaattccaaagattcattgagtccttaaaatgggtgggtaggctttatgtatatgctgggtacaaattcaaatcgactaggttggaaacaagaaaaggatgaatggatttcatgattgttttgaatttagaattttgaatacagttatccaatatttcttctcccctcttttcatgagaaaggattaccctgaaatggggccaggcaggccactggtttccttgaagtcttagttgaaatatgcttcttcaatcattaaccagtaaacagatatgacttccataatcttcactgtcaaggaaagttacctttagcacatgcctgtggatccctttcaatatgtgtgataattttggtttcaagggtcatgtgttatggtcaagtgctgcttcagaatcttagaggctgttctagaacgcttgatgtctaaagcttgccatgtttcaatttaacatcagtttgtgaatatctgttgtgccaatatgatttctggtatccctgatgtctggataggacgtatatattttgtggggaaaacagaagaggtgaagctaacactgcattgtgtacactggacaggatcagtgatgatccagttcctttgtcttcccagcaaagaacagcctctgaaatgaggctgatgttgaccacttccatagattattgagagggttaaccgagataaaggaatatgggtggcaggaactaagtaaatgctacttcctttcactttttatgtgcaaagtattttgaaaggtgcggagggcaaaggggctaacgttttagactgagtgggtggttggggaggcaatcgcaaaaacaaatgtgtgatccttgctgtcagggaatttgcaacaggttggaggagccaggcaaacacactcaattaggggaagataatgcaattaaaagaaaggtggtaaaagtactgaatgtggctggagttagacagccttaggattgcaaattaagcctttgaggttagtgcatgtgatggtttgtataacccaaatttgaagaaaggctggtacacagggcaaatgcatactaggaaaatactctgagagacagtcacacactttaaaaagtgataaaatgttgtaattatactgtttacttttgaaaactgcctattgttcacttcactgtatttcaggaagcattttataataagcaaactgcaacccttttttaatgtttgtggaaggaggtgtgggaagtaatggcgttgactctcagccacttctggctggtctctgtcttcgagggattcctgagcctccaccgaagcaccatgggtggggctgctgtgaactagtcacgagctagatttgcttgctagccactcctgaaattcttactgtgatgttggaatagggaggtggaggaaataagtgttttatttatacctctcctttgggacttaccacctttcaaggtgtagtttcagttatttgcaggtgtgtcttatcttccctgttggattgtaaattgcttgcgggaggaagggtctctcgtttatttttcaataaacaaaatgttgtcaaaaggaattccctttactccaaagtcttgctgattgaattacatggatcttttttgttgttgtttatttaatagcactattcaagagtatctgaaactatatcagtattcatttagtctttggcatatttgggattcaaaggaaattcattctcttcccacgtctaacttgtactctcccggtgttagggatcaaccacagcatgttttagagtcttcatctatatccctctggaaattcagaactttgaccacctactgtttgtgcagaggagatcagaggaggcacttgtctcacatctgatagctaaaccagatacgtgggtctggtaaacagaagcaggtggaacccaaaagaagacaaattgacacatctaacaaatgtaagaaggccattgttttccctgggcatggctttttgggagagctcagagttaagtagcagttgacatgacagaaatggcaagaacacagtggagtagaaaggtctgctgtccctgaggcaaagccgggtaattctttcttggaaagagtgggcattacaattgattactggcacagtgggcaggcatccatgaaaagctcataatccgttgctggtgatgtggaggtgggttggggggggggcggcgcggtgggagatgatgatgatgatgacgacgacgatgatgtggttggaacctgtaccaattttgatgctttgcacatccattgaattttggtgccctcttcctcatagcagaagggaaagttatttgatctaggtgtgggccgcaaggtgattgtaaatgctcatgtacttgtgtagttgaattggtggtaacttatttttagaagtcctctaagaagccaaccatccaaccacaaaatttccagtgggaaatgagaagcagattgctgaagagaaccttgctgcttgccgtctgtacacatgcagtatggcactaggtgctggttattcctccagtacaatggttaatctcttgcctgttccaccaaagcgtgtgagccaggctggcattgggctccaaactgcagagccttgcatatttcgtttttctctgtttgttcattttgtgtctaccagtctaactggttgacgtgtgaagcagtgtgaagaatgagggctaaccgcagtgcttcccaaagaatttttaaaattgctctttcccttgaatcctattgtttatactatgcacaaactctgtgtgacatttagatttgggggagaacaattgaataaaatttttctcagtcagtttgaggtcacagaccaagggtttttctcttttcttctgagatccccacttattgaaatacttagactcttttttttttttttttttttttttttttttgagatggagtcttgcttattcgcccaggctggagtgcagtggcgtgatctcagctcactgtaacctccgcctcccgggttcaggcaattctcctgcgtcagccacccaagtagctgggactacaggtgcaggctaccatgcccagctaatttttgtatttttagttgagacggggtttcaccatgttggccaggctggtctcgatctcttgaccttgtgatccacccgcttcggcctcccaacgtgctgggattacaggcgtgagccactgtgcccggcaatacttagactctttaaaggatcatttaactagtatatttattaggaggcagtagaatgtattgtggtgattaagagcttgaatttgggctgaaattctggctctgcaacttccatgcaaccccacgaaagtcacttagctactttattcttcagcattttcagctataaaatgggggtaattatattcctacctcattgacttattgttaaaaactcaatgttaagtactcaaattcttgctaatatttattggacaatttgattgatcaaggcacaaagtatatacagaaaagtagatgaagttcaccccattaaagagtttactacagtgttgttgaggaaatacgcatgtgagacacaaccaactgcctgggaactcaaagtgagacaggttttattagagttcagaggagagaaagatcactcctatgtaggaggcacacagaattaataaagctagaagaaacaatagaaagggaaagatgtcttaactgggagggaaggaccataagaacaaaggctcaaagctacgtccaacatatctctactgctttgttgagtggttgaccagtgaagactgctggtagcaggcagatgggtccagaatgtataaaatggactggatatagaagatcctcctcctttttctctctacttatttttcctctaatgtgatgactgctacctgctcccatgacattttgctcaaatggtcttgaaactcacaaggataagaatgtccctccagtctatacaaaagggagaaacaggattgataaggaaggaagaacatgcttatctataaatccacaatctgatggaggaactattctgcagaacatttggtgaggttaaaagaaaaaggaaagcagcccatcatttgattgttgtaggaaccttctactagccaaacagatggaggctgaggctgatctgttgatactgggcaaatggcaaaactggaaaaggcaataggaggtgaccatctcagcttctgctggctgagtaattgggctaaaaacaacctagtgcctttcggcctatttttgtcacttttcagaatacaacaaataaattgctatattggatttaacaccaaccattaagaaagaatgactttatggcatggaagatggaggagcctttgatgacagtggtcctgatctcttggaagttttttttaacaaactttttatatgagaacatgtttagatttagagcactattacaaatgtagtgagagaattcttatataccccataccagtttcccctatctttatcttatattagtatatacatttgccacaattcattaactaattttgatatactactgttaatactttattcagatttgctgttttcccctagtgtcttttttttttttttttttttttttttttggtggttgttcttgttccaggatcccatctggaataccacgttatatttgtcattagatttgtcatgtctacttaggctcctctgggttataagttgacctcctcttgatctcagctcactgaaacctctgactcccgggttcaagctattcttgtgccttagcctcccaagtagctgggattacaggcatgtgctaccacgcccagctaatgttttgtatttttagtagagatggcgtttagccatgttggccgagctggtctcgaactcctggactcaagtgatccgcttgcctcagcctcccaaagtgctgggattacaggcatgagccactgtgcccggccacaaatagatattttaaatatgacaataatacatgctttggagaaaggtaaagcaggataagggagtagggggttctgaggtggaatgatgggactgttacttatatacagcagttgaagaaagccccattgctaaggtggcatttgagcagagacagggaggaagcaagggaatgagccatgcgcataccactaggaagagtatttcaggcagagggagcaaacagtgcaaaagcctgaagcaggagtggcttggaacactccaggaacagcaggttggtccatgagcctggagcagggtcagccaggtaatgagatggagtgagtgaggacaaacacaaatttgggcaggtggtgtctgggatggaatcacggaaagcgcatgtgagtggctgtcgtgggagctgtgtactgctgtggagttgggctatagaggtccttgtggggacttggtctttttctttgaggagagaggagctattggaggcttttgagcagaggaatagggtcatctgatttcatatttgaaaaggaccactctggtcactctgaatgttgcagaagtagaaagaccagttaaaaagtcttttactctactagtatattttatcttaatctattaatcttgatctatttgtatgcatatttcacatgtagtaattgtgtacatacagttttgccatctgtgtattttaacattttttttctgttgctctgtagtcctcaggtttataacattcagtggctgcataatagtttgtgtattagtctcctactgctgctgtaaaaacttaccacaaatggaatggcataaaaggatacaaatttattatctcacagttctggaggtcagagtcctaaaatcaaggtgttggcagagctgcactccttctggaggctccagggagaatccatttccttgcttcttccatcttttagaatccaccctcactccttgactcatggcctctcactccatctttaaagccagcagcatcttcaaacctcacctctgcttcagtcaccacttctcctattctgaacctcctgtctcccacttctacacacttttgttattactttgggtgcatttggataatctccccattttgaggcacttaatttaattacatctcgaagattccttttaccatgtaaagtagtatattcacaagttctggggattaggatgtggacatctttggggacattattcagcctaccacagctgatgttttgtagtttacttaaccattcccattgttgaatacttagaaggcatccagtttggggccattttgatattcctatacttcctataattatatactttgaccttcttttctttcagattgtgtctcttaagataaatatccaagtttaggtttcctggaacaaagagcatgaacatcttatgtatttgcttccaaatacagttaaattattggtaaatatataaggatgtcagtttccctacaacgtcaccaggtttgctttctgtcaattaaaggtgtgtttccagtttgttacaaaatgacattttattggtgtgtttattttatttccttgctggctaggttgaacctttttggagtgtgcatggcggcatatgtcatttgtattttgagaatagtgttatgtttattttgctttttagttgtatctggagctagaagaatggggacaggattagactattgcttaagtaagggcataaggctagcatgaatagatgatgtatgcagaactatgttgctttcaattctccatcaaaggaagtgatttccaaaattaaaagggtgttactaaaagggatttggatgacaatgaaagaaaatccaggtaatttgaatgcatttacctctctggggcacactggattgtatctcagggttagcagggttgaaggagttagcaggcatcatctttgagccattgctggtgattgttgagtgaacttggagagtggcagaggttccagaagaccagagatatgcaaatgttgttctatatagcttttgacaaagttgaattcctaaaactttcaatgtgtgaaatgcacccttgcaaaatttctgaactatcatcatataaattatttaggagtccagagaagagattgcattgatccttaggaaccagcataaatctactaatgcgtagtgaccaattgtcacattttcttttataaaaggggcttctatattggaagataatgccaaagacatcaaagcatttgacaaatatctctcaccggtctccttacgcacataatagagagatgttggaggatgacagaataatgcaataaattcatagctgattctattcatatgccataacataggtaatgactgagtgttcgtcagcctagaaagaggtttctagtggcaggtatttagggttttcttggccccaaactgaagcaggatccttagaacttggatagagatctgaaaaattcatatgtatgtggctgatgatgtaaacctatagaataaatcttcataatatgaactatgaaaataggccaacaccaactaggtacatttaacagaaataatgagaacttctaaaattgaggttgtatttataattgaaacaacagttgattttctttatttttggccgtcttgaatttcaccaattaaaaacagtaacacttgtatagtgaaaatgactttttaaggttaattcatgtatggtaggagaatgctgggtccacctacatatggttgctatgagagcatgctataataaagaattgctggactgagaggaaaagatgtgagtactgttcctgtcaccaccataaactagttgtcatcttgggccagcagttggcatcaccttccttggatctgcgtattctcatctgaaagctggagatgacaaggggtggggtgaagttagtcactttgctccattccggctgtcatgtgatatgaggcagtacaacttgattctcatgttccttggcgagtttggccaaatttctagacttttaaatggacccttccacatatttctagcttaaacagaccctttcaggccctctctgagaaggggccccttttcttttaatctgcaagttccttcagatcacccttcttcaggatcatattaaactatccacattttcaacgcttcaatccaagtttcaaacagtgtacttgagcccactttgatctcaggaaggccaacattttttttttcttctttttgggctcaggcccatgcctcaacatttctggatgagcctataccctcttcttcaccggccaaaaaagttctccatggctttaccatggggtccagccttcagtttcttcattctccgtcagccgaccctgaacaatcctggccaccgttggcatttgatcatcgactgtttctctagcttcctccccagcaccactattttgattctgctgtaatctttatgaccatttaattttgaatttttaaacttcatattttattttcctatttcatatcttcacattatcatttgtaaaggagtttaaaatatttcatgtgcctcgatttactcttgcatagtctgattttcccctcttatcagtcctcaaatatcatcaactctttgttttctgctcttatgggacgcaacatttgtacatcttcatacaatctagcctttggcttcttttgtctatatacttagattaacctctcagagttggagatctttgactgagggatatagtagtatagttcttgatccattttgggtacctttattttgactgacaaagacaagaggccacgttagcacattatattctttccttaaaactttaaaatatttaagaaggcagcatttatatttaaacataaatttcagcctccttcttggggcttcccttaataccaaagtaattttggttggaggaatgttttgcaggctgtgatatctcagattgcaacacttctcagcctgctgtttcctgtgcttctcctccagctccttccactgagaattctccccaggcagcattttcacgctttcagtgctcatttcaggcactctctgctctgctgtgcctatgcatgcttgaggctttgccctaaactcatgtgacctgcatagctaatttcaggttctcagtctaggcttactactgctgaacccaagagactgatgtattgcccagactcctgcacgctgtctgccagccacaggtacattctggggtcatgtattatgctcctggttagcacattgggcagggaacaagctacccattgtggctgtgaccaggtatagagtctctgcttatctgaaaaacagttctttgacctcactacctgtggccattccttcctgctactgtgtccttgatcagccagctccccaccctttgcctagaaagcattcccaatccctaccagtaagataaagggagcaaaacagaaagccagttctgtgtggcccaaggctctgctatatatgtgtttgcatccagtgtctgaattttctccctgaagaaatggaagatcttgggacggatcttttggtaagatttagatgttgcgtagctcctaacaaggctgtataaatagaagtacttaaagcctttaggacatggacactctcagaaagtgtttttagtttatctgatttctatacatgtttttgggctgactaaatgttaagtagttctaatacagtatgatacaatgggtctctacagtctcttgggttcagtggaagttaagtggctgttacatgtgtagttcacaacagtagaagacagaaataacctgtgtcttctccataatcacagagatacctcgcataaggactaaggtgccttttaatacatttttatcctgaagctctctgatagtggtcttctatgcaatgcgggagttcaaacttcataactagcactctggttcagtagctctgatgaaatcactggggctcctttagcaactgaattgtttgcatgtcataaaattatgatatgcttcaaaggcaaatatttatttagtgagaaatataggtgtgcacagtaaggcttgtgccttcctcatggcgtatttccttatgaagttcattagtctctgactctaggcaacgtgatataatgggagtggcacagaccataaatgtcacaagatctgagctcaagccatggtgtagctagttatccccgagttggaagacttcaggctcagaagccacttggtgtgtcagaggtcttttacctacaaacctgagagggactgggggaagttttagatcaggtcatttctaagaagtcttttagctttaaaatctcaaattagtatttctaaatgccattttacccacttttatataattacttgcccatttaaccacacttagaaaattaagaaaaaatatatctactctttcattctcgaacacagataaaatcattgttcatgttctggagtattagcttccttttttctgagcagatatatctaagaatgcctaaaacagtgtgtgtacatacatttcaaaaattggaatcacatattttttcataaattgatttttgtttcatttaacattatcccatgtcatctgagtagaacttagagtttttatccaaaactagatttccttggtcacttttgcagtttctttggaattttccatatcgaaggcaatgttatgcactctccaaactaagcacccttggcttctgaatgtgctgtaagtacagtcagttgattccattccagagaacaagcagtagaaatatcccagagcactctgccttcttgctgtcactgcgtgggtagagactgccatggccaggggtcaaggtggaggatgaggggtgacccctaaaaaatgatattagcatgtgaccaaacagtgtctcaaatcgtctcgaaagcccaccaatccattgtggaatgacctctacaaatagttttgcttctgcacaaccaggtgagatggagctgactctaagcaaagagatagagaagggaaacttggtaaccaagccttttctttctgttctctgcctcccttctccacgcctcacctcttcctctctttggcatttctcttcaccctctctagccccccagttatcactttctcctccatgggcccgttacattttgttcatgctgctgatagagtccttatcacgtattactaattggaagatttgggtggtagttgttgggggtggggagaaccagggtaggttatcatggccctactcataagaagtttatgtctcctcacttctatatgagtttcagaactggaagataatcttagctgaggttagaagaacatgtgaagctgaaatattactgaatatttaaaaattattttccactattacttgtttccttgcatgtggtttcaatgacattatgggttacattggttttggtggccttgcttagaatttcaacatcagagagcctatattaagaagtcctacatttagtgggaagttttactacatcactagatgtactataaggtcatctagtttctgattctaaagttctgtgatttgtagcactgtttccatgggaaagtgcattccaagttctaaacagctgagttttggatctcagctcctttgagagttgtggaccagtcagacacaaaattatctttaaatatacagataggggtatgtaatttgtgttgtatgtagaactaaccaccatttgagcccttattatgtgtcaagggctataataagagccttcatacattcacttattcccctcttcaccatgattgtttgaggtaggcattattatttccattttacagatgaggaagccaaggcccagcagagctgagatgtgactgcagagccgtccaaccccagtcctgtgacctttctctggtgcctgatacctctcagcatttgagggccttttctcttcctgcttcatctctaaaggtccttctaggagagaggtgaaaggtaattcttttgaaaatacctattttaaagcagtattattcccttcgagagacccattgattccctttgatggagcccaataccatgctggatctttgctgtttctgagtggtgtgaatgggcagctgatgtgggtggcctcaggagcctgtagaaagaggtgccccaggaaaatcttttacacaaaagaacactacagcatctgactgcaagattcaaataaacacactcaaaatggtctgtagagaatagagtggtcaacaatgatggatagtaggtctctctctttttaaaaacagatttaattatagtattcacacaaatctaactgaaaatatgagccagaatgttcatttgttcactcactcatcagctgtcagactttgaatgaacgcacatatgtaccagattttgtactaggccctaggagggtacaaaagtggatgaaacatagtccctgcttcaaggagctcagaacctagtggggagcaggcccagaaaccttcagatcctctgctgtgcatttttaaaatagcccaaataccaaaactttttttttttttttttcgaaacagggttgtcactctgtctcccaggctagagtggcacaactatagctcacttcagccttgaccttccaggctcaagcaatcctcctgcctcagcctcctgagtagctgggactacatttccatgccaccatgcctggctaattttttattccagtataaagttggggtttcgctatgtgcccagtctggtttcaaactcctgggctcaagtgatcatcctgcctcagcctcccaaactgttgggattacaggcacgaggcaggcttggcccaaaatgtcttttaatgtcagttttgaatgagctttcataagaacactgcatatgtgtgaggagaaatccctttcacatggtgtagatttggtaagcaatatttccaatatcagaaagacttggtcagtgtatgttgatttgccaaaacccactggcatataaggatgctgtggctgttgacttttcacatttgcttaaccaaagtgccagtttattgaagatgagttctgtgtcatgttttactgccctgcatgttaagatttgcttttcatgacactaagacaatgggagattgaatgggtggagttaaagaggcccctgtccttctattgattctccttgggtttcctgctgagtatgggttgaggctctggccttctcaactgggtgccagatgaatgtaccgggaatcctgttagggtgacatctaagaagaagactcataaagcacaatattgggaactcaatcagagcttgtttcaggaggatcagggctgagcttagtgggggttcttggtgatagggattccttcctgaaacacatttgtcttcctggaaaaggaggaaggtgtaagaacgagaaccactgatgtatgcaggaggtccgtagcctcagttgccatagatactgaaggctctgcatggcctggccaaggatggacaatgttacaaggtggacccacaaaccacagtgatcttcatcctcaagctggggcatgctgggcctcatttttggaaagtacattttccacgagatgtgctaacacaatggggttctatgtataatctgccttgaacaaataggtttcatgggaggccacgaaaaaacaacttcatcaagtctcccactctcccattaaaatttattcagtggaaagcatttcccctgttttttggatgaaaacatatcacgtggctattctgattcctcatatataataaaaagccccactttaatttgccagatatttaaaatgtctagtatcatgggatagttaaagcttccagcttcattcatatttataactgctccccttcccctggctagggcctgttgcagggagagggggctgtggttggaggctttttctcttgcttactcagtagctatgacttctggactggggtgaggggctgggtggggaacaggaaggagtgtaggaaagcttttactaggcaggcggtatcataggagagctctttttgtgttgtgggtgtttagagttgattctttctcttgtggggcccttttgtgggttctttggagataccctctcaccttgtctctgggggcctctcacctccaatttccttggtggggctgctgcactctcttcagcctaattgcagactgtttccacagtctctagaaagcccaccaatccattcgtactcctgtctgctgggttctattgctgtccaggtggcccttgttgggaagaccctaatatatagccctgtacatatgctcatggtgtggtccatgggaaacactcacacttcctttgttcccaccaactgggagagggcaggctgctcccagggcaactgtcgtttcctttggcttgtccgtcagcatccagccagctctccagttcttcagatttcttaggcagaagtcccaaacaaggtcacagtgccttccacatcgtaagagcctcatgctctccaggtagtcctgttgagccccctcatgaggctggaagggggagaagcagggaggggcaggtactcttatctcttcctaagcttagtcctttaggctaggaccagactggactgcagcctgcttgcttcaatcattctctccttttagccaccaacaagcagtctgacctacttgtagccacaccgtaggtaagaggtttaagaccagtgaaaaaggttttgggctatgttctttgaaaaactgcatctaggcctggcacttcactttggaacctggtatctcatccatcttagcggcttgtttgacacatcccattttgacattctgtaatactttcttgggaagcagggcttatccttagctcttggagatgcacatgacacacagcatagaaaaggctcctgggagtagacaggaatgtccacttcactccagcctcttcctctcctgccctccatcctgctccaagggcctgtgctccacctgaatcttccatccaggaagctccctctctgctgcctgctcccactctgtgttgccagctccttctgttcctttaggattccttaatgttccttccttagtaaagacttctttgttcaaaccccacctaagtagatctcccctaattttctgttttctgttaccgcaattccctttatttccctcacagtacatcttatattataaatgataacgtttccaaataaattatacaagctatttagtgtcttactctcacatcaaatggtaagccccataaaggaaaattcatgtctgttttattcggaaactaaccagtgctcactaaatatatgttgaataaatgaatgaaagcatgaattaaaaagttacttttgtttaagctgttctttccccacatgtctctcttcttttgtgttaactcttttttttttttttttttttgagacatagtcttgctctgtcacccaggctggagtgcagtggtgcgatctcggctcactgcaacctccacctcccgggttcatgctactcttgtgcctcagcctcccgagtagctaggactacaggcatgcatcaccatgcctggctaatttttgtatttttagtagagactgggttttgctatgttggccaggctggtcttgaacttctggcctcaagtggtccacccacctcagcctcccaaagtgtgttcactcttaacaaacagattcttagttatatggcatgcacagagttttggaagtactgagacaaggcttaatttttggtatatttttctgttcatcatcatctcccctcaccctttctctcctctctctgtctcactttctctttccctctggctctgtctttttctctcactctcttctaacaagaacttagtttgaggcaagtggagcagaggtgccaccccatgttacagatacccacaccaaggagagttagctgtgagataacctaaggggttgatggcaggcatggcccagagctcagcacttccatgtctcttctggtcttgtcctctctgtgcctctcctgcagtcctttgtgtccagctgtcatctggccttgcagcaaggcctggcttaccacttccagaacctgccgaggtagcagcagcctggcctcgggctggagtggaaagactagttcccagcccagaatctatcttgcatggtacacagcaagagaaattctcttcaagatgcagccccatgaaagcagcatgtttacaggtagtagatccccaaagttgtcatagcctcccctaaccccctcacaccagacctgtccctgcccttggcccacacagttggggattcatgggctatgggaatgtctttctccttaggaatagaagctggattctgaaggaaggcgctggacttgaactaggcttggcgatcgccttccctctcattctttccctgcctactccatagacagtcctaactctggccacaagtcagagaatttcacattcctcccttaacaagttttactccgtataaggccctgggggcagtctagatttcctgggcaacaacttgggtgtacttgcttcaggaggaggaggaggcttatctcgtatgtgcacattcttctggtgtgtcctatctggttattatcaaatcgaaactgcagcagttgaagtttgttgcttaattactgtctgttgattgtaaaataatagaccaccaattttgttggttagttattactgccacgtcgttataaagtgcgcgctgtaacatggcagtgttttcctttatgctgtctttttgatgagtatcattatttacactaataataatggcttgcatttgaaatatgcttcagagttaacacagcacttccattttattatctcatctggctctgttataaggaaatgcaagcaggcaactaattttaggagagttggaggtaaaatttttattctagaaattactataaattttggcataatatagcttctttttacagcaagtacttattactttagttaaaaaatcagaagcgaattttaaaattgtagatttgctgttttttttacaccttcttgtcataatccaaaaagtagagtactagaagacatattcagtccagggtcatataaaatcataatatcttagctagaagccactcctctagaatttgatccacagtatggtttaacactacattgtaaggaaatggattgtctaccccagagtttgcttagcatagaggcttcatttatgtatttatttaggtaaaacttatagaacataaaattaaccattttattatgaaaaatggaggtgaacactacctctatctagttccaagatattttcaccattccaaaataaaaccccatcctcactaagcagtcactccccattccctactccctgtagcccgaggtaacccctaatctgctttctgtttctgtggatttaactgttctgggtagttcacataaaaggaatcgtacaatctgtgtcattttgtgcctggctgctttcacttagcgtaatgtgttaaggttcatccacgttgtgacttgagtcagtgcttcattcctttttacagctgaatgcccaatatttttaatatcaaaacatttctgggattatggaaactccagccccacagacacacagtcccaccatatccttctctccactgggaatgacttctcacaaatgtgggattttagtccataataaagtacaaatgctaaagaagcatgtgtagttatagctgtaatttgctgcattttactttagactcaggaagaaggctctagatagttctatgcaaagattacaggtgattgtattcttcagacactcatatcatgaaagtttgtgccatcataatttttacagacagtgcttagaatacgcctggatttgtagttttcttgcagtaggcaccactcggcggctgagtttcagatttcttttctttttttttttttttttttttgtttgagacagagtttcactcttgttgcccaggctggactgcaatggcaccatcttggctcactgcaacctccgcctcccaggttcaagcgattctcctgccccagcctcctgagtagtgggattacaggcatgtgccaccacgccctgctatttttagtagagacggggtttcaccatgttggtcaggctggtctcgaactcccgacctcaggtgatccgcccacctctgcctcccaaagggctgagattacaggcgtgacccaccgcactcggccaggtttcagatcttttctccagcctctgtaggtgacaatgtataaagaaaaaagaatgagcttctgaggtggacagagctgggttcaaatcccgcctctaccccttgttagccatttgtccttgggcacatgacttgaagttccctcatggtaaaatgagaataataatatctactcatggtcccccaaagatatccacatcctaattcttagaacttgtaaatattaccttattttgaaaaacagtctctgtagatgtggttgaattaagaattttgaggggattaccctgtatcattcaggtgggccctaaatattttacaagcatcctaatgagaaagaggcagaggggaacagagagggacatgcaggggaaggtgatgtgaagacataggcagggagtgaagtgatgtggctaccagtcaaggagtgccaattctggcagccaccaggaactggaaggggcgagggacagagtccccctgtagcctccagagagagcatgaccctgccagcacctcagtttcagcccagtgacattggttttggacttctcgcctccagaactgggagagaataaattttcgtagttttaagccaccaaatttagtgtaatttgttacagcagcctcaggaagtgaatgcacttctcttataaggtaacatgaccacctgtaaccacatgttacagtttgttttcctcctaaaaaggacagaagtccttctatcaaaggtgtttctcaagctttaagtacagaggttaagagtttgagagcagggcttctcaacctcggcactaatgacacttaggggccagaacattctttgttgtggggcggtcctctgccctgaggatgttcagcggcattcctatccactagatgccagtagttccttccccctagttacaacaaccacaaatgtctccaaacattgccacatgtcaactgggggacaaaactacaccctgttgagaaacaccaaggtagagtacaaattaagtacagcttaatcccagctccatcactaagtagctgtgtggccatgggcaagttaggcaccctctctgagccccagtttcattatctataaaataataacagtccctacatcacagggttgttgtaaggatattcaaatgatgtaatatgtgtaaaggcttcagaacagtgcctggcaaattgcaaagtatttaatgcaggaaaatggttattaacccatgctctgccatgctactttgtcacactgttttccatagtttctgttatagaactaatggccattgaaaacattttccaaacagtaacttctgttgtaaagatgcacatgttttaatattaaacatccttccttcattgccctcccctctcacctttcagctccccaggatttgtatgcgtagattgcctgtcagttatgctaactcactgaactctttatataattccctggataagctgtaacaacaagcaaaacccttccatctgtcagtgatagttctattattccataattacagctttctcgtcggtgacgtagctgttgcattcacttatgaatgtgtcagtgtctccattcaaatgtgtgaaatatttagcagcgtttagcaggttttggtgaaatgttagaaagtgatttgaatagataccatcatatacttttgtaaggaagaggaacgtgctccaactgtgacccaggtcactgtatctctaaacactggagacacagcagtgaataaaatgaagatccctgttctcaatgagtttgcattctagcacactagaatacttatatgcacaataaattagtaaatggtatcgtgtttaggtagtgataagactatgggaaaccagcagtttagggaagggggttgggagtgctgaaggtggcacaagggggcaggttgtgatattagaggggacagtttttaatcctttcatggggataatgaaaatatctttgacatggattgaaaaccagtgtttgttgatgcacctctgctgatgactaatggttggaattcctaagtctttcaaaggtggtgaaccttttgctccttccccacagactgcctgggagtgcctttcaaagttaagccatgtggctttggtttatcccagctgctgtgggaattctttatagaaacggttcagggatcattattggcaatgcggtctcagggaagaagtatgcctggtagttattgtaaagtggatgactttgggcaagtcgtgtaacctctaagcctcagtattgttataacggttgtaaggttcaaatgaaataatgtatagaaagcacgtagacctgtgtcaagagcataataaattcttagaaaatgttggtagttgtaattttatgattagctttaaagcatatttctaaggtactatgtaaatattcatggcacttgtcatttctttctaaagcatacctataattatcagcttttcataggcaaacatttcttgcataaaccttgcctgccaaagaagggtctgcatagagaacctatgaattgatctcttgtgagcttaggcttggacactctttgaatactgtgtgccaactttcacaaagattgagatgagagaatagaggcagggagtaattcaggtaataaaagtccagctactaaaaatgcagttttgtgattagttctcatggatgactccagagattgacttttctgggtaattatatggcccttcattttgttggtagggatttacatagacatttgttaaatgattttagaatagaatgagttgcctagttatgctgagtgaattgagaaattcctcaaagagtcatgggcttcattgggaaatggtcaagatcaaggatggagcacatctggaattcattgctgcactgcaaagaaagtttgggaactggtagaagtggtagttacacaacattgtgaacatactaaatgtttactttaaagtgtttagttttatgttatatgaattcagataataattttcttaaaaatggatttctgacagtgctagacctcaagctcagattccctattttcatatctaattatttaaaagaattgttaaagaatatgatagtccttaacattttatatatatggaataaattttctttaattttataaatgtattaaaggttttatatttcagtatatccaacatgcttgttttctcgtttataaaattcagttattccaactctaaaattttatggtaataaattgattacacaagtagaggccaaagctgtatccccacagtgtctattatggtatcttgcccatagtaggtgcccaataaatgttcactgaattgtatgtaggttgttttctgagttgctcataactttataatgtcatacattaatgcaagtggggttaaactagacagtgttagagatcttcaagttcagcttgctctaagatgagcaacaaggccgagaagttaggtcacttacatagttagtgcaagggtaggatattgctttttaagttaacatttgtagaaacatgcataagtaattcattcagccatagccattggaatatggtttggtttcctttttattctttctttttttttcttcctttctttttctttctttccctcccttgctgtctgccttgctccttctcttccttctttcttttcctttctctttttttagatttacaaacctgataatgcagaaaaatcatgtttctaggggactgcaaagcccatatttcatctcatcttttgccaggagttaccaatgtatcctttagtcagtcttctctggatttttcttacctcacctattagatgagaagggtagtgcttattttcaatggaatgctctgcttttgaggttaatttacaaaaactctttattggttaaaattttaactctctttctgccatatggtgcagatatttccttcaatttgcttgcctttcagttttgtgaaacaaagatttaatctctgagattagttgttagatctaatatttttctctacgattttggctgttggcatgctaagataggtcttttccatcctaccattacataaattgtaccttaattttcttctagtacttttgtggttccattttttacatttaaatcttattgcatctgatatttatttttgtataaggtgagaggtagggatctaacttcatattttccaaaatgaatagccagttaaccaaactgatttaagaatccatctttttgttacattaatttgaaatgccgtaatgaatactgaattctaggcttttttttttttaacattttaaagaacagaataggtaagaacagaataggtttaaattcctatagctttatgacacattttgataacacattttgatatctagttgtgcaagccctatctgaatggttaaatatggtttatttccccccacattttcttgatttttttttttttttgagactgagtcttactctgtcacttaggctggagtgcagtggcatgatctcggctcactgcaacctccacctcccaggtttaagcaattctcctgccgcagcctccctagtagctgggactacaggcgtgtgccaccatgcccggctaattttgtttctttttttttttttttttttttttttttgagatggagtctcacaccgtcaccgaggctggagtgcagtggcgtgatctcagctcactgcaagctccacctcctgggttcacgccattctcctgcctcagcctcctgagtagctgggactccaggcgccagccaccacgccttgctaattttttatatttttagtagagacggggtttcaccatgttagccaggatggtcttgatctcctgaccttgtgatctgcccgcctcggcctcgcaaagtgctgggattacaggcgtgagccaccgcacacagcctaatttttgtatttttagtagagatggggtttcgccatgttgtccaggccagtcttgaactcctgacctcaggtgatccacccgccttggcctcccaaagtgctgggattacaggcgtgagctaccatgcccggcccttcttgaatattcttcatgattgttcttctataagaacattagagtaattttgtcaagttctaaacaaaactgctagtgggatattaattgtaactccattgcatttctgcgtttatttaagggaacattgtcatctttacagttaagctttaacattcagcaggatggtgaatcattttattaatttaagtcttcttttatgttccatgatttcttttttttttttgagacagagtctcgctctgtcgcccaggctggagtacagtggcgcgatcttggctcactgcaagctccaccccccgggttcacgccattctcctgcctcagcctcccaagtagctgggactacaggcgcccgccaccatgcctgactgattttttgtatttttagtagagacggggtttcaccgtgttagccaggatggtctcaatctcccgacctcgtgattcacccgcctcagcctcccaaagtgctgggattacaggcgtgagccaccacgcccggccggttccatgattttttaatgttagttctgtacacctatcttttgaatgtattctatttgtttatactctttctttcttttatgaatgtgaatttttaccccattttattttttacctggctctttctagaaattagggaagctattgatttttgtatattggctctgattttattttcaggtgattctactgaattttgtcagtggagtttcataacatttccaaataataattttatcttccagtttacattatttataatttttactgctttggctaatacttctagaaagatattaaaataacagaggttatatgaggcatctttttttctgattttaaagagaatgtcactagagtttcactatcataaatgatttgtgattcttgtcctacagtactctggcagtgctagtctcttttttttaaataacatgttatctatatgtgatcttcttgacatgtagcagttgaactctgtgaaaatggcaactatatttacctggaactctatgtctaaacagtgaccaattgatcaataaataaatacattttattgtgttgctctttctgccttgctgaactttgaaagatctgtaagaatttgaagtgcatcataattgttaggaaagtagatcaaacatttatgtaatgtaaagcctttatttttcatgcagcattgtcaagaccttagatgtacagtgtaactgaatggttgaagtttacactcatacttcaaaaaagaaatgttttccttttgttgtttgctgactttggagactgctttcccaaagaatccactttcgtttttactactgatctgtgtttttggatagcaccatggcaccttgaaagcacatttatgagtatacctctgcttactgatatcacaagaagtttgcaaatatcacaaatatattaggtgctaatgtcagaggaagatactaattcaaaatgtattcatgtactttcatagatatagaccctttttgtttcttactgctccctcatacaaagaataagttgctctgtataagtaacacaagatttttcctccttaaaatgtggaaaatattgaaaaatagagggaatataagcctgttactagggataaccactgttgatatttacagttgttttgtgtctgagtaattgctatcacactacatactggtttgtatactgtccttttatctaaacattacaatcacatgtgtttttcctagatggtggaacatttaaataagacaactaaagttatttaggctagttgggctgtgggaatctgaagtaagaggtggtctgtgcaaccttagaaatgggtggagccggaggatgaatcgcaggatgaactcagcatggttcacccacagtcttcaaatagtcattgatccaggtgtcctcagagagcctgaaaaacaatgcttagatcatcctgcctgacctctaggaagcttaaggtcacctgaacaaaataatccttttctttcagcaactgggtggcctctgaaagctggccctactttgccatctttgatcagtcgtctggcactgattacagactattaacagtgtagactcattcctgttgtgcacaaagaatcgtgtggagaaggaggctgcataaattgtcttactcctaagaccaaattccagggacttttttagggcctttggccatgtgttattttatgtaaatattttttaagacctccctgtttgacaggtcagcatgtctccttctattgtataatattaattctagaaacttatagcagatccatttccatttccaaagccgaaaaaggaagagcttgaattagaatttaatgtgaagagtttgtaaattgcttatattcttattttgtcagcttgacacatttgtggaaaaaatagatgtctaaaaatgtctagtagctgctatgcagtctgcagtctgtgtattcattcttcatttacagtttttgttttacaaggtcatctgtaaattaacagcctaccaacaaacaaagatagtattgcagagagtaattttgaacatctttttgtcctaatcatttttgcatttcaattaattgaaaataaagagaattagaaaagaattttcttttatctttcaccttgtttgaggattctgataatgtgtacatgttattcttctctctatatgttttctctatcatttcttctttgcaccaaacaaatatcttatatttttgcctatatttccattttctggaatttcagcttaaaatacttgtatgcatctcaatctttagaagagatttagaacagcattgtctgatacaaatataatgagaggcacatatgtaattttatatttcatagtatgcacatttaaaaagagaaacaagtaaaactaatcttaatgatatattttatgtagcctaatatatcaagaatatagtttcgacatgtaatcaactatgaagaattattaatatattttctattttttattcagactaaatctgccaaatccagtgtatattttatacttatagcacatattagtttagacacgcaggtttcattagaaatacttaatctgcatttagatttcataactttcataattgaaaaagtagactgacattcccaagttgttccaacatacttagcagtttcccaagaacagaaacaagcatcaattttttaaaaactttaattaccattatataaaatttaaagttcaccctgtcagttacaggcttatcaaatactaagtggctgcatgtggctagtagctagtggctatagtatttggcagcacatttctagaattttaattttctattttaaaagacaagattaaaatttcagtaaaaaattacatttgtgacatggaaggtggcttaaaagaaagaggttggcattactggccaaggtagcaaaactcagataggagaaacttcagagacctagtttcattaaacttagctctggtttatcgtgactgaagagaactagggggcttcattatgttaaaaaaaagaaaaggccttgaaaaatgtgagttcctacctctttctctctgaaagagtcggtagtggaggatgcttgttttagacctttggttatactcctgctctctctcgtaaattctttaatatgactttctaagaatgctctgaccatgtgtggatactaagccctttaaagagtggctgaaatatgtgattttaaaattatttttaatttaaaaactgatactcatttagttattagaaaacatttatgtatgtttggagcaactgggtatataagtctactttttcaactgcaaattttatgaaatctaaataaagtcagaagattccagttccagataagatgaagtaaacacagtttactctgactctgccaccgagtgcagctataaaacctggatagaatgcatgaagcagctatttgaggaccctgaaaagtaaatagtggcaggacgatgaggggaaatgaccagaattggaagctccaccaaattgacaaaagagaggtaaatctggttcctgttacttcactatggctagaagtggaagtctctacaaaggctttgaaaactaaactgatgttggaaacgtaacccacggaaagaggtttagaacttgaagcctgaagctattcacgacaattgcctgctaagacaaaaatagcaacattctcagtaggattgaaacaaaactcagaatcttgtaatagagtgttccaaatgtctaggatacaaccgagaattacttggcatatgaagaaccaggaaaattatccatttttatgaggaaagacaattgacagaggccaatactgaaatggtaaagatgttggaattatctgacagacttttaaagcagctcttacaaaaatgctcaacaagtaaaaacaatcacttctgaaacaaaaagaaattctcagcaaatgaatacatgatataaagaagaaccaaattaaaattttagaattcaaaaatgcagtaaccacaattcttaaaactcactaagtaggctcaataactgaacagaggtgaaagagaggaaagtcagtgaatttgcagatagctcaacagaaattgtacaatacgaacaacaacgagaaaaaggattgcagggagaggggaagcagagcctcatggacctgtggaataataataaaagatctaatgttcatggcatcagaaccccaggaaaagagaggaaaaaaagtatggcactggaataagatttgaataaataataactgaaaaatcccaagatttggcataaagctacagattcaagaagctcataaaaccccagacatgaacccaagtaaatctcactgaaacacatcatcatcaaactgctgaaaacccaagacaagaaaaaatctcgaaaacagaggaaaagaatgcattacctgtagagaaacaatgatttgaatgactgtgtatttctcatcatggagaaagtgatataacattttaaaactactaagagaaaataattgtcaactcagagttctatattcagcaaaaatatccttaaggaactttcagacattctcagctgaagggaaacttaagagaattcattgccagtagtagaccttgtataagacaattgctaaaggatgttcttcagacagaagggaaatgatgccagaaaagaatttagaacatctggaatgaaggcagaaaaatagaaatggtgaatatctggtaaatacactagactaatcttctcctctttagttctctaaaatatgcataatggttgaaagaaaacaaatgttgtctgatgaggttttcaatgaatgcagatgtaatatatgacaactatagcataaagcagggagtaaggggactcatggcgtgttaagatttttacattccagttgaagtggtaagatactcttaagtagactgttaaaaattgagtacagcatgtgtattgtgatctctagggcaaccatttagaaaactaaaacatgtcaagaaaacataataaagtggaatactaaaaaatatacaagtaacccaaaagaaggcaggaaaggggaaaccgaggaatgaaaaacggaagaaacaaacagaaaacaagtaataaaatggcatccctaaatccaaccatatcaaaaagtacattagatataaatgttctaaacacaccaattaaaaaacagattgtcagaatggataaatacaatcaatattttcaaagaaaatttaacacctgaaatgagatgtgcagtaagtataaactgcaatccaaatattgaaaacttaatagaaaaaaatgtggaatctcattactttttatattgatttcatgctgaaatgttttttgtgtactgagttttaaaatatattattaaaatttcacctattacattgtatatttaaaaacatgactaccagaaaaatttaaattacctgtatggcttacattaaaatttccatcagacagcaatcttctaaggtatggcttttgtaaaaaatgaaaagaaatatttcaagcagcaaacagggttggtcagaagctacatttttgtattatcttagttaagacattaggagatctggattaccctttattaaggctaacaaatgtagggctaaatgtattaaatttagtaatacaatataaaacaattttggtgtgcacaacatctgtggctagctacaagctcagctctgtggcacagttcatgtaactcagccatgagcacagctctcttttggaatgggtcatccatccattgctttacctagtacttctcacaaatcaataacaactactctagttaatcagaactaaaaatattgttgtcaaactactctttctctgaaaaagttactttaaccatacattccaacctgaagcaaacagaagtcctcagtgaaaaaaacagacaaacaaacaggactattccaatgaaatgcaatggaggtggacagtgaaacgtgggagttaagttatctatgaccagtgtctagtggtgtttctcattagctgctgaggctggagttctgtgaaaaggagaattcatacccacatttctcagagtgagttgttggcctatctagttgttaggactttgggacagtccatgagtgagagacaaaccatgaaggtcagctcactctgctggactcttcctctaagttgtggtttaacgtttagctaacagagaccccattgcttatctctctgtcctcacctccagactgtaagctccttgagtccaaaaaaccatgactattttgcttaaagctctgcctctagtattagcataataatacgtaggagctcacaaatatgctaaaaataaatgagcatatgccaaagtctcatctcagccaagccttgctggcaggggatggaaaggtatttttggcttcattctaaagagtcctattctcaaattttcctgttgacatgttctacctcataaaaacacatacatattttctgatggttgtaatctggcagatagtgatcattttggttttagttttagttttatatgtagcatttaatcctagttactagtagcataaggaattggagaataattggagagagagagagagaatgaagattcttatattggctatgcaactaactagctgtgaggcctggagtatggtattacccaagccttctgatgtggatattttcatttgcacattaattacatggagtggaccagatgttcctctctgaggtctctctggctcttgtaaaatggaatgaatcttgcatgcacaaagcctcaaaattccataccaattcgaatatatttcagaccattgctataaaattgctgcaaagtattatggtagagaaggcaatgatcattaagatatggtagtctgctggagttcttgtctctcctttgggggaagaaatactcacatgctttagagattacagaaataatttatttcttctctgaggtgaaatttcctatattcatttcttattgctgctgtaacaaatttatacagaattagtggcttaaaacaatgcaaatgtattatctcatagttctggaagtgagaaggccaaaattggtctcactggactaaaattaagatgtctacaaggctgccttccttttggaggctctggggaagaattcctcttcttgccttttccagattctagagttaggctgcattccttggcttatggcctccttccgtcttcaaagctgcagtagctggttaagtctttctcacatcataccatttgtacactgactcttgtgcctccctcttaaaagaacccttgtgactacactgtgctcactgcataatccaggataatcttattttaaggtcagctgattagcaatcttaacttcacctgcagccttaattccccttgccgtgtgatagactatagtcacagtttccaggggtaaggatgtggacatcttttggcagccattattctgcctatcgcattgccatctttctgagtttttaaagttttaaccaataattgcagagctagtaatttattttcctctgttcccttttcgcactctgaattagttaatggatggcaggaatcaactgaaaaaattagggctaagtaatgtcctggattaactgaagagattctcttcagggaaagctgtcacaatctccagctatttcttaaagctggttatgtgtagaaggttcttttacctaagatcatgttcctatccacaaaaagacagaaactatgtccttttaaaagaaataaaatgcattatctaagcttaattttttttatttctaatcaaaaatatcataaatgtttgccaaagttcattgtgcaattttttctccctgctgagcaggtggctgaaagtcgtggaatgttgtttttctgaatacagattcataatgcccatagtgaacatgctcattaaaatagaaaaattagactgtattaatttgcatttcagtccactcttgggtagatttgttatgtgtagttctcactataattatctgcgtctttggaaatgccacatctatttgcagattaattatgccattatcaaaggcttagaaggaaatcttcaaaattcattgttaacatttaaagaaaatgcacaggaagctgatatagaagagataaaccagagatttttctgagtgtacttatagtgggcaacagaactaacacttatctttaggttaatggtattatttagacttgcacttatgaagtgttgatttagaggataatacattggttaagagggctcagtggttaagttccatttcacatttattgtgatctctgtttcagccacttagtcacttagaaacgtttatgagtgtatgggatgtgccacttcctttagaagacaatggggatactatccttagagctcccatactgtacaactccacgtgttaacattttcctcactctgtagtctatatgagtggtaccctctggagtagcgcagttatcgaatatgaggcttaatgcaaggatcctggcattctctatgacagaggctgtgcacagtggggaacagattcacaaacagactcatgttatgtgtgaatgggtacatacggtaataagagcacagaagaagggagcatctgacttttcttaggatggaccgggatatctgggtttttcagaggaagctttgctcaaacagagtcttgaaggatcaataggaaatggtgagacaagaaaaagttggatgattttctgggccaagccagcagcctgtgcagaggaaaagaggtatgcaaaagcatgctacatttacaagacttgcagatatttgagtatgacttaagtgtgagattcatgtgggcatgtgaatgaggcaaagcgtttaaccttcctgtgctttacttccccatttagtaaaaccaataaaacaacactacctaccttgtggggttttgtgagttttaaatgagatatcatcagtaaaatgcttaggttaggcttgatatataaaaaagcactcaacgaatgtcagctgcctttgagacgatgatgatgatcacaatgatattacatgaggttgaaaaattaggcaaaagctacagattctgtgctaaggagttttgacataatactgttggctggggaaattgtgaaggatgttaaaaaaaaatacaattcacagctctatagatttataaactccgtgtcatcatttagcaaggctgattagaccccatgaattgatgcatactacttgaaatcatttagagagactgatgaagaaaaatgccattttatcaatttacactcaaaatagaaaccactcagcatgctgtgataattatggcaatgaggtggtgtatttccttcctatgaattggtaaatctccttgagctcctatgtgaacatcacatggtttcttaagtgaggatgaggagagtcagagtaaatgtagatgagtgctttgaaaggctggtggattagccttgctcacttactacatgtctggcagggagatgagaaacaggacctggttggtaccttctctggaaatgctggttacactctgatcttctcctccctctccttttacagatatcccttttttggacacccctctactataacttcttttttttttttttttttttttttttggaatcatcacctttgtttcagcatgctttcaggagatgtcaatggttttccagttcatcttgatttttttaaaggtggctgctctttggtgatattttggggtttacttttatctcaacaataagtggtctccatagtgttcatctattcattgcattcagcacctaaacagtgcgttatttttgggaatagtcagttcaacccatccactgtgggagaattcacagtactattgattacataggatggcattttcacttctaaatgtcatcttattttcctaacttgttgttttaatcatctctaacattagattttgagatccattctgtttgaggacctgtagttcaatgaatgagttgggagtataaaatttgtctcatgaagttgctatatttgtataataataagcttaactcatcaagttactactgtaggcctttagaatttgggtatctttctagtgaatgctttagggatataaacatttattttactggattttcatactactgtttaatgctataatgttaccttatacattctaccaagcattgtaagctcagacaaattaggcaataatttgtcaaaacaaaaagtaataatgctagcaaagacaaagaatttatgctagttacaggtgataaactaaagctttcctcgtcctcaccttcattctgtggtctcttaaccataaacatcaatgtagcaaagaaaaattgattttgtaattgattttgaaattgtaattaccttgatttccttagtgatggttatttaaaatactgaagcattttaagctaaataaaactaattttaaaataaaactaatttttattttaaaaaaaagtggagaaggcccatgtaaattccctgccttttagaacatgcattctgaatattgttttaaagcatttcaacaaaaatgctttgatggaatgctacagtcactgctcattatcttgaattcacttgcaggtcatttgttcttaactgtttttttaaaaaagtgagtgtttacatgtttttactccaaaggaaatcagttacaattgttcataatgggtgcttatttaaaaacgaaagctctgagaaaaactgtgcttctaatttttaatatttcaaacattatagatgttggcattgtgatgaaacaaaacttgccactagtaacattttaatggtcttttccatggagcagttggagatgaaactgtgtcataaaatatttattaaaatgcttatactttactgaaaatttgagggtgtacctgtgctgtactgaattctgtgttctagcaaatatttcataatgatgcctagtacaaatttttattaatgcaacatggagaaaatggtcgttctcttgtctgagttggattaaagcaaagttccaagcagaagtgccagagctatttttaaatgtacaaggcatgcatttttttcttttaacataaattctccatcaaaataggacctaagattttaagaaacaaatataatttattatggctattttgtgtttagagagatactaatagattagagaaagtgatttgccatttattgagaagggccaaaaagcacattaaaatatccaatttgttagtaacttttgaaaatgcaaacttaaaaaagtgccactttttgttatctaagtctaaggctaagaagaatgatcataccaaggttgaagtagaggtggagaacaagcactgtcagatctgttgggaatgacaattgatgtagactttctcaagggtgatgtgtttacaagaagccttgctatacatatcctctgatctagcagttccactgctggaaatttaaccttaggaagtaattggacaaggggccaaaaaataagacaatgatattcatgatagcattgtttctaatctcaaatattggaaacaccttaaatttccattagtagataatcaaattatggctcttttatccactgagtaccttgtagctatatagaatgatattgtgtaggaaaagatggcataatatggtaaggaggtgacaacttggtatgtataatatggttaaaaaagaatgtgcactaagacttggtggatatctataacaaaatgttaacagaggctaccactggataatggattgcaggaaacttttactttgttttttgctgctttttttatatatgaaataaatacatctcttataagcaaaaactattgttataaatgtatctatctttgatttagcacttctactttgaataatctgtccaacaaaatgaacgtacaaagatcttatataatgttcaatgcagcactgttaaaaatagttgaaaaaaattaacctacctgcttatcccctattagaaatatgtataagaaggtcatggaatagccatacttcacagccattgaaattgaagatgtaagtctatatttactgatatggaaaaagtgttcacaacaaatatggaaagggcaagttaataaacattgcattatgtagataggtaggtatgtacacagataaaaatctggaatgctttttattacagtgtcaaaagtaattgtttctgggtgatgggattgtgggtaattttcaactatttttttctatgtgtctgtattttaaatttttttacaataaataaatatctctttattaccaaaacaaaggtaaaaaatcaacaatatcagatatcaaaaaggagaagtaaccaaaaaatattgttaggtactacatgaaacactatggagataggtgaagtaagtggtatttctaggaaaatttactttattaaagtggtcccaggagagagtcagtaaccatgaaagaaataaaaatgttatcaaaagatgctttctaaattcaaagtgcaggcccccagatagcccaagtaaattcttcaaatagtcagggatattgatattaagtagggtaactatatagtttattgaagggagctttaattgagagaaccagtataaactagaatgccccatgtaaacctgacagatggtcacattactatttcaactttttctaagtatagagcaaaagacagactttcaagattttttaagataccaaaatgatcttagtaccaaaacttcacaaagatagctggcatgggcatgtgcctgtatgtgcacacactgcagatcaatcttgatgcaaaaccctttcataaaataccatcagatagaatttagcaatgcagtccgggcgctgtggctcacgcctgtaatcccagcactttgggaggccgaggcgggtggatcacttaaggtcaggagttcgagaccagcctgaccaacatggtgaaaccgcgtctctactaaaaatacaaaaattagccaggtgtggtggtgcacacctgtaatcccatctattcgggaggctgaggcaggggaatcgcttgaacctgggaggtggaagctgcagtgagccgagactgcgccactgcactccagcctgggtgacagagcaagactctgtcttaaaaaaaaaaaaaaaaaaaagaaaaagaaataatttagcaatgcattaaataaataccatgatcaagtaggtacatcacaagaatttaagcttggctcaataatggagaagctagtccacatattagatgaaaaaagaaaaacctgtatggtcatcttaataggtgccaaaaatactaaaattcaacatccactagtagattaatttgggcagtggttacatgactgtttaagtttgtcaaaactaactgaactatattctttaaaagggtgaattttattgcactaaattatatgccactaaaatgaacttttaaaggaataaataaaattataagtttatagtaacaaaaaaaactgacacacattcccaaataaaaagaaaaaaattaaaacttagtaaaataagtagaatgcattcccatttaaatcaaatatataagaatgctgactttcactgaaattataaactgtacacggaaagtaccagtcaggagataaggaaataatagacataaatattggggaggaagttgcaaagttaacattatttgcagatatttcaattgcacagctagaaagaatcaactgaaaaattattggaaacaacaagagaaatcagtaagatggatggctagttataactatgccggtgggaagagaagtgggaagaaaaggaaaaagtggatgtatacatgatttgaagtttccaccatcattcatatgtatgtgacacaccccaggccctacactaagtgctgcaggacactttacctacaagacacagtggctgccctttttcagagaccatgtagccagagacagaagttgggtatacataaaaatgacaaaggactttatggagcagtgatcatcaaggggcagaagaggaattcacagtcctggggaaggaaggcatagactgtaaagtaaggagagagaagaatgggttgtcagaggtcacagcttgtcctcagagcctaagacagcctttagaaccttttgattaggtctaccctatgtttaacttttaaatttgttttttagttcaacatctacaaattgtaagcatccacatttttaaaaatctagatttttaacctctattaaaaaattagaagcttgggcaatgtatggcatccttttctgcaagggcagctgttgggtggaattgagcagtagctgtcagccacctttaggtgcctgggtctctccagtctgttaagtgcaaatgctctattctctcagtactgtcacccattagttatctatctgttgttggcccttggaggcatttcaatagaaacccctggtgctaataataaagtaaagatactgggcaaaccttctccactcttggtcatacaacagtacttttaaaaattagctagtcgtagtcgccctgttgggaaaagccacggaagcatttgaacaaatgatgaagtgtttgcctcagtaaatgtacaacttgtttattcccagtaatgcatccctatttccccgtattattttttaaattgaaaaattattttaaaaattgaaaaagaagattgagaggctatctttgtggggaactggccattgtctacatcttcctcaatgcattctttcttttgaattctgaggcatgtgcagaatgctttttagcccagggaaatctttctgttctgtgacacatcattaagattaattgagcctttcaattttacattttccaagagcaaattaagtaggaaaaatgggacaggttttcactgtcacttatactgtgtttttttttctagcttatattctacatctgatggtcagatctgttaggtattcgaaaagcagtagcattaattgcattttcccttcctttttgctgaagggcagatgtttttatgttgttaatggtgggttgggttaaacataagcagcacactgaaagtataactagctattatttatgagaaaagaacaatgtaattccccagatttggctaatctaaaactaaggtttattttatagactttaaataaataaatatttataacctataattttgcccttagttctatgccctcaatacactctaggcttttggtcccatttgtctttccttttttgtatcatcggtatttttcttacctctagttatttctggggaaagaatgaatgtttaaggaaattctgtcctcaagaacacttccgtggcctgtcaaggtggcatgacattgcttgctttcctctcgttcttcatgaaaatgcctagcagggtacctggcacccagttggaacttgaaaaatactttttcaatttgaattagccaaattctggaaaacgtagcctatctcactgcctccagtttcttaccacctgcctacggtgtggctcctctcatctgggttttccacgccttctctcctaggcctctactagagctctctccagatcaccagttcctgccctgaaaaatcaacagtccttatttcttcagcatttctcacaagtgacctctgtccttctttatgcaacaagcagcactcatggaatagaaaggtcttcgctggcttctgaatgaaaattcaagaacctttctttctgctcactcttaggcaataaaatgtcccgctaccatgtcaaatcactgtttcaagctggtatcccaagtgtccagtgctatgtaattagctaagcctccgacttcattatacctactcctctccctcaggaaggggagtggcaagtttaaaatctcagctcctaaggaggggcatgattctcttcctctcttttcctgccttttgccaccagtcctcctgcaccttgctgggggtctgacttctcagggtaaaaataaggatgaaggagagaaggatctagaataatttgagtattgacttggttgtctggagagattgttgtgcagttcatgctcaaaagaagtggactggtaccagtctgcggcctgtaaggaaccaggccacacagcacgaggtgagcagcaggccagtgagtcttactgcctgagccccgcctcctgttggatcagtggcagcattagattctcatagaagcgcaaaccctactgtgaactgtgcatgtgagggatctaggttgctcactccacatgagaagctaatgcctaatgatctgaagtagaagatcccccttccactgcccaccccatcccatgggaaaatggtcttccatgcaactggtctggtgccaaaaatgttggggaccgctgctgtagtgggtttggggtagaactgagctcatgtgtagatgcatttgaagaatctgtggaacatatagcggaaatgtatgtaagtaactatatatgacagtctggaaatgtcagccctatctagagatagaaatttgagagatatcagcatatcgatcatagttaaaaccatgggagtggttactctttcatagagaaagagtttaaagttaaagaggaatctagagaccaaacattagggagcaatccttacagacttcatcaagcatcctagctctctcggatgcctttttcaccctgaagaaatcattggctccttctgaacctcagactccctgctgatgaaagttagtgaaggtgatttctaaagtccctttcagatctgacatgctgtggttctatccctttgcattagttttcacaactgctttgggacaaatagggcatttactaattgcttaattttataaactcgctagtatctgtaagcctacacaattatatggacccctcatctatctttctgataagcagaatggctgtgctgtacacctcaactctaccaacagtcttgaaagtaaacctggaacaccatgaaaatgacaggtttgaggaacccaagtgtatttcatgtgtgtcaatagggagtgatgaataagagctcagcttctgaagccagacccctgggctcaaattcctctactgtcacctcaggcaacttagttaacctctcctctctttgtctcatttcccttatctataaaataagggtaagaatcctagaaatcgaatgagttaatatacacaaaatacttagaaggctctggctgggtgtgaactaccatcatgtgataatgataatgataagacagccttgtctgatgaaaagggtcttaactgtaagggctgaaggttactatcttagacttatagttttcaaaaggagagtgaagaaaaaaaatctgtaccatttcctaataagtgggaactttcagatggctgagctctgtggatgataaaaattcatttcctactatcaaattgagctacaggtgaaaaagttgtggatactgaaatacagttgtatttagtttataaatttgtatgaggtaggaggaattagaacacacccacccttctttttgttgcacttactggtcatatttagctcaaaggaaaggtgcatgaaaagggaagaaactgcccgctttctccataatactcctttttatcttaaagtgtcttagaggctaaggaattcttggctgtgaagttgtcaccttctaaaaccaaaaaatttccctaaggcatgttgcttatgaatctctaggtttgcagcagcagcttcaaacttcttttgaacatttgacctactcctccaaacatccctctggatgtcagctacgtagagggaaagacacaccttaaggagcagtaactactgagacttcttgaatcttctctcagttgctcttcttattttgtctgagagaggctgggttcaacctgtttgtcaggcacagccaaacatgtgtcctcctgcagtttattgtatgccaagaaggatggtgacatgacagcagtaattcaaaatggggttttaagtgaataaataagaataagcctctgggattagtcccaattgaaaagttcagcgctaccggggagggtagctgctactgttggggattaacaaatggcttgctgcagggaatagtattcactgatccagctgcattttagttattgatggcctctctgccccagtgcccatctctcttcccagacacacagattctgctggcaaagatcttagaaatgtggttttgcccaattattctactcagaaactacctgcttgtatatgaaccttccaattcatagtttttagaccacagaaaatgtatagctctataatactatttagccttagggaagaagatgaagaaagaatttccctccacagaatcaaactgaaagtaagagaacagagaaagccttctggtaagagtagtggaaaacgggtaggatcattttgcgatcacagcactgaatatgtgaaaaaagaactctgttataggccctttactgtttgcaaggccttttatggacaccatattattttatctttacaacaaaaaggctgcatccccacttcataagtgacaaaagtgaagtctagagaggttgacagacttgcccaaagtcccactgctggaagtatgataatctgactccaagtttggttctttctttgctatgtcttgctgtgcactaatacactgagctcttaagattcccaaacacccacccagctgaaagatccaagtatataaatccaactagatttgcagcctttgcatgttttaaagttaactttatacattatccataaagccatcagttcctccacccccttggcaaatggattaatccttcaagggaaggatagtagacagacagacagaagcatttcaccaaagaaagggctatcgattgtattcttcgattatggcctaggagggttttaatgtcaaagagaaggcaccaaggaggttcctctgaggttccactgaggaacaaggagagatatcactcctgttttctattctattcaaaagacttaagggattagagactgggggttagatggctattttaatttaatatcttcctttatagtcccccatggaaaaaactaaacaaagtaactacaatccacaattacttgtttacttgaattgtgctgagggcctagcctgtaagattcttccatcaagtctttgaggcccctttctatctgttcactgtctccataagaaggatatgtctccgtgcaatggtgtgatgccttttcactttatcaaagttgagagggctcagtagccgctttgtacacttctaccttgattttctaatctttgctgttgctctgaagttttaaggattagattaagcaattttaaggtagataacatagagggtgtctgtacttaacgggccctcaatgattatttgcaaattgaatggttggtaagtttctgagataatctattattttctttcatcagaataaccaagtaagttcttggtggccagaattgtgtccttaaatgcaattcttattcttcacatatgttctaacagcccacgctgagttcctatgatgctactttaattctgttccatttcatgaattattctaggaggataccactgagaaggcaacagagccgactttgcttgaacaaaatacacaaagcttgcagttgagaaaataaaaggcaataaaatgggcttcatttcctcctattgctttcttagaagtaactaactttaagggtactgtgggaacagggtcaagaaaagctgatggttctattcttggtgatctgtaactggcttcggacaagtcttcagagtttatgtgaggttgctggagtctactggtgtttagggccccaatgaaatgcaactttaggggtgtgtgtgtttctcttttctctctactgtcaagctagttctcttccactgatactgttgtgtgtcagagagatttggaagctcagcattccagtttagatttctggttagtgtttgaataagatatcttccttccaattgaagtacatacattcttatcctattctgtccttctccatttacattccatgctgtttttgtccatatcaacaacattttaagatctaactttatatagaaacgtgtatacatttcaaatagtttgataatgttttccatatgtgtacacccatgtaaactagcacacatatcaggatatagaacattttcttgtagcccctctcagtcagtcctaagggtaaccactataatagtccccctcatccaaggggaaacattccaagacccccagtggatgcctgaaactgcagaaaccaaatcctgtatgtgtactgctacatagtactacagctaattcatccttccatgttttatgtctggtgcctcttttgtactttcatcaatgtagattctactggacatcttccagaagaggccagtttcattgcaactgaagtctcactcagatagtatcttttttccttgatcaacttcttcaactctgctagaaatgtggcagcagcttcttcattggcagacaaaacctctctagtaaattttatatttgtgaatccaaacctattaccaagtcggtgtaaccatcacttatttgcagtaagtggcttggtgtcactcatttcaggggatcccttgctgaaatcttcatataggcttactgctttctgatgcaacacattgccatcaattggaatgctttctgttcatgtcttccacccacaaatttaatgccctttccatcttcactaagcacttatcacacactgtcaccgtaacttctgcaatttgaggtgcaacagcaaaactagcacatatttctttttccttcttcacaacttcatggatagaggatttgttcttaccacagatcttagcaatctcagcatattttttttcaccttttcacttagaggaagcactttacagcttctatttggcatattacaattgtcagcatcactactgttgtgtttggggccattattaagtaaaataagagttactcaaacataagcactgctacagcagtcaatctggtaactgagatggctactaagtgactaatgggcagggagcatagacagcatggatgcactggttgtagggatgattcatgtcccaggtcagatggagtgcgacggcaccagatttcatcatggcactcactcacagcagcatgtaatttaaaactcatgaattgtttatttctggaattttccatttaatatttttggaccaacgttggccacaggttaaccaaaactgtgggtaggaggggactacttattttgacttctaagttggttttggctgtttggggacttcataacactgaagtcatagtgtatgtattcttttgtacttaatttctttcattcaacattatattgtaactcatccatgttgttgggtaaagagttccattgtataattaaactgtttatggttgtttgagtctggagctattacacataataataataatgcaagaaacattcttgtgcatgtcttttagtagacagatgccctcatttctcttggttatattgtcaggagcaggattccttagtcgtgggctataaatatattttcttttaataggtacagcaaaatatttttcctaagtggttgtaacagttaaccctaagttcctatggttttaaagcacagttttttctgcagtatttttactgtaggttgttgatgctaattaacgtggaacattgaggtatttgccagcccatcttagattatatacatacacacatttttgtattttacattcattcaatttggattcagaggtagaaatttgccttgtcatatatttggaaatttaatagtgaaaaattgccctcagaaattaaaagaaaactatctaataataatattgttctaagtgcctactccctgctagtcactttaaacattctagttccacttattcctcattgagatcttataaattagatatcagattgggactctgtcccaattctagatattgttatggtcatttttaagctatttatttattttaattttataagatgaggtctctctcttgcccaggctggtcatgaactcctggactcaacaatgcttccacctcagcctcccaaagtgctgggattacaggcgtgagccaccacgcctggccctaaactatttatttttaacctaaaaataagtaatattttttaaaatataagtaatattttaaaaatctaatattaatcacaataaagtttaactgtggaatagatgtctggttttgtggcttcacagtgagaatgaatcttgactaagtgtggtatttaattcatgggagtgaaaccggaagggggaaatgagccagggaggttccttggatcctgcctctggcattattcatttgcagctggctacattgcattttatggctgctattttctctcatttgtccttgattccttcgaaaggaagtagtaactcaatatattaaacactgcctagaatcctcagtgctgaacattttaattctatcaaatttttattagcatatcgttgaaaaagaaagaaaacctagggcttcagtttcttaggtcacataatgggtagttccagtaacacacctgcatgggctggagggcactctaaataataataatattcctgatctttaaaaaatatatcaaggtatagagctcttagaatcagtgtagaaaagcctgttagactggattttcaaataatagagttctcttcccttttagacaaagctatattaatccatcctttcattcattatcatgcattcacacaatgattcaacaagtacttactcagtacaatgtgccaggccctgttctagatattaagcatataacagagaacaaaacaaaggtctttcccttgtagagcttactttctcagcaaagaaacaggcaagaaaatgtatacatatatgtcatgtggtactccggaggacaataaaaacagagtaaggggcatgcaaatgtagacttggtgttgagaactgcaattgctttttataaggaacagttatgaaagcctctccatcagtattaatatttgtgccaggacctgaaagcactgaatcatacatgactcagtcaattctctgtccccagctctacaaggacaagggtagaaactgggaaaccagctaagatctctaataggtgtgttcaggcaagaaccaaatagcatatatgttttattttgtgggctcatcaccatccttgtgttttattagtaaaggtaattattatgtttatccagacatggacgaacaatatctggtacatttgagccacattgataataatgtagtaatatgaagttaacagtaatatgctgtgggtattataaattgagttctatatttaatgttcttttctacttacctaatattaatttttttgtagacatttcctcctctctcctgtttttattgaataatttgtagcattctttcagccacttacagttgaacttcagtcatttgtgtctcctgttcatcctctgcacagcatgctattaggttctgttgttgccttgtctcccaaatccatctccttctgcctttcccaactttggttttagacctttgtttcgtctcagaattagccatccttctctaattcatgcgaaattctctctttaatccatgtgaaattcagaaaaaacaatacaggtttttgaaatgagtccttgattcaaattggttcagatctttgttcttccgtgtactggctgtagtgccttttgcaatttttgaacctcaatcgttccttcgtaaaatgagtataacaatatctatgcagtgaggattaagtgggattatggagtgtttaaagtgcctagcagggagtaggcacttagaaaatgttggttctttccaccttgtgttcttctgcttcagatctcttaatttctacaactctaaatgtgctattttcctctctcagtaaataatactaccatctcaccagtttaaataaaaaaagctatgagtccccttcgaataatctatttctttcacaatctaaatttaatccatctgcaaatcctatttgttctaactcaacacatatcctcagtctctctgcttctccccattgacactgctacaaccctagtccaagaatcttatctgtactgttgccataggtcctgaattcatccttctgcctccactctggtcttctttcagcctgttttccacagagcctaagtgatatttaaaacataaaccagataatatcagtcccctgcttaaaaccctccagtggcgtttcatcatattcagaatgagatccaactcttaccctctcctaacactcccgctcttatgcttcagcggcactgcccttttttctttttctgctaactcatcaaactcatggctgcctccggccttagcacttgctattctctctgcttggaatactcattccccagatgtccacgtgacttactgcttcttgtcatttagatctcaactctaattgtcccctgacttctatcagtagtgctccatcacaccatcttacttttcctaaggcttaccactatctgaaaatagcctgcgtttctctattttcccctcagtaagaattaaaagttcatactagggcccatttcctagcagtgtttggcacatagtaagtatgctgaaaaaaaaaaaccttgactgactgaataaatgaacaaataaactcacttttaatgagatatcaaggttttatattaattacatgagccaagaattgtggtttcatttttaaaatgtgaggacctactggtttaatccttcatacttcacacatatgcttgtgctggaactatgactgtaaatcaatagcaataccatcctctgttttggcttcttcccctaacctaaatagttctcagatttacttttctctccatctccactgccacactgtcaccttagtgcaaatgaccatcctctctggccttttttctgtaaggttttaatctcccaatatgtattctccagactgcaggccagtgagcttttcagttgctgttacacccatgcttgaaaaccctttaagttttcattgttctcaagataaagaccagaatgtggtctggtccaccacctcacgtcaggccagccctcactctccactccaggccacactttctcctcccctcctggttcccgcctgccaactggctgggtagccgttgcttcccgcttcctgcaaagttctacatcgcacccatttcgcccacttcttcagatttcaggagattgttccttcctcgaggaagccctccctgattaggccaagcgccactccacgtcatacagccccacatcaccatgggcctctctttcagggctttgttttatgagtatgcaatccagaatatgacaatcttattgacatgcgtcaacgcgagcttgcgctcaatagctatttgccgaaggaatatacggactagcggcccgaccactcctcgcccctcccctaccactgccgcgcacatattacgcattaagcaggcgccgcgagtacggacatcgcgagcgcctgcgcgaagggctacgcatgcgcagaggggccagcccgctgacagattctcggtggcggcggcagcggcggcggccctggactgcggggaatgggaatcctaggtccctgactgagcacctcccccgcctccctgcccccgacatggctcaggagaagatggagctagacctggagctgcctccgggtacgggcgggagcccggcggagggcggtggcagcggcggcggcgggggcctcaggaggtctaacagcgcccccctgatccacggcctcagtgacacttcgccggtgttccaggccgaggcgccgagcgccaggcggaacagcacaacgttcccgagccgccacggcctgctgctgccggcctcccctgtccgcatgcacagcagccgcttgcaccagatcaaacaagaagagggcatggacttgatcaaccgagagacggtccacgaacgggaggtgcagaccgcaatgcagataagccactcctgggaggaaagtttcagcctgagtgacaacgacgtggagaaatccgcctcccccaagcgcatcgatttcattcctgtgtcaccagcaccgtcacccactcggggaattgggaagcagtgtttttcgccatccttgcaaagttttgtaagtagcaacggattgcctccaagccctattcccagcccaacgacccgatttaccacccggagaagccagagccccatcaattgcattagaccaagtgttcttggaccattgaaaagaaaatgtgaaatggaaactgaatatcagccaaagagatttttccagggcatcaccaacatgctttcttctgacgttgcacagctgtcagatcctggtgtgtgtgtatcttcggatacccttgatggaaacagcagcagtgccggatcttcttgtaactcaccagcgaaagtcagcactaccaccgactctcctgtgtcacctgcccaagcggcttctccatttattccactagatgaactttcgtctaagtgattcactcatcctgagactttctttttgcagtggagagagagaataatctagttggggcaaacactgaactttgtcaattaatttgaggctatttcctatttgaccccttttcttttttgaaattccctgaaatgatgttattctagagaacttctatgtcaggttcctttggatacccttgaattcagtgtagtaatattttcagacgtttccccaataagtgtgttgaagcatacatctttacgctgctaatatgtctaaatacatatgttatcccttgatttttttaaataactgagagctctatttatttatgggattattaagttctgatgaaaatataaatgttgacttaatcagcatagtaaactgatgtttaaaattccatacttcatgcccacactaatttttaatgttattttcagtggttgccgatttccatttgatgaagaactatacagcttaaaaaaatacgttagttatatctatctagtggttgtctgttttacccaggaattcttggatatttagttttctgggtactgaagtggatgggagggggaatgattaaagaacaaattataaaagtttgaacaaatcttttcaaattaagtatataaaagtaaacttttaagaaaaacatttttaatgagattttaatagtaattctagtcagtcatacaactataactactatagagaaaataaaattttttcctttttttttttaaccggaaagtgcatttgcttgggtgtaatcctaaagtgaaatgggacagtgccttgcagtctttgcccactatacataggctaaggctaagctctttgtactactgcaaacttaaaagtttttcaaatgtgggaaacgtgtgggaaggcttgttgaactttggcgcactcaggtaaacaatactctctcaattgttgatatactttaaaatattcagttgtgcctcagttccagaaattattgccaaacaggagccacagcaatttttggctacttttctgctctgcccatctgtcaccttactggttttcccttgttcaggaaggaagcagctgtttccttgccaacaggtcccttcctctccatctcccaccaaactagggcaccattgattagacaaaggtacagtgtaacttgggtttctgacagcaacaacaggactgtgaattgtttaacctctgtggttaaagctacagcttgagttgactgccttggggatgtcagttaattaaggggtgatgatttgcaagagaaaattagtggagagtcacataggtaaatcattatttaacttaggttttcctaaagttagaatagtcgaatgttcttttctttacctttacaattaagacaaaatgtttaataagaatagcaaaaatttttttatattatgcatccttatacctcacatatcttccttaactagatagtttgacagaaagaatggcatacaaagaggaaaggggaaaaatgactcagaacaagacaaaagctctgactgtttaaagttatcgcttacagagactttaacaattttgtggaatttttacaactatgagagtaaatggaactggtcaactcttgacagttgcctcaagatggagtgaaattgcatcgagggtaagactgtgtccacaggtttaaaattctctcttctgagtaatagtgttcatgtgctcccattctcgaccctgttgttgaaattcaaacttaaatagcctgacttcttgttgggtaacttgccctgcctccagaggtatttgaacttcattatcttcaacacaggaattgttaatcttctcacttcacctgttcttgcattagctcaattgatgtcatcactgatttcctaaactagaaactatggaagcatctttgacttttccttttctctgttggattagcttaatcaccaagtcctgtcaacttctgaaatgaatctcaaatttcttcccttctctatctgttgcccctgattttgccttaagttcttgcctgagtgatctcccagcctgtcttctgtctccttttggttcagtctttatactgcctcttgagtaatctttctgaaatttaaacttgatatttttcgccctcttgcttgaaaacttcacttgcttccccatttcctactctttaaggaatgatttctttagcctcagatagaaggacctttatgatctggccatattctgaaatagcttcaatcctctcctcatctctgttccagtatacatctttccttcttattctgcaaacattagaccacttgatattctttaaatatgtcatgtacttttcttgtgtctgttctttgggataattcctatccttttcagggaggcaaattgcacgtgagtttaagtatgaaggcaatgtatacctgctgattgtaaaatatttaaacattgtacatatctgtgtggttttaaaagtctgcttttaattatgtaaaattcatcttccctttccacagataacttctgttaacaacttgatatctattgtacaagatgtgttactggcatttccatgtatatatgtatataaatgcaggaaaccaacatgtcattgacacctctcttctttacttttccccatatctaatcattcctcaagtcttactgatttttatcagctagaatctatctccttatttctacctctattgccactctgatccaggctaccagcatttccctcttaggcttctgaagcaacttcctaactcccacttgtgctcctcacactcactctggtcggctatccattcattctccatacagcaactagagtcattcttttaaaattgcggacctgatccttccatctcccagctgaacgcttttcatttgcttcctgttctcatgagtatgccaaaatgtattaattctgggctaggaggccctgaggaatttggtccttccctcctcccccctcgttttctgtgcttcgccctcactggcttgcctttcttttccttaaatacatcatgttctctcctattttagatccttttccccgaaggtatggaaacattatttctgtaagcttattcttctatatagatgggaagtttttaaatcagataaggttctaagggcatgtggacaatttacgttatcatagtattgttcataacgtccatcattattctgtagactgtaagggcttacttagctcgtgtaagaattatccttcaaaaagcatttttaaggtattagtattgctaatctataaactttgtgcaagaagtcctaaagtcaatagcaacatttatttaaagtacagtttgtcatacttaataaacctctggtatattttcctttattatgcttgttaaaaacacagtataaatgggagaaatcattaaagatcattaactccaaggctgctggatgttaggacccttaagcatacttaaaagattgattgtaatcaagaataacttgtatcagattgccttccagtgattcacatttattagttcaaccagttacatacctgtagcaagagaccagtttatttggcaataaaattggggaaggaatcaagacttaaatgaggaaagtgagtctgagaacattttttttcagggtgtgtttatagattagtagaacaattttgaagatctaacagaggtgggagtcaggggaatggttgccagacaattgaaccaagaagatgatgatcatttcttgagtagcaccagagaacagaagaaagagttggccttggaaaggaggtctggaaacttatttttcttctgaaacaggagggagagtgaaaaggctaggcaaagatatccataaatgttgaattgatttgttgttgcaggggtttaggagtatggaggtaggtatatgaaaagtagaatttgtttctgattgtgcctattttccaattattgaggaatctaagatacatgaggatagggacaggagatcatttggaagcttgagtgcagtaaaggtttaatgttgcctctgagaatctaaaggagtaagttaaggacaagtagaaggcttattaggctatgatggatgccaggttgcagttggatggcaggcacaaggaagtgggttggattgactaggtttgggaattggttaagtgggtactaggtaaagcccagtgtgtgaagtagttaagggttctgctgaaagtgtagtttgaatgattggctgaggcattgaggataagagaagggagcagaggcttatggactagaccacttttttcagggctttaccttatcagccatgacaaagtatagagaatctggtctcaatgtaggtctctcactccagcagttttgcccacatttttcatggctgttagagaatcagggctgaaggcaagccttgagtgccacttacttggtaaaaaattgtgtcagattgctcactgtagccaagacagagttctttgtggcttctgtaacttgccatccaagtaaaaaaattttcttaaaagttgaaatgacctttgtataaaaagtaataaaatacttgctatgtgtcagggactgttctaagtgctaagcaaatatatcaatgcatttaatctatcactatcatctgaggcaagtgctatcattatcctcattttataaatgaggaaatggagacacaggttgagttacttgcccaggattccagagctgggaggtaggcagcgaattgtggtggttaggaatatagacagtggagcagggtggctgtggtgaggattgaatgggttcgtacacaatgtgcttacaaagatgctgggcaattagcatccttgatggatgaaactcctgctttcacactcagttaacagtacaatatccttcaaagcaggctatccttttatgaagcgattgtttctgatgttagcctttcttatagtgaacagacatttccctctaacttccaccattcaattcaagtccacctttggcaaatgcaaaacaagccttattcttctttttataggtgatagcccccttctagaaatcagaaatactgatccttctctaatgactacttcttccttccagattttagaaatcttgagctgtgtcttcagtatgctgtctgtgaaataaggctatcattgcgtggcagccaagattttcaccagattgtgattcccttatgaccatttgccttcctgggtaggaagtgataaatggcctgataacgtgagtttttgccagtaataataataatgatgtgttaatatttcttgagcattcactatgggtccagacactatttttagtgctttacatttatgagtgtttaaaatcctcatgacaaccctgtgaggcaggtgctatggattcccattgaagagatgagaaaaccaaggccattttctcaagtccctattactgtctattttttttccttttgaatttaggcccttttggtttttttattattattattataaacttttttttattattaacttgaagaccatttcccagctaactttagcaacttgctttattttactagtgctgctacttctgttttgaatcaaatgataggtaatcattccttaaaacagtattatattaaaggaacataccaggaagttttttttttagtaataggcaagaaattaaagtgtatagaaggaaatcatggttccacagctttatgtattttttccctatagcattaattttattcaaagatttaggggaaattttttgttttagaacgaaaagggactggtagctaactgttgtaaatacatggtagagtagagtacaaaacaaaagtctatgaggaaatgaccacttaccaagcagcttcacggagcaaccataccctccacggtaaccattctcttaaggcgattgatggaagagtttccaaccggaaggttgggattcagtaccacccccgcatggacaaatgcagatgtgagatcactcacagccatgtctaccttcatggaaaatgagtcggccctctccaataccatgacacgcaacctctggctgcactgcggttatgggattggcttctctcctacttttgcggttatgggattgaaactctcctactttttagaaaatcctgtggaaggatcaggtaataggaaaaaggctggtgaattctgtaaagggaagtgagtagaattgagttgggttagggaaggaagcattttaggcagccaccatggaaagaaggcaggccaccttctcactgacgatgagacccaagtgctaaaggccagcaacaggcagtgtctgaaaactagtctgatatcatcacagtcttcgagggaaaatatgattctactagggttttcatgtcaatagtggactcgaatttaagaagtctccagtccttttgtagaagtacaagtgttttttatatatgagcagaaggaccagaaagaaaccaactcttcttcccatccctccttaatacagaatttatttacttttcttgccaatctttcatttaaagatgtctcgtaactcttctttaattctgtttcctcctccttctcctgcatagatcagatccttaacagacctttccttgacctaacattcatttttcttccaatttttctttctaatctttctttctttttttttcagagacagagtctcgctctgtcacgcaggctggagtgcaggggtgcaatcttggctccctgcaacctccgcctcccgggttcaagtgatactcctgcttcagcctcctgagtagtagggactacaggcatgtgccaccatgcctgactagtttttgtatttttagtagagacggggtttcaccatgttggccaggctggtctcaatctcctgacctctggtgatccacccacctcagcctcccaaagtgctgggattacaggcttgagccaccatacccagcctctttctaatctttctaccttgaaaaatcaacaaagaagtctttcgtcagctttagataattaaagccaagcaagcaacaaatgttggtctttttcagtagaaaccatgttaaaaatagttacacaagcatcaagcatctctacccccatcacacaccttgtccttgagaactggttttgctgtgtttcagttctgtccagttctccctggtgaccctttcctcccttgattagttccacagcactgcaggctaaggggaaaaaggaatgtgtgggcccaggaggggactgtcctaggagacaggccgatactttttacttttagataagaaatgaaaaagtgttcatgacttttccctctgcagactctcccttcaggttcaaacttggaactttctagctttggtcatgtattttatgcccttaaagggtttgtacttttctccatacatatccagatgaccctaagtccagaaatagccagctgctgcatcttaactacaagttaattttatcatattagaggaagatatcaggaaggtttttgttttgttttgttttgttttgttttttagtaataggtaaaaaattaaagagtatagaaggaaatagtggttccacagaacaatggttctggtttggaatctccaatgtgaagacccatggtcttccttaaacttggtagcttgtggggatttgtttttcccacatcccaaaatagcatctctgtgactgggctgaacgtgtacatcctttgtcgtggagtcaggctcacgtttaggacccctttgggcatctggctggtgactatcactccctctgtggtcttccccattgcctgcttgggtcccaccattattccaaagcatacaagtgaactactgtctcagaaactgatattatatttgacatacactgggattgcaaccagtttctttgcactgacaggataagagagcaggcggaaatttccatcaagagggatgaaagaaaggatatgctcagatttccagcacttaaacacaaggatggaagctgatatcatccaaccacctggggttcatgaagggaagtgtaaggtctggcattccaatcagcttgatacagcatcaatcatcccctgggtttcagcagcaattgtagaacctgatttatcaataatggcatcaatctcttcaatcacatcaaaataggcctcattgttggtgtatttcaccccagtacctcgccaaggcaccattgacagttatccagtgggaagttggtcacccacattggtgcttcctgtgatggtgttgacaactgttcgaaggatagtgggaggctttatcttttctttgaggatatttgactcggtagccaacgagtcagcttggaaacccattgccaagcgtctcttctgatgccgcataaatcacaatcacattgtccttcatcactaattctgaacagactccaacatagtcctgaaatgtgtccactactcagtgaagaaactctgacaaatagaggggagacctccatctggatcacagccacaaaaaaagatcttgtggtggtaaacacttaagagacagtggtgaggggtagggataactggaggcacactttctgcctcagtagcttgttcttgcacctcaaaaaagtattcacaaacagaacagtgtaccacacttctccagtgtttctccaggaaaatatctccagaggagttgatcaagaaaagtctataaatcatgatagactgtgattgtcaggtgagaaaggaaagcctttttcagtctgaaagcctcaggactctgcagattttcaaccccatctttcaagaccaggctcagtcttcctctactgcacgagcctgaagtatccctcccttgaatacccggcctcactcctcggagcacctgatgcttgctccaccttatgaacaggtcccaccctgctctgctttacatattttttaactgactttatatttgaaatttgaaattaccaatcccacaaattttggatttttttgttttctttaaatatatacatatatataaacagagctatgtttaatttatacagtatctttggttgttcctagattgtcattcctagggaaacaaagacaaccagtttgacccttccctcccctcctttcccctaaaaaactctaagttaaaactgtggcatttttttaaaggaaaaatgtaacaccaagattcaaagaaggatcatgcttacctcttctttccctgtgagaggctctccccagaggtagagatttaaattcagaggaattgagcaatccttgagaaactttactttttaaaaacttttcttcatagaaaaatcaattcactggtgagtaagaggatccgaaaaaggaaaacctccctttgaaaacattccagaattggtgattagacttccagtttcatactatcatgtccctacattagacattttggaacaaaccatcaaaaaccacagttggttccaaagggttagtcttatttttagaagttcagtaaatatttagaaatcacttcaacactgacttttagttctatatgtagcttgtttgtgaaaataattttataacagaataaggttaagcagataatgtcaaataattgggtcttgtgtatgtacacccaaacgcacatgagcgcgcacacacacacacatacacacacgcacccactcactcacccttgtggacctttttctgcgttcctggagccatatttagctttcctgccactttagattttcttctatttttcccttcattttcttaaacagaaacttgggctttgtaaatgatactgaactatgcatatacctatgtaggtactatatagatagaaagtgtgctgtgctttgattttgcatcagcggttcagatttcaagtgctgccctaagagagaagtaagtatttggtacttgtacctaggacctctttgtgcctgatttctgtttctcctttttgaatttctagaataaatactcggggagatgtaaaaaatactcatttacaaattttaaggcaacatgactgaaagtagagaacagagaacctattgcttttgtttacccgcagaagttcggttctgtatcaatgccaggtataattctggtttttttccagttgcctacagtggtcccccaaaccaaactaacctcttaaggcttggctagcaaggcgtgttgtgaaagaatacaattgagaaagatattttgtgccccagcagagtaaaatggttgtttgaggtaatcgctcctgggattcggcaatccatctcccttgctttaaggacaaagaaaggttttaatgtcgagatgccaagaggattatcagaacttgggagtgacaagtagctgttgagtattggtatcttttgggaaggaaaatatgagatatttgggagggagtgggagtgaggggatgatggatggattgggtatttcttttggcactgtaaatgttctcttggactattattgtgaactccctgttgagtaaagaatggcattgaggatggttttcttcattgtttgtttcacttcatttaggttttggatttgaatcaggatgtgtttaagaatttctttgagtctctttcccttgatgctctcttcttttgagtcctcttggggaaaaaaggtaaataatataattataattgtcaggttactttgagtcaagaattaaaattcctgatgctctttaccaatttatattgcatttctaactctgaatttaaatttcataccttttctatatagtctttctcaaggccccgtttaccatactacttgctttcagttatttctaaaatacaaacttgagaatgcaactgtaatggctaccacagaagttcaagtttaaatcaaactatgcagtatgagtaaaagacctctccacttcaacatatcccctggattccagtactctagctaactgagctgcctgcagttcagtgttttctgtatatgcttactggctgtgctttcagacaagctgtgtcctctgcttaaaatggcatcttcttcctccttcctccacaacccctgccaactgtttttccttaactaactccttaaaaatttagttcaaggggcacatctttcctgatggcccctgcctctacaaccacggtcagttaggtgctttcttctgtgatcctgttgttcccagggcttccctctataaaggcaattaatagtctgaattgtatttgtatggtttcttttctctttgccccatgcaaaaatagggactaagccttttatttatgtccctaatacagggacataatgcagagcacattatagttacgcaaatttatgttgagtagatgaattaatagatggataaatggatgaacaaatggtacacagtttctgttttgttttgttttattgagttcatgatatttgcggtgagattttattccatttacaacacagtgccatttagaaattcattcaacaagcatttattcagcatttactgtggcacatgtgtttttttgttgttgtttgtttgtttgtttgtttgtttgtttttgagacagagtctcgctctgtcgcccaggttggagtgcagtggcgcgatctcggttcactgcaagctccgccttccaggttcagccattctcctgcttcagcctcccgagtaggtgggactacaggcacccgccaccatgcctggctaattgttttgtatttttagtagagacagggtttcgctgcattagccaggatggtctcgatctcctgacctcgtgatccgcccgcctcggcctcccaaagtgctgggattacaggcgtgagccactgcgcctggcccacatgttttttaagaaaaaggaatgtagtaagattcttagtggaacaagttcagtcacatggctgagccctttatagtttgctgagactagaaattcattcattaagcgatgttgattaaagcactgattatgtgcctcacactgggctagtctcttaggatactttggtgtacaaaacaaagactcctgccctgtagaacccacattttgcatacattctaacagggtagaaggaggggcagtaacaaacataaaaaataagtaaattactatgtaaatttacacatataaagtgtgtatgtgtgtatgtgtatacacatatagtgtatgtgtatacacatatagtgtaaggaacaggagctcagcatggctgaagcagagttgttgaagggaaaaatagttagaggggggttagagaggtgggcaatagtgaggattattgcaaacataggtggcatagtatcttgtatgaaggacactggctttatgagtgagatgagagccatcacagagctttgagcacaggagtgacatgatctgtcttagattttaataggaacactcctgctgtgttgagaatagactctgagggcgtggtagaggcagggggaccaattaggaggctatccagcaatccaggtaagagatgatgatagcttggatgagggtggtagcggtggaggtggaagaagtggctaaattataggtatattttgaagatagaaccaacagattttgctggtagatttaaggtgggcataagagagaagttaagcataactgaaaggtttgaggcctaaacaacgggaaggattggagttgccatcagctgaaatatggaaatctatgggtggagtaggatattttttggtggggggaggggctatggctgtggaggtgagtggcattagctgctgagttttgcatacgttaagcaatctttattagacattcaagtggaggcatcaagtaagcagttagatacctgagtcaagttcaggaaagagggctggactgaaatacacaattgtgagtcatctgcctgtggatagtgaagtcaggagagtagatgggatcactaaggggaaagtgtcattaaagaaaagactaagaactgaaccttgaagcattctataacattgaaagatcaggaaaaggaaaccaagctagagcaatcagagaggtaggaaaaccaagagagcacggcgctttagaaaccatgtgaagaagacatgagagaagatggagtgatggtgtgtcagttgcagctgatctgacaagtgagatgaagtctaatcactgagtgctgcatttagtgacatagaggttacaagtcacctgtgtgagagtcattgcggtggagtggtgcagttggagcctgacttgagtggagttaagatagaatacagtgagcacaattggagacagccagatagctgaagaaggatgtgggttcttctagattcttgaggtgaaaaaggaactgaagcgaaaggtcatcttcctccccttttattggtaaattggtattaagtgtttcacaagaaatactcctttacacgtatgtgattatagcttgggggaacaatcaaggataaatgacagtttcttttctttctttctttctttctttctttcttttctttctttggcattattgtgagagggaacaattttataagtaaatgtttttactccaaacatgagtaaactgttcaagctaagggctttactgacttacttccttcatgggtttgtctggttcatcttattcccttgtcatctatttctcctgatgacttttttccacttataaattgaaatatagttccacacccatgacacaattatttctgtaactttggcccagtttcctaacccagagacatttttctcttcagtgagtgctgtaaattaaaaaaaaaaaaaaaaatagttcattgtcttcttagattttattcaggagcagatttttccctattcctttgcaaaattgttgctgaatagtgggagaggagaggaccagtaatgataggaaacaaacaatattttcctcactttgaattgctaagatttccttctaatcatagaatattgtcaggttccttcttgtgggttgggaagtctgtctggatcctttacaaaagaggactgagggacatccaagccatatttgtaaccagcagggaaaaatgccttctcctggaactgcttatctctcctgataatgcatttctgtctttcaagacgtcagttaagtgccgtgcactccatggaatgtcctctgatccttccggctctaggtagtattggttttcctctgaatcagtgtactaccttctgcctgtactccttactttgtgtgtgtgtgagagagagagagagagcgtgtgtgtgtgtgtgttttaatggttaaaacatctgtgtctctacaggctggtagaactacattccacacctaaccttgtgacttccaagctttctgattttaggcaaattgcttaatctttgtgtgtcttagtcttttcatctgttaaatgggagtggttcttatcacaaaaagtagtaaggattagaaaggaattctctataaaattgtaaagttatttattcagaaaactggtaacttgaataaatggaaacccgaagaatatatgtaatatatggaataatcccctatctttagggcaaatttcctgaaggaaagggacaatagtttatctgtctttcctaataccagttgactgagaaagaacttagtgaatgtttattaatggtgatagataacgcttggaaaatatgtggaatggttgctcacagaaatctgtgatatgtgtcttaaaatatttgcacattagcaaatgttttagactttaggaaatcttccagactaaaactctttctagggaaatggtgttgcaattttgatggtatataggaagtcagtgagctttccttttagttttcctaacattcatgaaaatttctgggtttctcctatttcattcatattttcatagagaattcagaaatctgctttaattttaacacagtcaatcaaccttgttctataattaggatgagaagttaaatgacatttacttttgagcaaactttcataagatatgtattttaatcatgtgaaaaaaagattagaataacaaaatatactgaaacaggcaaattacaccttctaatgagagaagcgatgcaggttcattttagaaattgtagaaagttctgataagcaaaagtagtacacttcactgagatgccattgtttgcacttcatgtatattgttccaggctttttctatgtctaaatatgtatatgtgatttcatacggtgatagcatcctgctgtatattcagctccataaacagcttttattccccatgtaatatacagtgaatgttttaaatatgcttctgcatttttttgatagttgcatttttttgatagttgcatgttatttttttctgtggatgtaccacagttaatccactgttactctttagtttgttttcaattttttcctcaattacaatgttctgatgtacatctgaacaaacttttaaaatttaaagaccacaaacatttcttagacttgccaatataaaatacctaattcaactttgttcattcttaaaacattcctttctgaaccggttttgttatttatttgatggtcatgtttggagctcctgtgtgtgactgaaaaaagaagaaaagtgtagttttctgaacataatctgcatttcagattttttcatgaatctaagacagcattttcctcatttgatccaaactagagagttttgataatgtcatcaggaaatgatgctccgaggttgtcttctcctcaaccagagcaacccgtaattcatggctagtgaggttgccaggaagtcagtgatccttaccattgtgtcatttgaatgaaagaaaggctggagcataggaagtggggagatgagaaagaagccagagttagatatctatcccacagatttaaggtcaccaccgtttccgtctttcatagctatggcaacttgagatcccatgttttctaggttagttatcaaatattccctccagtagcccagtgaaacatcttagaaattctagtatttggacatcaaaactagcatatttctattttatgcacctaaaaatgacaccaaaaccctttatgacatcatggttgtcagttttagggttataaaatatggtgaccatatatagatcttaggaaaaggagtaaaagagatgagttaattattcattttttcaataaatgtggtgaatgaatacttactatgtacctggcactgtcctagggcctgggcttacaaagacgagtggacaagtccttaagttgctcttggcgtggtacacacatatatgtttaatgtctacgatgctttgttgttatttgttgctgtgtaaaagacatatgtccaagatgctacaggaacccagaggaaggaaatgcaaaggtttttacagaggaagcaactctttagcaggttaataagtggataggcattccccagggagacaaggggtacatgatgagtgtcattcaatatgtgcaaagaacagagtatattctaggattctccagcaaacaagaattgcaatgttgatttaaaacatttggagtaagtattgggttgaattttttgttggtgatggtggtagtgtttgctaattgtttttatttttccatatttctcagttttttaaaatcttcattgtttattcctttttagggaattactaaaccatttgaccctgaaagatcagatgaaatggacatggcttattaaggagttgttgtaactacttcttgtctcaatgacatactattttcctgtcttggatttaattgcttagaaattatggctacagattcacaaagagattggaagaaagaatagataaagaatatatagttcaaattatctgctaaattttttgtgctgttagtaattaatactccaaaatgtgataaagatcactgtgcccgttttgttttgttttgttttgttttgttttgttttagcattggaaaagccttgggctatacattctgagatttcaaacaaagtagatttatagtggaaaggaaccagaggtttagactaaatagatacgctgtaagagagccataatgatcttatttaaatattttccacattaaataaggcatgagtactgttatgctactgccttttttttaataattgaatttgcatccatggtggttttttttcattccccgtggagttccacttgatagccaatgtgaatatttgaagaaaataatctgttggagcccagatttgaattaaacttcctcaaagtataatgaaagttttgagtttgtcttataagaaagaaatttttgtttatgctttagaagcttaattgatagaagtctggagagcaataattggggtgaatttttaagatggttgtaagattgttcacttggtaaatatttcttgagctcttactgtagacactgtggaccagtcattgaactgaattaactttcactctagttcctaatagacatgttaagctgctggcttcatggagtttacattatagtgagaggaaacagacaaaaacaataaaaggtagttagtagttagtaaaatcattgccaattacaataaatgttaggaaggaaataaacaatgggctgagaacttgaaccacagagaagcacctgctttgggtagagtggccagggagaatcatcatgggcaagggggaggcatgtgcatgcacttggggaattgaaaggaggctggtgagcaagaggaagcatagcatcagataagcatggagagctaggcaggcaacagaccacacggggtcttatagggcaagatcagaagtctagattttattctaatgccataagaagacattaaagggttttacacaaggcctaacctgaactgatttcttttttaagaccattattgccttgtggagaatgggagcaggaagatcaagtaggaggatgttatattagtctaggcaagagatattggtgactgggctgaggtgtagcaattaggatggagaacaaaagatggttttgagaaatcagcaagatttgggagagggcatactaaggagaaagagagagaaatcaagaatgactgatttttgtaaatgaagtttactgacttgagtaaaaatgggaatgaagtgacattgaatgagatgggaaagtttgcaggggcagaaataaagaggtgtttgagttttgtttaggacctatctctaatatgtttttgaggattctaaagggagctgtcagttggctatataagttcaaagctagggaaatctggatgcagctaaaattatatttgagataagcacaccttccatcaatatgttggctgtaattttaaaaagcatttggagtatacttgaaaatactgaaactctctatctgtagtacataccttctgttcatcagtgactaattttagggtacacaacagttgtgcaaaagaatgaagtcctcttagttgcacttcttatcaaaatcccaatggtattgttttatagaaatagaaaaaaattaaattcatatggaaccacaaaggagcccaaatagccaaagcaatcttgagaaagaagagcaaagttgaaggcatcacacttcctaacttcaaaatatattacaagccacagtaaacaaaagagtatggcactctcataaaaatagacatataggccaataaaatagaatagaggccccagaaatgaacccatacatatacaatcaattgatcttcaacgggagtgctaagaatacacaatagggaaagatagtaccttcaacaaagggtgttgggaaaactggatatccatatgtgaaagaatgaaactggacttttatatcagacgcaaaaccaactcaagatggatgaatgacttaaaaataatacctgaaactgtgaaactcctaggagaaaagctaggggaaaggcttcatgacattggttttggcagcaatttcctggatatgacaccaaaatcacaggcaacaagagcaaaagtggacagataggactaggacaatatcaaactcaagagcaaaggaaatgatcaacagaatgaaaaggcaactcatggaatgagagaaaatattaacaaactatacatctgaaaaggggttaatattcaaaatatatagggaacccctacaacccaatagcaaaagaaaaaataaggagcctgattgaaaaataggcaaaggacttaaatagatatttttccaaagaaaacatacatgagcctggccttcccatatcaggttccttagagaaactgaaaatagtgatggtgaaggggctggtggagatacctgtgggcagcaggtgcccggtttgggccagtgagtgaggagaagcctcacacacagcatgtggtatgtggctaccattttttctcttgcttaggccctgcaaatgttgggggtagaccttgcctttcgaatgcaatagtccttgaggtttgtaccatgcttttcatccagcatctagacagggcctgcacatgcacaggtgtttgttaaatggatgagtaatccagttttccttgttttctgtggcatggggaagaaacatgggttgcttgaagtaccttgggttcaacagacctcaccatttccttcttactgatgtaagaaggccttgaagacccatcccagtcagtcatccatggatagcatctatgtcaagaggatgtcgggcctttatgtgtgattctatagttagtgcagtgcacaatggggctccactgaagggtagatggaggctgatttccaacctgttctcagctgccacgctctgtatctgctgttgaaaaggggcctttttctttgcagggttaagtctgcccagaggtggtatctttttctcatttttctgcaagggcataggcatttgctaaatcagaaaggttgcctttttgtcattcaaacaaaggtgtcctaggcttcccaaggtcatatttgggtacccttgctccaaattctccatgactgttaagttcttgaggaacttgagctgtaagcactccaagtgttggaatactttgagcagttgtctccctgtgcttgcatctcttctccccctcatatagaaatcccagataggaaaagtgtcgatccaagttgcaggcttccatgtccattcctagggctctcaggcctcgctgagtcagcacctgctactaccacacaggtggattggtccatagatattttaacccattgctctgttcccagatgcccctgccttccttctgataaggcaaatttaatttgtgtgtgtgaggaggggatggagagggtgctttgcttgagccaggatatagtcctttatattctgctgaaaattctcaaaggagggctatccaagggaaaataacaagcccgggcatgagagaacttagaattccagggatacttagcggtattaacactaggaaaagggcacattttttttttcatattggattgctaataatcacaacaatgctaaatacttcctggatttctttcagttgggctgaatttaagaagtataggtttatgctgttccttgatgctgagaaaagagggtacatgtaatactgagacatccgcacagtggtgggtgttgaggcaccctgccaggtgggagagatttgaaatatattccaagactaaagatttgggatttttttcgtactttcaaaaccacagggattgacagagtttaataataagattacagagttactcctgtgaatataatataccacttgaaagaagtacatttggtcaggctggacggaatctcatcaaagagataagggaaagtccggaagacacacctgagtatggtctgaagccaaagaacagcatgctccaaaacaagcccaatctcaggttaagaagccttcatcatttagagtggccaccacacggactctccttgttttgtcttttgactgttaggttgagttctgatggaatgaatgatgggggtttgccccagcatattagcagcgcatttcggcccttgtgccagtctggaaacaggcgatagagagtgaagtcagtgtgttaccatcacagaaaacagcttagaaaaagataccccaccagataaataatgggcatctctggatgagaagattgatggctccttttattttctttgtgattttctgtctctttctcatatttctaaaatagatatgagttgcatttataatgatttttaaagttattccaaaagagaaactattcaaagaaactgaaactttatggaatgaacctggaatagcaagaaaagatatcttatggaagtattcgaaatactaaattgatagccatccttagtttttcatgtcagtttgatgcttgaacattccttgattatccagtgctaaaaggaggaagaaaacatttatgaagcatctacttaatgtgtaaggacttaaaaaatgagacatcctttctgaactcaaggtagcttatctaagaacaacagaaatacgcatatatgcattaaactttccatttttgtgtctattcatgtgccaggcactgtgatggatagaaaatggatggatggatggatggatggatggatagacagaggttattgccctcaaggggccaatagtgtactagaaagagaagaaatttaaactgaggattacaatatagtcagtaagtgtcacaatagagttagtcccagagcacgtgagtacagagaagaaacgctgccctttgcctcaggaggggtaggagaggattcatacgaggaagtcatgcctgagctgcatcttggaggacaaagagcactcagcctgagagtgaaggggatgtgccaggcattgaagtgtgtgcaaaggtaagatgcaaagagaaccacgcattctgagagctgacagtcatcccatgtggctgcagttgtgttggggtgagctgggaggagatatgagagtcgtgagaggtcatacgctgtgccaaaacctctgaggtttgccctgaagcagtgggaagcccttgcaggattttaaagaaggagagtggttagacagatttgcatatagaaaagtccctttagcaatgttgttcaccaacaaggcagactaattaggaggctagggcagcaatctgtgttagaaatgatgagatctcaattaagtttgtataagggaaaatgcagagaaagactcagagtcaaggaacatcaaggagattgattggaaagagcttaattgataggttgtggggaggatgtattgaggaggaattgggatggccccttgatttcaggcttggacaactgggtgctaatggtggcattctttgagctggatgggatacgataaactgcaattgaagcattttaaatttatagtgcctgcgagatactatagaaaccctaaaagcagctgggaatataaatcttgagctcaagaaagtctgggctcaaagagttatttgggagtcatcacaagtaggttgcagttaaacccattggtgatggaagagattattcagaagcagtgagaagaaaagaattcggaagaccatgaggaacaggaacatttaagaaacagtcaaaaaaggtggaagcctgccagagagcccaagaaaaagtgttcagagaagtggaggaaagccaggcataccaggaagggaaaaccaggcatatatggaggccctgctcatgctgtctcccaagttcatcatccgtggaagaaagggcaaagagcaaatgccaagtggcagacatgcacttcccaactgagtttgcctctaacaagtctctctggatgtaaatgtctgtcgatacctcactgctagaatgtctaggaatacaagtttcttgtttgtttaactgggaacattaccttcctaaataaagctatgatcctgttaataaagcacatggggaaaagggatttggggtatttggggtaggcaaatgacagtgttggccacttcaggtagccaagggaagagggacagtcagtgaaggaggactggtcattcatcagttcaacacagatttgagagcctgctgtgtgcaaggtattcagtgtccgtgcttcagagaagttgaggaaggtcatgaatgaaatgactgcttgggtgaagcaatgaggaatccacctttgaacttggggtggttgtccaggaggccggattgctgtgcctccatgagcgtgtggaggggtgggggtgaagatggagaatggacaacagtcttttgaggagttgactttgagcataaagggagtgggatgatgccgcagccaggagggagcatcaaggtgaagaagaggtttcaggagccaggaggaagggtctcaggaaggagttcacatgctcatattctcagggtgaagagccagatgagggaaagtagtcgattcaggaaaaagagtatctgataaagctccagacaggtatgtgttgtggggagcggagaacataccttagctgtgcatcagagagggacaaagatgggtatgggcgttcatagtttacaggtgggaaggcaggaaacaaagggcccaccattcctcggggaggcagggggcaggtagcggacttaaggaaataagcgaagtcttcaaataggcagtattagcagagaggttaagagccactttggaactggacagtctgtgcattcccatcctggctccaactgtatgaccttgggcaagttatttatatattttattcttctagttttcaatttttttttttttttttttgagagacagggtctcactctgtcattcaggatggagcgcagtggcatgatcatagctcactgcagctttgaactcctgagttcaagtgatcctccagccttgacctcccaaagcactggaactacaggtgtgcaccacttcacccagctagaggcaagttatttaacctctctgttgccttcgttttcctctgcaaccaagcaatgaggataataacagaaacctgttacttggagttgttggaagaattaaatgagttaattcatgtagtacttgtctgagtgcctggcacaaaggagtgtttcatatgcattggctgtgataatgattatttataggacagagagcacatgcagtccagggtcacctaaacgcctaactggtccagaatgcaagtgcgttggctgagggctgtgagggcacagcagatgaagcattgcattcttcaaggaagtcctcagggggaggcatttgagattggcacagccctggagaggctagctcaagtagaacaaacactgttggtgcaggcaagaggctgtcagagcacctgccacatttgcagaggaaggagccctctgacacttgagagggagcatgtggggcgcagggggccctgtgtgtagaggctccttcacctcaagggtgggaagaatggtggaggagcggccagagatgagggtgagcatcacactttgcaaggcctcgaatacctggagtttcttctgtagccacgagaaggttgggagcagggcaatgagggtccactctgtcctgtggtgctccttctggtgagagtagctaaaaatagtcatcacaatgctgagtgcagggactgcgtatggtgtgccaggaacattggagtgctgtaaatcttggacattactaacgactgccctgtgagagaggtactgttatttgttttatttttcagatgaggaaactgaggcacacagaggttaagccacttgaggattccatacagctggtgtgcggcagagtcaatagtgaagctgggcagtgttgtgacaccagagcctcttcctgtgaccaccgagctgtcatcacctgtcacattagggtgtggctctccagagggggtagtgacaagtggagattggagcaatgacctctgctaggcttatggcagcttattgataaaacattttctgtcttagtcaaggagagtttggctgtaaggactagaaactcctgcaaagaactcaagtgaatgctgaatggattgtgaagatacaggggcgctcccagaacccagttgcttgctagggagtatggctagacattacacagctggagagttgtcaggctgtagcagtatctctgtctgtctggaaacacagggccttctctgtgcatctttccacagtctgattaaattgcagctttcctagtttcactctcccaggaccttggctagccctgaccctacctgacctgaaaagtcacttgactcactcagtccctgtgttgtagataaagttcttgctttggataatctgctggtttagcctagttcaagtgtccctccttggttccttctgcagctgggataaaggtggcacaggttatgaccaggcagggagaaagctgctctgagaactccatgatcttcagtggttagtgaagcttgcacgccttgccatcttgacttaactgctaaccctgcactcctcagtccctggctttgctcaggttctgacagtgtttttgttgtaaacatcttgtggggctccttcctttcagcctgcagctctgccctggtctttcaggtcttcatcctcatgactattgcagcaggctctagagtcacccttcaaatctggttttcgcttcccattttatctcgccttcttttaagcaatattatttttacaatttttattggcctcctattcagaagccttcagcagatgttccttaatttgtcacattcatggctgtctcccagggccatctagcccgccgctaatcatcctcttcccttgaattcccatcgtatcagcacaggataattttctcttaccagacatgccatggcccttcccttctccacgcctgctccttccctcctgctctgacatctctcatccatgacttaagaatgctgactgtagaccctgactctagaccacagtcacctccctctcctctgaactccttttagttttgattctctagggaaattgttggtttgttgaaagcagctgcctgcccagtgtgtcttgaacctgcacacagccaagcacatgtcaaacacttggaaaatttaatattcagtgattagtggctgatttattatctcttttggccttggtttttttttttttttttgctttttaattttttattacatattaaagaacattccatataagctctctgactgtgatgattgaatacttgttagaggcaaagccaagtaaaagtattaactctaatcctgttaaagactttcccattattacatgtgcttgagttttggcttctcttttgtgtgccttgagaacagggaccatctcattcatcttgtatacctcaaagtacctcacataaagacatccgggaatacatgtttgagtaaatgaataccctcctcattgaagaatagatcttaagtggtcatttcatgactgcttctatctaggcatttacatttgtgcctagtttgaaaccactttcattgcttgttacgaattaagcttattcacccaaactacagaaaggcttttaaaaattttttcctttggacaaaatttgtctcctgctcagtccttttctgcccataacagcattggccatcccctgcaatgattgtatttatttaacagttcttcctgcttccctgctatggcctttcagacttccccacaggcacagagcccccagacacctggcagggtaactatcagctgttctttgtatttggggcatataggggatctgtgtggctttggtttctcaatagaaaatgacataaacgcagaaatactttgcaggctgctacaggaacaaaggcaaacagacttgtttgtttgtttctgagaccaaacatttttctgccaatcaaaactggttttatttgcatatagtgtatcataaattgttgtaataattgaataattcccaaggcatgtactcttaggaaaaaaagaggaaaatagcttagaaataaaatgtggacaaaaagcataagctggtgaatgaaaaatgagaaatattgccatgtagtaaagatataatattgtgaagtctacccagtatcaaatgtatggtaaaaactagggaagaggctggcacagtggctcacacctgtaatcccagcactttgggaagccaaggcaggcagatcccttgaggtcaggagttcgagaccagcttggccaacatggcaaaaccctgtctgtaccaaaaatacaaaaattagcctggcgtggtggtgtgcatctgtaatattagctactcaggaggctgaggcgggagagtcacttgagcctgggaggcagaggttgcagtgagcagcgatcatgccactgcactccagcctgggtgacagagcaagattctgtctcaaaaacaaaacaaaacaaaaggggaagaaaaaatgtaagcaagttatagaggcaagaagttcaactatgtgagattatttgtgattatcccagatgtgactgggaagagatagaaaagtaacagtgttagttaaatctccatggattctttgcctccatgccaaatatcatgactatctaactaattactccccccgactcccagcttccccaccaccccgacactatcaccagatacacacagatacatactatgtctttgtatatgtaaaatgaaaatcattgcaggacatcatgcagtagcagtgtttttcatgaaaggctgtgagttacattggtctgaaagcaacacatccgtcatggctgttttcactggcgactttcttctgtctaatgtttgcaatgaaggcttggcttgaaaaggcttatgaattcttttagcacaacctttgttgggaaaatgaattacaagtggttcatttgatgctgatccttttgtcattgccatttatagctattctgtttattcactttgggagagccattctgagaattgatgaatgtgttttatgagagaatataagagccctgcaatttgttttgattggtctccatttggattcatagcgagcaggtgccatcgtttggaattggttttggcagtggcttggttatataaatattagatacatgaagtgaaacctcatttaaattattttcatcagtaagaataggagagctttacattgaatgtaagacaccatagttctatttttacagcttctaagcatacaaatgtgtaacataccatatgtctgaacatatgtatgtagaagtggcctccattgtacaaatatttaacatacagattttctgcatttctttgagagtttatgcaaatattctttaaaaaactctaagcctatagtttcttaatataagaattttttctggtctgaaaaatacaggcatttctgctttggaaactatgttaaggattgtttcagtttggtgttttttttgttgtttaagcctcagaaaataacccagcacattttaaacctttgctttctcctgctttttgttgttgttgttgttactgttgtttttgttgccaaacccacattaaaaaaaataccacgcctctttgtaagggctctagaagaagaactataatacttcctatcttcccagcaaaactgtttaccaggctgacgttttcctaagaatagctccctaggttttcatgaatccatataaatttccacacatttgttttttattctggcacaaaatttaagagggacttacgatcataggtggaaggagcaatgaggaagtctgttggtaaccctttaggtaacatcctaaacctcgggctacttgcgggcaaattgttaaaatgcaggactcatgatctctgagtacacccatgaaaatttaaatacccttcacggtgctgggtctttttgtaagcaagccaacacggtgcccagactcttttccaccctctagctctcaaccttatgtccccagcaaacggctctaagtccaatttcagtgttcttcataagtgaagctttccatgagccccacaggctgacttatgcagttcctcctccaaaaacccagagtaaaggacatgccacattgtaaattgtagccactgcaatgcctgtctctcctgctaataggattcctttgaagacgagtacctgtccttgtcattatggccccgggcctagcttactgcctgacatgttatgctccataaatgttcattgaatgaatgaaagagtgaatttatttggtgttaggtaataaaaatgaattcaaaagagcataaataaaacaaaaatgattgactttaacatgcaggtgtgaccaaggcccaaattatcttccaattgctttgtctttcgggaaatgcgctaggaaatgttaacatacacagcctgaatggcatgaaaatatttgaatatggctatcctattggaagcccaattcccatagggcaagttgcactcataatgaccaaataatcaatgagtcctctcctcattccaaagaggatttgaagtgaggccctacctaagaaacttggcagaggcaccaaaacaaaagcactatctaatggagttagcgcaattcataatcgaagagaagtggacagcagcagagatggacatgaaacccaggccttcggaggcctatcccagcgttcttccaattcattcttgttgcttcactttatcagtgtttaataaagtgtttgtttttatgggaagatgagtaaggactcgtggctagtgtcccttaacctcttgtgtctacagattggcctacttagttaagtgattaggtaattagcaattctcccacttatttggccatgtatgagaagcaaactcatctgtggcaaattaaaaatactgagttttatggccctagttggggaattagaggttgaaagggttgcttctgactcacatatggcccccaggcacaatatatctaaaactttcggtaactatagagttttaaaaagctcctctaccaccttttcaattaagacatgccctctgggttgaggcttactgatgtagaacaagttttataggaaaaaattatgtaaattaatataattggctaaccttttgattgcacttacaaattgaaaaatgcggtgcaatattgattagacaatcttctcattgtttttaagtaggagaaaacaagtaaaagagagaggtgtatggtggaaagagcattagttttgaagtcagacaaccctggatcaaatctcagccctaccacttgactggactccaggaaaatcatcccaagtcacaacctcgctcctctccttcctcctagacttaatgcaggggctgcagtagaccctgactacttggtagtgatctatttaagctcttaacggattcccagagctataacaatagaaacgtgtgtaccagttcctagcctacctcccaatccacatttccattgagaatcatgtttctcaggcttattcccctactgctttcccactttcattatactttctgttttgttttatggcccatcattgggtcgtttgtccttagagccattccttactcttcctgtgttctgtatcacagggaagtcatcccatataggatgcatttctcaggcttcctatgggctcagatgcttttcatgaggttggtctctgggagccatagacagggattggcgggtagaaggtagatgagaaaaaccaggatgttctcccccaacctgtgtgtcttaggtggcatctccaatagtgactgtcttctccatgcttctaaacatacccctcctactgcagttccaacttctgccagtcaacccccgtcctgatgttctgaccccagctgacctctgcttttgaggtctgttaacaccaccttctcttgtgcctgcagccctaaaagcaatagtggcatcatgttgattgtgatctgtttcatcaccatctcttgcttagcttttcagttcacccatcacttttataaccaattccatgtattaaatatcccctctttaatatacccaaagtggtttctgttttccctaatagaccctgaaagcaatcctgaagtgataaactctctttattgccttttctggtcacagtagcttagatgatcccaagcctgtgaagcgtgctgaaaatactgactccctaggtctaccacgcagaggtagtgattccctggtttcagtgtgtggccccagaagctgaattttcaaaaagcttccctggtggttgtaatgcccagcactgatttagagaatggcaaagccaggctgagatggaggtgcgtggggtgggaatggatggttgctaggttcattcaccaactaagggcgtcacttttacaaaccagcctcacagcaagagagcccagctcagcaaaattaaaatgactgcatcccatggactttataggacacttacaagtgtcaaaatagcacatgttaaattggggagtgccaacggattctttgaagaataaatgaaatcacatatgtggcagcatttcacacatcgtagttgctcaatacatgatcttcccttctctcaaattgagtgaaaacatagaactatagaaagctatgaaatagtataaattatttattccttaaggtcacagaatccagatactaaataccagaaataatagataagtaactacatagtcaaaaaaaagtcattgtctggcacatattattgctcactgagctggtgctaaacagtccaatcatatgacaccataggttagctctctttcatatcagaaataatttttgaaaataagttttaactaggactcttgtgtcagattacatagtaacatcttctaaggagacatgaaccttgtgagtatgtccttacttggccattggaatttctgcattccaggctcttgccagagactacaactttgagtactccactgtccaattcttatcaaaagactggttaggagaaataatattcatggaggactgcctgaaagatatgcagcctgttcattcctcattgagataacctaaattctatttgtggtttaagtcaggttatcacatagcttcctatttggatctccacgtatttacttcttgtcagtttctctttactggggaagatgaatgaaaaaaggcacatctatcattatggaattttgaacaatgttaaaagagaagaccctcagaggtttccagacagagaaaaccagcatgcttctagcgcagggagcatcagactaacatgaaactactcatctacaaagtgggaagtaagcagtaagcaatacagtatttacagagagatgggacaaaagacctgtgagccaagaatcctgcattggccaagagctctattcctacataagtgcaaaaggaagacatttctggacatggagttactcagactgggccatctacatgccacttctgagaattgaatcaggacataggtgtcaaggtaggaggagatgaagagccaaagagagagtgatgagcaatgaacgttgcaaaacttatggtcaagtctaaataaatgatcataatgtgactacgaagtccaaattgttcattaagatttcttaaagtggaagagacgtgttgactatgaggagatatttagtagcttagagtggagcaggcaatgaaagagtaaaaatattccaagtatctctacctatggacaagaaagagaaaagagatgtcatggattgggttctctggaagcaagcactggcacacagttttggttgcaagattcttagtaggaattaacacccgtgtattatgttccctagaaagatatgttgaagtcctaattttcagtacctgtgcatgtgaccttatttggaaatagggtctttgcaaatataatcaagttaagatgagttcatgagggtgagctctaacctagtataactggtgttcttataagaagaggaaaatgccacatgaagagggagacacatggagagaagcgctaaatggtgacagaggccagggctggagtaacacagtggcaagccaagggactccaagaaagatggctaccaccagaagctaaaaagtagcaaggaagaattcaatcgagtctcagagggagcatggccctgccagtactttattttggacttctagcctccagaactgtgggaaaataaatctctgtcatttgaagccacccagactgtcgtactttgtagcgacagccctaggaaactgataaaacctgtaaaaagatgagggaaggcgcacaaaatgaaagtcccacgcaagacacacaaagcctgggccaccttgatggggagctggaggaagagtgccaccgtgccactcagtcacaagaggtgactgccccaggaaggccatgacctaggctaaactggctccctgcagaggcatgcagtaaggcagtcttcccttcttacaggagatctgggtagctcatctccatgtctacacagcaagccgagcgaaaaaatgggcagcgaaaatagtgtatagtcattttgctttcttaattgaaaaacaggtttttaaatgatttaaaatcaaaaagataatatgagcaaaccagcaaagaaataatgagtaaaaataagtatagtaacaacaaatgtaattaatagtaaacaaaacattgttataggcattgcctttatttcctgaccaacatagttctggaatgtataaggcaaaaaaatgaagtagacatacaggagaacatggcaaaactataattatattagggaattttgatataattatttcataatttggccgggcacggtggccatgcctgtaatcccagcactttgggagactgaggcaggtggatcacttgagctcaggagtttgagacaagcctgggcaacatagtgtgagaccccatctctacaaaaaaatttaaaaaattagccaggtgtggtggcgtgcaccggtaatcccagctactcaggaggctgaggtgggaggatcgcttgagcccaggtggtggaggttgcagtgagccgagatcatgccacttcactccagcctgagcaacagagccagaccctgtctcaaaaaaattaataataataattatttcataatttgacaaagtagacaaataatgatacaggttcgtatttgtatatagtgtttataccctaaaaacacagaatctgcatttttctcttttgtctatagaaggtttacaaaaatctatttctatggccacaggaaaaaactaaatgaatttgcggagaaaagctattttactcatccccttttttatcccactgtgataaaacaaaaaattgacagtgaaataataataataagtaaaatgtaaatgcttgaaattaagaagccttcttatagatgattcctggatcaaattgaaaatcaaatacaaaatgacaaattctctggaagttaattaaaaagaacatttcacatcaaaacttatgaagaaattgttaatgcatttaggaatactttatagcctaaatgcttttggtactattaaaaaaaaaaagagtgaaaaataagctaaatattgcatctaagaaatttttttaagaatcagaagaaagaaggtattattaatgacgaaagctaaaattaatgtaattggcctcaaaacaattaaaaggagagaatctgactaatgaaaatatgtatataatataaagaatgtacatatacacatgcaacattaggaatgaggaaaaaaaattgcccagatcccggaaggattaaaataagtcaataagacaatgttatgttcaggtttatggcaataaaatttgaaatctagaggaaattgatgtttttctaataaactataaattaccaaaatttgattcaaagaaaggttataaatcccgagaggagttataaacagaaaaaaacgtgagtgcgtataaagaaagccttccaattttatgaaaagtataaattctttcataccaaaaactgataaagatggccacaacggttgttcaatatcacttatgaaaatatgcttttaagaagattaagaaatcaaatcaaagatttattctagaaacataaggatttttaattttatatttttatatttctagaaatataaggatttatatttcactttatttaaaagagtgacaaatgaaaatatccaggagtgaatttagtaagacataagacaaattttaaaaaaagattgtagtgaaagacaaactaacatttgaagaagtagagagctatactatcttttcaaatgagaaaacttatgatcctaaagataaaaattgttctaaaataactatatataatcccagtcagaatcccaacttggaagataaaagtgttgtcagctcagtcaacacgatttttttgtttgtttgttttttgttttttcgagacagagtttcattcttgtcgtccaggctggagtgcaatggcccgatctcggctcactacatcctctgcctcccaggttcaagcaattctcctgcctcagcctcccgagtagctgggattacaggcacctgccaccccacccagctagtttttgtatttttggtagagacagggtttcaccataatggccaggctggtctcgaactcctgacctcaggtgatccgcccacctccggctcccaaagtgctggaattacaagcgtgagccactgcacccagcccaatcaacatgtttttaaaggccacataaaaatataaatgcaagaaaatttccaaacttgaaggaaaaacagtcagcatggggaagtcgtgccagcaggcatcaaagcatactatcatgttactgcattttaagcaatatggcattagcttaggaatccacaagtcaatgtttggaacagagtagatgccataactaaatcaatgtatataggaaaacttaatgtatgctaaaggtggcttgtctttctggtaaggaaaatatcattaagtaaatgatttgggggcaattaggtgtccatctggggcaatattccatttggattagattccatttgaagtaagagctaatattaaagatggacccataaagctatcaagagaaaatatgggagaatacatgtataacatcaggttagggggagctctctttcataatccatcttccaaaaaggaaaaattgcaagatagtaaatttataatccataaaggaaaaattggcagatttgactgtgtaaaaatttaaaatgtctatgacaagacacaataaataaaggcaaaagaagaataatacttgcaacctctaggacagagctaatgtttaaaatactaagaggtctcacaaattgtttataaaagaaagataaaacagcccagtataaaaatagtcaaagggcatgaactggaattgtaaatcaccaataaacctgtgaaaagaatcagccccgttagtagtgagagaaggcgaattaaaaccagagatgcctatcaggtgagcaaacacttttaaagatggcgaacaccagtgctgatcagtgtgtcaataagcaggcactcaccatgcacatttgggctgattgcttcaacctttgcaccggaaagaaatgtagcaatagtcattcaaatagttaacatgcttattatgtttggccccacagttattccacttctaggattctttcccacaaaaataaaagtactagaacattaaagatgtttgaataagactgtttattcctgctctggttaaggtagccaaatttggaaacagtctgcatgttcatccacagaagagtgattggttaaacaatggtatgtccatcttgtgaatatatgcagttatttttaaatgagatagatatatagatttttaaaatattttgataagagcaagtggcagaaataaatgtgtgtgtgaaaaagcatagggaagattttgaaaggctataaaacaaacagactgtttatattggctatcgcacggtgggggagataagacctcattctttttttttttttttttttttttttaagagacagagtctcactatgttgcccaggctggtctcaaattcctggcctcaagcaacccttctaccttagcctcccaaagtgctacgattacaggcgtgagccaccatgcctagcctaattcctttttactttatacctctctacatttttaaattgattacaataagcaagtatctcttctgtataaaacataattatagcacaacagcttttttgaacttttctttgaagttgtgtcatctaatcaacccttatggaaatcacaggtagtttatcatagggataatattgaaaaattgtccacatgtcacatggtgtcacctctgtgaagatccataggagaaatttccactccagcttgaatctccagatacctgtggttcatttgagcaactgctttgcttttatcttttgcgcattgtgcatctggtaactgatcgtattttcctttcctctggaaaccaggaatctcagagtcaagttgtagactgtaaagtttattcaacaaccataccagactctgtggcttatgttctatgcacagcccttgctgatggaatcatcttgctctccatgtttattttccctcacccacattccttcctttgttttaattttaactgcttatgttgcatgtatccctatagctacctctgatcttttttgggagatgtagtagggatatgaataaatgatgaccagaaatttctattttaacagaaacctggcaaagaaaacggtctcgacaatgagtaggccacccatcactactaactacagatgacttgccatttcatttacaaaggtaaggaaataaagtctgtatttttaattaattctgatcaaatcagtatagagcccttacctttttattgtaaatatttttacaaatattctaaaacatatatctagctcataacctttaactctgacatcaaatttgaataaaacatcaagcaaacagaaacaagaaattttatgaattttggcatgccagaagggttaaaaaaaaaaccgagatgtggtctctgttgttaattactatgtgtgttaaatttttaaatagtattttccttatttttaagtgtagcagtgttcactgtagaatacttggagaatctaacaaaatataaaaatgaaaacctaaagcatttataatcccatcatctgtagataatcaccagaacttctgagaatgtctttcctccttccttttatgtgtacatggaaaatacacatgattataacttcaaaaaaaatttttagagacgatgtctcgctgtgtctttcaggtgaaattcatataacataaaattagccatttaaaaatgaacaattcagtgttcatttttagtacagtttagtacatttacaatgttatgcaaccactacctctatgcagttccaaaacatctgcatcaccccaaaaggaaactcagtgcagtcagcccttggtatctgcgggagattgattctaggacctgtggataccaaaatatactcaagtcccttatctaaaatgacacagtatttgcttttgtttctctttttgagacaggctcttcctttattgcccaggctggagtgcagtggtgcgatcatggctcactgcagcctcaaactcctgggctcaagcaatcctcccacctcagcctcctgtgtagctgggaaaataggtgcaagacattgaacctggctaattttttattttttatagagatgagttctcactgtttttcccaggctggtctcatactactggcctaaagcaatcatcccatcctggcgtcccaaagtgctgtgattacgggtgtgagccacaatgcccaacgtaattatataatgttttttaaaacaatgttttgaattcatacttaccttgacttcattagttacagatgatgtggtgcagaagcatagcaagtctaagaagaaacagtagtcatcattgtgaccattgtaatggccctttgcagtttaccagtacatccccaagcatcttatttgtccctgctacatggcctctccgactccaatgcccctggttaataggtttatgtgacctttgttaaacatcactctacaggaaaaataaatgaataactcttgaatccagatgatagttcatggccttcgtttatcattattttatgttttgtgctgcttaaaaggaagtgttttaaaaaaaaatagaagtttacctgtttttctcctcctcttccctactgtcaagtcagggatgattcacaaagtaataaaaagtactttaagaccatctcatcctccgtccttcattcatgccagttagttaacctctcattaaggttgtttttttaagcacccttcagagttgctcttgtagttttttggttttaaaagctgcaaagtcttaaaagtgaaattactggaatggcattctttagggaggtcttcattctgttggctctgttaaacagttgaaggcctgtattttaccctgagcctgatacataaaccattttaattcttctggcatttttattcaaaactgacctaatatgattataaagagactagaaaaatgaattattctttaagtcaatttaagctgatacagcatggaaaacaatagtttgtgaaacatctgtcctggaagactctattctaacacggacagattaaatagatgcaaatagaattgcaaaattatgtaagagggtggtttgattggtgggcagtactagatctagtgaggttggctcaccgtgattcttgcgtttattttcctggatggtttttagtcatatcaagctcatggcagtgtgggtaaactcagtcacttagttccaaggcacagaaatggttgatgaatccctaggtttagcatatgccgtgtttattaaaagcccagaatttaaagcatgcttcaaaagcgtaaaagaaagtcagaaattttacccttccttggtgtattaaatgttctgcatgcagtttaaggtaagacccttaaattatggttccctaattatgaagttatccttgtttaccacagaagtagcataactggctttaaaaattcagatgaattataggtcacatgtgaaaatcttatcattaggaagagagagaaacacatttgaagatcagatctcccaatgaaaaaacatattttatcttaaggcattagaattcacaaagatacgcaatagttttgagtgtgtaaaaatgtaaacttctctatatcataattatgaaacaagttaaaaggacacggtaagctgggcacagtgcctcatgcctataatcccagcactttgggaggccaaggcaggaggattgcttgagcttaggagttcgagaccagcctgggcagcatggcaaaaccctgtctctaacaaaataattacaaaaaattagtcccagctacttgggaggctgaggtgggaggattgtctgagcctgggaggtcgaggctgcagtgagctgtgatggcaccactgtactccagcctgagtgataaagtgagaccctgtctcaaaaacaaacaaaaaggcagatactaacacagaagaatattaataatgcacttggcaagcaattaatgaccttaaaacataaaaataagcaaaccactagtatgaataaccataataggtaaaaatcaatatcagaaacattaagacctccatagataaatggacgaaacaatggaagactcgaagaaatacaaagaactaaaactgatgtgaaaacaatgttaaccttcaccagtaattttcacagatgcaaattaaaaccaggagatgatttcttttacctgtcagattagcaaagctgtttaagatgataacagtcattactaaatgtgtaatgaaacaagcccccactcactgctgatagcagtgtgaatgagtatactcttctggaaataaatttaccaatatgtagtaaaagctttaaattttttaataccctagtatgccctagcagttccaagaattgagtccaagaaaacattgaagttagataaagatataagcataaaataattattgtactatttgcaggagcaaaactctttgagctgcctcaactatccttcaatattagcattgactaaagtattaacacacagtggtgtccacacagtggtatatcttgcaactagaaaaaaattattcttacaaagatatttttgtaatcaaatgggaaaatgtttattacataaatgttcagtgaaaaatactgggtaagatagtattgtaagttttttcatatgaaaatacacataataaaaggtagaaataaatatgacaaaatgtgaatagaggagttgcccaagggtagtagaattgagtaatttttttgttctgactcatattttttggtacttcccagataattttacagtgagcatgcataaccagaagaaaagttttttaaaaggctatgtagcctgggcacggtggcacatgcctataatctcagttactcgagaggctgagatgggaggactgcttgaactgaagagtttgaggctgcagtgagccatgatcacaccactgcattccaattccagcctgggtgatagagtgaaaccccatctctaaaaaaaaaaagctttgtagaaagaaacttatacacatgtacatgctttcttagagcatatgggataaaatatattacgaaaatgttttagatttatttttgaaagattaaggaatgcagatttcttttttagtattctgaaatgtttctgtcttccttaggaacaacagcaatagcaataacaaaaacatacttaactaaaatagatcctttggttagcaatattattaatatattgtatttcagagtaacattgaagttcaaagggcagtgtgtttctcttgtagatgtcttctgctgctgaaaatggagaggcagcacctggaaaacaaaatgaagaaaaaacctataaaaaggtgagtgtgcattttattttctaaagaggaacaccgttttgctgtttggcacgtgaatattatcaaaggcctttccttctcccaagcagttgtaagttactatcttagtttccagttgctgctataactaattactgcaaatttagtggcttagacaacatacatgcattatcttatagttcagtgagtcagaagcctgacatgggtctccctgggctgagatccatgtgtttgcagagctgtattccttcctggacactccaggggagagtccacttccttgtcttttccggcttctagaggctccctgcgtgccctgtgtcatggctccctgccatcttcaaagccagcaatggccggtggcgtctttcccaggctgtatcactctgacactttaaagggcctgtgtgattgcattgagccctcctaggctcacagaaatatgggaaaatattaataaaaattaatattctttatctaaaaggtcagctgattagcaacgttaatttcctctgcaacttgaattcatttttgccttagaaggtgacatattcacaggtcccaaggattagagcatgggaatctttgggggtcaattcaccataatatagaatattgagtgaagagagttgtttgaagacccttcttattcctaagaagaaggctcctgagggcatgcagtgttctgtgtataatatatgaatcctttaatggactcactactttccaccaacatttaaaacatttcctacctttgtattttaaaacttttaaaatgtgagatgctcctcttccccaccttttctaagccgctcagattttatgtcttcagcccatttcacaaaaagtctttttccagacttcctaatgtatcttaacttaccagtctttgataaattctcgactcccagctaccaagctaatgttcaaacacgttactgggtaaaatatgttcccaagcacctctactcctgattataaattgactatacattttagcttttcaaagttcttgctattttgccctcttaagagtaggaggtttgtgtattgaaggtttattatttcttaatttttccttttatactttgatggacagcctgcaagacgtttagtcataaagtacatgagctatgggctctgaccacatattcaggtcatggaactagcatgatgtattttctattccattttcatatgggagaatgtgccctttttcctggcatatcttctttatctgatttttccactcagccaaaccttgaaatacaaactgggaggttgtcattcaaagtgatggtgtggttggaaaagagttgggtaaagattcaagagctcagaagtgccgcagtatattttataaaatttgtacattgggccagaggcaacaatacactattatttatttttagacacaagtgaaaaaccaaatcctgtctcgtttacccaagattccgtgtacattcattcaagcatggaccaacacagagatgattacgttgctagcctgttattacttcagatcagtttcaggtggtattctcaatcagcatcaagatgcactgaaattcttgaccaaattctgactcacaggagatcctttgtcgctgcaaaagttatagaaaaaatgtgaccatgacatctcagagtttgctaagtgtaccctgcccaagaatttatttagtcaagcaggttttcaataattagtataggtaattctatgattaatgtctccagtaggatatttaactcagcaatgttttttaggttgtaaaaactaaaaatcaaattctatggtaggagaaataaggaaagacacagaaaacctaaggggaccagaaattttttttaatgaacaattttttatgtgtaataatatcaggatcttattaatgatttctggttttaaaaagtataagcaatggaaggagatgtacgtagcctctcttaaaaagcaccaagaagaccagcacagcacttagaacttcagcccttaataaatatggtattgatatgaatagcaagaagaaggaatcgcttagagagagtgttgttttactggcaggtaaaagctcagctgaattattcggtttagttctctgatcttcaaactagagaaggtgttcatggtggacttaggagttagctattgcaaatgtgtttatctccaggtccagataaaccatttcccagatgaaagaacttaaagctagaataggaaaacctctgaatgtgagctttaaatgaatttcagaatgggaaaattgtcagaaaacaggacataagcaaatattattcttattttcaaaaatgaggaagagtacattctggaaaccagattataagtgagacattattccccagtataatttgagcattattattaaacatatggtttatacatatttagagaagaaacatatcttttacaaacctggagaaattcataaagatgtagtttatttcaaactaactgcatttcctattttgagagagtcattaaattactcataaagagtatgttcaaatttaatgagtcttgatttaaaggtgtctaaaagattcgctagtctcctttcagacaaggtggataagtatgggttaaatattatgtttattgtgtttgtatctggttggactgatggtctcgaaaactggcaattttgctccctgttcactcggtttccaccagcatgatgcatgagttggccctgggtagcttaccatgttcacccatgaccttaatgaaagcataaaagcagtgctttgcaaatgcaaatgacaaaaaaattgtaaatgatagcaaacagactacacaagtgttgtcaaggccaccatacatcttattccctttacaaataccttaaatttctttcccagtcctgaagccctgatcataaggtatgcacagatttactaagaagctttgatgacccattgtgtttttgcattgactgaagccagtccatggatcccaggttaaggcccctggtcctttatgctaggagtgagaaatataccacaggagtttataagtagctcacagtggagtgggagaggcaagacatgaaaacagttttagaacacagtagtctataatgaggagttcaaaagggaagaaaccaatgttgttagaattaagcagcaggtttaggctttctgtatggagccccagatttactgggcagctgccagtaacattcagcgtcatgagtgctatgatttccacgtgttattagggaacactcagtgttcatgggacaactttacactttgcgtctcagctatttgcatgtgattattgaggctggctgccttttgtcttgcagttgaccatttcctgaatccattctcagttcttggcaagcccgggaagaacagctaacattggtccgtgaggttaataatgtcttcagctaatggctaaaataagaagtttgattttagctgcataaaacaaacaagttgcccattaagacaggcattaaaggctgcctggctatatttacagagtggagtatttccattatcagttaatttattgagtgctttccgcaagagttgtaaatgcagaagcctactggggccaggcagcaaagaagggagtgagaaaacgaggggaccatggtaaacagaacccacgccttccttaaaaggggcagcaggcagtcagctctagccaacagagctatgaatgaatgctcgcccagggttgccagatactctgatgtttttcaagaaaagagagatgaagattttgatatgaaatctgccatttttaaataacagcaactaattcaaatgtttttaaaaatacactctgggcaaaacagtttgcctgcaggccctatctgtcccgtaggcagtggccagtttacaacctctgacctccctgttggtgtaaaaaagtgagaagaaaaaaggaggatgcaaaagaagtgtaagaacttgtctctgcctcccctgaccttacaacttatttgggagaaaaaagagggacccacatgaaaaaattaaatcttgacccaaatcggtgttgagtaagtgccaagacaagtggtatttctcttttatttttatttttttgagatggagtctcactctatcgcccaggctggagtgcagtggcacaatcttggctcactgcaacctctgcctcccgggttcaagcgattctcctgcctcagcctcccgagtagctgggactacaggtgcatgccgccacgcctggctaattttttgtattttagttgagatggggtttcaccatgttgcccagactgatctcgaactcctgagctcaggcaatcgacccacctcggcctcccagagtgctgggattacaggtgtgagccactgggcccggccaaaaattccactttttaagtgactgtgcattctgatttacctacgtgtttgtcttgatgtcagggagtccaatgagcacaggcacagaaacagggaggagcatgatttgttggcattacaggagaggctggcctggacaaagctaagtggtggtgtctggggaaagtagtaggcagttttggaagtatgggctggctctaaatgacagctacccttgggtgctggtttgaggtgtttggattttatgttctaggccagtgttgttcaacggaacttcccgcaatgatggaaatgttctataatttgcaccaatgcggtagccacaagctatgtgtggctatagggcatttgaaatgtggccagtgtgtctgagaactgtaatttttaatcttaattttagttaaatttaaacttaaataagcacacgtggctgatgactgccatgctggggagtgcagttttcaggcggtgatgtactgtaacattgttgtaggggctagtgacaaatgaaaggcctgtgcaaagccagtggcagagcacaagttgtacagggttgagggagatgacacgggaaggcttttgtgttagttgagcaacaaagttgggtgcaaagttgagtaggaaaagatgtggggaatatttttgaaaagaaaattacatttccaatcagtgcgactaccagaagttttctgccattggtggaactagggaagtttgggaaagagtattgtgttattttgggattttgtttgtttgttgtttaaaaaggcaagagacctaaaaggaagcaggaggcgcagggcacgagtttacttgaaagaggatggtctcaatgcaagtcaaatactgatgctagacattcaagttttgtctgttttatatgtgaagaaatgacccagccccacctctccaaaacaaacagatgtcagggtggttcagtgacatatgccaggttaccttgcagttctttgttaggaagatgattagaagctccagtcacatgatgtcccatgttgtcatttgtccgttggactgggtcagtgtttcccaacaccagggccttgactgtcatgggaaacgtgcactgccatttgcctttcttcttgtctcacctcttcaccctgaggttgtcgttctaggcccctcaccccttcctcttctgtttctcctgcctttctgggcctgcccacaataggcctccactgggagattctggttttgatgaccgcaggctgccgtggggtcagaggccacctgcctgtggcaccgaggcctcgcctacagtgtgcagagtctttttagctggttttcactgtgacgggcacacgtgctcacagcattcagaaagctccattgggaaactgaccagaccaggacacctacaggatccttgacccaaatgcccagtttttttcactttgttttatctttgaagaccttggttgttgcttcattccagtgtctgagacagtttcctatcagtggaggcaggcagcggtgaggaaggaggaaatagtacctgaccgtgaccacattccaaggaaagatgccttttattgctttttcaccatgagtaagataatagctcagagacactttgatctaaaaggaagtatttctttaaatacagggtcttttataaaatgtttctgacagctggtaacactgtctgtctccagggagaaccgggtagtagggtccttagttggtgggaaacttctctgtgtaaacctttctatggccgagcatggtggctcggtggctctatggctgggcacggtggattatgcctgtaatcccagcacttcgggaggccgagatgggtggatcacctgaggtcagaagttggagaccagcctggccaacatggtgaaaccccatctctactaaaaatacaaaaatttgctgggcacggtggtgcaagcctgtgatcccagctgcttgggaggctgacacaggagaatcacttgagcctggaaggcagaggttgcagtgagccgagatcacgccactgcactccagcctgggcgacagagcaagactctggctcaaaaaataagtaaataatacatctttctatgcatatttaattttgaactatgtgaaggtaataccagttcaaaaattgaacaaataacgtttcaggattttggagggaagaggggctggagtgtgttctctgtcctgaccattcttcttttccttcagattctggaaagccaccacttccataaaacaagcaaactcgtttgtgctaagcagcagttgtcatgaatagcagctatgctggtctctaggatgaatgaccctttggtattctaagtgtgattcctaatccaccttaatccaaaataccctaacctgctggttctcaaccagcaattctgcctccaccccccaggaagatttggcaatatctggacatatttttagttgttacaaagtgagggctggcgctactggcttctaggagatagaggtcaaggatgctgcgtcttatgatgcagaggatggacccccaaaacaaagaattatctaaacgttgttagtgccaaggctgagaagccttgttcaaatcaaactaccctttttaagaggagggcggatgtgagtccagctcttccagatactggttgataactgtaggcatttttcctagttgttgtgaaccttaatttttctcattgataaaatgtaattaattaatatctacccaagctggcttatagtgctgtgaggatcaaacagtttaacagacttgagcaaatactgggaaaagtagcatactaatgagtgaagtcactgttttgatgagcaagaatgcagtccctgagcctctgatttccagattagttctatggggacggagcactggattcccggggagaagggttacttagtctcctgggggtagctgcagtcaagcctgggcatgggaggtgagctgacagtactggggcatgatgctgtatgcgtcccaacagcaacaggtgtttaaaatcagagagaaagatgtgctcttactagtaaacgggtgccgctgtgctgaagcctaggcaacagagcaagaccccatctcaaaaaaaaaaatagtaaactgctgttgtgtttttaaaaattaagcagcaaggaggtgagctgcatcatttacagagggaacattttttaaataattccgttacacttagaagcatgtgtaatcatatcacgttaccatgcaccccccgccctgtcagatcacccctccaaacacttgtgcttctgtctccttcctcactaagtactaaagcaggtgattgcaagtctgcctttatgagttttaagcaggacattacagataattaagcaaaaagaattggcagcttcagattaaaacagctgagcgagccaaccctctcattattagcctgttgccctgaatggttcattctgaagtgacctctttcagcattcgctttggagggggcctccatatgttaagttacccaggtttgttgtacttctgccttctgattaactgtagactctctgtgttttggtccctaataccaataaacgtcacattgctgtctctaaaacgcgaactataggaaatcgtattctacacccaaaacttcctgcacggcttccttcactggcaaaaaaaccccacagtgttgttgagtttggtgtgaatggcaggcgaggaggttggggtgttcagtgttactgcagccagtggggccgtctgaactgtggcccatgttctcagggcacaacgatgcttttgtttttcaattaaaaggcttaatataagcaggtgttcactcgcttccctgcacagctcagccaacctggttccgatctggccagcaggccccctttccctgaggcctgtggctcatccactttcaccactcactacctgccctcctttgcctgagcacataaaagagattttttttaaggtggctcttaagaagttgcaaaaggacatgaaaatttaaaattctaaagttctctgttctgaatttgggaaaagataacagcaatgtaatttaggttctagtcttacatctactcaatagtcgtagggaacataccttgtgcttattcagagtttttgctgttttatggagttagaatcattggctgatggaagaatgttatcaaatatattgagtttattttaaccagaagcctactaattcagtgaattgaagcctaattattaccaatcaaaagcaattttaaaagcaatgctaataatagagttaacataagtgcttagtgcatgcccgctatcattctaagcactttagaaaatacatttaatcttcctaacaaccttatgaggttatactattacgaccattttacagatgagaaaacaggtacagagaggttaattaaatgctccagggcataaagcaagtatgtggcagaataagtctgggattttaaccccaactgcctttcttcaggatctgtaagaccctacccactgcattattgtctgaatgctgtggtgtctggagggcagtgctgctcaagacattaaaacagtgattctcaattatctgcaatagtagcaggggtcagtaagataaactcagacagctttggaatgggaacaaattaatagaatttaactttttttttttgacggagttttgctcttgttgcccaggctggagtgcagtggtgtgatctcagctcactgcaacctccgctgcccgggttcaagccactctcctgcctcagcctcctgagtagctgggattacaggtgcccaccaccacgcccagctaattttttttatttttagtagagacagagtttcgccatgttgtccagcctggtctcgaactcctgacctcaggtgatccacctgccttggcctcccaaactgctaagattacaggcgtgagccacgccccaactagaatttaacaattttaaaatgttttccctgattcattggttccaaagccatttttctcatcaaagtgtatctcacttctgaacacagaatctgaactgtagcctcaagaataactttttctagaaagtatgtagtgattttaaagtgaaaaacaaaaaaatcccttgggcactgtgcataacactagaaatgggaagatgactaaagtgatcatttcaaaaattatccctgagtgcagaactcaaaattgacagtaaaggatgagatccacttgacagtggtgacatatcttggattgtcaagttaggagaagaacacattttaaaacctaactggcagttctgtagactgtcacagaaagagtcacaactcaataataatcttctcaatcacttaaaaacatctggtaaagaaagcattagctaggaggatgactattttgaaagtcattttcctctatgggaatccagttctcccaaatggtacactgtattttctggcaagttctgtttactgtctggtcctgtgtcagctgcttttattatgccagagaaaggaatatgtggcagctcagtcctctgcatgaaagaggcaacccttcaacatatcattaaggaaggaaaagaagatgggccgtgggctctgtgggggctgtgaaattaagattctcagtcctctatctgttctgcccaacttctgacatgcacgtacacccagacacccagagacagaaattgggttcaattactaggagacttctaaactattcatgaggtcttgctgcagttctttccagcagagttgatgagctactcttcctcttaaatcagtgttttctgctcatccaagatgcactgctgtctacttcattgcagatcaggaatcgtttggttattgagcacagggctgaaatgtagactgtctgggtaacattctaattttcctgagctaagttttcatattgtgaccttgccatttttatgggtgtgcttagtgcctagaatgtatgacatacatttgacttacgtccatgtactcattcatttctccagttgacaagtatttatttagcttggcatggtgctaggccttaaggggtggaacagaggccaagacagacatagtccctgcccctaataatgctttcattgtcatggtacagacagatgagaaagagtatgcacaatcaaataattactaacttttaaagtactatgaagaaaataaagataggcaaaggtactgctgccttttagataaggtattcaggggaccctccctaaggaggcagcacaggggctgggatcgcgagtgtgtgaaggaggcagtcaagataagagtggacgaaagagtgtgcttggcagagagaatggcctttgccaagccctgaggcaggaaggagcttggtggattcaaggaactgaggtggaggccagtgtgatgcaaggttctgagcagggaagagtggccgagtagcgtgacagcagcggttcccaatgggggcagatttgtcccccaggagacattagacagtgctgtcagaactgaggggagtaggtgctactggtaggaggccagggacactgcccccccaccccccgacaacaaatactcatcagccccaagtgtcaatagtgctaagttgagaagccctgagttagagaaataggcagcagcctagacaaaggttgtggactagaggagaaagaagaaaacaagtttgagattcatttcagagttgatattgactggacggggccatggttggatgtgggggtgagggcatggtaggaatgattgatcccaggattctaatttgagcacctgggtggatgctgtgaccatctgttgagacagagatgaatggtaggggggaaacaagtcttccaatttggacatgtgagtttgagaatgtcagagaggcaagtgggtggctggacatggacttgggactcaaggaagaggtctggggctcagcttcaatttgtcaaattgcagatgcataggcattggtgaaatagatggagaagagaggcctcaggaagggggaacatccatattttgatgttgcctcctaagatccttttccacagttatattcctaaaatacacaaagctggccaagtcactgccttattatcttccattggccttctggtaccttcagaaaatatccatgctccatagcgtggcatgtgagtccttcacagccatccccattgggtgggtcttgaccatctcctgccattatcttggacacgcacctaactgcggccgcactgaatgctgcaccttcctcttttccatccccattccttcccacgcaagctgatcactctgtgatgtcttcattccagaaacagctctatcattgcctttgtccaccctcccaggcagtggctgtcagtcaccctccccagcctccctcagcaccctgcacttaaccctgttatgacacaggtgactttgttttgtaataattgttggcagttatgtcctgccaactgcactgtgagtggctggggagcaggagccttgcccaattattttgacatccagagggtcccacgcagcgtctggtacagcatccaaaggatgtatcacttttttcttcttaattctaagattgttatagattttccaaagagatatgttcttgagcctacagttctggaggtgcaattagaggtgaaatatggggcggggctggggggctgaagagggatagaatttgtactgtggatgttcacagaaagaacactttgaaggtgctcagttccattcccttggctttttctgtttcaaaatggtagtgattacctgagttgtgggtcactgtacaggcatttgaaagttggctcttaatgatgtggcatcctgaagtcccctcatctgtagtctacagatggcttgtgatcagctgttcctggaagaacttcagcaatgaattttaaaaggcagtctttttccaacactgtcacttaaaggttctattctttccagatgttggctcaattaaaggcagcccttagatgacagtaacttgtcaggggaggtcaggatttgggatcgtttggcagcccatttctccagaacaaacatcatagtcaatgcccttttctttgtaacatgaaagaaacaagatcaatgattgttcaggtttgctatttcaaagagagtgagagggaacaatagcctagcagttttaaaatcaactgtatccctctcaaaatcatagaggagtgtagactttatagctgcacttaggacccagaaacaggcattgatgagaacagacagaacattggaccttactctccgtcttccttcctcaccagcagtggactgagaagggagtgtgtggccagggccatcaggctggctgtgccattgatgagctcatccttgtgcaagacaatggctgagcatagaaatattatagtatggcttgagtattaaatctaacactgtatgagaaggtaccaggaagatggtaattggctgtacaaatatcaaattgctactattgatgctggctccccacctactcccaatggaatttaagccctatgagaatggggacttggcagtccaggtattactagaattcaatacttagtgaaggccccaataatactgccacctactccatattgggatactgttcaaagtatggaattggaaatttcaaacccattccaattgcagattgggaccccattctccttctgtggtagtccttattattgactattgaaggtggaaggttgtttcaaaaagcagtggaattctgtggcaaaaggaaatctaaccttcatggattaaagacacctttttaaaaagcctgtgcctagaaagtgaattttttttttttttttgctttccgtcatattaaataaaaacgacaaattttctgttgtagctttaccatctctcagtgtctgatttagtttgaggaagctatattgggcttcaagaaccctttttcctcatctgtctctgactacacattcaaactgttcttcctgggacaatagagtttttctgggcagaagcaagtgccaccctcttgaaggacagagagtacagtagaatggggtgagggtgtatggttgaagacagtagggtaagggaaggtgggagtgggcagacaacatctaaaacccgttcatgggttttaaagaaaatcatgaacaaactaagctgcacaatcagcatagtccctcgccccaggttatttctttatttttaacttatttattaattattctaatcttggagacaagtctgttctcccattcctgacccccaacccagtgttctttggaatatttgatttggatataactttaagattacaaattagaggggttttaaagttgtaaatacaaaagagatttaaagcggtaaagtttcatttgagaacaaaatcaaaggatggagtcttctgagattctgcttcataaaaaacaaaacaagaccctgttttccaaggaagtattcaatgtaataaaaacatcaaacgtttccatttcctttggaatttggggtatgccaactcaagctgcattgatgtttatctctatgctttttattcattttttggagaaattttgtttttagcatatgggatatgtacacacatacatctacacacacacacacatatgtatagcttatttttaagtgtgcattttttttgtttttttttattatgagggtcctgaattgcttcagatgagttaatagatgggtgggaagaaactacactttatgataaagctcctgatttacctggtcaagggaaggctgtcttaccagaagccaggtggccatgccgagcagatgcagcatgtctcaggcatcccttggccctcagagtccctagtggggacacacagtggctggtatacaaagcagagtctggtcaaatctggggcaccaggccgaagccctttcccctcaggcttccatttccatgagagaggaatttaaacccacagtctactcctggaataggaaatgttacagacatccatgcccttcctgcttattgacccaaattcagccttagcgaggtcacttgggccggaaagcgttcagcacccagatggcctggaacagtatctttgtttccagctttccagcctcagaatgcctgtctccccacatgttctccctcagtagataaatctgggcacctgtttgtgttaggcagggatacagcagtgaacacaaggaacttggcccatgacctcaggaaaccaagttaaggggttctgtgcattttagcactttactaaattacctttaaaaatggttatcccatcttagacgtccccccgctaattaggggagccctgtttttccgagtcctcaagagtactaagcactgctcctttaaaaatgttttaacagctagataggtgaaaatgccttagttttcactttaatttgcattattattgtaagttagactttttcagatgatttttattgatttatgtgtattattatttatgaataccctttgctgtctgatttgtaagcactaatatatttagggccttgcatttttgttgcagatgcttttccattcttaaattagacttttacttttccttactttgtgttttttttttttttttttgacccaagcttttatatagtcaaatttgttaatagttcccttaaggcttttatctttgctcttattttgtaattttgtgctagtaatgccttgctttaattttaataatttgtaatgcaagacttcccatggtattcttaattttcaaaaatttcttagtgatgtttttacattttttccctctaattgaactttagaattataaggtcactatctctaaaaaaatttctattgtgatttttgttgaaattatattaaattaatgaattcagaaagaagcatctttaaacttgtatttttccttccaagaatgaaatgtttatgtatttattgtcttttatgctcctcagtaaacttttattttcttcatagattttatacctatttttagttgaatatatgtctgtgtaacttatgtggggttttttgttattaatgttttgaggttttttttttcttttgcgcatgggatttttttttccattacattttctgactggggatacgttagatcttgatttatgtgagtttattttgtaaactgacaacctgttttttttttaactattctactcggttcatgactgattcttgggtattctaggtagcaatcatataatgtgtaaattatcatttttctccttctaaccaatattttgtaattggcttgtcttattaatttgatattcaaaaacagtatcaaagaattcttgtgataacagcacagccttgtcttacttgtgttttaaaaaacaaatgcctcttgtactgtttccaagagtgcattctttgtacacacaagttattaatagatacataaataaaaatcccttggtcacgtacatttgggaagtgtcactctagtgcttccattagtatactgttgtcttttagcttgaaacattattttctgcattaagaaagtttttttctgcctccaattttactaaaacttttttaaaaatcataattgaagggagaggaagggaggggagcaagggttgaaaaaactattgaatactgtactcagtaatggggtgacaggattgattgcaccccaaacctcagcatcgcacattatacctggtaacaaacctgcacttgtacccctgaatctaaaataaaacttgaaataaattttttaattaattaactaaaatctttattgaatattggctttttcatataatttaagctgaccatggaaaggcaattattgtaaacacagttagctttttgagatactccaagtactagcaaataataaaatcatgtttctcttaaaatattatttaattcagattttatatcagtttagatgaatgggatcattttatttccttatagtttggagaatgtcttaaaatttcttcctatgggtctactgatcacttccccataccagagtaatgtgtggaaattatcttaagagttagtgctttttgcaagttattttggggtgggcagtttgttgaaatcattgagaaattttggttttggcagaggggaaaaagcttgtgtttcttttgcctgaaagtctgtgctttttcatctctgttttccttttattgagaattttaatgtaatttcatgttatatttgggcctatgcttcttcatttgcaaaatttggggtgtggttgactgctaaatgccattgaagtctcttgatttcttggtggtggtggttttgtttgttttattctgtgatcatctcttgcagcagtcattttatgaaggccaggcaggatgccttgggacggggaaagagaagaaggtaaagagtggggagaaggttacatctcctttcgagaaaacctgagttggtttccctttggtgcaaaggcaataatatcttgcatattttcccaccctcccttaaacaccctgtggattaggaactcaaatgactctataggtttaggaagattaatcctctgtgggaaaaagtagagattttctcccccttttctatgttcttggcaaagtgaatacaacagaaaattatcaaaatctgtcatgagagtttgaatttaggaaaattaacttgaatgtgtataaaacatgacactgtgctgccatcccaccggcccttcaagcctaggggagccctgatgtaaccagagcctgagatggagacgtcttgcagaaagaggaggagaaatgccagggtgctgtattcctgttaggtccagccatggtcgtctccattccagagaggtcatgacaagaccattttctacccagatggccaagtgtgtactcttccttgttataaactcatcacccattcatttattcaacaaattgtcctctaggaccactttctgggaccacacagatgcaagccagtctccttcatttcaacccagtgccaattagcatcaactcttggggctagtgggataaagagtgaaaatgttcgggtgcctcaagtaaacaggacctaaaagtattgaaagtatttcacggcccggcacagtggcacatgcctgtaatcccagcacgttgggaggccaaggcgggcagatcacctgaggtcaggagtttgagactagcctgaccaacatggtgaaaccccgtctctactaaaaatacaaaaattagccgggcatggtggcgcatgcctgtaatcccagctacttgggaggctgaggcaggagaatcgcttgaacccaggaggcggaggttgtagtgaactgagatcgcgccattgcactccagcctgggcaacaggaatgaaactccatctcaaaaaaaaaaaaaagaaaatatttcacacttgctatatgtattagtttcttattgctgcagtcgcaaattactgcaaacttagggacttaaaaacatttattatgttatagttctgtagaacagacatttagtattcttctggctgggctaaaatcaaggtgtcagtgtggctgtgttccttatggaggctctaggagagaagccttttccacaggggccacttacatttcttggctcatggccgcttccttcacctttaaagccaacaatggcagattgagtccctcttacattatgtctcactcacccgctcctttgcctcttctttttttaactcttaacaacccatattattacattaggcccacctggacagtctaggacaatctccctaactcaagatcagctgttcatcaaccttgatcgtatttgcaaccttgtaaagtaacattatattttgccttctaaggttacatatttgctggctctagaggttaggatgtggacatctttgggagacattgttctgtctgccaccatataatttcacaatgtcctcctctgtgcatctgcagctctttgttatgcctttgtcattactgtcagtctgtctggtactctcagtagataccaactgtgatcctgaggtgtagacatcactgtctcaggtctgtatttccttctcctcttctctttcccttttctacttcactccttccataaaatcgatgtgctcaataaatgtaccttcaatacctaagtctccctgtaatcaacttacataaataagaaatcactttctgggacataaacatgaacctggcttcaaatgcaacacgttgtgactgaaaagcaaatgtggctcaggttactactgttaacatgaagcaattcatgtttgaacagaattttcaaaatcaaattttgaactcactgctggagacgatgtggcccccttcatttcctggattattatgcatctcccacagaaccatttgctatattatttctttggtgtttacagaagcagatcatgtttatgaagcatgtccagaagaaggaaatgatatatggaaaatctctacgtggggtatagagtcaagtgatccctaggttacagttgagagctataaataggccagtgacttcatgtgtaccatgggactggtattttccatctttcgtcccacagtttggataaacttagatggattttttaatagttctttgaaaatggaacattagctatccacagagatttaacttgggacaaaaaaaaggaataaaagtcatcatttctgatgacaggattagacagaccttttttcttgaaagtaattgaatattctgtgtgttttttgcagtttctgttgaattgagaatagtgaccatcatttgaggtggaaatagcagaaatgattaatttagaaagaagaaggattgtagggtgggtggaagtggcattttctgcattgtattcttagaaacttagactgttagagttggaagtgctctgataaaaccgttctttaacatacgagaaaacagaggcccaaataccttaagtcccttgtccaagagtatgctgagtgcagaaagccacactgtggctcaggtcctgggccctggccctcagcgtttctcagcccactgcactcatctccagcacttctgatggactcactggggtgacaccatcaaaccatgtgccccaaagatgccttcatgttggtttccacttgggcatttctcatgcttggatggctaatatactccctgcctggtttactcttgagaacccggctttcatctgctgtgggacacagtagcctttgcgtgagtgcctacgtgcacatgtgtccatggaggcagggagggtggacaggcagggagggtggacagtggtacacacactgcaccagcagcacttttaaagacaaggatcatgacaaaagcaacagcaagtgcactttcttttccaaattacccaaggttgttttttaaaaatagtaatatcacttcaagtgttttgcacttggcttggtgaaacaaaatgtgagttaaaactgtggagtattaaagcattattcttgacacacctacaatatgagacactccattgatgtggatagcatatatgcagacaacaagcattgatgttgtacttccacctatagatagaagggggatgtaccttggtatgggagttttgcacttagacaaagtcttagttctcaaccagagctgattttgctcaccacccctccagagggcatttattactgtctgcaggtatttttggtttttatgtctggaggaagtggtgctacaggcaccatttgtaaagaccggggatgctgctgaacatcctacaatggacagctccacacatcaaagaagtctcgaatccaaaatgtcaatagtgccaaagttgagaaatcctggcctacaggaatttatgacttatctgatactgggctttgaaggctatatagacagttgattaatttagaaacagcttggcttgtggaataaacatacctggtatagtctgtgaactgaagtgagccaaggtggtcccagtattgcttccacacttgctgtctcagatctctgttctcagtgaccagagttaaaaaccagcttccctctgcccttcacgtctgtgggtcctatggttgaggatttttatgtattgtttttctttggggtcctgataaagcttagataaccaaacatagaatttttaaaggtgattgtgaatacaaagaactaaggagtgccttaccctgatccattctttacacaagcagccccagtcagggaaccctatgccaggggaggaattgggcctcagcatggacaagtcttggcaaagaccgctatggcagcagtgtctgaaaaaggaaaagagtccaaggagggaggaaatgactaggaggctgctagagccttccctcagcgccatgttctactcacagaccaatgtagtaaaaatgatttgtatttccttgttcctttttaaatttttgaaaaaaaatttccatatttgggggttttccccattgccaggtggttacattccaaagaaattatatcatgggatacagacacaagtatttccaatcatgcttattgtgtagggctgatggcaaggtgattcccctccatggccacacatcataaccaggcaagcccgttaagtatcagcaactggaagtccagcatcaggaccacccatccctctgtcaggcagccccggttggtggtggtaaatggaggagactgaggcctctttcactcacttaaattcggagagtgagccactctactcctgttgggaaaacctatttccttacccaacgagactgtagaaaattcccctcagccatataccatgccaggtttcttttacaagccaacctgtttccaagcaacccttcttgtaaccttctggagccaagtatctgatattcgtactgggagaaagatgaacggattctgcacagacacgggccctgccaacatgggcctgggaagaggggaagctggatgtgtggctcaggagacaggcagaggttgttagaggaagcacagaatactggaggtgaagataaagtcagtagttggccaggccttttgtgcaacggactcaagaaacatgtaagagaacaaaacatttttagactgataactgattacttgtgtacatcttgaaagttggctgctgcagggcctaaacaagagagaggccttacagtaggggttatgtgtccataggctcatggaagcttggcattgagatgatcttcattcattcaatatcatctactcagtcattcagccaacactgagttaagctctgagcaaggcattgtagttagatggcagataggttagcgttgttggaaagagtgtggggtcagaggtctgggctgcagaaacccaccacagtttcctctaatcatgcctgggaagggggaaccaagggggaaggaagcagccctctattgagcaatcaactatgcatcgggcacttccacttgtgttgtagcagcaggagccaataatcgtgcatttgggactgggccactagaagactggcttgttgggatcaagtcaaggggttcttggaaacctgctgagaacaggcccatcacctgacagcccagaaagatgtccgagtctggtggccagatccaatgggggagatccagtgggggagatccaatgggggagatctaatgggggagagccaaaggtgtttgttggtagctctgacaccaacttttatgacctgggcaacaaccaaaacaatttaataacgctctctcagagttcaagagaaaaggactaaacagaaataagcagcagcccagcctctacccagctggtactcctggaaattgcacatgggtgaagcaaggctgcttcctcctgctccacttgtgagaaaaatgactgcctgttctcctttctcagtatcggtctctaagagttgtaatccaaagaaggcaaaatacaattactttctgttgcatttttagagcagcaactgtaagtgggagggaaaaaaaaacagacatctagaaaatggtggaatgaaatatgttaaatcatacaaaacaagtggcttccagtgaccacctatactgaaaaataaatgaaatcagaaagtcgtatatcgtgtagaattttagaggaggaagaaattttggcaattctctaagccagctgccttcattttctagaggaggaaagtgagcccccgtgctataatgaagctgtctcagagtctcacagccccctggtggcagaaggagcctgaaactgattgtgctgcgtgttggtgatcccaaatgtctgtccatgtttgtaaattaatatggtggggcttatgaaatcaggaccacagtcattgtctgtgaatacttctctttttctacctttggtcaaaaagttggttggtagaagaagagctagaagcctagagccagagccgtggagccgtgggggttctctttcatcctatctgcagcttgggtagccagctgggttttggaggagagtgcatctcttccgaagaccttagttgctttccttgcggaagggctgatcctggcctccgggaacaggagaaacatagtaattttaaaggttatgaggaaaggaggatagggatcccgaaggccagggaggaaaagccagtgagtttggagcgtgggagctgcaggcaggtgggagaagctgaaggcctaacgtggctgttttatttgtttaaatgtacagggctcagaaatagaggattttggaaactgtattccactgttctaaaagagaaagtgtgtaggggggaaaatagcatcttgactacaatgtaatcctagatcttgaaacgtgaggttacatggacaaaaaatgcttaatcccaacttgaaagtatgcataatattcaaaattatcccccaccttcagtgctttacccaggttatggagattcttgaaaaacatgtaaatgaactttgtgtatgttagtctatgtacacatttaggaagagttccatttaatagtctttttgtaaaacatgatctaggatttatctttcatatgtacaatccatctgaatttaagtttcctcatctgtgggggtaatatacgggttatggtgagaaataaatgttgcaaataacttaatcttacacaaaataagcacttaacacaataaaatatatgtgtattaaaatatctcaatggaagtcattgcattagagtcttcaaatactcaaaaccagtctttttctacccaggaaacacctacattctaaattttaaagcccctttaggtaaatactgatattaatgtttcagattgttttgtttaaaattctcttggcattgttcttctgtggttttccagaaatatggccagaactacaaagcacatggtactgtaaacaattgctatgccagtcatttaaaataactcaattattaaaggagggatgtcttcacccccactctttcagaaaagacagcttggcctctaaattcttatgaatttagagagaagccattttcctcatcccttcttgatgtcattccttagtccttacatctgctggatctattctataaggagtgtttagggctggcatatggaaaaatgatttgagattggtaaacagcaagtcacagcaagtgatgcctctcactgtcagtctataaaatcactgcatcgtcaatttgaaagtgtttttgttctatgtatgattccatctcatttagcaacagttaccctgcccctttcttccttctaaaccttggatccctgagctttgcttttctatttcgtaaatgttatttattcctctaacatagataatgacatctgtgatataatacatgtatgtataattccctatcatcaacccttacagcttactatgaaaattaagaggaggaagaattaaactggtagagatttgaaaggaagagaaaaactattttgatttcttctaggcctgtttcactaccatttattatagtcctcattatgtcttttatatatcaagaaaaaaactgcaggaccaaaattgaggcacaagtgggaaaaaacatccagtgatccctaccccaataagaagcttcatttttatttttttctttttgtttgggtaaatggatagcaattaagtcctcctgtcttatgaagtcagagatttatctcttgaattaattaactgcagaatagtgacgagtggcccagtgaacactatcagagcactgagagatgctggtttatttcccctccttagctaaatacattcttctttttaaaactgaagaggtcagttggtgggatgaaaaagaaaggtttgcagtctcttgggataggcggtaaaagataacaaccagatcttgtatgccactgatatttccagagtatattaagtttccatgctggtttccacctttttaagggagttataatcatcccctctcattccctaaatcagcaacaacagcagtggttttgtgtgtgtgtgtgtgtgtgtgtgtgtgtgtgtgtgtgtgtgtgtgtgtgtaggtggggataacattaggccagaagggatggatgagagggtggaggttgctgagggtttctttgaggggaggttggttgtcctaatcttgttttacttaaagctggtaaacagcctagattctaattcctattctaaagattcccaatgttatagtgaaacctttccactttggccccatataggacaccttttcaattagtgcccatgtgtctgtgcacctgacatggcagagggctgtgatatgcccctggagaactctgtagagcagaggtttgactttggccctgacccatctccacacctatgggcaaagagttaaccatggatttgccagtcaaaggagaatgcaaattaaaagagtagaagctggcttggtattgcttggaaacaggcccatgtagccaataaacaagcagttggagtagccacatattttagctgggcctgtgctaaactgaaacacaaaactacaaagctgctatttctgtaattctatgtggggttatgacatcaggtatgacagttatgagcatggactcagggttaacagatctaggttcaagggccagctttgccacctcctcactgtgtagccttggataagctgatttgtctttctgggccagtttcatcttatgtaaatcaagagtaagtaattttgtacaaggcttggactacagtaagtactcaggaaaggccagctagctaatagaatggtgaaaagagccatgaacatattccattcattccccatcaaaagaagagtgagtggagttatggcaagaaaggtactaccgtaatgtgaaaagattccacctaaagatacctgatcatttcttacttcagggaagcccatcttacaggtcctttctggccctacagtgtaagactttaaaagacataggtaggcaggcacaattgcagtttctccatatctttctgcctaggtgtgtttctcaacccccacttcacccacaagctgctgttacatgttcctccaagagtccagcatcccagtgagccaattagggaacacactccttatttgttattgcaaaagtatatatttaattgtgaatatgggtgtaaattcttctaaaggactattttaaattttaaatgaaaaaggctagagaagtgtaaaattttattataaaaaggaataaacaagaaccttatttggtagatgataaagaatagctatagtttctgccctgtgagagcatacaattttaataatcaaaactcttaagagaaggcatggaaattttattgttttagagcttccatggggactattttacaaatgcagtttaactttaattgctgtaaaataattgaacatgactattagtgtataaccataaaaaaatgaaaattataaagttaagagcaaataatacaattaatacacaaaaagagaatctgtctcactagtgatcaggaaaatggagactaaaacaacaagactggcaaaagttaacaatattgatgatactggtattggtaggagtatgaggatagaatcattcttacacagcactctgttggtgagtatgtaaattgatgaaatccgtagaagacatcttggcagtacctaccaaaagtataaatgtgcatttttttaactcatcagttcttctaggaatcaaagctgaagaaatattcaagaaataaatgtataggagtatatgaacaaggatattcatcaccacattattttctattaaagagagagaacaagaaccctagtgtctatcaataagagagtagttaaaacaattgtggtacatacaagctatgaaaatctatgtaaccattacaaataatgagatctgtatagatggaagcatagtatttgggggaaaaaaaagcaagctgaaacaaagtatgaatagtacagtctcattttaattttatttttatttttgagatagggtctccctctgtcaacccaggctgaagtgcagcggtacgatctcagctcactgcaacctccgcctcccaggcttaagtaatcctcctgcctcagcctccccaggcaagagccaccatacccagctaatttttgcattttttgtaaagacagggtttcaccacattgcccaggctggtcttgaactcctgagctcaagcaatccacccacctcggcctcccaaagtgctgggattaaaggcatgcgccaccacgcccagcctcatttttatctgtaatgcgtgtatacagacatgtatttttcagtgtgtagagaaaaaagccccaaacacacactaaacagttgacagtagttaaccctcaagaataagtgtgagaagggcacattggtgttttactttctgtagttaagagtttttttttaactttttctcaatgagcatgggctacaatttacctttctaaattgagcaatggtatctttatggatatttatctttcagtctgatatatttttgagcctatattgtttttcaggtaaaaagcatttggttataggtccatagggtatatgcgcttggaatatagatcaaaacaagaaccagaatgaccatggcttaagctaagttgaagtttatttctcacacgcatgaagtgcagaggtcatttacttgcctctgcagggtattcaggggcctaggtttctatcttgtttttctaccattctcaatgtatagctaacaaaagcgattaaagaagcctacttcatctctgtccatcacatctgtacacagcacaccccttcctggtgaggacgtgacctaggagtcggacacatcatttcctgtcccagctcaatagccagaaaatagtaatgtgatgatacctacctaaaagagaaccaggcaaaatacccagttgaaatccattactatatcacaaggtttccgaacctcagcactattgacatttgggctagataattgtttgttgaggggggctgttctgtgcattgtaggatgtttagcacatccctggcctctgtccaatcagtgctaggagcactgcccaggtgtgacaacccaaattgtctccagacacagccagatgtccctgagggtaaagtcaagcctcttgaagaacaactgctaagtaagaagagaatagatgctgcagacaaccagtaacatccgctataagcattgtgttatttcccccaaaacagtgcttagcactgaactaatatataacctttcaaataacaagtcctctaccaggaaatcaaacatgctaagattgtgtcaaattttattttggttgattctaggatgaaaagtcaatcctgtcttattttaatctattgaatctaaattgatatttatatcaaataaataacaatttttatttgaatacacagacaaatgaaatattcttccctagtgtgtaagaatagtattaaggatattatactgtgttacatttataatgaatatctcagtttaaagtgtaatatttctgaaagactaatataacagcaaatatatacagcaaatataacagctctatcctaaatcaagaatttcatctgcagttgatggcctgtctctttttagggcaattaagtgtccataatttgatgctgctgtattatgaatactttaagagtacagtatttttctgttaatgaggagtgtttacttaacatgctcttcctttccaatgagggaacatgctttgctgccaatcaaattaaggtggagatcatttcaaagaaaccatgaaacactttttctttattctgcctctcctattaaatgttgagaagcaaatcttctatcaaacagatggatatactgggatcttgttaaaaggctgcttgataaaaagggaaagttaaatataaagtggatctgtgttgggcttcttccaaggttgtttagtgcctagtgtgtcagaataaccttgttataaggcaaattcaccacatggagtgttcgtgccagcctagggaaggccatcatttaatggaactccagtattcttatttttgaaaatgcagatgctgcagaaattatatcagaaatgtcgttgccaatcatgaaaataacagaataccccaaaagtcacgtatgaaatgattcatactgggagacgggagtaaccggttttagctcctgtaatgaacagaggctgtgtagaggcatgattggtaaagctggacctggaagagtgggtaggatactgaaaagagaatggaaaaggacagcatggaaagcccagagatcagtggatgcagagaccagaaatcacaaggcaagtttaagtgggacagtttggctaaagtggtggatttgcatagaggcaagaggatctctggcttgtggccaaaacagtaactggtccaccagagtttgtgccccctcttccaaagcacagctgggtctggaaagcagctgcagagccggccctccttgcatctgagccaggccgtgtggcttatccttactggtgtgctatgaatgagtcattgtctgtaggacctgggcagttaaaggatgacacacttaaatcggataatttggaaggaatttaagagggactctttttatgagaacacatggacacagggaggggaacatcacacaccggggcctatcggcaggtgaggggcaaggggagggagagcattaggacaaataccaaatgcatgcagggcttaaaacctagatgacaggttgataggtgtagcaaaccaccatggcacatgtatacctatgtaacaaacctgcatgttctgtacatgtatcctagaactcaaagtaaaattttaaaaaagaaaaaaagaaagactctgtttgcaaagatgtgggagaaatgcagggaaaccataaggggtagttcagtgtcttgaggcaaaatgtaccttgttacccgcctcccccacaccgccccccaagccataaaaaggtaagagaatggcactatttctagatcccagagtaggaatcatctggaaagatccacagagaggagctgtaacctttagaaggacacaaccagaccgagtcaaacccttaaggagggagggatggaagtaaacactttgacctcactctcaaacctccgtccagtcttctgccatggtgtcccattggccaaacccaactagaagccagagggagccctttgatgtggccttactgatggtaacccagggcacagagcagggtgaaggagggttgagggacaggcctggggtagatatcctgcactgtcacttcctggcaaaggtaggaagaagtggatattctctcacttctcctatcagccagctggactggggggattttacgatcctaggggctactagagctacagggatgcaggagccaggctctctgaatcacctgacaaaggcaagtggattatcattcagagacactcactgtggactaggtcctatcaaaaaataaacttctcttgaatcaagacattgaattttaggggtgtgtttttttttataggacttggtatttgaggattgatttattacagcatttagcattaacaggaactcaattgtagaaagttttgaaggccaagcaaagaatttggattcatttctacagatggttaaaaattagtggaggcttctatgctgggaggtggttttaaaaggaaaaacagaaagagagccttggaatgatgagtctggcagtcacatggcaggtggaatggaacacagtgagcaatccattgatgcagctggcccaaaccccatgtgatcagcgggacctgtgaatcagtcccacacaatacaagctgaagggatggaagcataatcatattccaagttcaggtgccagcctgccatgtagaacttggggaaggaggtggtctaagaccagttgaatgatcaccccactctatgaaagggcctggctggcccactgtgagatatggaagaggaaatttggaaagagttgttgatatgtcatgagtaacccacataagggagaggcttgggagagggtctgcccaccatctcaagcctagagaagggggcttctgtgagaccactgaagagtgtgctgtgtgctccctggagcctggaggatgcaatagactatagtatttttctgaaaaatcagaaagttttcagaagagaagttttggtcagctgctctgatgacggcaaaaccaaaaaaggctccttggggagggtgggtgttccaggcaaatgatatgtgaccattggaggacactgagctctagagagagctaatgtggggtcaccccagtcctgtctatgtgaagacctggaaaaacaacaggaaactaccaggcagaggaatgcaatagccatttgcgggggagaactgcagaccccatgagagcacctcacaagaaaaaaagatacatacctggacagccttttcagttcctggtacattttacaactgtactcttcaaaaaacacctttcctacctcttttctcctccctctagcaaccagtcagaaaagagaagagaggctcccaagcccctcccactgctggaggccggcttgtgccaggcaagctgggggaagagagagatggctaccaaaagcatatataagtttttattattattattattattattattaagctggactgtacataccagatgtctagatgagaccatttttacagatctatgactgggaataaacagaaaactttttttttttttttttttttgagacagggtttcattctgtcatccaagctgaaatgcagtggcacaatcacagctcgctacaacctttacctcctaggctcaagcaatcctcctgcctcagcctcctgagtaactgggactacaggtgccgccaccatgcctgaccaattttttgattttttgtagagaaaaggtcttactatgcggcccaggctgatctcatactcctaggcccaggtgatcctcctgccctggcctctcaaaatgctggaattacaggtgcaagccaccatacctggacaggaccttttattccagaagccaccagaagggtcatagacctgccgtatatttcatgctggggcagaagaaaaatctaaccccagaatacatttagaggaacagtgggagacaaaaataaacttgttatgattacattttataaaagcacaatcattacataggtttgttgcattaaggccttgacctaaaagaaaaagctaaaaagatgagcaactcctaaacatgcctttgtcatgcctcaaaatgtattttaaaacatagtagcaataccttcattggaggacatttccatcccaatatataaaacataaaatttagaaaacttgggaagtacaaaacttgaaagcaaaaatcacctaatatcccgctatccagaaataattgtacattttggtatatttccttcctgtcttattttcctccgtggatatgtacacgtgtacttggtttttcttgtttaaattttatgatctgtattgtgtcctgctttttaaacttaacatagtatcttatttttctaagttaaggatcacttctaaaatatgatttaagtgatggcataatttgacgagtccatcaaataattttgtcaaatatgctagatccagatttaggtttatatatgaattaacaatatgaatgagaaaaatatagagaatttgactcatagctttagatattccatcaagttgtagtatttatattatcagatgaaagagctacttgtggagacggttgtcacccctttcttcaaactctcttttcttggtttcagtgaagccatatttccctgattttcttctactgtgttagtcactcctacgtctcctccaaagcttttcctccttccatctattttctaaatgttgttgtggtttaggactctccttggatactcccctctctctcttggttttctcattcaaccccttggttttcaatatcatttatatgctaacaactctcaaaatgaaatattctctctaacctctatcccaagctccagacttgtatgttagcatctccagttggatgtctcattagcatctcaaatggaactctgaatctctgctccaaaataggtaccatcttcagtttcctcagcttggtaaagtgacttcagtcctctcaactgctgaaggaaaatgccaggaggcattgctggtacttttctgtcccttatttctagtttgcagcaaattctgtctccctccctccaatatatctcaaatccacctcctctgcccatcctctcgttcatcacccttctctaagccatcagtatctctatatgaaccactacaactgcccccaatcactttcctgcctataatccctccaatgaaactggttgtaggactatggaaatgatacagtttgtgggtaggcaaacctcctcctctctgagaggaagtgggacaacctcttgcttctgagttcttcaaatcatttctcaagttctttcctgtattaattttctattgcttctataacaaattactacaagctcagtggcttaaatcaatgcaaacttattatcttatagttctggaggtcaaaagttctaaaatcaaggtgttgacaaggctgcgttccttcagaggctctagcagggaatcaattcctgctacgctaagtagcagccagagtgaaccttttcaaataagaatgctgttccctcattgaaacacatcaaaccattaggatggcctataagacccagatctcagtctgtccagtctttccagcctccagttctggcactttccctgttacccgactaatgaactcatatgatttgctttcaggtccccgaaccttactgcttctctatccctggaaatcaactcccctaatttcctaatgtgctttgtctttcctcaccacacatagtaatccaaaatgtcaattccttaagggcaagactctgttcaggtcacctttatgtccccagtttgtacaaaggacacagccagtctttgttgacacgacttgttgactggcccattctcacttttcaggtctcagcctacagatcattcctcagagagacctctgagactccatcattcttgagtgggtctccgcccttctgacctcaattatttcacgctgttctttctgtcactgacttcatttgtctttatgcatgtgtatctttgtctgtttaatgtctctttcccccactagactagaaactcccatgagagcaagaaccacgtctctttttcggcttatgcttcgcacaatgcctaaaataatgcctggctcatactaagtgctcagatctttgctggcagaatgaacagcctctgactgaatggggttctgagggaacctcttctctctgctgggggcaacacgggaaaaaatgccagggtcaatcctgaagtagaggagtgtgatccacagaataatgggaccccaaagagatctatgtcctaatccctggaacctattaagaagacattgccaataacttcacacacttggcaggtgtgattaagttaaagattttgagatagggagattatcttagattatccagatgggtccatataaagcgaagtgagaagatcagagtcacagaagatgtgatgagagaagcagaggtcagagggagacagagatttaacaattctgctggctttgaagatggaggaagaggccacaaggaatgcgggtggactctaggaactgattccccaccagagtctctgaaggaacgcagccttgtcaaaaccctgattttaggacttctgacctccagaactgtaagataataagtttgcatttttttaagccactaagcttgtagtaatttattatagaagcaacagaaaactaatacaaggaagaacttgagaaatgatttgaagaacccagaagcaagaggtggtcccacttcctctcagagaggaggaggtttgcctacccacaaactgtataatttccatagtcctacaaccagtttcatgcaatctctctctctttttccttagttctctcagtgggaatctatccctgtttctttctccttaattctctcagtgggacaaataagtggactatgacttgtttcttgagtataggttcacggagaggagggagaacctggagctgggtttgagctgtagaaatgaaggaacgtggaccaggtgtggcggctcacgcctgtaatctcaacattttgggaggctgaggcaggagaatctcttgaggtcaggagtttgagatcaacctgagccataaaatgagaccctatcccaacaaaaaattgaaaagattagccaggcatggtagcatacacctgaagtcacagctacttgggaggctgaggtgggaggatggcttgagcccaggagtttgaggttacaatgagctgtgatcataccactgcactccagcatatgttgtagaaccggggtggttaccgaagaggaatgaaggagaaataataaataaatggggaggctggtcagcatctcccttcccatacacccatataagaattactctcttgctgttttgttgttgttgttgttgttgttgttgttgttaagactgagtcttgctcttttgcccaggctggagtgcagtggcgccatcttgggtcactacaacctttgcctcctgggttcaagtaattctcctgcctcagcctcctgagtagctgggattacaggtatgcgccaccatgcccggctaatttttgtatttttagtagagacgcggtttcaccatgttagccaggctggtcttgaactcctgacctcaagtgatccaccctcctcagcctcccaaagtgctgggattacaggcgtgagccactgcacctggccctctcttgctgttgacaggtgatactgaaccatttctttatggcctagtctaaggcaccttgtcagtgaatatctctgatttagaattagactctcaaaatctatggttttgggaaaatagatcttctcagaaacagagaaagcattggacctcatccctggtaaaaatgcacacaagcaaaaattttcacatgtagtttttaggggttcataaggtcagcttgctcaaaggatagagtatttggtttttaaaatatatatcaggcgtgggagttggtgggaagcagacagggagtaatattctaagataggcttccagtgttaagctaaggggtttggacttaatcctccagggagggcactgagaacccattagagggcttcaagcaaggcactgacatgatcagatttgtgcttttgaaaacaatcactctgcaaacatctatattggccataatcccaacatttgttcatccattcaccttaggtggaaaaatgctgttgacatgaaatgttttaatatttccttttaaagccagtgatatcagatggcatattaagtgacctaattttatagatagtgtgctgtagaaagcagttttgatgtaaggacgtcaaaatcttgtcagatcattgcttttctaagagatggtttgcttaggcatttggtcttattgtaactttcatcattattatctcattgttcgctgcttctcagcttttatcagatccatctctagcagagaaaactccggtaagtaaagcaaaattgtagaatgccgtattgggagccttctagaagaccagcgtatgcacacactagctaagggatttagaccaagttcatctcctggagccacggtttccttatctatactatggcattagaaaccctatgtagctatgtaacagttgtgacaatcaaatgtgatcgttaaaagacagtgctttgaaaaccataacatattacccaaatgcaagctgatattcattttcctcttagtattaccatcatatctgaacatgtttgggttaatacagaggagctgtgaaactaaacgtttgtggtttgcctttatgatgttatatggttctccctttctccaagtatcaaatgctttagaggtttttctagtatccaggcaacatattgcctccacttagcccttgcaaaaacctgaattaaaaatagactctgtttgctgtgttctgaaacttaaacctatatgttttaaaggagtcaaaggttccccttggcactcaaaggggcagtagtcctgtcctagcacttttagagcatatgccaagccatgcagaggaaagtggagaagctcagttgtgcaaagccggcaacccaccaccgtgtcactggtctgttggtggtatcctggaggaaggaagggagctctggcggcttagagttttcagggaaaggactattggttctaatactgcaatcaccaacacttcacacagaaggttctttgtcatcatcatgatttactaatctcatcagagacactccaggtagtgtttcacagtgttttttcacagtttcaaagtacatctggcttaatattaggatgtgcctcagacatttccacaaagcagacaagatgctttttttctattttatttttttaattgacaagtaaaaattatatgtatttattgtgtacaacatgatgttttgaaatatgtatacgttgtgaaatggctctgttgagttagttaattgaggtagtgtgcatttcctcacatagttattttttgtgatgagaacacttaaaatctactttcttggtgatttttaacatacgatcattgttattaatgtagtcaccatattgtacaatagatctcttggacttattcctcctatctaactgaaattttgtccttggaccaatatctccccaagcccccagcccccaaccagcccctggtaactggcattctacttcgagttcaacatttttagattccatatataagatgctttttagtgatacccaaatatatcactattaaagcatttaatttttacacagacctggggaggaggaaactttgaggtgtcattcctagtatgtcagcaaaatgccgccttttgttaatagtccccatgttaccagtggtgacattaacgatggtgtttgtacagctttaccaagaagtttacaagtttttccttggcttacccgtgggtgggtatgattggaagaaataaaatttttacccttttttcaccaaaaggaatggctctctcagagcttttgctttgttgaggtcaaacattcatacttaaaagagaacttccgactttgattctaggctcattttgcaaacactgatatggaggcagcctgaatttggcagtcagactccaccacatactagcaaagggacttgggcaagtcacttaaccttgctgagccttaaatccacctctgtaaaatgggaacagttgttactatgcctcacggttctggagagggtcaaatgagtgaggagattctgatttagagacagtggagtgtaacttgggactctggagccagcctccctagaggtgagtcccagcttcaccttgtcagtagctgtgttacctcgtgtaagttgctaaaccttcctgagccaatagaaatagtaagagtgcctacctcatacagtcgtgaggataaaaggcttaatataaccagaaagcacttagaacagtgcctgccatttagtagtaaacactacattagtatgtgctatgattatgatagattatgatcataattgttattattcatatatcaagtgcctggcataaattagttggtcaaaaaagattaataactacttttattatttctcccatcagagcacctgaaatttaaatgctctgaaaggaaagtaatattattaccagtctgtttttgatttaactaaatatataacagcagggttcttttcaaaatcttactcctcagggactcaaaacttaaccttacaccagaggagaaagattttttcttagaacaagagcatatatttggtcctcactccagacctttggaatcagaaattctggggacatgaccgtcatctgttttagcaagtatacccagtgattctcatgttcctgaagtttgataacactaggtgtagactagtcacagctttgactaccttctgttgccagggtggagacaagaattggttactctctttggcaggctgttccagcccaagaagtgttaaaatgatgttatcgtggtggttttgtgagttaagcagatacagatagttctggaaagcagcgtcaggggtgcggtgcgggggctgcagagcacttgggcagcatgtgaacctgttgatagatctggcttagaacagtgtggcgtatcgggccctctgggaagtgcttatgtcacgtcttgtgccttaccagtctgagtgacgcatgggagaagagatgccttttgagtttttatgcaaggttaaaatgaagaaaatccatttcagcctttaaaagtcagagctactggtacaaaaggtcactgacgccaaatggtggcattgcagagctccgagagggagcattaaaatagcagggggtttttttgtttgtttgttttttgttttttttttttaagaaacactgaatgcactgtgggcttaagtcttagtcttttgccatcttgctgccctaggatcttaaataaaagggcatgtgaaaaaagaaaaacacgaagacatttttctacctccttaagtgtcaaggatgtagatagtcgtcctcacactaaaggtgacataacctttattgtagaataagcaaagtgatgaaatgatgcccctatgagaaagtagtctgtagatggactagagacctagccctgctctagatgtagtctgtttggaggtcaagtttggataactgaagatgacactgccttgggaaatgaagccagtctcagaagtggtgtggagaggttgtaagatattaatctggctctgtatacactgcattcgtgttgacagaacagcatcccaattgattgaaaagaatctgcgagccatctgaatagaaacagtatttaagtcattaagaatggattgattaccagggcaattaaggagacctgaggatcaaggaccgaattcaggggacactgcaattatagcaaatacaatatgagaggtcagagaagaagtgacaggagagactataagaaaagctggaagtgggccgggcatggtggctcacacctgtaatcacagcactttggggctgaggtgggcagatcacatgaggccaagagtttgagagcagcctggccaacatggcgaaatcccatctctactaaaaatacaaatattagccagatgtggtggtgcatgcctgtagtcccagctactcaggcggctgaggcatgagaattgcttgaacccgggaggcagagattgcagtgagccgaggttgcacgactgcactccagcctgggcgacagagtaagatgctgtctcaaaaaaaaataaaaaataaataaataaataaatatatatatatatatagaagtggctccaggaccatattctatcatagaaatcaagagaagacatttttttccagaatagacaggtgttctctggtgttaaaagcttgaagaaataaaaagatataaagcatgtggggaggtggggatgggtcttagatttgctaagtaaaaatattaaatcagaaagaaagtatcttttctataaagtaaatgatctttattacatccattcatgtcagggtttcttaacctgagcattattgacattttggtctggatgattctttgtggtgggagctgtcctgtgcagcatccctggcctctacccactagacgtaatgccaccacctccagttgtgattaccaaaaaatgtcttcagatatcatcagatgttcctggtgaagaaccactgatttaagtatttaattcctaccatgtatgtagcactacattaggcagtgcaaggcataaaaagtatgacacacttcaccgtaaaaaaatacattctaattgtcctaaattgagttattctgttatttctcctattatgttggttaaaactatatatgtgtatactcatacacacacacatacacacacacacgcacacacacacgtatacagtagttattctccaagttaacattacatcagcttaattattggatgatattagaaaagtagtaaatgggaaatattggtgtccccatgctgtatgttttagcacagattaatgtaagaaattattatggatctatggtgggactagtaagcaatttccaaattaaattataagaaacattatcacaaaaaacatttgaaaagaaagagctttaatgtttggaatagattctgcatcaaaagaagcaacttatcatcttgccaaacctcagcctcgtcattgttttggagcaagaaagagaattgaacctcactcatgttttgttgcctgtaccattgaacaaggccctgactgttaagactaatgttgagacccttgttttctttgcagactgcatcatctgctattaaaggtgctattcagctgggaataggatacacagtgggtaatctcacttccaagccagaacgagatgttcttatgcaagacttttatgtggtggaaagtgtgttcctacccaggtaagaacatttttatttgtgatgatttccatgctaaggaaccttctttgtgacaaccccatattgaagggcttttctactatgtacatgtttatatgtacagatgtgaatattgggcctttggcagggccaaaggcagtccaaatgatgtttacttcctgtttcatcaggatgtctcacaatttttatgtggagatggtaaataggtttcatctatggactaattctaattagttgtgatgaatgcctggaagaccatatggagaaagattttgaggttcagtgggaaagagtgcagtaatcacagagtaatgtccgccaagggtttatagaaagaaggcttccatgaagcagcaactggtgctaggtttttgctccccctaatttaaaagcatgggctggtaggcccataattgggcctcaaatctgagtttagtcttatctcttctcttttatgatgactttaacttaactttcctcgagaaaacatggataatcctgctgtttgcaaaaataccaaagttacccatatatgttgtctctagctttcatcattttagggtgaggggatcaattatttaaaaacaaatacatctggaaatggatgatggtaatatgaatgtattaatgccacaaaactgtacacttaaaagtggctaacatagtaaattttatgttgagtatattttaccacaataaaactaattaattaaaaattctattactacgttcatttaggaagagaagaagtaatcattaaataagtatcaccacaagtgacaggatttttcaaatgatccagaaaataaaaataaagatattcaatttggggacttgtctttggagctgtgagaattgattttaacatttctcttaaaaataagtcatgttattaccaggcttgggtaaacatagctaaagtgacactttgtttaccactagtgtcctcatcaccttattaaaaatctatatgtatctttagaataattgtctttacacatttatctctgtgtctaggtgtcaactgcctaaaaataaaacctgtttgtggacatgcagtaacccccacatagtcaccaaggagcagagcccataaatttttaaaagtcagctacctcgttttgctttaaatgctcttagctgcagaataaagttggtctactggccttttgaagtctgcttgtctagggtcctctagcagccatgagaaccagattccaggcagaaaatggacaaccgcaaggcccaagatataatccttgcttatgatcctactcttctttctatagttggaaatgttctctgtgtttgtttttaacagcctaccattccaaaaaaaaaaaaatgtatattaactacatgtttttctcttaaaagccagggggtcatgagtttatcttcatcttttggtatgatttttttaggctcataatgcttgtaagtgtgtttgcaggatgtttgtttgagctctcatggtctccaaaggtctctacccagacatttcaactttgttgttctttggctacaaagaacaggagaaatggaggacttctgtgggagtgtggagacagtgagctcagggtgctgagagcattacagctgaaggtgggggtataaagacgttccatgtgctccccctatcctcactgactgacctcttctacttccagtgtccaatcaacacagccaaccattgacgggcacttggggaaagcatggctcaggcatgaggtccccaaatcctaaacactggcacacctggaacttgctagacatgcagattcttgggctccacccagaccaactgaattagaaactctgtgggtgggaaccaggaatctgttttaacaagccgtcggggtgattctcagcacagaaaggtttgagaaccactggcctcgcccatgactttccacttgagagagagaatctttctggtagataacaaattttgttcttggagttattacacgactcttacaactaataaaactcaaatcattttttaaaagcatcttaaatgtcaaaatgacatctattagcactttgcatctttggccttcactgtcatccaaggtagcagcagcaggtgtgtcactggcagaggagtagctagctgactttcccttatttagaggcatccattgtcacatttaaaatatagcaatttagagtatttgcagcctataaatgtgcacacctgtaatcccagcaactcaggaggaggctgaggcaggagaatctctggagcctgggaggcagaggttgcagtgggctgaggtcctgccactgcactccagtctgggcgacagggtggtactctgtctcaaaaaaaaaaaaaagaaaaaaattacctccctcattttctttataataatattgtgtaaaatgagtaaaagtctataagaaaaactttaaaaattattaagtgatacacgtgtgtgtgtgtgtatacatatacactcatataatatatatctacacacatatgcaatggagtaataaaaatactacataataaatataaaatagaataaaactatttaaaatagatgcatgaaatagaaaggctaaatagatattgatgtttgcatgtaggcacatttagttggattaagttagatttaaattgtccgatagagaactgtgcatacaattacaattacaaatcaaccctttctctgggctgtctaaaataatcaggtactagaccaaaaaatgacatgctgtctgccttaccttttagtgacgatttgtaggaagaggaaggtgggggctggtgagtggaaagatagtagagtttgtgagggaatgttctgtgtgactgaagacaaaggctggaggttcatggaccagaaggtgtgaatctactctgaaagacaggcaagagtccagtccagggaaaaaggtgcagatggtaggattttggtgggtactcgaattaaaaaaatggatttgtgaggcaatattgctggggtcaaaaccaaaaaatcaaattgaccagagtgaaaaatagcctgggtcctagcatggctctgctgccacgtaggatgactggactgtcccttcaggttcgtgtaacaatccatactacttatagtgtacatgaaatgctttctattcattcaagcaaccttactaaaaacaccccatgaaaataaaagtctatatcttcccttcaaaaaaaaatggcaatacaatatttaacatttgatgcattttttttttcttgttatttttaaatgaaaaagaattattgtcccggtttggctctacaccctcggactccggctcccacgccaccctggcaggtgccggcctcaacatttgattcagaccaagaatttctttcagcagatgctatcttgtttgtttaagtaacacaggcacaccagatggatttacagtaaacagaagaaacttatgttagtcttgcctcagtttcatcatctggactcagtgtcttcgtggatttagcaaagggatttggcccagtgtttctcaatggaggtgctattggctttgttggataagacaactctgtgcaagacagtacctttcaggagatctttggtccccaggccctgccagtaatatctcctagttgctgtagcagtcaaaaaacccctataaagtgatggataaatttagtatcatgattgtggtgatggtttcacaggtgtatatacacatgtgtaaaagtaacaaatggtatactttcttgtatgtcaattaaacttcaataaatcagtcaaataatgctttctctctaagtatttccaagcccatatggggatgaagaaaggggtaggtgggcaggacaggccctggttgtaagcatccaaaacattctgcagtctctgatggctcaacgagtctatctgggtcatagaactaattacttgaggtaccttgagatgttttaatttactgctttctgaagttgcagaatccgtttcccctagcaaccaaatgcattgtgtttttttcttatttatatattttgaagctgctcaaagttatttttaaatatcaagtacataatttgtcctatgaattatttcattttggagatggaaaaagccctgggcctttttaagatttgaaagaggatataaaaatctcttttaactgtttggctccatgatcttccaaaatgtgttccaaaatctcaaagtagataagtaagaaaatcatgatcatatcttaatattttgaccccaaattctgtgttgggatcagaagctcaaggttatagataggtttcatgcattgataggataaagaagaaggaggatggtttataaagcttgtaccatgtaaacaaggacctaaggtggcaaagggaggcaacatttttaaaaactaattgtgaatcaagcatagttttattcatatagtaaattgacttatataacatatattaatttttattatctttcatctttataagaacactatttggtatatgaaataatttgaccctaagacattaagtcacttagcccaaggctatccagccagtaaatggtaaagccgagattttaactcagggttagctggccccaaagttttgtttttctctacattgtggcaataaagcatgggaatggtatttctgctttattgaatcagaacaagtgtccagcttttatcttagaattatagacctcagtctgcttctttgttcccctaagagccagccctaatctgttctccaggagacactatcactaccttacctggaggtggcaaaaatggtttaaaagctggtggtaaaagtttaaatatctttccatattcaagaataattacacagctgaggaatttttaaagcccctatatttcagtctcttcacttgtaaaacaggagtttaccctgatgtaaagatcattacagaaaacagactgcccttgggtttgacccacatgcacttcaggatttatttggacagccagggaatacccaccttttggaaaagaattccaagaaactacggcaagggtaaaacattatcctaaatgataagcaaacatatatgtcaaagattcatataaaatattgcctcatatcatcactcaatgttacaggtttgacaaactagccaactgcctgcatttctaggcataatgacataaacttatccaagagtccatcttataccagggattcccaatccctgggctgtggacaagtaccagtccatggcttgttaggaaaccagcagcacagcaggaggtgagcagagggcaagcaagtattacaagggcgagctccgcctcctgtcagatcactggcagcattagattctcataggagcacaaaccctgtagtgaactgtgcatacaagggatctaggttgtttgctccttatgagaatgtaatgcccgatgatctgagatggaacagtttcatcccaaaaccatccccccatttccactgtctgtggaaaaattgtcttccacaaaactggtccctggtgccaaaaaggttggggaccactgtcttatatcatgtgggtcagcatacaacagcccatgggacaggccccgctaactgcccgtttttgtaaataaggtttaattggaataaagccacatccattcatttacaaattgtctgcggctgctatctacaatggctgcagagttgagtaattgctacagagactgtatggcccacagagctcgaaatattatctggccctttatagaaaaagattgccaaggctggctgcagtggctcacgcccgtaatcccagcactttgggaggccgaggtgggaagatcacatgagctcaagagtttgaaagcagcctgggcaatatagtgagacctcatctctttatatttaataaaaataaaaataaataaaaaagaaaaagattaccaactcctgatctatacaaacattctgcaccagtttttatgtacatgtgggtagaagacaaagctgccagcttagtcttcttgggagaaaatgagaagtgactgctgctgggcaagccataatatgatgctccttcaaatcaaaactctttatgtctttgttcagcgtgtatttggtgaggatggggagaaactgatttcctattactaaaagccatatacctcttcctttagctcaaaggatttattgcatgcactggatattatacaatattctactttatttgaagttatcttcaagcacggttttccagtatggtaataacttcttggatggtttaatgtttatataaccgatgatgtcacatgttcccagtaaatgacatcccggaatgcactgtttggttggggaatttaagctgtcttcagatgctgacttttacagattggctgtcagctggttggtctctgaagatggtgcagcctcgtcttatacaatgcagttcatgtgtacccatcacagaactgctcagcaacaggaggttggcaccagcaaggaatgtgtcttttgttttgctttgttttgtttttccattcatgagcactctctaatttggcaaaaaagaggaccaatttctgtctctctctctctagttacgtaaagaattgtatgtggaaaccaagggatatccaccttggctgaattggcagaggcaattaataataccttaaggccgcttttacagactgctgtgtacgaaggtccaacttgaagactgggtaccatcagtagtttgttactggattgtagtggcattcacccaactgtagtgccacttaagctttcctaatgtctgcacatcaagacaaagcacccttcatttatcctgtcatacagagggtaaggtcatgtttgttgaatacaagtgagggcatttagcatcctttagcgacactgaccactatcacccaggagttgcgtaagtactagttttgtcaaaagtcctcagagccactattgatggtttggttacaatttgaaataaacaaagctcactaaatggaaaatgctgctctagaggcaagaaagctctgagtctcagctccaaaactggtccccttgtgttgtctttgagatgctaaattagttttaccccattgcttaccaccacatctctcagtccagtgccaccaaaactagcacttggtcatcaggctctaaaaccccataaacaaagctgtgttgttattagtacatagagaggagaacaccaactgaccaaagcttctgtaagtgaaattctacccaccagcccctgtggtgtgaaggcctcatgtggaagtaattgggatatttgggcagggagaaacccctgaaacttgtaacagaatcctgaaaaggaggaataacagaggaacgtcaagtctaagttaagccattcctatctgcttatgacttttctgctgttctgatgtgagtctaatctcccaatcttgtttgttcctgatcagtttgggccattgttttccctccctggactatgatttatctgctaaatggggaattccagatggcggctaatgcttcctcaagcttcaacattgtgtaattctgaacatacgttgccattaagatatatgtatttttagactaagacaagcagtagctttggccttaaaaatgaacttgcctcagaagaggtgaatatcagaatgccagagctggtctgtgattgaactttaactgcttcttagtgaataagtggggaagaggacagagaaacttctgttctttatttgaaatttctttctccttttttggagctaaaaatgccctgatgtgatagggattgtaacgtgtgcttgcttaattgtttaggttcttacttggcaaaataaatttggaaatccaaggttggattccaaacttttgttgtcgaaattttactggcccatgggatccaagcatctagaaccactgctcaaaaccccatagctgagatttccaaagcttcaacttacgccaagacaagaaagtcagttgtcgggtgttttttttttttttccacaccctacataagtgcattgaagaaatataaggtaaatcttaaactgtgaggagttctactctttttctgacttcatttttgctaagtctggatgctgagcacagttactcaacaggtaactccagtctcaagcaaggaaagcctgtggacttcaggaggcaaacgttgattgcggtcattgtgtttgaatgttggcagttctgccatggtggaagttgctaagcacttggtacctgtgctgtggagattctgtgctgaacgcctgtgggctggcacccacatctacacacagtaaatgtgccagcgtggggcctcagagaaccaaggttgttgcctgctggctgaccttcactggacttgctgttttgttctctgcactcgtgctcccctgacaaatatccgggcccagcaggggccagcgatctcattaatttgcatttccttcactagagcttcattcatgtcaagctggtatttgttattcattggaacagcttaaatatgcagaggtaaacaaaccttctgctgtggtgctgagcacggagggctcagtttgggggaagaggaatcagtttatggcttttaacctctaactttttaaatttatttaattttgtgaatgataatacacagcaaggcttgtcctgttcttaaaaggaatactgtgaagagttccttttgtccctgtgcctttttttcagtgtccagctccagttatcactgttacttgtggctgttttttccttcaaggattttttatgtatatgcatgccaaaagaatatttgttttcttttttatgcaagtggtgacatcccctacacagcattctgcatcatgtttcatccacttaacaatttatcttagagatcttgccatgtcagtacataataagcacccttattcttttcttaataccacatagaattccattgtgtagctgaatcataattaattagacaagttctctcctgaaggccatccaggttaccataatgagtaaccatgttcacatatattgttttggacaaatgctagtttatccataggataacataggcatgcatttgctggatcgaggagttacatgtttgtaattttgatagaagttgtgaaaatgtccttcatggggaaaaaaagtctcaatttacattcccactaacaatatttcagaatagcattgcccctcaagctacatcacagtcgtggattttcaccaatcttccaggtaaaatggtctctcggtgacatttattttatgaatgaggttaagcatcttatgtttgagtcatatcttttcatttctgtgaagtgcctgatcatatcgtcagctatttttttaagttaactttctgatcttttttttttttttttttttgtctgagacagggtcttgctctgttgcccaggctggagtgcagtggcgcgacctcggctcactgcagcttcaacttcctgggctcaagcgatccttctgcctcagcccaccaaacagccgggactacagatgtgcaccaccatgcccagcaaatttttgtatttttcatagagacagggtttcaccatgttacccaggctggactttttggacttctatgcagttcattggagctctttatattaggagattagcccattgtctgtgatatgagttgtaaatattttcccattttggcatttatttttcttatttttttttaactactttttcaatacattcctcatgtgaagtgtttggctcagggctgtttcctatatagtctcaatcatccaaatgtgttaggggctccctgcattcaaagtactttacctttcaccttttcatttactaagccacttaatttgtagaggttctgtactgggcctcgtgaaactcagcttttaaataacagagataatttgaacccaggtctccctggactataaaatccatcatcttaactaccacacagtgtatccagtaggacttaagagagtacagcccagtcttaatattaaccaaaggaaaacagaagccataaaataaaacctactaggagagaaaacaaacaagaagttttgatgtactatgaacctaatttacagaaggcactatttgagaattttcctttccattcacgcaaatacagaggttcaagagtgtgtaacctcagcaattaattgttatttcctgtatgttaattacgccatgaagcaacatccattctgtatgatgcctccattaagtattatgcccactccttttcattttctctgtttatacaaatataatttcttgattatcccatgtaggtaagcctgcctcacagttggcccatacttctccatgtcttaatatggcccaaagatagctagatttaattctttttcatggaatgatttagtggtttttttgaatgaccaaatacctgttattatttctgtatgcctaaggaaataaatgttccccttctctacctgaagctgctctgctgtgtgtacatgagcattcttgtgtgtatgggtgtacgtgtgtctgtgtgtctgtctcacctccagggaaacctaacactatcgttttataccataactgaataaatcacagcagtcagagagatgtgaacccaaggaaaattattataattaatggaaacttcagggaaagatgaataatccaaggagctcagaactaacccaaaatgaaaataataatagtaaatgcagcatcctctctgataaaatcttgggcccaaaactgcaacaaaatgagaaactccatttaggtggaacatgggtgttttatcttacctctttgaatgttgaaggaaatctgctccagtagaatgagttactttgtatgggatagaaggtgaaaaagagagaagaaattggcaacactcttagcccactgaaagcagcctgcttcagaacctaaggccttgtggttatttttactcgcttgcaaaagtgaggaaggatgttataggtctctttgagcctctttgcttttaccctttatttctatatgatctacatttatattaataaattattacatgccatataagttccagaatcattccttttgacagtcccatgggatttaatcccctcctaaatcccaaaatatagaaagagaaaatgtttgggtacagcactggggcatcatgcatactgaatattcaacaataaccatttgaatgagtggatgatttgggggtcattccttactatgtgactgctcttctctcaggcagtcttagtccctgtgtcactctcctagtgtgtagccgggctgctgcctgagtgtaatcctagcctttcaagataaccatttattatatggtgctgacccctaacaacacaagccagctccatcctctggtactcagcaaaaaaaaaaaaaaaaaaaaaaaaaaaaaaacagtcatctgtaatcgtgcaggaggaaaaactagttgcgttggttatattgaatagatacttcctaaatagttttcaagggtgacctgtgactatgctgaatttctgccttacatattgattttctaatgtaaattccatgtaataatcaaatcttctctgttaacattatgttgaagactcattccttcactcaacaaatacttattgagtgtctgctatgtgccaggcattgatgcaagaatctgattgatctgaacaacttaaactatagtagatccaaagtgtttattctgtgctgaaagcctttgtcatttgcccagtcctttttgtgtggtatccataaaaagcagaccatgataaacttgcataggctctcaatgtcccacctagaatgtagatcaaagggattttgaacctttacataaaattctattgcattgttctaatttttctgaaaattttaagaacaaaaacactgaaaaatttaagaatgagtggcttaggtggtttgactgagctcatgtattaggtaatattgtatggagtcaaagaataaaaaggatgagattgataaacatcaacatttaggccagtggatccctctatggatctgagcagtaaaaagtacagaaggggcttcaactgtatggataatgttttatgtcttaagcagcattttggattcattgatattcactggtttattctttgtacattttatatatcataaatattgtgtataatttttcaaaatgaacccagaaaaaggaaaagaagataatgatatattgaggaatggaaatcaggttttaaattttttaaatatgtaaggtctccttttttggaaaatgtaaataaaagagttcagattggggtcctattccatgtgatggttctctctgttggtaggatgttttaagaattatttcacttatccctggttaacaatgtttgtcaaatatccaaaattcgtggttaaaaaaatgcatttttgaaattgctccacactctaaggcctagatcttttacccaaagcattacaatgtggttacactggtgataatggagtgatcttcccaggaagaaggcacaaggggataaatgaattttcaggcatgtgacactgattgacagggaaagcctgcacggagtgacctcactaactaacgtcttattctgcctggttatcattggcctttatgacatgaactttgagaaacccgctctcaggggatgatttttctagagataacattggcccaggactaatagagctacaatttgcggtcaaaattgtccttgctaatgtgttctttctttctctctctttttaatattttgacttcagcgaagggagcaatctgaccccagcacatcactacccagactttagatttaagacatacgctccattagcattccgatatttcagagaactttttggtatcaagcctgatgattacttggtaagaacctgtcatttttcttccttctatagaaatgtgtgatgtaaacatttgtctcatagcaacagcaacaagtggcttgtgtctctcattttataaagctctggggcgtagtaaaagttccaagttttataatgattataaatttagcttcaagaaatttgatgtgactttgtagcttttactgataactgcaaaatctgtggtggtaattgatatttaaataactataatatcagttgtgacttcagataattattctaacagatatgttataattagttctaaatactcctgtgaattttgctgattagattctatttgaaagcctttctatgttaattgccttatttgtaccattcctctcaactaccttggcccacaatcatttcaccttgacctacaaatttgagtaaacattgtaaagaatctggatagttttgttctcaagatctcttcaggcagactttttaaacatatttttagttggtacaagggcatattttatcctcagatttgtctgtgctcttcatctgccttctggcacacaagaggtacagacacaacagcctttttgtaagaggtagtctgatgtgacctcagagttttacctcattcctgttcaagaagccaggaactttctgttacaagtgaaaaaatggtttgtttcataatttgatcactgttaacaccctgggggctcctcagaattggtttcaaaagactgtaggaagaatgccatcaaatatttattgttcatcccattctgaatgatcttaataagacttgagccagatcctgggataatgcttttcagaggaagtatagcaacacgtgtaacaaagagtgcttaatatgcatcttataatttggataagatgtaaataattaaaagctgattctactctgtgctgatgaagactctcggatgtctcctctgaatcttcttgtaaaggaaaaaagaaaatctgtgaatgatcttctttatttggtccctaagaaaatcatatgacttctgcctaatgaagcaatactgcttcctcaaggcacatcaataagtctccaaagaatggtgagcgcaaggttgaaagtccctagcatactgctgcccttaaatgtatatattactctctttctctcaccactcccctttcattgaagcctcaggtgcctctacccatcactaccaatgcaagtacacaagcacacgcatttgttctgtgtgtgtgtgtgtgtgtgtgtgtgtgtgtgtgtgtgtgttagagaacaccctttggtttctagccattctgtaattactgagggttgccatcattcaggaaatatatttgagaaacccaatggggttttgatattatattatggaaaacaagatctcttatcttctgccacacactcaaatttaatggattctctttctgaatttccttgaacttctcaccagctgaagagatgccttagacttgcgtttcacactgttgatccagtcaatatgaccagatggatgcctgtctttagccctcccatatccattgccccaaaggctggaagtccattctttcattcatctggacctcacaaatttgctttctttggggaagatccttttctgaacaacttcccacacagcctccccaagtttcctaatgagtctttaagctggaaaaattattttcataatgtggttagagtatttacaaaggagcataagaatctaagctcatcacttctcacaagaaaagtctttgtccctgtacctagcaaaaggtaaattaatcaatcagtggacactttgaacaccaattatatctaaaatgctttgctcatagttgtagggaaattcaaaaaactgcaagtcatgacacacaaagaacttaaaatcaaactggaatactaatttgtctatgtagaaaaccaatcaactctaccaggcaataaatgtaaaaactgaagcaaaacatgaaatactctagggttgaggtaggggtctttctctttgttggggtgatgattaggaggtcttcttatgagcatgatgtggttttaaccatgccttaaaaactacgagggattttaaaaggtagaaaagagatggatgctcagggggtgaagggttggaaggggcactgtagaatcagagatgtggatgtgttcagttttcgaaaggacatttagtggaccaatatggctggaggggagagtttttatcaggaacattattaacattattaagagataggtccaggcaactcaaataaacaagcttctaaattataggaaactaaggaaatataaagattgacaagatatttgatggtgttgagaaataacttttttgtgggataataatatcatggttctattttaaaaggagaatccttgtcttttagaagatatactgaaatatctatggatgaaatggtttgatatctgggatgtacttcaatagtatctgaggagttggtcaaagcatacaaaatgtgaattagacagccaggcacggtggctcatgcctgtaatcccagcacctcaggaggccgaggtgggaagatcacttgaggtcaggagtttgagaccagcctagccaacatggtgaaaccccgtctctactaaaaatacaaaaattagatgggcgtggtggcacatgcctgtaatcccagctactcgggaggctgaggcaggagaatcacttgaacctggaaggcagaggttgcagtgagccaagttcggacctctgtactccagcctgggtgacagagcaagactccatctcaaaaaaataaaaataaaaataaataaaaaacaaaatttgaattagagaggaggaataaatacaggagatctattctacatggtgactataggtaataataatatatacttgaaaattgctaagagagtagattttaaagataaatgcttgaggtgatggatatcccaattactcttatttgatcattacacattgtgtataggtatcaaaatatcacatgtacctctaaaatatgtataactattatatatcatttttttaaaaaagaaaaagttcccaccacaaataaagtgatgaatatgtgaggtaaataatatgttaattagcttaattgagccattccacaatgtatacatgtatcaaaacatcatgttgtataccataaaagtatacaattttatttatcaattcaaaaattaatcggaaggattgtgtactctaaacgggtgaattgaatgctatctgacttacatctcactataactgttaaattgaatgcccccctacaaaaagaaaaatctgagggaagtagggcagcagagtggttggaggtctagaagaaacaagattggccatgagttgatcattgattgatcatgaatgagttgtccatgagttgacgctggaagatagatacatgagtgttaatttcacaattcttttcgcttttatgtacgtaaatataacttaaaaggtagagagaggccaactgtggtggctcacgcctgtaatcccagcacttagggaggccaaggtgggtggatcacctgaggtcaggagttcaagaccagcctggccaacatggcaaaatcccgtctctaccaaaaatacaaaaacgttagctgggcacggtggcatgagcctgtagtcccagctacttggtaggctgaggcaggagaatcacttgtaccccggaggcaaaggttgcagtgagttaagattgtaccactgcactccagcctgggcggcagagcaagactgcatctgaaacacacacacacacacacacacacacacacacgcatacacacacacacacacacacacacgcatacacacacacacacacaaaatagagggaaagatagagccaggtatgtaagtgtgcttttgtttgattccatttgtccacctccctcattcaccacacacatggttcagtgtctagacacatctctggggcttgcaagaaacagaacaaaggcagtggccttagctaaacataactacctggtccccaacagctgctgccacccacctgtgcctgcactggggacacctgcagcacaggactgaggcagctccccaacaaactttggagtctctggaagctcacctccaaaccgctctatctgggactgcacctaatgatctggagtgtgatagatgaggaaagggtcgtttgcatgacacagcatgcttgagtgtcaggtataataaccttcagcgactttttagctcaatccttcattttacagatgaggaatctgaagctgggatcagcaaagggagatgcccaaggttacacacattggtgggggcagagcctagaccaaacagtggtctccccatccttccccaagagcttgaagacccttcaccagctggcctcatgctttccatatttgatgagaatcacagacctcttaccaaatatgtactcaaactagcctcttcctagcccattgacctgtgattgtccattctgaagaatacagctgaaagaagtcaaacacctttaacaaaacacattgtggaagagtttagctaaaggaaagcacagaaataggaaataagacattgcttgaaaaaccctgtgaagaaacaaaggatacagtgccaatcacaaagtgcatcgtggtggctgtcaaactggggctactcaaacccacacttgtaagatacagtgagttaagttggaggtgtgggaacaatctctagccattggtaactccatacttaggtgtgatattgaatacctgcgatatgtgtgtatttctacttagctttttgctgttgcatctggattcctgcctgaattactctgtttatgccctccatcccattaaaattcaccctgtgcatgctgattacaagtttcatgttgaaacatgcataatttggattgtgagacagtatggtgaaggggcttctgtacatacagcagtgcaaactttccttcttccttattcctagacaaacacctcccaaggcaaagccaaagggccccagagcattcccatctctgcttgggcaaccagctatgggttctttccttctccatcatgtgcctggatattcaaaaatccagtagaacttatatgagtcttttcaggctcacctgcgccaataagaaagagagcagagtgaatatttcatactatcgggggaagaaatggcacataaaattatctccaccacatggggcaagtttacattgttaatttacactggcagggcccagctgggttgtgctctgctttttctttttctccagtgaatatagcagggagaccctgcaggaaatagaagcaagagcatgaatacattagaacagcttgcacagatgacaagtgcctggaaggtgcataaaacccaggagcacacatgggggcttttgatcatgactaattaaaatgttcccatctctcctcttcatttgctcttaagaggcaatgttgcaaagaaggtggcttagaagagaatgtggtaaccaagttgtagagtgagaaaccatagaattctacagcataatggtgatactcctgttcagtatcataatcacagtttattgcacattgatgctagtctatgaatagcccccaaagggttattaaagtggatcaaaacaatttattatttcattcgtgttatgtataaatgacataataaaagaatatttgacaatgtagtaaccaatgaaatagtcttcatattatgtcactgcatttttttttaatgtcactgcttatagaagaattggagactttaattgggagcagatgttcaggtctgaatccagttttttctagacacctctttccggatcaccccctaatttctcaatttgcaacctctaatttctgcatcctttgttgttttcatattttcacaacataaactcctacccataaggaagttctgtgtcaggaattcaaatgccatggaacaaagaatccaaattcctaaagagagtctagggtctgcctttactttttatgagagcttggagtccacacctttatattccagggtcccaaattcgtgagtaaatgagaaacccaacattttcttgcttcactcagaatgttttagtgtctctttggatcaccctgaagtcatgggcagtaggctgagaacctcagtgtatcctagggtggtatcagctcttccttacctgcctgtggaatgagtatattgtaggccgtgtgcttctctcacctgtgtgtgatcatgtcataaaattaacaacagcaatacatggtcactctttgccagggttttcaaaagcattcactttaaaaacttccagtgactttccagtagatattattacctttattttagaaatgaaacttctaaaactccaagatgctaaattccttactcagaatcacataactagcaactgatacaaatctcacgcccttttcacaaatcgctcttccacaaggacactttgtctgcacacatggctgggcaagtgctctctgattcctctcggtttttatggtgtcctgtctgcagtctgatagctatttttgttttcctaacttatcctcaactcatctgtaggcttaggctctaatgctgtttagcaagagattgtcaagaagcaaggctaacagaaagaaggggaagtggacgatcaaagttgccaatgacttaggaagccagcagacacttgcttctttcttttctgggataattttgtttcctttatcctcagtattttcaaagcaaaataatgtaaaagatgtatctagaagctaccttttaatcatgtttctgctagtttctctctccctcctctccctttttctttcagtctccctcctttcaggtttttctatgatagggacttaaatattcacaagctcagaacaaaaattgtgggatttttagccttgatgttttttcagatgcctacatcctcaagatatggctgtttatattacagagctgtagtatcaaaacagcatggtactagtataaaaacagacacattgaccaaataggatagagagcccagaaataaacacacacacacacacacacacacaccctatagtcaatagacttttgacagaagtggcaaccacacacaatggggaaaggatagtctctttaagaaatgatgttgggaaaactggccatccatattcagaagaatgaaattggacccttacctcacatcataaacaagaatcatctcaaaatggattaaagtcttaaatggaaggccagaaactgtaaaactactagaagaacacataggggaaaattgcgcagtattgatttaggcagtgatttcctgaatgcaaccccaaaagcacaggcaaaaaagtaaaaatagatcaaaagggttgcatcaaactaaaaagcttctgcactacaaaggaaacaacagagtgaagagacaatctacagattgggtaaaaatatttgcaaataacgcatcaggtaaagggttgatatccaaaataaataaggaactcaaactactcaataacaagaaaactaataaccctatttaaaaatgagcaaaggacctaactatacattcctcaaaaaaaaaaaaaaaaagatacacaggccaagcatggtggctcacccctgtagtcccagcactttggaaggctgtagcaggtggattgcttagcccagaagtttgagactaggctgggcaacatggcaaaaacccatctctacaaaaacacaaaaaaattattcgggcatggtggcacgttcctgtggtcccagctactcaggaggctgaggtgagaggatcaccagagcctggggaggtcgaggctacaataagctgtgatcagcccactgcactttagcctgggtggcagagcaggaccttgtctttaaaaaaaaaaaaaaaaaagacatacagatggccagtagatacattaaaaaatggtcaacattcttaatcatgagagaaaaccacaatgaaatatcacctcatacctgttagaatggctgttatcaaaaaagataaaagataacaagtgtttggtgaggatgtggagcaaagggaactcttgtatactgttggtgggaatgtaaattcatacaaccattttggaaaacagtagggaggttcctcaaatagctaaaaatagagctaccatatgatccaacaaccccaccactgggtatctatccaaagcaacggaaatcagtatggcgaagagatgtctgcactcccatgtccactgcagcattattcaaaatgggaaagatggaagcaacataaatgcccatcaaaggacaaatggatttttttaatgtgatgtatatacacaatggaatactgttcagcctttaaaaacaacaaaattctgtcatttagaacagcatggatgatcatagagaacaatgtgctaactgaaaggagccaggcacagaaagataaatatcacatgatctcacttacttgtggaatctagaaaaatcgaactcattgaagtagaggagaatgatgattactagaggctgaggtggtagtgggtggatagagaatagggaaaatgttggcgaatggatatgaagtctgctggatggaacaaatcagctctggtgatccattgtacagcgaggtgaacacagttaatgtatatctttctaaattaatttaaaaagtggattttaaatattctcaccacaaggaagtgtgtatggtgatggatatgttagccatcctgatttgttagccattctacaatgtattcatgatcaaaacatcacatacccaatacatatatacaattattatatctcatagaaaaacaaatactgcatgttctcacttctaagtgggagctaagctatgggtatgcaaaggcatgcagagtggtataatggacattgaagacttagaagagggagggtgggcaggggatggggaatgacaaactgcctattgggtacaatgtccactactcaggtgatgggtgcattaaaatcccaggctccaccactatacaattaatccatgtaatcagaaaccacttgtacccctaaagctattgaaataaaaaaactaaaattaaacaaatcattatttgtcgatcgaaaatttaaaaatagaaaaatttggccaggtgcggtggctcacgcctgtaatcccagcactttgggagggcgaggccggcggatcatgaggtcaggagatcgagaccatcctagctaatgcggtgaaaccccatctctactaaaaatacaaaaaattagctgggcatgtagtgggcgcctgtatcccagctactcgggaggctgaggcaggagaagggtgtgaacccgggaggcggagcttgcagtgagccgagattgtaccactgcactccagcctgggtgtcagagcgagactccgtctgaaaaaaaaaaaagaaaaatttaaagatgatgtggttctttaagcccctgcttctgctaggctgggtctgtctcacacctgcatggcctccttatctttttctctgccacccagtgtttctctagtcaattatgtagcttattaattaataaacactgagcttaataaaaccaaaaacagacttctttgctggttttagcattttttggtgacatttacagccatacaattattggtggagttcagccatctgacggaaatttcttgagtaccaaccatgtatgtaggcacctaccatgttccaaggcacaggtcctggaactgtatcacagtgtaagatagtcacagtttctgctgcaccgagttttacagtctctgcaactcgaggaaaaggaaacaggcaattgcaggattttgtggtgacttctgtgatgagaacatccagggccaggaagcaattgatcttttatccgcggaaccaggaagagttttccagagcaagtgctgcctcagcaggcactgaaagctgaagctgtggcaacagtctatgaattatgctccctacatcttccccttgtccttctacggtggtttcctaacccaacagagtggtcctctgctccagaccctccaatggcttttcggcccccttagagaaaacaacaaagtccttccagtggcctatagcactggatgtggtctgtccccttgacctctctggctccatccctttcagggctcctccttgccctctctgctacagccactggcctctgctgtgccttgagcccaccacatctcaggcctttgcattttctcttccctctgcctgaagtgcccgttccccagatagccatgtggcttgctgcctggtctcaacctctgctccaatgtcacctttgcaaggaggccttcagtgaccaccctatttagaatttactgcaactcattcctcactctttgctggtattctctgctgctttttccatgatccatttttttctccactgcacttaccactttctgatgtgtaatgtatttacttgtttactgtctgtttcctcctactgggatataaactttatgagtgcctgggacatagcagatgctcaatagttattttttaaatacagcaatgagtggtaggcaggtgaaagtagaagggaggttgtcgcaggcacaggaaaacacaaaagcctggctgttgagagtatgcagcacttttaagaacatgagaagttagtctctgtggctagagctaaagttgaaggaggaagtcatgagagagaaggctggggaggaggctgggtcattcatggccttggaagctctgttaagaaccattgatttttagatctcacaaataagtgagaacatgcaatgtttgtctttctgcaaaagatgtgaaagcccagaaaaacatgaagagatttgcattttagaaagatgcctagtttcctggtgaatgtactagaggggatgagagtggacaattaagaccagaagcttgccataacaatccaggcatgaaatgatgaaacctttgaactaagggtgttggcagaggcgggcaggcagcatcaacagtctggttaggaaagatgaggaaatgtgaggaatcaaggatgatgccctagtttctggtttggggaataaggcaaataatgcttccattctctaagggaaaaggcagagaacagggggcagatgatctagggtcaccatatgcagttgtgcaggctgtgcactgctcaagctctcctacctggccgaggggaaggagtggagactggaatccagccttttttttttttttttttgagcagagtctcgctctgtcgcccaggctggagtgcaatggtgtgatcttgactcactgcaacctccacctcccaggttcaagcaattcttctgcctcagcctcccgagtagccgggactacaggcacgtgccaccacgcccggccaattttttgtattttttgtagagacaggatttcaccatgttagccaggatggtctcgatctcctgacctcgtcatccacccgcctcagcctcccaaagtgctggaattacaggcgtgagccaccacgcctggccccagcctttcttctactcaccaactttgtatcctagcccagagctgcatctaccaagataaaaagttgcatctttctaattaccacaaaggcaccatgtgggctaaccacagccttgagatgaacttgattgtgaacttattgcatataaattgtgtgtggtataaccaaaatagaaatgtctattaaagtgttagatgaacaggtcttgagccctagcgaaagatctgggctagagatacagatgttgaagtcatctccttgttgaaaccatgagtagatgacatcttctgggaaaatcatgaaaagagaatagggttggtgttcaagtgataaaacacagtgcagttcacatcttcacttgttattttatggacatttgctggaaacaaagcaccttagtcaacacaactgtttgaattatctcattggactgataggatgattcatgattctatcgcatgactctgggggttaggagtgtatgtctgtttttcatcatagaattattaagataaacagaccaattaaatctttagaaatctcaaaaagagccttctcggtatacgtggagcctcttttaaagcccgtagagaggcttcttgtttcaacatagctaagatgtgcaatgctatgattgtcctccttggaggcatcacgtacatcaagtatatgttttaatgtttattcatttacccttttagtattccatctgcagtgaacctctaatagaactgtctaaccctggagccagtggatccttgttttttgtgaccagtgatgatgaatttatcatcaaaacagttcagcacaaagaagctgagtttcttcagaagctactgccaggctattacatggtaaggaactgcacatcattaatgcttctacttgaagtttaattactttcctcaacagtttttttctgttgtttttttcagtgactcaggcatgtttctttctctttggtaagctttattctgcatttaaattatgctatgacattcattgaatagattttttaaagtaaactagaactgaatggcagagcatacttgttgaatcccacaatcctgagttcaaatcccagctcagccaataattaactgtgtgaccctgagtaagcagcataactggtcagccttagttccctcagtctttaaaggctgagaaatacgtggccaggcgtggtggctcacgcctgtaatcccagcactttgggaggccgaggcaggcagatcacaaggtcaggagattaagaccatcctggctaacacagtgaaaccccgtctctactaaaaatacaaaaaaattagccaggcgtggtggtgggcgcctgtagtcctagctactcaggaggctgaggcaggagaatggcatgaacccgggaggcggagcttgcagtgaatcgagatcccgccactgcactccagcctgggcgacagagcgagactccttctcaaaaaaaaaaaaaaaaaaaagctgggaaatacttatcttacatagttgttgtgataaagtaaggatacaggatataaaataaaggaaagataaaggaagcaatgtgtttcaaagctctttgcagccagtacgcagtaatagtataaatggttaactttcatggattgcttactacatgttaagcaaggccttaagtgctttgcattcattaactcatttaatcctcacagcaaccttggatactacaattatcacctttttatagaagaggtaattgaggcaaagataaattaagtaacttgccatgggtgattcagctggagagctgcagagctggggctacgcaagcaaaagggctccagagaatgcatttttaacccctacactaatacaccggaacatattctatattagctgttctcagctactagacttcagaatttagaatttcatgggtaaatgtgatagtgtgaaaaatcacctttcatgtaatattttagagacaaaggaacagtaacttagcctagacggatttactacacgtttactccaaaattttcaaaactatccccactgttcctaaatagtccaggcattttcatacctccagtttcattgtactttgataacagttcttaattttctatgattggaagggctacatgaagctgtctggatttcagaagcccaagttctgccaatcacttgctatgagtggtgataaatatcatctttgtttttaaaaatgcattcatcagatgccatgttatctttttatgtaaaaatattattttaattccaaaatctgctagacacagcattaaatacttaaattaatctcatatagaagtataaaaataaaaaatctcaataaaaatcttagtggcatgcaggcagattttaaaatatttcaatactgagcaattatttttttttggaggaacagaaaatatagaaaagccaaaaaaaaaaaaactaactatagtttctttcccagagatacatattactaaaatatggtgtatatgctttcagttattctttgttcatgcacacattttaaaattatctaaaattaggatcaaattgatataatattatttgataacctgcttaattagtaaatcttaaaattccatagttctgagctcagatatacttgtcctcttgtaaaactgcattggccatatttgactacttatatttaattaaaattagataaaaagttaagggccaggaatggtggctcacacctgtaatcccagcactttgggaggccaaggtgggtggatcacttgagcccaggtgttcaagtccagcctgggcaacatggtgaaaccccatctctacaaaaaaataaaaaattatccaggcatggtggcacgcacctgtggtcccagctacttgggaggctgagaagtgggaggatcacttgagcctggaaggttgaggctgcagtgaactatgatcaagccactgtactccagcctgggagacagagcaaaaccctgtatcaaagaaaaattaaatttagctgaacaagtgattttatcccaattatgtaagctagtataacaatataatccaccccattaacaagaaaaaatgtgaacgtcacgtggttacccaaatagatgttgaggagaagctaaggccctcaaaattcaacatcttcacttaattaaaattctaaaaattggcaggggagtttttttttttttaaaaaatgataaataaatcaatgattatacaagttgtacatttatcagtcttccaaaagttcacatgatagctcatggaaaaatacaagaatcctttctctagaaacaataggaatagaccagagtgcccctcccatcaatagtcctttctgataaatttgctagaaattctggcactgagtcttgagtacaaaaagaaatagaaaaaagtacaagcactgttctctttaaatgacagaattcaaaatgagcaaaccttcattttgctcatgaaagtaaatcaggaatttttagaagtgatatgactccagcagatttgcaggataaaaggtaaatctacaaaatccattatattccattatatagatgatatagagtgggagaatataagggaaaaaagagatcctgttcatgatgacaacaacttataatgaaccctattagaaaaataagtaaataaagtcatgtgagtactgtaattctgattgggaaagcaagatatagtaagtggaaaacataaacaatcagttcagaaagaatgtaataagaaaaattctaaaatacttgaatctataaaaacaaatgttacaagaccaatatgaaggaaactacaaaacgttattgaaggacataaagaagatctgaaataatgaagaaatctgcattgttcctgaactcagtattgtaaagatttcaactgctcccaaatcaacttataaatccagtctaattccaagcaaaaattctaataggatttttcacatagcttgacaaagccaatttctttgaaagtgagagcaagtctcatttgaagaatgttttttaaaatgaacaatcacacagaaagattgtaagaatggagaaaacatttttgaaaaagaagaaaaatagtaggcctgctatagcatatacaaaaaatatataaggctgtaactaatgttaaggatgtaggatgagtacagttttagacagataaattaatggattcaaataaagtgtccagaaatagatctatgtgaatttgtctacttactgtattgacatggagggatttaaactcaattggaaaatgtcagactgttcaataagtatccatttgaggaaaaaattaaattctctatttcagatctttcacatacacacaaaattaattccatatggagtaaagaccaaatgtaatgaccaaaactattaaaaatttggaagaaaataaaagtttatgactttgggatataaaaaagctttgttaaacaaaaagcaaaaagcaaacacacacacacacaaataagaaacaagtaaataaacatgaccacatcaaaaggcaacacatttaggccaagtgcagtggctcatgcctgtaatcccagcactttgggaggccaaggcaggaggatcacttgaggtcaggagttcgagaccagcctggccgacatatagtgaaaccctgtctctactaagaatacaaaaattatctgggtgtggcggcacacacctgtagtcccagctacttgggaagctgaggaaggggaatcacttgaacctgggaggcggaggttgcagtgagccaagatcatgccactgcactccagtctgggtgacagagtaagactccgtctctcaaaaaattaaaaaaaaaaatttaaggcaacacatttatataaccaaaaataccagacacaaaattaatataagcaccttgaatatttctggaatgaaataaagtgagagcagtggttttctcaaatgttgagaattgggggaagaatcaaggatagcagagacacttttcattgactacatgccgttttgtaaactattttaatttcttatctactttaaaagggaacaaaagtaggcatgtattccctattttttttcttttttttttttttttttgagacagagtctcgctctgtcaccccggctggagtgcagtggcatgatctcggcttagtgcaacctctgcctgccgggttaaagcaattctcctgcctcagcctcccgagtagctgggattacaggcatgcgccaccaggccaggctaattttttaatttttagtagagacagggtttcaccatgctagccaggctggtctcgaactcctgacctcgtgatccacccgccttggcctcccaaagtgctgggattacaggcgtgagccacagtgcccagcctccctgtttttttaaataataaaaaagacaacagactagaagaaactaccccatatagatgagagaaatgataaatatccagagtatatcaagaatttcaacagtgacaaaaacctgcagaaaaaaatgagcaaaattatctttaaggtgactaaaaatacataagtaatcaatggcattcaaatttttaaaaacaggtttctatttttcactaatcatgcttacaaagattttaaagtttgggtactattcagccctggtaagagtaatgggaaaatctatgtacagtcttacatagtgtggttgtaaattggtctgccattttggaagacagttttgcaggagctattaaaattttaaatgttcatccctcataccttggcaattcgttttctctttggctaccttagagaatagtcactcatggcaccagtcaattccttgcctgtttttagttggagccaatttgggacattatgtccaatccagtcactttcactgccctgagtttagaataataaaattgctgtccagtaagcagacttaagaaatagattagaaacagcaaaattttagtaatgaacattaataaagataatcacatcccatttttaattattatatcagcatgaaaacacatctttagtggagcattattttgtcaaaatagaagattgtaaatatatttttctttttttggtttctagaatttaaaccagaatccaaggactcttttgccaaaattttacggactgtattgtatgcaatcaggaggcattaatatcaggattgtggtgatgaacaacgttttgccacgctccatgagaatgcactttacatatgacttgaaaggctcaacgtataagcgaagagcatcccgtaaagagagagagaaatccaaccccacatttaaggacttagatttcctgcaagacatgcacgaagggttgtattttgatacggaaacatacaacgcgcttatgaaaacacttcagagagactgccgggtaaggaagtttgattgttgtgatttcctttgaactctgtgctcatgtaaactgtggctgccacttattgaaagcatagaaataaggaatgtccaaagtggcagacatgtggaatcctatctttcccaatcctggcgctgagccatgcttccctgatattgaaggaattggtagatgataagggagttatctagagtccttaacctacatctctgttgattttactaataagctaagtcagctttctttgataaaatgaaacaagaaagctttgttttcttttctttctccgctgtggggaagatagtttaactagaaagaaatagaatttaggtttaatgtggtgttgagtaagaaaagccgtatagaaatcttggaagaagtaagactcgaactggggagacaagtttaaagaaaatgtacttgggattaataatggctccctagagatcagtgtggatgcaaaactatgatatgagcagcacgtttgctgaaattattttatgtggtctgaataagaggtgagcaggaatgaagcttgccaattagggcagacaccattccatgcaaacttagctggagtgattgtccaaagtggggaggaattcccccaggctgcaatgctttaaaaaaaaaaaaaaaaaaaaaactaagggaagattttttctaacatggtgaaaagagataaaaatttttttagagaaaagaaaaatgcagtgctaataacttctgaaggataataatcatgggagaaccgtccagccacttggctaagttgggtagtggaggtgggcagaaagcatgatggcacaggctgtggttttctgcactttccatgggcctggacggatgacccatgttgttataggggaggggagacacttctctgccagacccaaactcacgtgaaggtgaggaagacagtctgacaccccttctaaggtataaagtagggaatttccactaaggaacacaggtctactgtttctgttttttttttttttatttcttcctttctgcctgttatagcttgcatgattgtgcacaaaaatgtgtccttagaattgtttttctttattgacagagatgttactcctattgtttagctaccgtttattgaatgcttacagtatgccaggttagtctaaggtttttttaatgcatcatttcacttaattctctcagcaattctttggagtcagtactattcatacttccattttaattgctgaagaattgggttcttaaagagattcagaaacttatccagcattacttaccaagtcaatgacagagcccacatctgtttgggtacaaaggcatgtgcttctaacaactaaaacttaaagtctcactctgaggatttttttttaattatcttttcagaagtcagggaaggagcagtaggaaccaagcaaacagacgaacaaaaaacgtccagcagatattcagatatctgagtggatttgagtgatgcatgtttttctattcaaaaaacgtaaaaacagaacacacatattttagtagaaatctttttcctgtgttttttctgccctttacaggatgtgggtaaaaagtgactctcaattccccagagtttagtgtcagcctctccagttttaagtttgctttctcttttgtgtgcttcttgcctctttagtatggaaagcctttatctgctgccttctaataccacatgcttctctgccagaaaaaaaaaaaaaagcaaatgtaaaagagccattgctcaggatttgtctatttattagtgtttcctgagctcaggactgagaccgcgaggtcaaaccaaacttttcatcacaagtgagaccctggagatttgcctttttattttttattctttggcaggtttgttgttctaaggaacataaaggtcaaggtagaggtatcctgaggctaactccctcttactcactgcatttgcagttgtacaagacacagatcctggacattcttcaaaatatgtacatctgccttcagaaaggcttctcttgggctggtatgggagtgtgtaaatgctgagctgtaggggaactcagctcccttccctgatctgtcctgaccatgaccaagtcctctgggatctggattcaacagctggtgctctgagcagagctgcctcaaggaaagcctatttctggaatggtgaatattaatatttaatagtcaagggcctcttagtaaatcgtatgaatgctgtgaactctcctccccccaaaaaatgcccatcctcgtgatggatcgtgaatctcttggagcccgttgttccttcccttccttcttccccaaggctcagaatccccttcctagagttacctctctctctcttcaggtcatcctctgaaaggccaactcactggatgattgcaataggatatgtggttgacatcgccccaatattgcccttgctttgcagagctgagcctcagtgctggctgaggggctgcagagacccagagggtctgcaaggttagtctgagctgaggccagcacctatcaatcaggaatctcctctgctaaaattcctgtgagacagtatggctaaggctctagaaacaaaccagttagagaaatgtattactgtatcagcaccccaggcagagaaaggtgaactaaacctatattaggatatatgcttctattcacttatcagcacatattgcaagcacactacatgccaagcatgaggtgcacgacctttattttttatcaattgccatacagtctagtatgtgcaatgatattatattgtgaagattagagtagggaacattgtagcttgcttttaaaggatgagaagctttctccggataggcaaagcagtagaagcatatttctaggataagagaacaataggtatgaaacaatgggtgtgaaatagcacaatgtgttccgggagctatagttgtttggttttggggcagttaatagggagagcatgtggggtagaagaggaaagtggccacataatatgagagccacatattgtcagaagaccctttctggtggtgccagggagctcttaaggacttagcagtagcaaatccaagaatcccagacctttggaccccagcttctttgttgttcccagacggatttgttaagcctcttaacctatggctgacctccccctgcttcttggcgcccccacctctcctttcatattttggcttgacatctcagaccctggaattctatttcctttagcatgagtgctggccggaagggccagcttgacctagcttattccctgctccccatggactgcttccctgactgccaatcagagctgccgtttctgagctctgcgtctgaaaagacctgaacagcctcatcctgcactgagtcctcctgacacataccatcttctcctggcatccttgtggcagcccctgagtccctttgcctggcttccccaagcccagtcccagacccctgtgtataataagcctgccctttgggatggttcattcctgaccaactcctccatgtagcacattggccacttggaactattctagaaaactgatcttcttttatgcctcaaccctgctgagcccaattcccccacaggatcagagggctctttccaaaagcaggcatccagatgtcaggttctgcaccccatctccacattgctattccccattggctgtgtgtggtgggggagaaatggatatgtaaatgatgagtcccctttcttgaaggctttcctatcccttggtctgaccctctatatgctcactgccacagccatccatacccacaagttaatttgagccaaggaaagagtggtgacattgagtactacaaagacatcacagatcacttgctatcaaaaccagaaagcaggatttattcaaaccatccccaatggctcccacgtgacagacaagctgagatgcgtgtcctatttgaaaactgctcatcccaggtaccccttcatcttccgccaggcctgcacctcttctagtcttctgtgacccagggaacatgaccatcgtgcagccagatacccagatctgcaccctgaagctactccttcctccctcctctccctctttccctgcatgcagtaaaatcaccatgtcccagtctgcctaccaaataactcatggctctgccccctcctcactgtaggcacagccactgcttttattgagaccgtggttattcatcacctggagttttgctgtagcctctttgctggttttcattatcattgccttccatcacatccccaccactgctgccagactgatcctctgatcagaagacttaacactctctggccaaggttccccactgcttttgggcgaaagccagtgattcccagcttggaacattaatatccttcctgatctggtccctgctacattctccagatgcgttcttcagcttctgtctccagccttctctctcccctctcctctgatacagatccccactctccagctcttctaatctactggccacattctctaaaggttttggtttttttatgcatgcctcactctgctggaccgttcttcccctcttctacacctggccctcacctgctcgtctcaggactactcagggatcagttcctccaagaccgtgctgttgtggttccccatgcatcctgggcttacttctttcatgggacttaatacactgttactttttcacatgtaaatcctggagcctgaggagcaaggcttaatctatctttatatctacatgcctggttcttagtaggtacttagtaagtgtttattggaatatgtatttgaacagaggaataatcagctgtctaatgatttaaaaaaagagaaagaaaggtttaggtaagaaacctgtctttggtgatttttgtgtatctagctattttttaagttctgcctattttggaggaagtatccagtttcactgcaatgcctgccaaaaattgcactgagaatttaataaagtagattatctccattttgaatcacttgggattatttgaaaagttgtactggttgtcctcctatcaagagtcatttgtgtaacaaaagtacatttatattgcagtgagttttcccatggaagcaatgttgtaaatggtcattagactttttttctttccaacttttattttaagttcaggggtacatgagcagatttgttacatgggtaaattgtcatgagggtttgctgtacagattatttcatcactcaggtaataagcatagtacctaataggtaaattttccatctttctaccctcctcctcccgccctccaccctcaagtaggcccttgtgtctgtcattttctactttatgttcacatgtgctcaatgtgcaactcccatttagaagtaagaacatgcaatatttggttttctgttactaggttaattcacttagaataatggtcttcacctccatccatgttgctgcaaaggacatgatttcattctttttatggctacatagtattctgtgttgcgtatgtaccatattttcattatccagtccactgttgatgggcatctaggttgattctatgtctttgctattgtgaatatggactttattttattagcactgacccctgtcttctttaggtgtatgtactgtctctccagcgagactttaaatgtctcaaagggcaaagctcattctttacacctctctgcagctgcagcacctggcttattctatacactcagtacatgttgcaagattgtgattgaaaactcttttgaattgaaaatgtatatattaattttaaaagaacaattaggatctatttttgtattcattgtaatttaccatgattattttttctctgatataagttatctatgtaaaatctagaatcccatatcatttaattaatttgataaatttttatatgctgaaatatttattaataactctgggaaatgactttgagacaaagtatattagtgagaacttgtgtttacaacccaaatatttttaatccttcaagtgagagtcatttcagagacagtcttgataattaatgacctaatgacttattttacatttattataatttttgttgagccgcatgttattaatttttaaagagtgtggaaccaattttcttttttcacacaaatgactgtaaccataaatattaataggttctcagaatttaatgaaaccagtctcaagaatactgaaactttctgatgtgcaaagaagggtctttctatgtaaggcaagttctgaatttatgaatcagattcttaacagctatgggcatgtttgcatgggttacaaaatgggttattttatataatatttaacattatggctattgcttaccattcagctataattttgctggtagtaaactttttacattttgttcagacagtttattttctttttttgatattgcttgccttctcagttatcactggggaagaaaaaatgctttagacctaatacaaaggagacgtacatatcctgaaggtagaaatacttcaatttaaattatcctctcatcaataaggaattcgattttgtttttagacttcaatcaaaacatgaaaagggtgcagggacatcattgactccacactcctaaattacttgttttgtttttgtttttgttttttgaaatgaagtctcactctgctgcccaggctatagtgtagtgcataatctcggctcactgcaacctctgcctcccaggctcaagggattctcctgcctcagccttccaagtagctgggactaccggtgtggaccaccacaccccgctagtttttatatttttagtagagataaggtttcaccatgttggccaggctggtctcgaactcctgatctcaaatgatcctcctgcctcagcctcctaaagtgctgggattacaggtgtgaagcaccatgcccagccaaatccactgtctttcaaagtgtgttttacaaacactgtaaacccatgagatatttgatttgctccattgtcttaaaattatgagttttggctatctgtaatagtttgatatcatagcagtataagcataaagcaaagttaaagttggtgaacaaataaaaccaactcatagaatcaaagattgttcgagttggaaggaatcctaagagttcctaagaaacagtaaaagaatgccttctactctctggtcttagaaaaaatgattttggacttacctagccaagccaggttttattgtgagaacagaaataatgatgtcatatcatatatgcaagggctttgtaaatttttctacctgtaaatttttttactttgtattttgagataatagattcacatgccgttggaagcaataacacagagagatatcatacacccttcactcagtttcccccagtggtaatatcttgcacaatcttgcacaaccttagtacagtatcacaatgaggaaattgactttggtacaacctactgacgtttttcagcttttttcagatttcaccagttttacatgcacatgtgtggtgggggaggttctgtgcaatttcagacgtacatagatttatataaccaccaccttggtcaagtacagaacagttctttctcaaagatgcctaatggtacccttttatagccacagctacctccttccctcacaactcttcctaatcctgtgcaattaccaatctgttttccatctctgtaattttatcttttcgagaatgctgtataaatggaatcatacagtatataacccctgagattggcttttttttactcagcataatgccattgatattcatccaattattgcctgtatcagtaatgtgctcctttttattgctgagtgatatttcttggtatggatgtatcacagtttataacattcacccgctgatgaacatgtgggttttttctagtttttgagtgttacaaataaagctgctgtgaacatttgtatactggcttttgcgtgagcacaggttttcatttctctgagataaatgcctgaattcaatttctatgtcatatggtaagtgcgtgttgaattttttaagaaactgccatactcttttccagagtggttgcaccattttacatttccaccagcagtggatgaatgatccatttttctccttttcctcactagcatctgctgttgtcactattttttattttagccactctggtaagtgtgtatttaagtctcttgctaaaaaattacttgagtatatgccccagaaaagctaaagataaatctaataaagcagtttggggatatagaaaagagtggtgaaaagaaagcggaaaaactcagtggttaagtttagtgcctggtgatatgcctgtgagactatgcaactgacaagattcctaagaaaaggcctgcgatacaggagtttaacgtgtgtgtttctaataataagcactcctgtgagacttcatctaaatctattctacagccattggtgttgcttcattatattgtaattacttgattacatgtttaacgtttgctactaaaaatctgctctgtgggaactgtggaacctcattttcccagtcttagctcactcgagagttcttacacagcatttctcttggtgtcaatcttctgatgaagcctaggaaatagcaacagcaaacattcttggaatagtgaatcttacctagtcaatgcacataataaaagcaggttttagtaataacctacacatggtttgtctggaaagaaccaaggtaaatcatgtcaacattgtgaatttgtggattaattgtttggagtacatttgtattgctcatttgtccaaggtctgttaaaggccagtgaattactaaattgcaactgtgttgacctcttcatcctctcagtttttatttaggtggcaactggtgtcgccattgaagaccatccatacaccacaactgttcagtagtcttgggagggggctggtgtttgtctaggcttttgccgcttgctgcagcttagttctgctgaaagtagggaatggaaatgagctgctggcagcaacagaaggaacacaataatccatgcaagatagtgtcagggtagctacaaaaatcaaaataactctatgctgttgttcatgcctgactttctactaagtaagacaattcccaaattttacagaatatgctcttctgggttttggtggagagagggttccatcttggatataacctatagataccaaagtaacttaacatgtaaaacaaatcatatgtaatatgtaatcatcaaatacgtatatacaatacaatacataatactttattgcatggacaataaggatgcatttccaaggcttactttatctgtgggttggttcaggtaacatttatttaaactttgagccagacaatctattacatataggttctctcattcatcttcacaacagccatgtgaagtgagtggtatgattaccttttgacagataaagaagtgaatcctcaggagaggttcagcttccgcaggtccacagagctcacagtgctgcatccagaatttatacccaggtctctctgactccaaacccatgttctttcatcattacactctccttaaggagcttgtgtgtaatggtggtaaggccactgaaatgaaaacattaagtaataacatggacagatataggcagcatgggctagaagtgctcaatgactggtcacctaactctgacaaggagatacaggggcagatgctgtaggagtcaggaaagggctcaatcctagtggagagcttggtttggacaggacaatgagttcatgaaatcttgcagcctatttcaaggaaggaacacagtgccaagtgactaaggaacacaaagtaaaataaataatccaaacatttaattttaaaaatttaatgaaaagcataatcaagcccattgacatttgccaactgttaccaatgtgcatgcacacgaaatcctattaagttaaaagcgaggcttccttctgagcaatgcagcggttacaggggggttgattgtttttgaaatcttgcaggggaggagattagggactcaatgtgtgacgttgaatcctgtgtgagcagcttttgagaattctgattcactacagaaacggaaggattatcaagtcagtagtttgcttttttttttttaaactctcactgcaaaccaaagtattatcaaaatttctatagaaagaatgaaaatgggagactgaaggtaatttcctcggctctaagaaataaactccttttcctttcttcctaaaagagatattacctaaagattggagagttgaagcatttcctgagtttgttgttatgtgtctagcaagttttcattttaagtaacttgtcccacagaaatttatatatgcaataattcaagttaaggagagctaaaatctttgggcttatgaaatagaacaatgttatatctactacttagagtttctggcttttttgtaaaaagaacctactggtctctgattagatgaccctaagtgtaggagtaaggtcaatataggccccaagcggaaagacccacaaagtatttgggggagggagcaaagggaaggaaatgcccccaaggacccctcttctcctccctgttgagaatcctgggagtgcagagaggaaagctatggcaggaaggggaagtggccacacggggcctgatggtagcaactctggctttgaagatgtatctggaaaggctttgaggttggctgctgtggatctggttgtggattctgacgtaagccagtcatacagatcatgatgcaaaacagggcagagttgccaacagccaatccaaaagagatgttaggggcagcaaaccctggtgatttacaaaatggaattgaggctccataccttgggaggaacttctggaagctagtgagggactgagttacagagatttaaggcatatttgagagtttccaaggtctaggaaaatattacaaagtttaaaaaatggttcagaaatgtgccttgtgatacattacccagtgcattgtgtacctgtcagacatgaccttgtcttcctcccagaagctttcaacttaggcttaaagaataaagagtaaaatcagtttgattttatagggcttaattttattcattcaacatccagggcacatttatggagtaccgatggtgctgtaggaccagggcctgcacgattaccttgtgaaaagtaaagtactttggacatccagtggttctgaacctttcagaaaagatcaccccatactggcttctgagaggtttggggccacgtatatggctcttcatccctgtcagtatcagtccacactctttacatgcccttctaccctgcaactgagtgtccctttgatatcaccagtgttcttccttcaaagacatttttcaatttagtgtttttttaaattttgagacagagtctcattctgttgcccaggctggagcttggtggcatgctcatggctcacttgcaaccttctctcctgggctcaagcgatcctcccaacttagcctcacaagtagctgggactacaagcacatgccaccacacttggctaatttttgtattttttgtagagaaaggatttcaccatgttgcctaatttggtctggaactcctgggctcaagcaatccacctgccttggcctgccaaagtgctgggattacaggtgtgagccgctgtactcggccaaatttagtgttttgatcgagcaaggataactcttctctcctcatttttgtcccttcaaatactgcatttctaagtgacaaggtagaaaatgtccgtggggggaatgtctccctccatgagaatgaaatggccaaggacaatctgttattcatgaattgatatataacattcaacttttcataaaaaggatacatctgcgaactttctacatgtatacatcagaaatgtgttttaaaagggatatgtacttcactggacagatcaattgtccatagctactcaggctacagagaagttaaaactgaacgtttatttaaaatatcttcatccagccttaatgcgagcctggctggaatgattctacatctcgttaacttcctctcttcatttctccacacaaagacctcatttgtaaactttgcccatattcagccagctccagatgttccaaggacaaaccattatcacgaccaactcagtgtttgctgcattttcataagcacttggtgatctctcttcaaatgatgacgggagttctttagacacagagattctccatcctctgatattcctcattctgaattggctatccaacttttttttctagtttgttagcaatttcagaaaaaggtctacaatcaaattttcaaagaccagaaaaagcagtgattccagattgcagatttactctctgtccactcagatgtgcggggaaaatgtagttacttaattatctatgaatccttttccctactagcatccacttcctcaaactgaaacttatcagttagtaatattgcagtctcttctggtttagacagtcacccctccagttaaatattctgtttattcaaagttgaactctctcagggtaggtgtgaactgtccctgttttatcctccattttttaggtgagcaccattggaaacatagggtccttgtcccatgtggacacacagagctgagaacattgccacaggcctctccatactcacgcattccagctctgccttaactgtcaccttcatgctaagtgtggctttcaactgtgtcatgttgagccactcttgtaccttctttagttttgatcatgtgcatatattaaaataaatatttaaaaaaatattaaaataaatattaaaaagtaaataagactccaaatgatttttttttctaatgataattctcagaacctggattttccatcacttcttttaaaactcactctgtaggtacttgctgttcttagatattgtttctcaataccgatggtgactttcccgggcctcagatttttcctgctctatgaaagcttcaacaatcctagagcatggatcagccagttttctttagccttaaacaaccacaggaatctcagttgataaattctgccttaccttcctgccgaattaattacatgttgttcagcaaacagttccgaattttctctctgtagaaggctctgtgctaagacctgtgggaggtacaaaaaatgaataggatgtagtcctttttctaagaagcttagagtttaaacactaagtctaaaccatcaaggtcttatttatcacggacagattcttccattcttcttctctttctttgtccatagagtaatatgaaaggtgaagggtaagtacttttttctttttaccaagaaaggcagtttaccagagttggtgggctgtagcagacagtggtgagggttccagaattttacctcacacatggacgtggatgtgggtgcttggaccaagtgtggcctctgagtctcacaagacagctggcctatgcctgggctctctgctgacgtaccagttaagccacaatgaagtaaatcattcatagtaaagccaacaagaagatatatcatataatgagaaggatgtgacattttaacataaaatattacttttaaacctgtttacaaaataatttatgaagacatctttatttgaagaaatgaagtgtttataaagaaaacaaaccaaattcatccagcataggaagctggtgaatatatatatatatatacatacacacacacatacacacacattatatatatacatgtatatgaaatctttttaaatgatggatggctatttttaagtgtggaaaaaaaaaaagccttggtacaggttaatccagtacagcccaagttctaaatcacggcatacacaccatgaaaaacacattattgccaaaacaaggatttaatatttatttcattctgctttgccagccaaaattgtatggcttgtcacagcctgtattttctcattatgacattagcaaagaacactgagctttactgaagaaatttaattaaattgaaaagaaagtgtttggctctaactaaactggcacaatacaaggaattctagaactgtattctgaggggtctactttgtgaggaatggcaggcccttggattcatttttccctaaaccagtattttcagaaatgtctatttgcataaaatctccaggacactattttgaattttctgacattattgaattaacaaaaatgtatttgccaatcattaactccttgttcaggaactagattctaggccaactggaaacattactcaggacccttgatacatcttcctgtcagctccacattttgttaatttggttattttgcagatcttccatcaaagattgatcaagtgagatggaacatagcaagttttctgctttaaccactttagttaagatcccaaattattaatttctgtttttttctctgccatctctagctcatcattggcaaagggtaagttaatgctaaacaggtatagacgtgcattttatctaagcatttcaaaatagcacgctaaactttaattttgaaaagtttatacaataaaaatatgtaaaagtagaccaaatattgtaatgaatccacatatactctgtgctctatttttaactcatggccaatctaggtttttttgtttgtttgtttgtttgtttaactgcctctcttcccatataatttgaaacacatccaagacatcacatcattttactcatatgtactttagtaggaatccctaaaagctaaggactctttaaaaaaaaaaaaaactacaataccattataatggattaaaaatattaataattcttactaatcatcaaatgtcagtgttcaaatttctaattgtttcagaaacaactttttgtggtttggatcaggatttaaatagaatctacttgctaagttccttgtcactctgattttttcattttgaaagtatttgttgaagatattggtttgtttatcccagagcatctggattttgctgattacaccacattgtttcatttaacacactcctctcttgtgcgttttttctgtaaatggattgtaggatcctacaggttgagtcagtcagatttaggtctgacttcatatttgatgtctcccctcatcaggaggcacatcatgtcagaatgcctttctttctgcaatgttagtacctgttgatgaccactgattagactcattcattcatcaggagtggtaaaatggggatgttctaattttattatatgtctgctagactgcacaaaggaattttaaacaaaagagtacctgtcacatagtaggtgcgcaataaaatacgtattgaatgggttaatttccataagaacccctatgacaagggagcagaggacaggaaaactaagaaggccttgagatgtgttccatcttagggccagcaccaagcgttcttggatgattaaagagccttcacagttgaccaagcctgtgacatgctgttcttgcaaaggcttcctaaagaaaaatgtgatagtcttactagactcaaagctcagcctaatttatagcaaaacaactttgccttttatctgccatttagctgtatgcctactaaacagtaaatcaaaagaatctctataaatatcagcttgatttttgcccttgacacagtgtatataaaatacctatggtgtgggtaggtttgaaagcactgtaggcttttatctttatttttctgacaacacagagcacataatcacagtaaatgtttttagtgccaaaaatttgttcatgggcattgtaatcatgatgcacaggtatcaagttcttatatttaagatacagggtgtagtgttttacattctttattgctgaatattttggttttcacttacttatacatgtggaaagcagtataacaaatattcattcctactgtgttcagagcacacagcaaaatgcactaagtcaaaccagtctttgttgagaaatgaagtcttgtgtgtatgatacaaagaatataggtgtaacctgaggtagaattttatatgacagagggacactaataatgtgcttgggtcttcagaggggagacatatcccaatagtttgttgaaatcattagtaaatttgcatggagtggggacaggctttgaaaaaacagtaggatttgaaaagatggtaaggaccatctagaagaaacgacatgagcagaagcatcagagtttacatcttcagagcacattcaggggtaaagagctccagttagactagcctggcaaatgtctctagccaggcattaagtaacaaaaagacattggctagggccatattagtgaggactttctatgtcaaattgaagcactggcaccaagcagtggtgagagactgaaggctttgagtagggatgtgatgtgacctggtcaagcacagatgtcaggaatgggtttgtgaggaaagaatgggaaactgggccaggcatggtggctcacgcctgtaatcccagcactttgggaggctgaggtaggtggatcacttgaggtcaggagttcgagaccagcctgaccaacatggagaaaccttgtctctattaaaaatacaaaattaactggtcatggcggcacacgcctgtaatcccagctacttgggaggctgaggcaggaacattgcttgaacccgggaagcggaggttgcagtgagccgagaacatgccattgcactccagcctgggcaacaagagcaaaactccatctcaaataaaaaaaaaaaaaaaaagaatgggaaactgaaattaattcattatcattagagagaaggaacgttttgataatagaagctgcaggattgggtgactcagtgaaggaaaagtagccatgaagtatgaaatcgcattagaatgatttcaaataaaagagggaagtgaggaaaaagaactgctttggagtgaggtaagaatttagggttatagcatggccatgtgtagacatttagatggtcatggtggctcatgcctgtaatcccagcactttaggaggccgaggtggttggatcgcttgagcccaggagttcaagaccagcctgggcagcaaggcaaaaccccatctccacaaaaaattagtcaggtgtggtggcatgtgcctgtagttccagccactcgggaggctgagatgagaggatcacttgagcccaaaaggtcaaggctgcagtgagtcatgtttgcaccactgcctccagcctgggtgatggagtgagactctgtttcaaaaaaatatttttttaatttaaaaaagaagtttagagatgttctgaaggaaatatattgggctgcagcttaggaatgaagtcagattaaatgcaacaatttaggaattttctgtagaaagatggtaattggaatctacctttaagaagatctcaaatctatccacttctccctcgagctccccagctgcccctactcattcaagtattaccctctcttacctggactgctgaaataccccccagtcgaaagtaggtacttcctgtgggatcttcccacagctctctgatttttccctccaggccttattacaatgtgtaattcgggcttgtttaatgttgagtatggaataattatctgttgttttatccctgaagatccatcaacttccacagtgcgtggcactcaaacatttttttttccaacaaaagagtcaatgaatgtaagtactagaaagtagaaaaaacagagagctttgggtgaacatctttagggcacaggaagaaaaagtggaaaagtcaaatagacaaagaaccaagagaagccagggcacaatagctaagggagaggggagattcaaggtgggctggtcatagggatcgattctgcaggtggaggaataacatgaatagctgacattaattgagtgctttttgtgtgcctaagacttggcacggattaactcagttaatcttcacagtaactttggtaggaattatttggtaggaatccctattatagagataatacaggtgagaatagataccagaaatgttaaatactttgcccaaaaacaagcaagtgggggagccatgagtcaaaccaggccatctggttccagagcaaggagactgaaccaccctgcagccacaccagctcctgctagcagtaagacagaagatagtttgcagtgtgatgtggtgttaaagatgtaaaagcaaaaggaggaccagctgctctttgtagcctttagtcatgaagagaggatggcaatgcctatgattctgagttaggatatttccacattaggtccccaaatctacagaagttacaggaacactcatgcatcaccagtcatgaaaacctgaggaatatgctctcatttcaagaacaggtagtttttgattgtgtcttcagggtactctagcagctgctttgacattgactttgacattgacttttttactacattccaatgttgttattgacttaaattagtccttgagagagaaggaagaaagaatctgactttggcaatagaaagccttgcagtattccaacttgctttcagttttaaatagttctgtgaatcattcctgtttcctttttttacaagtagggaagtaaagtcctgccagagctagacggaaaggcacctgtatttgcattgtaacctgagttttgaatagtaaatgcacaggtacagaatatactagcaacagtaaggtcaggcagacattctggaaatgtgcacctgagtgatgaactggactaactggtgtctgtcatgttgcagaatgttgctaactcttaaagctcacacatgttaagttgttggcagatttatcaattcttttaattaaaggactgggatgatatgagtaacggaactattttgttcctaattgatgcaaatcttaaaagtacgtgactaaaatctgttcccagagtttctcattacagaagccttttaatttgttttaaaatatatgcatatacatttctctttttgttccttcagatttcttaatcgatggtgatttttcccaacccaaactctaactgcaatggccagctttccacatatggggatagaatttctttttttaagccttccacactgaaagtaggggtcttggcctcacgaggacaactcagcacccttcccagatgctggcaatccaaaagaagagtacagaggagatgaagctctttttaatattttttatcactttttcaaaagttaattctctcttggaatttattctttaaaaaaaaaaatcggaccccttacaggatcaggatagtgtcttactttatccaatagttcagtttggaccacacagcctgactttgtctcacctgtaaaattgcacagttctcttaggcctgttcatgggccgggaaaaaagactgcaagtacaaaacacatggttcaggttgaatattgcaggaaaaatataagaaaaagtatttcatttttaaaaaaatcttcttaacaattaattcatggatgctttgctgaggaaaatgctttgcagaggttgaatattgcatgacaatataaaaaaagcatttttttaaaaaaaacaaaggtttttaacaagcagaattcattcatggatactctgtggaggaaaatcatggtgtccggaatgtttttaagcttgaccactcctaacttgagtaaatgattctgggtgccttttgggaacatccacagtattgtcagagtcttcttaggacctgcttttgaagccagcttactgctttggaggatgctttgggctgtgcagggcagaagactgtgtttttgccaattgaaaattcctggccaggcacagtggctcacgcctgtaatcccagcactttgggaggctgaggcgggcagatcacgaggtcgggagattgagaccttcctggctaacatggtgaaaccccgtctctactaaaaatacaaaaaattagcaaggcgtggtggcaggcgcctgtagtcccagctactcgggaggctgaggcaggagaatggtgtgaacccgggaggtggagcttgcagtgagccgagattgcaccactgcactccagcctgggcaacagagcaagactccatctcaataaaaaaaataaacaaataaataaataaataaaaagaaaaagacaagagaaaattcctgtgttgtcagccatccaggccataccccttggtatccacaaacccagagcttctaaaggaattaggatttgccagaatgacactggtaagcaggccagcaatacagttctatttttgttggctaatttagtgacatttgttttcagaagtgtaattctaggaatgtttacttcaagcgaacacctgttgtctcttgagctagtgtgagggatgagtcaccgtgaattataatcatagtgataagagctagcaattaattaagcactttatgctagagacttttctaagcacttgacttgcattgtcacatttaatttttacaagcaccctatatgatatgtaatagtgtcagcattttacagatgaggaaactgagacacaaggagatgatgtgacctgcctaaggtcacagagtccatgctcttcatccctcatcccccatgtccttatccaagtctctccgagaaaggaagcgctagcactgataaatatgagtagggaagttagcatctgcaaatggtcattcattgtgaagagttgttgaagctgtctcggggggtactgttgccaagccatcatttcagtatggttgagaattagaaaggttaaggcccttctaccacttgtttctgtctgaagaaagcatctaatatctgttagtgttttcttttaagagtctggcccttggtgcttctgacataaaacagtctttctttctcccatggtctgtgctactgtatggtgcagtgaggcactgataacacctccatggagaaccagccaaagggtctggtactcaagcattggatcagtggtaagaaggatttcctatcacccctcccttcctcctccaacttgacatcactcctccttccattaggaaggctggttccacattgttatcaagccattcttagatcacttgggttaggaaatcccacagcccaaacctcttaagtgataagattctactctgagctcctgcctgactcccttctgaacttgactttttgaaagatgaagtgtgaaccctctggaataattgatacccatttgcagcccactctcagttctcattgatggcaaagatgcctgtaatacagaataacctatttcttgaaggccatatgccatacttcacaaagccttttctcaggtggcatccatgaagtggcagccacaggtaactgaatcttcaggcctgatcccctctttactatatcataaatatcaaaaggcagttgggctgaacaagaacaagaagcacaagaaattctggattattttatccctaaacaattatctataggctatgatccttcagggtgtttcctagctaaagtataggaacagcttctcatgttggttcagagacagccgttctgacaaccagggttgtcttgcttttctgagcagctttgtgtgagaaataccaggtattaagaagtctgttgtaggggagaatcatatacagactagtagaaaaagaactttatcatagaggaaaacacccagtttgcaggcattcttcctgaacactgctcttccgtctgaaaaggtcctgagtgtcaaagccccacctataccctgaagccatctcaacagactcggacccagacctttgtctcctgtcattttcttttcagagcattgccatctcttttgtctggctgcatccaactatttttaattcccttgcctccccactgtctgctgagtggataattaaacatgaagtactatgctttgttgagattatatttttaaaggacttgctacagggaactgaacggcaccttcgaaagacagactttgagggctgggtgcggtggctcacacctgtaatcccagcactttgggaggccgaggcaggcagatcatggggtcatgggttcgagaccagcctggccaacatggtgaaaccctgtctctactaaaaatacaaaaattagctgggtgtggtggcgggcacctgtaataccagctacttgggaggctgaggcagtagaatcgtttgaacccgggaggcagaggttgcagtgagctgagattgcgctagtgcactccagcctgggcgacagggcgagactctgtctcaaaaataaaaaaaaaaaagaggttttgagaagaagaccactaacttccaagaagtttatgagaacagaattcagacatagaaaagatacattcagctagaaaagatacattctagctgtgtcttcatgctgaggaagatacaagcgtacaaacttacaagcttgtagagactattggttgttggtttctctgctctactgcttaagagtgtggacaccggagttgactgcttgggtctctgtcacttatgtgctgtgtgatattgagcagattaccttatctctctgtgcctccagtttttcatctgtaaaatagacaatagtagtacctagcttatagagttgttgagattgaatgcaaatgagcttcctagcactggcacatggaaagtactcaatccgtgctattagtgaaactttcatggagggttgagaaaacatgtgcttgtttcagatttgcataaaattcccatcttggagccattgtgataatccttcctgcatgtggcctaataataacctcaagtgtttttattttgattcttcatctctcagccaccccgctgggaggaataacaggagctgtgtgtctgtatatctagagctctctgataatgagtagatgagacgaacaggcctttgggttgactggcttcctggttctttttctcattcaggtgctagaaagcttcaagatcatggattatagccttctgttgggaattcatttcctggaccattccctcaaagagaaagaggaggagaccccacaaaatgtgcctgatgctaagcggactgggatgcagaaggttctctactcaacagccatggaatctatccagggtccagggaaatctggagatgggataatcacagagaacccagacacgtaagtgcagccacacacctacccaccctcttgactgtggcagcccacgtcactgggtaattatagacagtcacattcaccttagggtgggactctaggaattaatttctacttggtgctaaaatgggttaaactggtctccatttctattcatctaaagataactagatgagtggcagtttctccagttattactccttcacccacttggtttctttttttaacaatggctgaaaatgtttttgtccccattaactacatattcaaaacattcaccacaagaggaaggaatagactttgaatttgaataaacatgttttattgtttatttatttattttttttttttgagacagagtctcactctgtcacccaggctagagggcagtggtgccatctcagttcactgcaacctccacctcccaggttcaagcgattctcctgcctcagcctccaaagtagctggaattacaaacatgcaccactacacctggctaatttttgtatttttagtagagatggagtttcaccatgttgcccaggctggtctcaaactcctggcctcatgtgatccacctgccttggcttcccaaagtgctgggattataggtatgagccactgcacccagcctgagtaaagatgttttaagcaaatacacaataagaatgatgttcgcaattcagagctttttgtctgcctaaggggattctgttgttctagtcctgcaccctgacagatgtggtctctcgtctcagccagatgtggtagtaactacaggattaatttgcatgtgtaaaatgcatattgactaacagaaacaactgcaaccaaagtaagttattgaaatggcagactgcatcagttatgtgtactagctgagcaaggagactgaaagaaagcaatcattttccaaggccataagtgcctgccttctagaattctccaacgatgactaaaccatgggcatatttcatttttgtaaaggaaattaacacatattaaatattttttgaaaagttctttcttgcaaatcgatctaactgtccaataatcagttaaattatcctatatcagtatggtgaaatacaataaggctattaaaaaccacgctagcattgaatataaggaaatgtttgtcatttagcaagtaaaaaaatcaggttataaaacatgataaataataccttttcttgactaataaatacatacacacacacacatactagaaaagcataccagatattaagtagttatctttgcatcctaggaataactgtttaattatattttttctttgtgtttttctgtattttatttttaaaagtaaacatacattactcttttgatcagaaaaaagtattgcattttttaaaaggaatattttataatggtctaaaaattcttgctcatagttttaaagtaggaataagttttaaattggattcttcccatccaactcttcacggttagcagctacgatattattctcctttgtagggaagtattaatacatcattctggattcccaggatgaccttaactgatggccaaaaaacaaaaacaaaaaggaacaaacaaaaaaaaaagatgaatgggagatagcccagaattcttaaaaattgtcaatttttattttcagtctatttattagaaatgattttttaacttcctattcttataatatgtaatcaaatattttctcttttgctccatcaacagaatgggaggcattccagctaaaagccataggggagaaaaactacttttatttatgggcattattgacattctgcaatcatataggtaagaagtttgaggagtggtcttttattatttcaaaatcaatctacaaaaggttctgaaaaatcaccaaatgagagtgattttacattctcatttcaatttttccatttatatttaggttaatgaagaagttagaacattcctggaaagctcttgtttatgatggggtaagtgacttattttccttattatactgtatatatttctgctttctcagagacttcagagtatgtgcaggaaactgtgttgctagactctaagaggaaatgaaacaacggtctttataaactcagaatcttaggttagtagatcagttcaaatctaagaataaggacaacataaatttgaatagctcttcaaatacatgacatccagcctagcggccagaaaaacaaaatgatatctgtgtctatgtgaaatccaaaggacctaactttgagagaggtctttttttgtagggatgatcagtagggcatttgaaatgaagttctcacacaaccaagctacagtaagtgtgagtcctgactctgatggtgaacagcctggatttgaactctgcattcactgctgaactagccatgtgaccaggcacaatgctggttatttggcctcttacccttgtttctcacctgtaccagggggatagtaatgacacctgcttggtgtgaacatgggacaaaaaaatgcatttcagtgttcaacacaatgcctaacaaatacacagagaaagtgaaaactttttaattggtatggatttctacatcaacatttatacatgctggctgcctgaggttgtcttttttttttttttttttttttttttgagatggagtcttgctctgtcacccaggctggagtgcagtggtgcaatctcagctcactgcaacctctgcctcccagggtcaagcaattctcttacctcaccctcctgagtagctgggacaacaggtgcgtgccacgacgcctggctaatttttgtacttttagtagagacaggatttcgccatgttggccaggctggtctcgaactcctgacctcaggtgatccacctgccttggcctcccaaagtgcagggattacagatgtgagccactgcgcccagccaagaatgtcttaattgatgtaactgaagaaaaaaatcagttaacaaagagcagtttctcccatctttctctctccttctttctcccattccgtctctgtctctctgtctctctctctcacacacatacacacacatacacacacacacacacacacacacacacgcagtcccatctagacattagatttctacttcctgctactaacaacatttattggcctaagttaataacttgaagtagcaattccaaagaatattttggtcaaggatttggtcacacatttccttttaagatgttagcagatactttcttttgaaagagaataaattatagatgatcttcttcttctttcttggaaaggagcccataatttctcagttctgtggaagactgttaataacctttcagcatgaaagatctacattttgtccaccgctaaggactgacttcagtcataatgcacttttaaacaacaggttcacacatttatttccaagaattaacctctaagctgggtgtaggggcatgtgctggtagtcctggctactcaagagactggggcaggatgatcacttgagcccaggagttcaagtccagtcttgaatatagcaagaccctgtctctaaaagaaaattttttaattaaaaaaaaaaagaattaacctcaatcttactgagatcaaaaattcctcctatgaaagaaggtcaatatggtaggttaatttaatgtttccttccagctgagaaaggaagggactgcatacatagtacctcgaacattgaaggggagagagtgaataccctcattccattcccctcctgttttctgagaccatttcaatttcctgttaccagatggatctgaatcgtctagtcttgtaccaaccaggtgcatctaagggccccccacctttctctatttaaaacccaacactttggggggagaccaaagcgggcggatcacttgaggtcaggagttcgagaccagcctggctaacatggtgaaaccctgtctctactaaaaatacaaaaattagccagacgtggtggcacatgcctgtaatcccagctattcgggaggctgaggcaggagaatcgcttgaacccaggaggcagacgttgcagtgagccaagatcgtgctactgcactccagcctgggcgacagagcgagactccatgtcataaataaataataaataaattaaaaaatatacctatcatctgcttttcttttctttttaatgaaaatttctgtgctggttatatatcatgaacctatttttgtttgttttcagacatggctcttacttaaacaatgtttattcatgccaaagcgaacaacaatgtaacttctctttataggcaacggctgaactttaatcctctatggatacccctcaggctcttgccttctgctgatatttctaaattactgccttgttggaagaatgtgtccacttcaggcagatactgccaggataccagaaagagtacattttaaaagatgtagcagggccaggtgcagtggctcatgcctataatcccagcattttgggaggccgaggagggcagatcacttgaggtcaggagttcgagaccagcctggccaacatggtcaaaacccctctactaaaaatacaaaaattagccaagtgtggtggtgggtgcctgtaatcgcagctactgatgatgccgatgcaggagaatcacttgaatccgggaggcggaggttgcagtgagccgagatccgccactgcactccagcctggcgacagagcaagactctgtctcaaaaaaaaagaaatttctctattggaatccataagcctgaattcaaaatgaagcattatagaagcaaatttactatgtctacaagtgtacagcttggatacatgatttggataaatgattactaaataaacatagaaaagtagctccttcatccacctcctttcccttcatctatcccctttcctggatttgtaatcaaatgacccttcagccctaaagactcctgccaagcatgagagaagaatggagttaacagtttaattcaattcaactctatgcaatcagcagataattcaatgcaaaggagtcatctgttagccttgtctcctaggaatcctcctagcatctcctcaccttgctattgggagatgaaaccagaactttttttaacttaaacgtcaatgtcactcttacattaggatagttttgtttatgtctccaatttttgttcatgattaagggagttacccttcattccagatgacatttgatgcactggttgcctgtatgtaaaaaaagaacttaaaaactcctcctgggacacaatgttatgaataagggcagctgttttgatttatgtagcacagttttttttgctgactctcctctgctcagtttggtcttgagtgtctagaatctttgttccgattgagtctgtgccctcctccctcagccccagactcctgggccccacgggctacaggacattcctgttttctatctctgggccacctttggttaagaatgttggctaacagagaaccaattgcatagatctctcttctgacttgagatgaacattaagaggtgaccctgtgatcctgggtttttgtcttttcaggacactgtttctgttcatagaccaagcttttatgcagacagatttcttaagttcatgaattccagagttttcaagaaaattcaaggtaagattcttatgaatttttttttttacttttagcagctaatttcattatgtatctttgcaagatttttattggaagaactaacacatttctctccctgcagcagtaatcacttagtaattatggttaagtaacccagtcaggtgtttattgatgccataatcattagagtcctgcttagtggtgaaaaaatttagaaggtatctaaatgtccaaccatataatatattggttaaatatattatgatacagtcaaataatggaatagtatgcacccaataaaaatgatgtgttagcacatttagtttgctaaatatagatgtatttaccttttatgtagttatcagtctgtataccttaaatgcacagcagaattctaagggaatatacaaaacagcagttattctcataggacattctctaggatggatcatatgttaggccacaaaacaagtctcagtacattttaaatgactgaaatcatacaaagtatcttttctgatcacaatggaatgaatcaataaacagtgaaaactgaaaacttctcaagtatttgaaaattaaaccacacactcttaaactagcaatgagttaaagaagaaattacaaggaaattagaaaaacctcaagatgaatgaaaaggaaaacaaacataccaaaaatttatgggatgctgtgaaggcagtgctctgaggaaaatttatagctataaactcttacctttaaaaaaaaaaaaaaaaaaaggaggccgggcgcggtaatcctagcactttgggaggctgaggcgggcagatcacttgaagtcaggcgttcaagaccaacttggccaatatggtgaaaccccatctctactaaaaatacaaaaattagccagacgtcgtggtatgcacctgtaatcctaactacttaggaggctgaggcaggagaatcgcttgaacccaggaggcggaggttgcagtgagccgagatcatgccactgtactgcagcctgggcaacagagtgacactgcgcctcaaaaaaaaaaaaaaaaaaaaaaaatgaaaaaagaaaaatctcaaatctataccctaactttaaaccttgaataactagaaacagaagagcaaactaaacccaaagctaacagtgcttattccagatcaagggagtatgtgggctcttattttcctttatattgatatttattaaattttctacaatgaatatgttgtatctgtgggaagtttttaagatatgtgaaaggagaaaataatcctatatatagttattttatcattttgctattctgtggtccaatttcataaactaaaacatgataatttagccatacacaactgaaaaagtagaatgttcatgttttatatttaaataagacaaattttcctggtaatatttattggagattttttaattaatgaaagtcaaacacttgcaatgtaaacattttggaaaatacaagaagatgaaaaaaaaatgaaaattcttgaaatgccacaacccagagatatccactgctaatactttgatgtactttctaccaatctttatttctatactttatgtatttacgttaaaatgatagcataatggtacacaattttaggtatagtcctcttttttcacataacattataacatgaatagtttataatgttatatttttcatatcattgtatattctacaaggcaccatttgaagttgcaacacattaaaattgtatgagtgtgacgtaatctaatttttttttttgccagaatctatttaaccattctttcagtattgggcatttacattgtttctcctttttctatttcttaatagtttatgaacataatttcagataaacgttgtgtccaaatttaggattatttctttagaatggattccaagaaaggggtactagggtaataaaatgcacgtaactgcgcagatagattgtgccacagaaggttcccacgaggccatgagagcccgtattctgccagcccttagccagcattgtggtttttaaattatgccactctgataagtaaaaaatgttatctgattgttttattttgcatgtaagtactggtaaggttcaacccttattcatgtttattagccatttgtagttcctttgagaattgagctttgtaacatttgaccatttatattgggtgtttgttatttttccgaattattaatatcaattccatgtattaaagatattaacccctttttaaaccttatttcactctaagggaaactttcttccacatttgactctctcagtggtatcttaaaattgctgtcaaattgacatcaccgtaaattatttgcccaaggtttctttggcctaaaatagactataagatagtgtttattgagactgcaagcctacatgaataccagcttgtggttccaattttttttttttttttttttgagacagggtctcactctaccactcaggctgcagtgcagtggcgtgatttcagctcactgcaacctctgtctcctgggtttaagcgattcttctgcctcagcctcctgagtagctgggattacaagcatgcatcaccacacccagctggtttttgcttttagtaaagatggggtttcgtcgtgttggccaggctgtcttgaactcccagcctcaagcgacccacccacctcagcctcccaaagtgctgggattacaggcttaagccaccgcgccctgctgtgtttccaatttttaagaaagatttttttcacttttcttagccctgtgccaaggttggaaaaacatgggtttcactgcagcccctggtgcgttttggaggatctagccctttaatgttctagctttggtgagcctcccttaggagactccccatcttgggaggtttttctttcttaggggcatataaattaatggtacaatcaatggcatcttcagtttcataaaatatggcatgtgtcgcagatttttccggtttggataatttttcaggtttttaatggaacaagttgtttaactcacgggtaatcaaatctattgacattttctcattttgattttattatctattttttaataatagctttattgagatataattaagatgtgtatgcttcacccttttaaagtgtacaggcctatgattcttgatttattcacagttatgcaatcatcaccattttctaattttttaaatttatttatttatttattttgagatggtgcctcactctgtcgcccaggttggagtgcaatggcgcaatcttggcttactgcaacctctgcctcctgggttcaagtgattctcctttcttagcctcccaaatagctgggattacaggcatgagccaccacacccagctaatttttgtatttttagtagagatggggtatcaccatgttggccaggctggtcttgaactgctgacctcaggtgatctacccgcctcagcctcccaaagtgctcagatacaggcatgagccaccatgcccagcgattttctaattttagaacattttcattaccccaaaaagaaaccccatacccattagcagtcactccccattccgtcctcttcccagcccctggcaactactgatttactttctgtctctatggttttgcctattctggcatttcatataaatcatataatgtgaacttttctgtttggctttttgcacttaacagaatatttttgaggtttatctgtagcctcgtagcatgtaccagtaatttattctttttattgcagaatattccattatattgatataccatagtttgtttattcatcagttgatggatatttgggatgtttccattttggccattatgaataatgctgttacgaacattcatggacaaggttttgtatgggcatgtattttcatttcttctgaatatgtacctagaagtggaattgctgggtcagatggtaactctctgataacattttgaggaactgtcaaactcctttccaaagcagctgtgtcattttacaatcccaccagcaacatatacgagttccagtttctctacatcctcactgacatatgttattgcctgtctttttttcttttggctatcctggtaggtatgaagtagtatctcactgtagttttgatttgcatttctctaatgactaatggtattaaacatcttgtatgtgcttattagcaatttatatcttctttggagaaatgctcactcaaaccctttgcccatttttagttgtctttttattattgagttgtaagagttctttgtatattctggacacaagtccgttatcagatatatgatttgcaaatattttcttccattctgtgggttgtctttttacttttttgatagtgtcttttgaagcacaaaattttttaattttgatgtccaatttttttccttttgttgctggtgtctttggtgtgatctaagaaagcattgcctaacccaaggtcatgaagatttactttcatgttttctttgaagagttttatagtcttagctcttacatttaggtttgtgattcattctgatttaatttttttgtatatgatatgaggtagagtctatcttcattcttttgcatgtgggatagccggttgtttcaccaccatttgttgaaaagcctattctttccccttattgaattatcttggcactcttattgaaaatcatgagagaacataaaccagacaaaaaaaaaaggaaaagaaagtcgattgaccacaattataataaggatttacttcttgactctcacatctgttctattgatcaatatgcctaccctcatagcagtaccatactatcctcattacttctggtttgtattgttaagtttcataatcaagaagtgtgagtctttcagctactctttttcatactgttttggctattctgggttccttgtatgtccctatgaattttataatcagtttgttaatttctgggggaaaaagggtagctggtagtttgataaagatagtgttgaatttggggagtgttgccatcttatatcttacatcccataaatgtgggattctttttagttaagccttatgcttacaaaggacttcaccattgaataatcagataaatgttcacccatatttttcttttaccttttatagattgttgtttatgttttcttttctttaatctatgttgtattcattttggtgtatgaagtgagggagatctaaccttgttttttcacaggtagttaactattgtcctaataccacttattgaataagatatttcacttcaaagcacagtcaagtactttatcacttttgtttattgcgtaggtagtagtgataatgtttatagtgctgctacagtggaaaatagtcctgctacagtgggaaaggtgattcctatctacttttcttgctttatgttttctaacatttatcatgacctataatgacctatactttaggtcctatgctataggttttacttacttaatgcctgtcccctttatttaaatgtaagctagctgggcacggtggctcacgcctataatcccaagactttgggaggccggggtgggcggatcacgaggtcaggagttcgagaccagcctgaccaacgtggtgaaaccccttctctactaaaaatacaaaaattagccagacgtgctggcacatgcctgtaatcccagctacttgggaggctgaggcaggagaatcacttgaacctgggaggcagaggttgcagtgagccaagattatgccccactacactccagcctgggtgacagagcaagactctatctaaaaaaaaaaaaaaaaaaaaaaagtaaggtgactgctgtatccccagcacttaatgaagccatgtgggtttggagggtgcacatattgtaatttttatttgttgaatggatgaatataccatgtatactgggtccgatcttctccttaaggtccaggacagatccctgtagagattatctccactacagggtaattttaaccattcactccctcttctggctccacacctcatccttctatctgctcattctcatatatcatagaaacaaacctcctcaacgatctgtctctcttcagttcctggtgtatctttttcctccttcactgtcaccctattggagatgagagttggatgtacttgctgtctcactttttttatttcttgtcactattcagtgttctccagtggcttttgatcccaccactctaccaaaatgttctttttgaagtaatcaacaatcattgctcaagccattgaacaactttcagttttttttgtttttgtttttgtttttgtttttttgagatggagtctcactctgttgcccaggctggagtacagtggcactatctcagctcactgcaacctctgcctcccaggttcaagtgattctcctgcctcagcctccagagtaactgggaccacaggcatgcgccaccacacccagctaatgtttgtatttttagtagagacagggttttgccatgttggccaggctggtcttgaactcctgacctcaagtgatccacccaccttggcctcccaaagtgctgggattacaggtgtgagccaccgcacccagcctctttcagtcttcttaaaactctccagcatgtgagaccactgatagcagttctctgtgaaataacgctcttcgcttgtctttcgtaactcaggacttccctggttgccttccagcctctcttctcctccttggtatcctttggaagcttttcatccctgcttactcttattgtggttgctcctcagggtccaggctctgactcggtctcttcttatacagcactctgggtaattccctgttctcccaagggttcagttaccatctgtgtacttgcaacttactccccacacttctagcaattccccttgcctgtccactccccaaacttaagcatccactagattccacaagctcagcatgcccaaaattgaatttagccacttaccaccccagagtctgcctctctacctgggtccacgtcttatggaagaccaccacaatccacccaattacccagccagaatgctgccatcatcccttgaccccttccttctgcttaccacccacgtgcagttactcagcaacacctatcagtcctcactctgcagtatcaggattgcagccccttctctcacagtacctctcctgattcagccactgtgttttttggtttgcaggttttattattatttttttttttgcataaagttgtggccccaaacaggtctctttgcctcccatcatgtacccattcaatccaatttccacacacacacactgcagctagaggaatcagtttaaaatataaatctgctcttgctgatttctgttaaaacccttccatgctaataataataataataataatgctaaaggaaataaacgtccatggattccctggtgcccaaagtccttaactttcacttaacacatttcctggcacacagtagacactcaatggttatttgatgaataatgcaatgaatgaatggaatttttatctaacaccaccatttcaaagggtaattaaattattagaaaagtagacacttgagttaactttaagatgttccatcaaccatggttaatttaaagcccttaatgcctaaaggcatactcccctcccaccaagaaaatagtacctggtcttcaagtttcttttttgaagtcagtgttttttaacctttttaaatcccttcatcccacccacaagtgagtcatgctgccggtgtaataatgtctacaaaatcctataatatttcctggaaatattagccaccattatgttgaaacttcactgaaattctccatacgaataatttgtctaaagtactaaagcttagtttcctgaatagaatataagagttaaattaatttgttagagaaaattaactgttctaaaacttcagaacaataatgcattcatgaacaaacactcgtgcacctattatgtatctagcactacactaagcactgatgatatagaaagctttttaaatattgattagttcctccctcaataatttaatagtctcttttgagccggagattgaaacatgtgacagatctgtaatgaaacaattgctaatatttctgcatatgctactatgggtacgcggagagaaataagagaaaaaaagaccaattcttccaaaagagagctcacagagaaaaagatatttcaactaaatcctgaaaatgtaacccagagttcattaagaagagagacaggaagggcatctcaaggagaaagaacagcatgtgcaaaggcctaagggcagaatgaacatggtaggttccaatatggcagaagggtgagctgaaaagtgaacatggaggcagtcgagtggcagaatgcaaggctagaaatggacacaggatacctactgccagccatggttgagccaaagacaaatctaggcgtttctgccacacaaaaggaagcaaccagccacccaaaccagctctcaatgttacccagtcaaaagagatcctgagaattaaatttctgcaaaatccaagctcttatctgctgagtgagatcattcctttaaggaagaaactcaccacttgagacaaaagtgaactctttgttgtggtgctatgtggtcttggcagaggtttgttttccggtcttctctgctcctcattatacgtgatgctgataaagaacaaagagttacttctttttccagtcttttggccctcactccatgaaatgccatgagtataggtctcctgagtatcttttcctcattacacggctctcaccctgatcgcatttccttggtactgccgaaaaccttttgatcattgctgtttcttcgtttagagaaataacattgacctaagaactatgatgtagaaaagcagttctcaaaccttttggtctcagggccacattacacccttaaaaattattgaggacaccaaagagcttttatttatgtgggtgatagctatctatatttcacatattagaaattaaaattgagaaaaatttaaaaatatttattaattcttaccagttaacaaaaaaaattgcgtgttaacatcagtcaatttttaacataaataattacaaaatataattatattttccacaaataatttagtgagaaaagtggaattgttttacctttttgtttgaaatccttaacgtctggcttaatagaagataagttggagtctcacatctgcttctgaattcaatatgtggtgacatcacaggtcatgtaacatctagaaaactctacacatatgagagaatgaaagtgaaaaaggcaaataatgtcttatgatgatgatgaaaataattttaacatcacagatcttctgaaagggtctcagagaccccttagtttccaccccacatctgagatcctctgatttagaagttttaaaatacagctgggcacagtggctcatgcctgtaatcctagcactttgggaggccaaggcaggcagatcacctgaggtcaggagttcgaaaccagcctgaccaacatggagaaaccccgtctctactaaaaatacaaaattagccaggcatggtggcgcatgcctgtaatcccagctactcaggaagctgaggcaggagaattgcttgaacctgggaggcggaggttgcagtgagccgagattgcgccattctctccagcctgggcaacaagagcaaaactccgtctcaaaaaaaaaaaaaagaagaagaagcagttttaaaatactatattgaaagacaggagtttattgaaggtctataaaagttagcagatagagatgataggttgataggtgtagcaaaccaccttggcacatgtatacctatgtaacaaacctgcatgttcagcacatgtatcccagaacttaaagaaaaataaaataaaataaaataaataaaagttagcagatagaatgttaaggcagaggccagtgtgacaataatggcttcttccttgtaaaacaagtgtaaccactgtttgagagagtggagaattaaggtaaacataacttattttttaaacattcaaaaatttcttcccctcaaagaaaaacaaattcaaggtttatctttttctcccctcagtttaaccagaaaacagaatgctaaagaactagaaaatgaaccacctagaaagcaacttaagaaaagaaagacacctgaaattcatgcttgctagttctgtgaccctgagcaagccacaatctttctattctcagtttctgggcctaaaaaagggccttcctcttcctcatacatgtggatggtttgagatatgcaatgtgaatgttggattccagactctaaagccctccacaaatgttatttattaggatgatgatattattatgattctaagactgctcgagggacaaataaaccttcccttctctttaagtggagagattgtcctccattcttctctcatttgtgtgtcccaaagtccttctccaattaagttcttgcaagcagcctctgggaaggccccagatgagctgtgtaatctaagctctgagattcccaaggctaaacacaattactctaatacacttactatcaggctacccctttatgcaaacttctaaaggaagagagacactgccaaaaacatattcaggggaaaacataaagaggcctcaacttccctctccccctccctccaaggaaattctcaagcaatattaagccaagaagaattattgcagcaaatagtgaatgtaaataaggatggccttgctgccgcttaagcagcttccatggacgtgtcctccatgaagtcccaggcttcagcaagcatgattgatggtgaagtacattttcattagttcaggttcccaacacacttctgaagttgtagactgctgtttagacaaagattggaagtgaattatacgtctgacataaaaccatgacctagaaaagagctaaagggtaggaaatgtcagtggaaagtcacagaaagaaaaaagcaaccagaagtaacttggctaaattgggcaacatgagtagaagattaaacattggcatgtttagaaattcccagtcccaagttaataaaaccagggtcgtgagaattctctatactttaccatctgtgcttatcaactcacccatcctcctcccagcactagaaaaacattgtttggagaggggggaatgattctttagcaataaaacatttgaattttacctcaagtaagactttattgcaaaatctggagagaaattttaacttttaatttgctctaggaaattctgatttaagtcaagtcattttggacaaataatatagccaattcatcgtattcatcagatgaaacaagttcatctccctttccatatatataaaataagcgtcttgtcttctattcaaataataactaaaatgttaataaataataaaatattcacttttaaataaaatagtaatgtgattttacagtaaatatctgtatttgtccttttcctttctgtctagctttgaaggcttcaccgtctaagaaacggtgcaattcaatcgccgccctaaaggccacttcacaggagattgtgtcctcaattagccaggaatggaaggatgagaagcgggatttgctgactgaaggacaaagttttagcagccttgatgaagaaggtaaagatatgtaacttttttaaaaagacaaacgttcttgtgatttatttatacaagtaaatttgcagaagaaaaatttaaaaatacctgctctaagaaataaaatatattaattaagtttttaaaggatagctgcagtggccgggcgcagtggctcatgcctgtaatccttacactttgggaggcctaggtgggtggatcacttgaggtcaggagttcgaaaccagcctggccaacatggcgaaaccctgtctctactgaaaatacaaaaaattagtcaggcgtgatagcgggcgcctgtaatcccagctacttgggaagctgaggcatgagaatcacttgaacccaggaggcggaggctgcaatgagctgagattgcaccattgcattccagcctgggcaacagagcaagactctgtcccaaataaataaataaataaataggatagctacagtaagatgcagttcatgcacattttaactaccacataaaaaatacaatttatggtttacgataaaaattagacaatactaattcaaaaagaaaaatgtctgcttccactacctgatggtaacaaatactaacattttgttgcttttacttctagaccttattctgtacatgtacacatacacatatgcacgagtacacatacacacacatacactcaatgtaacaataagttgtctcttcatttaggtcttctttaatgatttattttttggtacccactggtaatactcaggaggtactacacgttctttactttgaaagcttcataaccatgagcaggtaccaagagaaggaaagaaaagaggcagaaaggaaaaatatggaacgtttcacaaatttgcatgtcatccttgcacaggggccatgctaatcttctctgtatcgttccaattttagtatatgtgctgccaaagtgagcgctttaatgaatttcaataaagttttataatatttttcttgtgtggcttgtacatataccttttgttagatttatttcttggataaatgcagagatattgatatagatttttttctggatttttaaaaacagtatcttttttaagaattgagttttctggccatttgttgctattgcatagacttcacaccctttttgtctttttttctttcttaacttgctggttaggacttcttgtacaatgataaatagaagtggtgattgtagacagccttgctttgtcctgattttaaagggagtacttctaatgtttcactgttgaaaaagaagtttgctgtatttgatacccataatcaagtcaaggaagttcctttttttattcctactttgctaaaagttttttttttaattaatcaggaaggagtactgaattttatcaaatactttatctgccaagttaatcatttgttttttcccttctaatcaaatatgggagaatgacattttagatttttctattagtatattctttggagaatctcagcatttcctgaaaatgtcttctactttctacagaagttaagacctcttctaggggttttcttttcctcagagtctttaagatgtggtgttatttctattccttcttcagcagcacttatccatatgtgctgtttggtttctttctttctcatcttcccataaaccaacttttacctggagttaatgatttcagcaagagagttacagaggtgcccttgatcctctccgaattggtgtctccaattcctagcagacattcatccctttctcctaagctcccctgcactggcatctcccacactatactacctgattttctgatagcacatgcaaaactgcaggtgcctgtagtctgggaaataggataaacttattttaaaattatattagtttattgatttgcatatgttgaaccagccttgcatcccagggatgaagccgacttgatcatggtggataagctttttgatgtgccgctagattcggtttgccagtatttcattgaggattttggcatcaatgttcatcagagatattggcctgaaattttctttttttgctgtgtctctgccagattttggtatcagggtgatgctggcctcataaaatgagttagggaggattccccctttttctattgtttggaatagtttcagaagaaatggtatcagctcttctttgtacctctggtagaattcagctgtgaatctgtctggtcctggactttttctggttggtagcctattaattactgcctcaatttcagaacttgttgttggtttattcagggattcgacttcttcctggtttagacttgggagggtccaaagaatttatcccttccttctagattttctagtgtatttgcacagaaatgttcatagtattctctgatggtagtttgtatttctgtgggatcagtggtgatatcccctatatcattttttattgcatccatttgattcttctctcttttcttctttattagtctggctagaggtctatctattttgttgatcttttcaaaaaaccagctcctggatgcattgatttttttgaagggttttttgtgtatctatctccttcagttctgctctgatcttagttatttcttgtcttccgctagattttgaatttgtttgctgttgcttctctagttcttgtaattttgatgttatggtgtcaatttcaggtctttcctgctttctcttgtgggcatttagtgctataaatttccctctacacactgctttacatgtgtcccagagactctggtacgttgtcttcattctcatggtttcaaagaacatctttatttctgccttcattttgttatttacccggtagtcattcaggagcaggttgttcagtttccatgtagttgtgcagttttgagtgagtttcttaatcctgagttctaatttgattgcactgtagtctgagagactgttatgatttccggtcttttgcatttgctgaggagtgttttacttccaattatgtgatcaattttagaataagtgcaatgaggtgctgagaagaatgtatattctgttgatttggggtagagagtactgtagctgtctattaggtccgcttggtccagagctgagttcaagtcctgaatatccttgttaattttctgtctcgttgatctgtctaatattgacagtggggtgctaaagtctcctgctattattgtgtgggagtctaagtctctttgtaggtctctcagaacttgctttatgaatctgggttctcctgtattgggtgcatgtatatttagaatagttagctcttcttgctgcattgatccctttaccactatgtaatggccttatttgtctcttttgatctttgttggtttaaagtctgttttatcagagattaggattgcaactcctgccattttttttttccatttgcttggtaaatattcctccatccctttattttgagcctatgtgagtctgcacatgagatgggtctcctgaatacagcacattgatggatcttgactctatccaatttgccagtctgtcttttaattggggcatttagcccatttatatttaaggttaatattgttatgtgtgaatttcatcccgtcattatgatgctagctggttgttttgagctgggctgagttcttatcaggaagtgctgaagacgaatcctcttccaagctcattcatgttgtcggcagaattcagctccttgtagctgttgggtggagatccctgcttctttgctgtctgacagccaagagccatgtttagccctggggtccatccacattccctaccatgctgcccctctgtcttcaaacacagaatgtcctacaagtcagccccaaacactttgtctctctgacttcttgtctctgacctctagacccagatttaaagggctcgtacaattaggtgaggctcccctgaataatcttccctttgactaactcagtgttagccaactcagggcaacctgagttacatctgcaaaatcccttttgctaggtcacatcacatagccacaggaataacagctcatcatgtctgcaggccccacaacaaagggagaatttacaagagtgtgggtcattacgggtcatcttagagttctacctacgacactggctttagaaaaaagcatatgggagcatgaggaaacacttctctccctcaaagaactgctcctcatgggttgaggggtcaccttcccaatgatgtgtgacctgagactgagtcactggacagatgtgttttgctctgtcactcaggccatgtctactttgtgaagtaaagctggtatgcccaaaacctaggtcgaagaccagctccacctaccttataaggagtggcaattcattggaatctgatatcaggttatttttgacacccagttttcaatgttatggagagttttcatgtttttctttccatttaatgagaagttgggatcaagaatattgaagattgcaagccaggtgtcacattaaagttgaagcctttctaatttttgaaggttgagcactttggttattcatggttttatatgacgatcatcttttatccatcgctgcagttttctattttgacttgaattggaggcagagctccaccaccccagtgtgtcgtctgatttcccagactagagtccagcctttcctgtgcttgcctggcttccctccatgttgcttcctaccccaccatctatacccttcacatccaaaatccaaaacctcacactcatacgagaatccctgttagggtcggtttatatttacacactaaaaatctctaattttgaatttgttgtgcctataaaggaataccaggaataccttaaagttataattgtatttattagcatctattttaggtcagtcttgggggagtgatggaaagaatccacatagactccagagagatgggcaggggttactgcccagccttgaacattcctctttcctcacaaggatgggctctcgcataagtaatttcatgggcccctaagttttaaagaaaaaataagtgttttctcatttttaaaaaaggcagctttgctgttaaaatatgtcaataagagtcctggataatgtttaaaagtatttatgggctcagatggggttaaggtagagctgactgttagtctgttgaagtatttgtttcccagctcttgaaaagcctgggttcttagatccaacctgagaatcatagatatgtgcatatcacagggagggcaaaaaggttcactgtctgtttatacacttgccagtcatccttttaatctctgccaaattgtctgctttaactcctatgagtttttttatgccatctttttgaaatagtaaatcactttattaggtttttaaaagaacattcataatgtcatttccatgagccattttgtaaattaatgcaatttccttcctgtttaacctgtttgcaagaagctattttacatttctgctgtaattcagaaaaaaaaagtgcagttaattcataattgaatttgcagcctgataggtaaaatgaatgcttttgactcatttcaattattatagatactaaagctgcatttatccttgagattcatgaatgtgtgtgttgctttcgttcctagccctgggatcccgacacaggccagacctggtccctagcactccatcactgtttgaagctgcttccttggcaaccacaatttcatcttcttccttatacgtcaatgagcactatccacacgacaggcctacactctattcaaacaggtaatacttagtgcagtcaaataacccatcaggctgttaccacatcaacatcaggcctgaaccagtatctctgaatgaggacacgtctctaacaaccaggatgtgcctgtcatctgcctcataggtcggagagagaacatgcttgatttttactgtggcaaaagaacattggagggaaaaccctcatgatttttctttacagttgatcattatgtcatgtagaaattatatacttggctcaatggaagaagacaaatctttcatcatttttattttagtaaattttttaggaatgggtttcttcagagtgagcactcttagttaatattacacaggtagctgcaaagatattgtaatattctcttttggtatgtgtgatcttagtgactatggtaaacagaataattgctcccccaaagctatccacatcctaattcctgtaacctgtgaatatgttaccttatatggcaaaagggactttacaaatgggattaaattaaagatcctgaaatgggatgattatcctgaattatccagataggcccaatataatcacagggttcttgtaaggggaagacagaagaaaggtgagaatcagagaaggagacacaacatcagaagcagaaggcaggatactccatttgccctgatatgattattattcattgcatgcctgtaatcaaaatatctcatgtaacctataagatttttggaaattgtatgctctctagcaactttgtgtgaatttttatataagcactgttttataagttctatgaagtgttataaaaatagaaacaaattttaaaaaataagtaaaataacaattatctgttaaatgttagactagttcttgttgaaacctagctctcaataatcaagatcagatttatgcaggtgaagaattccttacgctttaagtcattttccatctccaggctagcagttcagttgatttccaggaagaggaatcaataaggtagatttatttttaatatatggatatccatagagtctagcttagtcttttggtaagttaaagtttgctagtcggacctgctataggaattcttttttgttgctgtttcctcctccctcagctagatacaagattaggtaggcaggaggttaggcggccagtctaggtccagaaaagtagatcaagtgggtagcaaggtgagccgcaaatcttagctgggcctgagtttgcactgttctgctctaagggccaacaaataaggctctattaaaaattatttaactcatctaaactatacaaagttatttgatttggtcagtttccttggattggagaaatttaaaatgacttaaattaatgtgtaatacttagtagtaatgtcaaatgtttaaacctggtatgtaaattagtcaagcaacggcctttcctgtctgtttggtgcagctgaacacatgggtctatataaagttcttttgctctcaaatataaatagcagctcaaaagatagctggaaggttgcaggaagttcttagcaaggtcaaaaacaattctcatgtgaagccatggtgatttcttaccgtttgctgtcatgataattattggggcatataatcggatgtgctcttcaatcatttcgtgagattttcagccaacaataaaagggttttgttttgttttgtgttttggtagcagtggtggtggtggtggtggtggtggtaagtatccagtctcttgaccaggggtgttagactcttgggtattcataaggttttcccggggcctggcagggcctcctcctgactcccaatcgttcctggccatcctggaagctacctctgcatgttccacctccgcatgctcccagagctgtgctgtcattcttgatgcttttatttacaccgatactgactagcatatagatttggagggggaaaataaaaagttatctatgatatttttcctttcttttaaatatttatttaaaacaagtgcattgttttaatcttctttggcactgtatctccaaaatgcaatttgatatcttatatttcactatcaatcaaggttcacttgcaagaacaagaaaccacttaatcttaaccagaaaggaatttaatctagggaattgggtgcctacaaagtctgtggaaaggcagtgggcatgggctccaggctggcaccaggaaatccatcctggaacatgccaccaaactgagccaccagcagcactgtagcaggacccacagtcaagttggtgcctgccaatgagatgcaacccagacaaacgcatttcagtgagcctagaatgttgtttcaatgagccaccctttaaaaaccaaacaacttcgctaaaatacccagattcttttgcaatatcagtgtcttcgtcaccatataattttggctctgtttcctcctggcatttatcagctggaggggaaaacctgagaccaccccaggtgaccaccctcttcctcattcatctgtgctgtcacctgcctgctcctgtaggtatgtctgcttttagccttgatgtgtacaagaagctgacagaagggcctcgggtcttaatcacagacttagggaaatcataaggaaaagaggcatgaaggtgctaaaaaaatcttaaagacaacagtttgagaactcccaggagtcaatatccctatttccctgacccactgtgcccaaccctcattattcaactggcaaacttcaccaacaaaccaaaacaaaagaaaaaattgtcatatttttgtttctatcattttttcctttagagcccacctagtcctatgtggcaataaatagacactactctaaatctcatctggccaactgagtttcaaaacctaatccagagagcctggaaagaaaatgcattgaaaagaaaaaaaaaagaaagaaaaagaaaatatgttgaatattgatgttataatttacatgtgagatttttctctttatgaatcatttttctgttcaggcaaagtggtctgttttccgattttgacattatgttatatgtatctgtgctaaaataagctgcaaatacttcaactagcagttgtcattctgtcagtctttttagaatccttaagttggcaaggtattgattagtgcctggatgcctccacacctaaattatatactgcagtgggaaactgctgtctcttagaattattcctttttttaaaggattattctttgtaacttcaaaaactctgatagcaacccattctttttttaatgtactccaaaaattggctaggaaggaaagaaaaaaaaatagtatcatcttaaaagtatgtatctaacctactgattgggagtacatattttcacaagttgcactgtgcagtcttgtgttagagcatgcagatcataggaataaagagaaactgtcatgggcattgcttcctagttaactagcaacatttaagttctgaatttttgatacttgcatttttatttactagtaagaagtctgttcttttaaaaagaggtataaattgagcactaagaaatatagaggcaaatgtgttttacctcaaagttaagaacaatttcatttaatgttgtagaaataggttacacttatgaatattttcatgatttcctgcgtagttggtagcaaagccaaagctctggttatgcataaggaattgaaagtcacacttcattccagtgcacctatgctttccccatcaaagatgtcttaccagtgtcaccactctatccagtctcaggtttggttggtggctatttctaacagttgggctcaccctgcagacatttgcagtattgtgagaagggcaaaaatgtcagagaaaaagccactggtcatttacacgtagagggaaaattggcaaaggctccctaaatgatgagtccaacattctagatctcagaggctaatccatcagatctaacagtcttgtgccctcttcttcctgccattacagtgtcataaacctagaacaggggtggaaacactctaaccagaagcccttccccacaaattgcttaccactaaggtttatagacatgcaagtagagccatcccagtggttagagatctttctttagatttgtctaaaatatcagaaaatggaaatgcagaaaccttacatggtatatccgagcgtgttagtaggacttcagttgaacacaggtctctagggtctaagcctcttgtcttttccactgtaccactcctgcatcatagcctccaaaaacatacaaggttggttggttggtttttttcctaacatgagttctggtcctgtgtttgagaccttttttttttttttgctgcttaataactaaaatatttctagcaggcaaagttgtgggcttatgttttggtttttgggttttggttttttgggtttttttgagagagtctcgcgctgtggcccaggctggagtgcagtggtgccatctcagctcactgtaagctccgcctccagggtacaagtgattcccctgccacagcctcctgagtagctgggattacaggcacccgccaccactcctggctagttattgtatttttagtagaggcggagtttcaccatgttggccaggctggtctcgaactcctgacctcaagtgatccaccctgctcagcctcccaaagtgcagggattacaggtgtgagccaccgcacccagccaatgggcttacgttaatgtctacctatagtatttgttctaccagctattggtgaattttgcttattaaaaacagcattgcaaaggcaacttttctatcataatattagtcctacttcaaaccaccaataataatcgaatacaatagcagctaattattggaccttattaagggccatgttaagccctttatacatatcaagtgatttaattctcacagcaattctgtaaagttattatatttacggtctccatcttacacatgaggaaattgatgcttagcaacatgaggtaactttctcaagaccacatggctaaaaagtggaggcatgacttccagctacagcactgatatagaatatacagtttcagatgataagttttagatgatgcttttaatggaaatttggtgacatccatacaagttctcgtcttcatctttttgccttttctttttccatgggattttgagtgaggattttcatcttcaaagatgttagagacagaatgttcaaacactttaaaaatttaacattaatttaaatttataagaaacctaaaatagctatttcctcaagttgttatttccaactctccaggtggactccaaatcactacgtaatcatcgagaaaagacttttattagatatgttcctgctgggtttagaaaatcctatatcttctgttgatacagcaaggtcagcaggaatctttaatatttacaaaatgaaaggagaacagctagttgcaaaaacttcctagtgattccattcccctaaccctaatctcaagggaaagacagcacaactgtgttacctgctgtgaactttgcagctacctgccatacctagacaccagtctagggctacacagcccctagtaggatgatgcactcgttgatgctaaacattgaagacgacctctccagactctttgttcttttatggttttttgttttttgttttttttttgagacagagtctctgtcacccaggctggagtacagtggcgtgatctcagttcactgcaacctccacctcccgggttcaagcaattcccctacctcagcctcccgagtagctgggactacaggtgcgtgccaccacgcccggctaatttttttttagtagagacggggtttggggtttcaacgtgttagccaggatggtctcgatctcctgacctcttggtctgcccgcctcagcctccaaaagtgctgggattacaggcatgagccaccacgcccagcctgttcttttatgtttcttaatctgctgactcctgccttgcaaacagaccttcctacccccaccacctcagatggtggtgggtaaagatgctcatgcgtcttgctaaatcatcccttaggacattagctctcaaactgccacttctagtgatctaacattgggcaagttacttgctcgtcatgtgcctcagtttcctcatttgtaaagtgtgaattactatactactgcccccagagttgttataaagattaaatgaaataacaattagaaagcatttataccttgtggcacatagtaagccccataaaacatttgttgaaataaaataaccaagtgatttgagacactaataccttgcagctgccgcataagtctcactgtaaagggcatgatgtttttgacaaaaagccatcatggagtgctttgttagagtcctttcaggaaatggaaaacacacttggaatttcaaagggaattggttacagaatgtggggaggctggaagactgaagggggaaattccagaaactcaggtaaataactgcaggaggcagctcccaccatgagctctgccacgatacctgctgccgccttggagaagggacagtggcggaggatgctacctgaagagctgggatagtgcaagaacatagccacctccagagacactgccctgaaatggaagaaagataaatgagagcagaaagccagcagcttctgtcctcctgccaccttctcatccaactcctgcaatgccttgactgacaggacctagtcaagaggcctatgggatatcgtttgcaactctgggccccagcattgcaaagtagagttgagataggataaaaacaaccacaacacatggagcaaaagctagatagacacaggatcttttttaaaagagagagagaggaaagggtcaaagctttacaaaggtagtgtgagtgcaagaacaggaatcaatttaggcttttatagaagtaatcatggaaccaatttattctcatgccattgtaatagtactatgtaaagtagccataaattttttaatgatctgtgcaattagagactccagtatttaccaataagtctgtctgacaatcagtaatgcattccctggtactgtgctggttgtaaatactcatagaaatgtcttagctaattctagacacatgggatagatctttagtttgagaattcctcaaagaggcttgtaagcttgaggaacccaagtgagactccctctgataaggcaggtgacacagtttgggagcagatagccatcacccatgcccttacaaaacatttctgctttattaccaatacatcatttgtgaacccaccacccctgcaacatcttatctgaatctttcttagtctggagcaaacacagaatgaggggaaaatgtggtcacattctttcattcttagtaaagaaaggatttagtcaccttttcccaagtgtcaagaaatgaagtcatcaagcaaatgataccacatgtttagagaagcaaaaaccttccttattcttcagtctcttgaaagaaggatattccattttaaaaatcaaaaccattatagcattaccagtgaacctgagtggtgtcacatctctctccagttgtggctgaggcacatgctgaaaaagttggaacctggctgcgagtgatggctcatgcctctaatcccagcactgtgggaggtgaggcaggaagatctcttgagcccaggagttcgagaccaacctgggcagcttagcaagacctcatttctacaacaacaacagcaacaacaacaaaaaacacatctgagcatggtggcacgtgcctgtagtcccagctacttgggaggctaagatgggaggattgcttgaatccaggagttccaggtttcagtgagctgtgatcatgccactgcactccagcctgggcaacagaggcgagaccttgcctcaaaaaaaaaaaggaacctgcagaagttttataatatgcctgttagtttagtttttcctccccacccccagaaaaaaaaaaaatagaagaaaaaacatggatttacatcacattagtctgcacctggattttgccagatgtcttttttcctttttgacaaattatagaattacttctgaagtgattagcttttcaaatgatccctcatatatttctgccagggcaggaaattgaagtgaatttttcagatatctgacattatatgaagaataatttaggattcagcattaattcaaagaacattcacattttttgaggaattcatgtgagataatatttctgggtactttttgtgtgttactaagatttttaaatcgatttagtttatggataaatcatattgccaaaaaaagtgggaaaactgttggccaatttttgaatattttaactgacaaaaaaaaaaagacttctttatccattctttgcctcttaattctggaactaaaacactacatctttatttcccttgacttaaaacactagtgctatgtctctggaagaatggtttgctggtagtggatgtacctttgtagacactcttcaattctctgccctccttcgtggagcctctagagaaatgcttctcagtgtgactagctcctacatcagggtacctacctctagaaatggagccctgaagtctgcattttggcaagctccttaagaaattcttacccacactaggatataaaagttctttggaaataaactcttctcccctctctgttctttctgagtagtgaaacagcacctgtctgtggttcagctgagacacagctggactctctgaagaaattaagaggacataacatgtaatgccagaaatataaaaccatagcaaagtggatatgttttcagattctagtaaggagaacaggacctcagttcctttctcatacttcagacatgcctggacaggccctaagcaaaagtgactttttgccttaaaggtgttaaaagaaaaagttcagctgaattaaattgaaaggagtttacttgagcagtgaacaatatgtgaatcgggcagcccccagaatcatatagcagattcagagagactccagcgccgacacgtggtggaagaagatttatggacggcaaaaggaaagtggcgtgcagaaaaccgaagtgaggcacagaaactactggcttggtcagagctcggcgtttgccttatttgaacacggtccgaacagttggctacatctgattggccaagactcagtggttggcacaaatgtaaactatggttggtttacacttccgcttgttgtatagttatcgatgtacagaaaaacctttaggccaaacttaaatatgtaaggaggcagctttaggctaaacttcatttaacaaaggtattttaggttagcaacacctctgggaaatgcttcagccagccccaaacctgcttcccagtgtggttcctctgacctgaagccaacatacatttctgcccagcagctattcgtgacctccctgagtctacagagatccttggttctgtagtcaagcagggtaattctctttcagattccttggcctccactgactccccctctttgcttaaaggtcagtttggtccttctgagccttgagagtccccctctccaccctgaccatttcactctgctgtttgctttgtccacgtgacagttgcactcttgggtgaagctggccttatgcaaatttcgtctcaccctagagagcccctggccagcagcctcacacagggcagcacccttcccaggagcttgtccatacccattcagctgccttccctgccatggcctctcttcgagacgtttccctttggcccaaccactgtatttccatttgccttctgagcctagctcttgtgttgtgtacaaagtagtgttccctgtgtgggcctgggatctgtaacaggtgaacttccaggttcatgttaccagttctggccatgtctcctccacccagaggtcctctagctggggggtctgcaagaatcccaagattcatttttgtttctctgatatgcttcaaacatacaggaagagtaacaaacaatttcttccaaggcaagtagaaagttggtcccgacatcctctgtttaatccttctgttacctgtggagtcatcaccacagtagtgagccttatctcctgtaatttaaatgacttgttgatttgggagggaaggaatttcactggggaagtccactaacataaacctgctgctgaggactcattcacttcacagcaccaagctggcccagcctccccacagacagaccaaacgcctctaccacaacctgcctttgcatttagttcatgatagttatgggtgcaggagaattaggtaagtgtaaggagggaactaggagacaatgttaaactctccattcagaataatattaatctaaaatggaatcatttaataacctgttttcaaggataaagtaataaaggtgacatgtgtaatgaagtaatggagctcattatttttccagccagccctattaaaaattagtgtgtggaaggtcacaaataacttaaaaatgaccagatttgttttcaaaatgaaggatttggctataatgcaaatttcatcctgaaggctacatggggaaaaaaataatggtagagtttctctgtcttttctttcattgcttctcatcacactggaagaatggttcagactaagcactttgtctgggagaagattttttgtcttttatttatgtatgagtgcatttcagttggtgtcctcctaattccaaccaccctcacctgctgctttctgtgtggtcactgagttgtgacaggagagaggccaggtattcgaaggccaggtcaaagctcatttagggaaccggtcgagccttcgccttttccctgttcaccctcctgcctttccaacctaagtggtaaaactcatcctgaaagaatcacggagctttggagatgagagggaactttggccatcatgtcatccagcccttttatttattaaaaaaggtattgattgattttaaaatttataaattatttttgtaacaaaactctatgcccagagtttaacaaatagtcgtgtaacatgtgttaagaaaaagagcaagccgtagtccacctccccctacgtcttcatgtgcaatcaccttcaactctttgagctgattcctttggcaattactttggtttttctaaataacatgcttatattgttattgcttgatctattgggtgtaggcattagctaataactgcccactatagaagacgaagatttagctgtcttttctccacccgacacataccacgtatgtgtactgttcccaccccctcctcctacacccttccagtttccctgtatagttacatcttgactgtagtccgatcgatattgagtgttttattatggctttgtgaatagtgtcatatactatgtttcagtttcctttcctgtgtgactttttgtttttattgtaataaatgactgccttgttcttcggtttgcttagttttctgtgtatttttccttaatagaaccctaagctttccaccagtgtcttcatttcttctcaaaccatttaagtgcatgaggttctgttccttttattgtcttgcagaagtttccgccagacacttctgaccagcctggactgaactggttgccctctaggacctgatgtacaaatgttactttggggcctctctgctccatcattctggggattctagtaacctcttgtctgtatcagttccgttgtttgtcatctcctacatcttcctctttgcttcttcctctttcttggtttactccctcattttggtggaacacattttccagaagaaaatcctccagtatgaaaaatattcattgcaggcaaaatatttgagatcttgcatgtcttaagtctttattctaaccctaacacttgattgatagattaactagtatagaattctagattgcaaatattttggattttttttttcaacatggtgaaggcttggctccattgtcttctagtttccaattaccattgagaaatccagtgctgttctgatttctgatcttctgtaaatggcttgctttctttgcctgcctgtctgcctgtctgcctgcctgcctgcctgccttccttccttccttcctttcttccttcctttctttctttcttcctattattattattattattgcagaaacctgtaaactctttgattttctctcagagtctcagtatttcatgatgctaggccttggtgcaggtctattttcagccagcatgctaagcactcaggggaccttttcaacctgcaaactcatgttttgagtttggggaaattttctaaactattttcttatttcctcctctctattttctttttcctttttgtaattccttttatgcatacagaatatcctggatttgtcttccaattttctctacttttctgtcttcagtcccatctatttatgtttctgtcctagtttctgagagatttcctcaacttcatctcctaatccttccactgagtttttaatttccattaccatgttttataagaattctttttttgttcgctgagattttattttttagcaatctttccttttttcatgattgtaatttctcttttttcctgaagatattaggattatgttttttgttttgccctgaattttgtttcttctccctttttagtctcggttttcatccaggctgcctttttctctttgtagtctacatgttctatactggaggttttcctcagatttttggaaatcttcatttgtctgctcaactaaggcttgagtgggagactagaaaactgattagaggccaggtgtggtggttcacacctataatcccagcatatttggaggccgaggtaggaggactgttggagcccaggagttcgagaccagcctgggcaatactagtgagaccccatccctacaaaaaaaattaaaattagccaagtgcagtgacacacctgtagtcccagctactcagaggctcagatggcttgagcctgggtggttgaggctgcagtgagctgttattgcaccattgtactccagcctgggcaacagagcaagactctgtcttaaaaaaaaaaaaaaaaaaaaaaaaatccctgactggaaacttaagcacttgagcagagcttgttgaccagcaagctattgagctggtcagactccctataggagatgcttccagtttcttgcttggaggagaaaggcctggctgtcagccttctgggacatctggcaggaacaggtgtcttagcatctagtatatacatatttacttcctctctttcttttacctcaattgcttctggtgtccctgggtccacacatcctgttctgtgttttccgcagggagaaaaaaaataaaatcctccagtcttctgttggaatggggagaggtttttgcctggctatatatttctttgcttttcccagtggtagctcaggattttcctctcaagtttgctaaattgattactacctgttcatatgcctttcagactcctaaattttgtctctcttagcttcttccaatcttctcccctctttataggtttatgtccttttttaaccctttattgtagtgtagagggttgagcgtgtctgcaaaattagatgagatgtgtttcatctgcctctgtttcttcgtctacagattaagagaggcccagagaactgctcagcgaagattctaaggtttgcagcataacttaatagcaaaagtggagctaagacctacaattcctgactccttgttcagggcagcctctttcaaaatagacaaaatcattaataatgagttaatccaaaatcagtatgtttctgattgtgtgtggacaagttgaaaaggctatttttcaaagagttctttgtatcttagctttgattggtatctcatcatgagacagtaaatcaggaaatgaggacttcccaatgccaacatgccccatagacaagccccacatgagagaggactagcgaaaaatgttgatacgacagcagtggctgtgctgttatactgctccaagtaactggagttgcaccagatctcctctacatgtgggaacaaacagggttgcagtcaaatacccaaatttcactggctcttgccccatctgctggggggcaggtccatggtcaagtgctgtccaagtagatctgtaagtccccagaggtgtctccttggtgctcacaaacaagtccaaacaagatgctagaaaggatggaaaagatggaaaatcattgcccttgagagactataatatttgtataaatagtcacaatagaaagcaaatggtattcaatgaaaaatctacacaaagtgagttaggcagacagagttaggaaaaatgacttgcctggagctgtgtatgatgcctgcagtaaaggaagagtgctacagggtgaaaactgcacatccctgatcatattgctcattgtccttggcataagtgctcagaaaatgtttcataattatccacatgcaacatttgagatgcccatgcttgactgaaccaagaaggcattccaaaagtgacaatgttgcttcataaagggtttaatttcaggaagatgtacattgatcacttttatttgtgtttgtaacaataattagtacatctgacttttcaagtgcaaacagatgtgttgaactcatcagcccaggcactgtgagagagagcagagctccccagtttgctcttgtcatttgtcccgtgtgtcattctgtggttaagacagatttaaaattcatttcctggcctcccgtgacatagaaacagttcttaataaacaagggactcccacataaagccctctcagtgcgatctctggaaaagtggggaactggatatttttgtttaagaatacacagctctcagatgtaaccagagcatggcacttctttgccaaaacaggaaggtgggtcacctgagagctggcctcgggttaaaataattacatgagttctggggagtggtgagagcttcatatttttatagcacttttatagtaatatttatgtagtattttactgtatccatatggaagatattttgtatccaatgagttatgactaccattaattcatgcacattctttttacatttttgtttataataatcctaagaactatgtctttgatgtgtactgtatgcaatgtagtcagccaagagctttacagatattattttatttaatgcacccatcaaccctctacggtaagcaccagtggagctgacaaaagggacttgcttagaaacattaatgtcaggctcatagaaaaatcaattattgccaaggtcattgtgtacccaaacctaagaccatataaaaaacataataacttgacccataagatgaacttctagataaaatgaaacttttttccctaaaatctataattcttcaaccattatgaatgtactctcaaatgcatcgtttgaaacattcctataggccgggcaaggtggctcatgcctgtaatcccagcattttggaaggctgaggcaggaggatcacttgagcccaggagttcaagaccagtctagtcaacatgggaaaaccccatctctagaaaaatacaaaaattggctgggcatgatggcaagtgcctgtattcccagctactcaggaagctgaggcaggagaatcacttgaaccccggaggcagaggttgcatcagccaaaatcgtgccactgcactccagcctgggcgactgaggagactctgtctcagaaaaaaaaagaaagaaaaatttctatgtttggatctcatgaaatgtgcctgtagttaatcaggaagtggccccattactgacaagaaagaacacgagttaaatagcaaatagttctgtcagtagaatcatatgatgtgatttgggctaagatcagtattttttgcatattcatatgttgctagagaatgtatgatatcttataaatctcatcactttccattgacaagcagcattgagtccaagttttacttagaagtgcattcagccaagtaacaggtaagtatggcttaaactagaacttttcaacgtgtatggtgaggcccattgatgagccacaaagagatgtgcagagagatatgtatcccctcaggcttcaaggtagggaggagtcctggggcagctgaagcccccagcatagttcacctcaggtgccagcagtctcctctgtgttccccagagggcagtacaaatattaccgcccactgtgattgtcatgacacaaaaaagatgaagaagcaatggcttgagatagaataaaggatatttgtcatttacttaaagtccaggtatatgcagtctagggtgggtacagctgcacagtgacactcttatgtatccaggttctttccatctttctgctctgccatgcttcactctggtttttgcttttcttgtttgtggcctcatagttacaagatggctgccatagcttcagacatcacgtcctctctccagggacttctgcaggaaggaaatagaaaaagaaaaaaaaaaaggtggggagggagaaattcctcattgcaaggctttttatgggggaggttgcccagttgtgcccccagcagcatcctctcagcagctcatggccagaagtggatcgcatgactctagctgcaaaggaggctgggaagaggcctacctcccctgagactacttcagaggagagaaagatatctttttttcacccatcactaggttcatgcctataacccttataaaagaagacatattaacaagagaaaggcatacaaatgcatttaatgttttatacgacagaggagctttcagaaatgaagacccaaaaaaacaggcaaacctgtgtagttttatgctagagttgatgaagaagtggaaagtaagattggctgaagggggtatgatctaatggtaaaagactggtgaaacttagcaaggcttctttgtttagattggtcaccatgtccctgtgtcttcagagataagtatatttccttcctccagttatagggagggcacctcttaagtggggtcttacagcctactacagaggcaggccagaggattcttttattgcctgcttcagggaagaagggtgagagaaggtcagagagtgaccttcctaggtttattacctgttttcttttcttttttttttttctctttagacaaggtctggctctgttgcccaggctggagtgcagtggtgcaatctcagctcactgcatcctctgcctcctggctcaagcgattctcccacctcagcctcctgagtagctgggactacaggcatgcaccaccatgcccggctaatttttgtgttttttgtagagactggatctcaccatgttgcccaggctggtcttgaactcatgagttcaagcgatccacccgccttggcctcccaaagtgctgggattacaggcacgagccatcacaactggccaaggagctgttttctcaaatgctaagttgccatataatgggtagaatatcctgaatcccatcactacagatctccacctactacctaaaatcaaaacctagggttctgttagcaaagacaggacactatggcttttgtacaggcaccagtgattgtgccaaacacagactgtaagggaaaagccagaatgattttttttaatgaaacatattttctgcttcttaagtaattgtttagactctttaaaataccacccaccagatcatttacccctcaaactaaaagcctgttctggaaatggatttgaaacagagcatcctacggacaagagagcggtttgtgcaaatcttagagaaatttttctcagtattcatttttattgagacatccaagcagcattcatgattttgtagctcttgagttataaactagatataattctttgctttttttctcctattcaatcgcatacttagacattaatatttttaattattttttaaattagatgggctctgtggaatgttgcatgagatgcctcaagaatcaggccacagtgttggaaagttatcataatgcaaacgtctcacaccacaaattttaaaaggttaattttttttggttcaagcagtattaactttggatatttagaaggatttttttcacatttcctcagaattggtgacagagaaaagtattttatggtattgcaaatattatatcagaaatgtatggcactgagaggagaaactaagtataatcgtcacctttgatcaatttataatttttagaaagttggttcatagtactcccaatattgacgtgtaggaaagaaagaataagaaagaaagaaaccaccatttccttgataacttgaaaaatcatagatttgaatgacagaaataattgtgaaccaagttccagtctataatgaggaataaactttttctgctttgtgaattcattttctgattatgaaaattatacaggaactttatgatagaggaaatttggaaaagacaatggttattcttaattccactaccttaatacaatcattaatgcctctgtaaaccccatcagacattttcagatgtgtgtcattcattatatgattgtaatcacagtgtgattgccattttacattatacatatttctatggaacaaaatactatattctcttcatatttcttttcatatttttctaggttttatttttatgaaagtcaaatagttcttccaggactattattaaaaccaccaaccccattccattccccacccctatttcctcctcaccaaaggcaaccacctttttcatctgatttttttagttatttctctcaacaaaatacttgagttgctatttccagtttttttgttctcactttggaagaggatgatatagctcccttttatcaccccaccttcacagtaacccttctcatcctctctattctccaagtagagttgcatcataattcctattagattgtaatttaccttatgtcataaacatattcgcaactgtgccctgttgtaaagtttcattatatttccttatacttttccccaaaatgatgttccattctgttttctttagttgtctacatatttattaataattgaatctcaaactctttaaaatgtctaattggttcagacgcgtcggatatttcagcagagttactcaactgaataatctctccccagagtcttctgaccttgtctagtctgctaagtttggtgcacagatgttatcctgggaacttctttcacctttgttctgggaattcactttgtctctaaagttggctccactgcttcatagtgtttatatttccctcttcttggtttagtcctttgtttctgcagagcacatcccccagtatctttttgagaaaaggactcatgggaagttaattttttgagatcttgcaagtctgaaaatgtctttatgctaacgtcactcataagaaatagtttagcaaagtatagaattttatttcagaagtggttttcaaaggcattattccattgtcttcaggctccctaagttgctgttcagaagttcagatttatccgtttcctgatcatctgcatgttatctattttctccccatctctgaaagtttaaagatgtctttttcttaattgtcttggagttggtcttattttcatctgtagtaaagcattgtattcagtggaccttttcaatctgcatactcaagtctttcaggtctagaaaattttcttttttcctttttggtctttttttcttaggtctaggaaattttcttgatgatttcattgcctctgttttttcttttctctgtgtatctcctcatttgaaaattgaagccgctagactagtcttctacgtttctgttgttttttctctgtctcccatctgtttgtctttttactctattttttgtgggatttcctcaaattttcatacagccctctaattcaatcaattctactgttacgtttttactttccaggacctcttcttgtcctgataatttcttcctttagtatcccgttcttttatttcatagttgctgtaacttatctgaggaagtaaataatagttggggtctaagggttttttggcattttctaatccctgcataatcttaggttattctagttagcttttttcgatattttcgatctcttttacaatagtagcttctctcagatttctcataatcgttggttgtctgttcgtacttaaaagcgtgtcaccggccgggcgcggtggctcacgcctgtaatcccagcactttgggaggccgaggcgggtggatcatgaggtcaggagatcgagaccatcctggctaacaaggtgaaaccccgtctctactaaaaatacaaaatattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaagcgtgtcaccacaaatctatcaagacagaaagtaagttagcagttacctagtgctggggattttggggaaatggagtaactattaatgagcacaattttcttctcgaggtgatgaaaatattctaaaattggttatggtgatagttgcacaactctgaatataccaaaagccattgaataatatactttaaagcaactaattatatggtatacatatgatatatcaataaaactatttcaaacaagaagtggggcactaacaaaatgattaaaagttcaaagtgcgtggctggggcttgtcatctgtgggtttcactgtagggcgatttggctgggctgtgtagttggggaaacctggtatttgtctttcttcttgggttgattagatccccagaaaaggctctaccaatctttccagcctggatgataaaggctggctgtcagcttgatggaagccgagttggggaagagaccgtctctgaatctggcaggctagtaccctccttatctccttattttcagttggtcccttatccttgtgctgtgactaatgatccccaatctagagaccttctgttccacccactccggagaataaacctccattcttaaaatagggttgagaaaaggcagttgcatgttggtagaagttttgggagatgatttacctgctgcttaaccagactttcaaccacagatacttaacttagctgcctcctcttaccccgacacatgctatttcatggattcccaatgcttctaattcttcagccttttgagagttttgtgaatcaagtgtgttctaggcttttccctcatttttatgagtttttagaaaagaagcaaagtgggaagcatgtgttcacaccatttttacctgaacagaaatacatattttgctctctccaattattcaaggtcattacagtatgaactatcaagatcatttttttaatttaaaatactgatttgggaaaaaaaagacattaaataaacatttccttgtacacagaatactcctgttttgtgtaaaatcaaaagatttgagcacatttatcccctaactaaaggcagaaatgttatttttcatatgcaagtagaaaaatcaatcctctctgaattcagagaactggttaaatgcattcaaaatcataagacttatgattagctgttttaagatgaataggtaaagtaagcttctggccaagtcatgaagcatttctttccctttgcaaatgatttaaagtcctcaaattctgactgcctcataaagaacagatagattttattgttgttacttgctgtagaaaaattagaggtttactaattgctttacctactcttctcacatggttctttgattttaagggagtcattcagtccatctagactgaatttggaactcagagaattaaaattatgggcagggggacagtggccaagcttactattctttatgatacttgatcttgcagctgacttaattcctgttttcatttctggtccctagagctgcaccgatattcatttcatatttcttaaaggtttatcaggtaaataagagagagaaccattcatagttaacagcacaattgtcatatatattgacaacttcaaggcaattctaaattgtctccttctctaatgaaaacatttcaatatgacaaaaaccttgatccaaattctgcttgttaattaccatgatttctaagatctccagtctctaaaaccttatgattctgtttctttctcaacttaaaatgccacccttcttttacttttgaaaagaacctttatctcattgcatcgatgaaagaaacttatatttgatttagattattactcataataacttgacctttccaaagcatcacagccattcagaacaagctacatttgcagcatctcaaataaaattgtgaggactaatgtgcaaaaattattaacaggttcaagatggcaacatcagagcattaaactaagcaagcagtcctgtgtgtggctcacacctgtaatcccagcactttgcgaggccgaggcagactgatctcttgagtccggaagttcaagaccagcctgggcaatatggtgaaaccccatctctactaaaaatacaaacattagctgggcgtggtggtgcatgcctgtaaccccagctactcgagaggctgaggcaggagaatcacttgaacccaggaggtggaggttgcagtgagctgagattatgccattgcactccatcctgggtgacagagcaagactctgtctcagaaaaaaaaaaaaacaaaacctaagaaaggaaccattctaagcccaggaatccatgcagttgcataggtcacatgaccctgtagtcagccctgaaattatctgtagaaggaagacacgtttgatgtccctgccaatgataatttgctttggttcagctgttacggtgactaacacttccccagatcagggacctttacaatggtagtgggggcattcattatacagtcattgcctgaaattccacatttcaggtatatcctgagttaaatcacacagctattacactttagacaatagatccttcaaccgtgggtggtcagtattgggtggtggtgacttcaggtgctttcttcctgctctgacagtagctttcaatgggtcaaattcttcaagccaaattaaatgaaagcttgagttctgatccacagagaaaaagaacttgaataaatatatatctcctatttctaagctcccgacgttttgtaaagctacttaattttcccccatctcacttgtttttcagctcaatccatctgagcacctgttattcatatcagaaggaaatgaaatcaatagcattttcttccccagtggcagtctttaaacttccttctcttttgccagtaagtcatcattcttctttaagactgctgttgtatccaggcatgtccaagatttccttatttgttttgaactttgaacctgatagacacttagaaattcacgtggttccaccctcacccatagagcatgttatactatcacagtggactgaaatgtttcttaagggtttataaaaggatgattatgatgccattaagagaagtaaaggcccctaagggaagtaaagagctaatatttattcatcatgagtaaacatccgatcttagctatctcagaacaggacatgtattaatacattgaactttgaataaattggcatctcacttctgtggttgccttgctgtgaagggtactctcctgggtctgccacaaaataagcagaatccgacccaggctgacctgactccccatatagcccaggaagctgatgagcctggcatgtcagctcaggctgagaattcttctccccaagaaagcagaatcaaaacccatgcatggaagttacaaagaaaggattgttctatataaggaagagtttaataatgtggttaaagaagaaataggctaccctgaaaatgctaagcctctcactgtagctgagcagccatctgggaagactaccgtagaggggagagaaatagcacagagctttttaaactagaatgcctgtaggtttccttgtaaacgctgcaattctggaattctcttagctcccaagaggaggttgattgatcacaataaatacagagcctgatagacggaaaaataagcctgttatatgtgtacaaaccttctctccctttccttatgagcaaagtgaaaccagacctgcaggcatgtggccttatgtaggcctgagccttaagctgccaccatttggcaggatgtgcatcctttgaggaaattgtaaggttatatggccatggttttcagcttggacaggtaacctagcatagaagctttcgaattagaatgccactctgctgttgaccagctacactactttacctccctgcaccttaatcacctcatctacaaataatatcgacttcacaagattattgtgaggatgagataagaaaatatatatgactagtacaatgaatagaatatatataagatacatattctatgactcaattagttctgtgatttaatttgaaagtctaaggtgaagatgggggcagagggtgtccctggaaaggctaacgttctaatagagtttaactcaccattgccacttctgatggatagtctagttctgcaagaccaagcctttctgcctgaactctagtacctcaatcacaggctgggaatgacttaaggaaacgaagccagttccaaacgctaacacacagctgtcatacagattttgtcccacaaatgaacaatgatataaatgtagtcaatcttaaacttctgaattaactgtaaagtgatacaagagctttgtgtttaaggatgagaaggttcagcctagttcttcagtggttccatacttaaaccatccaaaaatacaggtatgtatccttatctattgaaaagaagaaaaggcagcggggcgcagcggttcacacctgcaatcccagcgctttgggaggccaaggcaggtggatcacctgaggtcaggggttcgagaccagcctggccaacatgatgaaactccgtgtctactaaaaatacaaaaattcgccaggcatgatgcatacctggcacatacctgtaataccagctattcaggaggctgaagcaggagaatcgcttgaacccaggaggcggaagttgtagtgagctgagattgtgccactgcactccaacctgggtgacagagtgagactccatctcaaaaaaaaaaaaaaaaaaagctatttgtattcaaaaaacaaaacagtgggggtgtgtcagagggcacaggagctgactgaaagagctctcaatagctaaaattggaacaatttgagcaataaaataacacagttttgagttataacccaaagaataaatatccaagaggccatactaatattaatatatgattgaataaataaataaatggaggagaggagacaaaattcccatacagaagaattccaaatactgtatgtagctactccaccctgaaggaagtggaacacaacaccccatcccttaagcgttggccacacttagtggcttgcttccaaaaagtacagcatggaaagggaggtgggggtacctttgcagtagagaagcctggtaaacactacctcagccaggtaatcaaggtaaacattatcaatgataagtcatgttaatagtgcataaccttgacttaatatggtacttgacctctgtgatcttccttccaaaaacttacaaataccgtgtctaaccatgagaaaaacatcaagcaacccaaatcatgtgggacattctgcagtatacctgatgagtactcttcagaactgtcaaggtcatcaaaaacaagaagtctaaaaaaccatcacagtctatgagagcctaaggagatgtgacacctaaatgtcacatggtatccagagtgggactctggaacggaaaaaggcattaaggaaaatgaacaaaatctggatatagtatggaggttagttataaacaaaaaggcatgggtgcttcctctttcaaaatgacattacagaaacctgtaccacaatcatgcattatagtaacactttgttataatgtaaatgttgggggattgtgttctaaaactgtctcttgaggctttacttgaaatgatgggaaactcagtatacagctgtatgcagagaagatgaataagtaatctgtcaaatattaataccatgggtctttttgcagctgggtttaactatgattgatttattatgcagatcacattttcacctgccatagaatcccaatccatataaggttgaatatgtacaattttgaattttatagttcaaatgtcccagtttccagaatttggggttgggtaaaagttgtttttcatgcatatgtgccatttttggatacctgtggtagttgtttcaacctatgaatgaatcaagggcactgtgggaataaactacttccccacatattgtagctggacttttttgtggggacctttatgcaacctaataaatgatctctcataacagattgtagttccttgatgctccaactgaggagttttctagagcttccttccttgggtgagaatagtaggtgaaggtcattgctatagacaaacagaactccatcaggctgggtcctcaaatattttggcatatgtaacaactctgtggaaataataggtatcagatagagttctctgcttacaagcaagagaaactgaagtagcaaaggaaatcatgaggaagctaagaattagttcacataatctaaagaaaaacctcaactaccaagccaagggaagaatatgaaatacagcagctcagaggattcaaccattcattgagtaatatttatcgagcctctaccctctcccagacactgctacagggtgagaatccagcagttcagggaatctgtcacgccatgctttcatcaagcttgcttctagacaatctcagactcagggacagcatcttctagaagacattctcttcctctgggaagcctgagactcatggacatactggtgttattacttagctcctaccacttgacattcttcatcacactgcccaaggttcagatttctctgagagtatgatgagcctacattgatgagtcaaaggctcacccccatgggggtgaggtgctctgatgtgcattcccaacaggactacacagaataccagaaggattgctccccaaaacccagtgagctgctcttaccaacagaagaaaggagtgctgagtgggcaaaaagttcactataatttgtattaatagtgtgaagaaagaaaagagaagactcagatctggctcagaattctgattaaagctatttatgttagtataaccttgggcatgcttccacaatttctctaaaagtccctttcctcatctatataaagtggaatcataatccccataccatagaatcgttttgatgtttaaatcaaggatcaaactagctatttaaggacctgttctggggccaggcatggtggctcacacctgtaatccccgcattttgggaggccgaggcaggtggatcacttgaggtcaggagttcgagaccaaccttgccaacatggcaaaaccctgtctctactaaaaatacaaaaattagccaggtgtggtggtgcatgcctgtaatcccagctactcgggaggctgaggcaggagaatcgtttcaatctggaggcagaggttgcagtgaaccgtaatcagcctgagtgagagagcaagactctgtctcaaaaaaaaaaaaaaaaacctgttctaataactgcttaataaaaattagttgtattttcacacagttgtgaaacatagtatctacagattattttccatgcatttctagcacatgatatttcaatacattctgctcttttttttatcttagcatgaaaatacttgtagggtggacagtgtgttaggatccttgtttatatatatatatatatattttttttttgcatgtgttgactataaagttttgcttagtaaatgtcacatcagccacttcaaaagaggcatcctatctcagctcccagttatgtctcatgaaagactttaagagtgaaatctccaagcactgaacctctccaagattctctactggatttcactctgcctgtcttgcctgtgtcatgctgggggttttatttgtagagggaggcattgtaagggaggttatatatttactatccagacaaacctgggttggaaacctgtgtctttgggcacagtgcgtagcttctgagggcctcatgtgcttcatgtgtgcaactgggatgttaatacctaccctgatgggttgttaaaactgtaaatgaggccgggcgcggtggctcatgcctgtaatcccagcactttgggaggccgaggagggcagatcacgaggccaggagatcgagaccatcctggctaacacagtgaaaccccgtctctactaaaaacacaaaaaattagccgggcatggtggcgggcacctgtagtcccggctactcgggaggctgaggcaggagaatggcgtgaacccaggagccggggcttgcagtgagccgagatcacgccactgcactccagcctgggcaacagagcgagactccacctcaaaaaaaaaaaaaaaaaaaaaactgtaaatgagataatgtatgtggcaggctcagagcctcaatcaagggaagctattactattattaggggtgctgattgtgtcatcatttgatcgcaggcacagtatgcttggaaatgtagaattttttattcaacagtactaggggaagaaaaaaaaacacagactcagatttttaaaacaagactttgccatttataagaaattgctagaaggcagaagaaaaatgctcaccagcccagagtctaggaccacccattttcttaataggtcaacattgtgagatatcttctgtacctgagcacatcctcccacccgaggcccttccgggaattgctttatgatctaccggaaagagagccctgttctcataagtaaacaaacttcagtggggaagactgataataaacattgaagaaaggtcaaatatacatttggaaacaaggggaatcagtgtttgttcagaagaacaaaagagaatgtgactttagaaaatccgtaaaagggtcttaatggctgttcaagtgagtaacattgaggacatatttgttgaatttctaattcataggacatgaaatttttttagttgtggaggttggattttttcattaaaaaaatagcccttacttaccccaacacccttactttagaaattggaaaaccagggtgcatagaagtgacattacttacttaacatcacacagataggtagtagcagaatcaagaccagaatctagttcctcaactctgaatccagtgacttttccattgacatgttcttaaatgttataaaggatgatggtaactttctaaaatcattgactgataaaatctaaaattgtttaaaggagcatgtgtttttccttaaattgcttctcactgaaactctgtgccatccagaattatagctagggttaattacatgttgtcaagaccaggcactacgccaagtcttttagatgcgtattcattgtgtacttgtaacaggattggcctaagctttgatgattaccactagggtttggttgttcctggcaattagtaggaaattgtcctacccaagcaatatgcatgcagtcatctgagataatctttcccacaatatgtggaaaagtgttggtaaggcagagtaggttgtgaataccaagatggatggaacttttgttcacccaactgtgaactttattccctcactatatatcgtattccatacacgatggtgtgtaccctttttcaggtttccatttttagaattgaagaaaatgggctgttgctttcaaaaatcatgttcatttaaattgtgtttttactctctgttaagaaatcacatataaacatatggatttgagcaccccctgcgatttttctggggtcccaccaggatctgtggctgcctaactgatatccacctctccagcatgttgccagcagccacagtgactccaatggaagcagcaacttcaaaatattatgctaaaattggctcctaatgttttcctcttgccttcatgcagtagcatgccagagcccacatcttcttgcttgctagagtcaaattttgcaagccagttgttaagaacagcgatttttattatttatgtatttatttattgatttatttattttattatactttaagttctgggatacgtatgcagaacgtgcaggtttgttacataggtatacatgtgccatggtggtttgctgcacccctcaacccgtcatctccattaggtaattctcctaatgatagagtgccccccactccccgacaggccccagtgtatgatgttcccttccctgtgcccatatgttctcattattcaattcccacttacgagtgagaacatgcagtgtttggttttctgttcttgtgttagtttgctgagaatgatggcttccagcttcatcaatgtccctgcaaaggacataaactcactcttttttgtggctacatagtattccatggtgtatatgtaccacattttctttatctagtctatcattgatgggcatttcggttggttccaattatttgctattgtgaatagtgctgcaataaacatacttgtgcgtgtgtctttatagtagaatcgtttataatccttatggtatatacccagtaatgggatttctgggtcaaatggtatttctagttctagatccttgaggaactgccacactctcttccacaatggttgaactagtttacagtcccaccagcagtgtaaaagcattcctatttctccacatcctctccagcatctgttgtttcctgacattttaatgatcgccattctaactggcgtgagatggtatctcattgtggttttgatttgcatttctctaatgacgtgatgatgagctttttttcatgtttgttggctgcataaatgtcttcttttgaaaagtgtctgttcatatcctttgcccactttttgatggggttgttttttcttgtaaatttgtttaagttccttgtagattctggatattagccctttgttagatggatagattgcaaaaattttcttccattctgtaggttgcctgttcactctgatgatagtttcttttgctatgcaggagctctttagtttaattagatctcatttgtcagttttggcttttgttgccattgcttttggtgttttagtcattaagtctttgcccatgtctatgtcctgaatggtaatgcctaggttttcttctagggtttttattgttttaggtcttatgtttaaatctttagtccatcttgagttaatttttgtataaggtgtaaggaaggggtccagtttcagttttctgcatatggctagccagttttcccaacaccatttattaaatagggaatcctttcttcattgcttgtttttgtcaggtttgtcaaagatcagatggttgtagatgtgtggtgttgtttctgaggcctctgttctgttccattggtgtatatatctgtttttgtaccagtaccatgaagaacagccatttgattgttaataatgggcgatcgaggcgggtggatcacctgaggtcaggagttcaagaccagcccggctaacgtggtaaaaccccgtctctacaaaaaatacaaaaattagctgggtgtggtggtgtgtgcctgtagtcccagttacttgggagcgtaaggcaggagaatcacttgaacctgggaggcagaggttgtagtgagctaagatcataccactacactccatcctgagcgacagagcaagcaagactttgtctgaaaaaataaaaatataagtataaaaactttatgtacatacatatgtgcacatgggtttttttcctaaatgctggttgttaagcctttacttgtacacaactccttctgagccagtcaagtctataacatgtgtttctttatataattatcttcaacaataatactaataactaaaatgtattgaacacaagggacagattttataacagtcagcctcactgaattctcccaaatgctccagggaccaggagacaatgaggagggtaaattcaggcacctccagcatgagcaaggacatctaataggtgccttccgaaggcaagcagatggtagacacttgcacatgttattatttacatcaaccctgttgtaaataacgagagtgatttttatcactgtgatagggataaagaacaagctcagaaagataaagtgactgcccaagcaagccccagctaagtaatgctggttagaaggggagaccacaaggcaagaactaaagccttccagtgcctgctcccgcaacagctcagacgtaatacaacaacctcatctgttgcagtgaactccagcctgggcgacagagcgagactccatctcaaaataataaaataaaataaaacaaacacattaacaagaaaaaaaaatctaaggagaggctgtagatatgtagatacatcaatgataaatattttgagagcatttttagtaatagccattaagaaattttatgtaaataggatttagatatacctatgaaagatagacattatccaaaataactaaagcttaaatgggactctgaaaatggataatttagactttttaagaggaggtcaaaaacataggaaaagggtatatagtttcagtgacagcttgtaaacattaatatttgtatttacaaatggctaagcacattaatacataacaagaagtcaggtctataaacagtgtaaaattatggggagcgtatttgtggttcttaaccaagggcctaatcatttattagtttacatatatgtgctttctggaaggtaggatttattcagtgtgatgtggtaaatggttacatatctgacctaagggtggaattcagagctcctgaacaccagccaggccccagcctcctaagccagaatgctaacccctacagacagtctaaacactagcaccaagccaggaggcacaggcagggccttcagcagtgccctttgacccatatgttactcaacaatttttttcggggtaggggagacagggtctcacactgtcacccaagctggagcacagtggcctgatcttggctcactgcaaccttcacctcccgggctcaagcgatcctcccacctcagcttcccaagtagctggaactacaggcgtgtgccaccatgcctggctaattttttgtagaaatggggttccaccctgttgcccaggctggtttcaaactcctggactcaagaaatcctcccatctcggcctcccaaagtgctgggattacaggtgtgagtcaccacacccagccttcctcttcattcttgctaagatggatcattctggtcctcagtcattcttagaagcatactatgccatttctagactgcacatctcactgctttaccatttctctaagccagcatttcttaaagtataggctctagaatcacctgcttcagaaacaagttgtttaaaatgcagcttcctgttgtcaattctaatgcacattaaagcttgagaaccactatttaagcaattggagtgttactaatgtcagattctaacacgcctagccttgatccttaacttataggaagggtttgggtatataaaagaaccactgccagagattactaaagctgtaccatgatttagaaaccagaacaagtatgtctatccctaaactgcttacgttcctagtgactcaggacaggtgtcgacctgtatagcagagaccagtagcttctgtgacattttctgattagtcagatcagaacttgtaattcgtttggtgtcagcctagccacgaatgagagaactttcctgtcattctgcacctctttgaagctagcaaggacagaaagtcaattctgcttatgattttccaatagctctgaacagttataattacagtgtacatctgtgagagcgaagctgcttttctaatctgttttcatattattttttcagcagcttctgcagacctaatagtaatttgggttttgactgaaggataccacttacatgctgagggtgctcatttcaaccctgtgtgtttttagcacattgacatggtgacaacctgagtagagtctgaaagctaaggcacaaacactatctagcaattcctggtcactaataaaggtttaaaaaatgtttgttggattttactgaagaagggccttgctttttgttctgggtttttgtttgttaggttggctggttttgagacagttttgctgtgtcacccaggctggagtgcagtggcacgatcacagctcgctgcagcctcagccttgtgaactcaagcagccctcccaccccagcctcccaagtggctgggactataggtgtgtgccagcatgcccagctaatgtttatattttttgtagagacagggtttcgccattttccccaggctggtctcaaactcctggactcaaataatctacctgccttagcctcccaaagtgctgggattacaggcatgagccactgcacccagccacgtcttactttttaaagacagaaaatgtagtgtttagcaagaaatatgaattgtactttttttcagttgcctaaaatataaacttcctaaaagttaaggtgtttatttatgaatgcatgtcagtgagaagttcttttttcccaaggtggtgttatggagggaaagtcagtgagtcagcctatttgccgaggccagcttgtccttcaggcatttataccaccagtattagtttgctaagctgcccttacaaagtaccatgaactggatggcttaaacaacagaaatttgtctcaccgttctggaggccaggagtttgaaatccaggtatcagcagggttttccctctgaggttgtgaagaagaatctgttccatacctctctgctagcttctggtggtgtgctggccgtctttgacattccttggcttgtaaatctctgcctttatcttccatggagctttccttgtgtatttgtgtctctatgtccaaacttcccctttttataagaacaccagtcataccgaagtaggacacaccctattccactatgacctcatcttaactaattatgtctgcaacaaactcattcccaaatagggtcacattctgaggtactgggggctaggacttaaacatatgaattttagggagatgcaattcaacccataacaacatggctctgaataaagctttgtttttctgagtaatttttgtttgtttgaatctgacagcagcaagtatagagattgcagagtatctggcagcaaaccactatccatgggaattatgccattgaggtgtagtacagagaaataatagtgcttaggccaggaattgtttcctgttcactgtgtcttaaacctttattggttccattagcttacacagcaaaaggcatttccaattcagcatattttatttccagtatgccactctgatctcaaactttagttagagaagaccaactaaggctaagaatcaaaacttttggaagctagcaagacctgatcaaatccaaactcctgatttttacagagaagggaactgtggagtacaggaaaattcaatgtcttacccaaatacagtactcacagctacttagtgccatgttgctaccacaaccccactaccctgcctcttgctgtagctccttctttcacatattgtactgctcctctgagccacaggggccatcggtgccctatgacagtggtccccaacccttttggcaccagggaccagttttgtggaagacaatttttccatggattggacggcagagtagggatggtttcagaatgaaactgttctgcctcagatcatcaggcattagattctcatgagaaacacaaaacctagatccctctcatgagcagttcacaatggagttcatgctcctttgagaatctaatgccaccactgattactgcctaaggcagagcttaggcagtaatgctcactcacccaccactcacctcctgctgtgcggcctggttcctagcgggccacagaccagtaacagtctatggcctgggggttggggacccctgccctatgattcaaaaggtcccaattcctgttgccttcatggtgcttttctctagctagagaacacagtcaaccctgttttcaatgtgtgctgtctacctgggaatgtttcatggatggcccatactgccattttttaaatctacctaagcctcacctctgggatctacctaaatatattctctcttaattccatggatatgagctctaggaagggaactaattataatgttagactctgccacatatgaacagtaaaacacattgtcctagagagcagaagccatccagtattgtgaagcttaatagaaattactttgatgggcctagcatggtggctcacggctgtaatcccagcactttgggaggccaaggcgagcagatcacctgaggttgggagttggagactagcctggccaacctggggaaatcccatctctactaaaaatataaaaaattagccaggtgtggtggtgcttgcctgtaatcccagctacctgggaggctgaggcacaaacatcgcttgaacccgggaggcagaggttgcagtgagctgagattgggctactgcactccagcctgggtgatagagcaagactttgtctcaaaaaaagaaagagaaattactttgatggtgaaggtttttattttggtttgctgttgttgttgtcttggatgttattttggtggcgtatttttttgcatttatatatttcataatcatataattattggcttcttttttttttttttttcgagacggagtctcgctctgttgtccaggctggggtacagtggcatggtctcggctcactggaacctctgcctcccaggttgaagcgattctcctgcctcagcctcccgagtagctgggattacaggtgtgtaccaccacacccagctaattttttgtatttttagtagagatgtggtttcaccccaggctggtctcgaactcctgaccttgtgatccacccaccttggcctcccaaagtgctgggattacaggcgtgagccaccgcgcctggcctattggcttctttttaacatttattattaatatatatctcctcaacttttgggggtttttagggtttttccccagctttattgaggtatacttaacaaataaaaattatatatatttaaggtgatacattgtaaaatgattaccacatcaagccaattaacatatctatcacctcacgtggttatatcttttgtgtggtgagaacccttaagatcaactcttctagcaaatctcaagtacacaatacgtgattattaactatggtcaccacactgtgcctcagatctccagaacttcctcatctggcatacattttggccaacacctcctcacttcctcttctttccaccagtaactatcattctagtctctgcttttatgagttcagctttcttagattttacaaatgagttcatgcagtgtttggctttttgcgtctggcgtatttcatttagcataatgtcctccaggttcatccatgttattgcaaatggcagaatttccttcttttttaaggatgaatactcttcctttgtatatgtataccacatttgctttaaccattcatcagataaggcacacttaggttgttgccccaactttttgggaagctccctaagttggtgttctgaccatgtctgcttactttttggtttaagcccagcacttggaatgaagtaggcactcagtatacatttgaatggatgattggtagttttgtagggagaaaagcagatactgtttattatgctgacagttcattattaaagtaaaatttatatatagtaaaaatgcagaaatctttgtagttccataaattttgaaaaatatgtacccaagttaccatcacccagatcaagataaagaacattcccccatcccaccagcaagttcccttctgccccttcttagacgtgacccgaagggcttttctccttcgttttttcctggaagctttctacgtttaactttcacattttgtcggtgatccatctcaaattaatttctgtatatgatatgagtaggggtgtcgaaggtttctgttgttgtgctttaacaactattccttgttcctttgatgaaatcaaataatcaagacttgtatatagaaatagatttgtcattgggaaatggatctctgtatctctttttctcttttataattgaaccatggttgctggggataacttagaaacacaggaaagggctaattttctgcagtgattggatggctcaaggcaatatgtgtaggacaggttactccagtcagacctacgttcaaatccaaatgccaccagaggtgagacaagatagtcttaatactcaaatgtacaaaataaatagccagagacctcacctaacagggttctttttaatgagtaaatgaaataacatgtgtaatacagtcatcacagtataaacatcacagtcaacgatgcctgctagctttacacctgtgcttgtgtgtgtacatgttggggtatgatattggaaagaaaaacaaatctcatagcgatatacggtgaaaaaggtccctgaacttggatgagggttcctctttaaaaaggaggaaccctttttatatttatatcctatcacacacagagtcactcccctcaaagggagaggaggccctcttctcacctctgaggctgctcatggcaggagctcagtcactgccagttctctgagccattgtggcttctgtcctcacaatgaataaacctggaaacacactgtttgagtctcttcctgcctatgggttctaagtgctgctgtctgagctgtgcctgcagcaggcttcctgcttctggtgctcactgcggggaggggagccatcggttgataccaggagagagcctgctgctctgctgccttcattagaaacaggcagtctccttgtctaaaaatagcaaaagtgggagagtggggaagagcagcagccatgctcagggctgaaagtgagaaaggcagaaacaagcagatctctgaaagcctcctgtatggtggcaggcggctaagcattctgggtgcagtgactgtggtcaaagcttttctacttccctgggtccgtgttggggggttttgtagatgtgtccacacactcagccaagggctgagcatgaaggagccgctctgtcctggcaggagcatgagatgtgccacacgctgatactgtccaggctgcagcaggagcgctagtgctagtgcttgagaatttccacaccctgtagtatcctcacccactccctgccccaaccaaaggtgagctttttcccagtggggcacaaggtgttggtttgaccatcacttcagaagcgcctgggtcacgctggaatgggcttgcccttaagcagagtgtggctctggtactaaacaagtctttgcagccattaagtgagaccaggctgtatttgtgggtgttctctgcaggtagagctttcctgtctacatttgttatcagttaatgttctggtagctaaactaagagcagaaaaggaattctttccaaggtcttacgataaatctgtctatgcaagcagacctcatcaaagccccatgaaaacaggcagagtctcagaggtaagagtcctgttgatactcctgtttgcttatcccaaagagctttaccctctcttggcctttctttctcttgtactatccaaactgatcctcttgctggccttgtgagatgggctgggcatctttcccacccacagatgaggaaccaggagctcagtgtcataacttgcccagcattgtaaccagtaatcagagacgcagagcttgtatcaaggcctctgcccttcgcctggatattctctgaggtttcttccccacatgacagtttctgaagggcaaaaacctcctaacatgaagcagcctaaaatgtggcatgaatttaagcaaacttagggggcaaaaaaaagactccatttaactttgatttgggaaacatttttctttgcatgacccagcaattatgactctgaacccagagagggaaatataaccctaactcactgttggccaggcagtatacaatatttatatagtcacaatactataaactctatgtgtcaattttctaattttagagccaatctgtggacaaagagggagcaattttgttatagctgcaagataggatataaatatgaacagccctgacaaagtagagataaaagttgttcggtgttttttaagtgtgtctaatataaagtgagaggggaaagcagggacaaagatgaaataatgtggggagttaaaggatacggtgtgtggttgatggaataaaaaagctcactaggtatgttatttacagttacaaaataaaatataaatagcaaatgttggaagaagacacagggtagaagagggtaaatgtccctcatagtgaatcaatggatgctaccttaggttaagaatcttttaacccctgattcatcaaaagacatgaagggaatcgccagaaaatattaaaagagaaatcccaaaaagggctgctgcccctagggaatggcggagggtgggggtggggagggcaggaggttgttgcttttcatcagaagtcatctgtgttgtgtgctttattatgatgtttattacttcgattaaaacaaattgaggcagtgagagaatgacttttaaaagacaaaaactgtggatagtaccatatgttccctcaacaaatgctctcatgagaattagctataaaacactcattaggtctgcaaacagaaatcagagtgttccaggctataaaattatcaatgactgttttcagcagtccagccaggctaatgctctccaatgaagccaaactaatgttgctgataaccaaaagaatctttttttttttttctgtaaatgacagaggcctgtgtggcatcagggtgccattaacgttttctcctagagagacagccaggaagaaaaatcgctcctcctgtactgctctcacctgtgagaagtttatgacttgttcggagagcagagcacagagcccgggaagagtactggcagtttctgtgtttttacaagggaagaacatagctgagtagattaacagtttcctgtgtggcttgttgcaaattacatgcaattagccctcagacagcctgaatcgagagaattgtggcaaaacttgatggtgcagaacctaggcaggcagccagactcctaaacccagtcacgtaaatttgctgctgtaactggatcttcccaagccacaagtctgagaaatggtgggcactctgacctgaccactagattttcaggatattcctcctaagagaggtatccttgcttctaagtgacccctaaaacagaacctaggaaactctcagccagataaattagaaattgattctaaataggcttgtgcccaggaaatcaacaatgcagtaaaaatatcaggacaaaagcaagaatacttcccaaagtcagaactgaggagcaatgaatattaaattgatcaatggcatagacatttaaatgaaaatcctttttttaaatgtatattactggccaggcacggtggctcacgcctgtaatcccagcactctgggaggctgaggtgggtggatcgcccaaggccaggagttcaagaccagcctggccaacatggtgaaaccccatctctactaaaaatacaaaaaaaaaagtagttgggcatggtggtgcgcacctgtagtcccagctacttgagaggctgaagcaggagaatcgcttaagcccgggaggtggaggttgcagtgagccaagattgcaccactgcactcaagcctgggtgacagcgagactccatctcaaaaaaaaaaaaattatattacctttactgcttggggcatcttcaagagaagactttgctgtagactatggatgcatttatttgaattagatgacttattcttgcgttatctccttactcttttgataattacatttcattattttttaagccacaatggacatgcacatacatactcctgcatacagtttataggttcttgagcctaggtaagactttatgtcctatgtgaaacatttcttgattaggaaagttacacctttctcttcagtagtgcatataacctttactaatctctctttgctaaaaataatgtgacagtgttaaactgaaatatttttagtatctgttttggctgaggcccaaaacaaaagtaaatgtgagactatagcacttgcaaaggtcaaaactggtttttgaatggcagaaaatcagctctacagccctcagctgactacccacctccagcctttaaaagaggttattgaggccaagaaaagagtggcagttagaatgtgatctttagagagaactgttgatcagaggtgtctgtccccacccagggacacttgggagggcttgataagtgtcctgtggaggatgtggctcatgcctgagatcctatgatggcagagcaaggagagtttgctgtttggagttggcttctgctactcacttcctatcttttttctgtgtgtgtgttttttttttctccttagcacttttgaccaacataatacatattttaaatacttatctcattgtctgtcttctttaatactatgtaagttccatcaggcacagacttttaaaatttgatctctgtattctaggtgctagaatccattctaggtgcagtgtgcatacatggatactcaataactatttgcagctgggagcagtagtagctcatgcctgtaatggcagtgcattacaggcctgtgtggcttgttgcaaattgtgtgcaattagccctcagacagtctgaatcgagagaactgtggcaaaacttaatggtgcagcacatcggcaggcagccagactcttaaactcttggcctttgggatgataacttgagcccaggagtttgacaccagccttggcaatatagggagacctcatctctaccaaaaaaattttaaaaagaaacaccaggcatggtggcacatgcctttagtcccagctacttgggggctgaggcaggaggatcatttgagctcaggagtccaaggctgcagcaagccaagattgcaacactgcactccagcctggatgacagagcaataccctgtctctaaaaaatacaaattaaataactaaatatttgcatcctacattcattaccacaaatcactccaacaaccctactcgttctgtattattattctcattttacatatgggaaactggagctcttactcagaagggttaagaaacttacccagtatcacatacaactaagtccaagagccagaattgaaagtcagattcatctgattccaaagcttatgctctgcctgttaatgctttctcagctcaggtgcctgtttcctgaaaatgtattctcatccttttttgggtgctaggtagtatctaatctaagatttttaggcaagtaacatgccattctgtgctgtggtctcacttggtagatcctgcataatgaggataacaaatagaaagattaattaattggttatgtagcttacactcaataccaagacaataataatttcagattattcagaatacatttaatggtactttactgtataaatgcctgattattcatttagggctgtatattctcccaaattcttttatatgtataatttggtttaaatattaaattgttggaagcttaagtagcattattttcattgttcaatcttaatatccattgttttaaatatgttgttttagaaagcatattttgcttacttttcctcaaaactttctgttcattgttactcttcccaaaagaacaaagatctccacagctaacaccaaacatcatataccatatttgtttttgtgggtattctgtaattattttcaagctcctaggcacatttgcgtacactacttttgtttctgcaatgacaaatttctaaaatgttagcagcaatgactgtaaaaaagggtagttaattggaaaagagttcagatcctaactctgtttagggaccatgtaacccaggcaagccgctgcacctccctgggcctcatcctggaagtagagatgttgggcagacacatggggagggattgcgtgtatgagtgtaacaggctgggtgggatgctcgagtgaggtggggaccctgcagcaatgcagaggacatgctcggtctaaggaaggcagctgcaatctcactgctactcagaaatgtaggcttacagttggccactcttctcatgtctcaaaagaaactgggtttttgtgggaatttccttttcctcaatttggcaataattcaaactaaaatctcttcttctttttttttttttttgagacagagtctcactctgtcgcccaggctggagtgcaatggtgcgatctcggctcactgccacctccgtcttccggattcaagcaattctcctgcctcagcctcccaagtaactgggattacaggctcccaccaccacgcctggctaatttttgtatttttagtagagacaggattttgccatgttggccaggatggtcttgaactcctgacctcaggcgatccacctgcctcggcctcccaaagtgctgggattacaggcatgagccaccacacctggccaacagatctcttcttcaaaacagttcttccagccagactgggtttgtgggacagcagtgtgtaacctctgggcaggacatccccaggatggaggtgctctggcccatgcctgcactataccagcatgtgccctgggacattgcagatggctccccaggcctccacgggcctgcactcacagtctcttcaccagagagctcgaaatctcagaacccaactctctcatgtcatcaagccagagacatgagtctgcttttctgtctccttagatttgtctgttcttagacattttgcataaatgaaattatgtaatatgtggtcctctatgactggcgtctttcacttggcataatgttttcaaggtttcctcatgttgttgcatatatcagagctttattctttttattactgcataatattccattttatgaattatttgtccattcatcagttggtggacgtttgagttgtttccactttctggctactatgaataatgctactgcaaacattcatatacaagtttgtgtgtggacaagttttcatttttcttggatatgtatgtgggagtggaattggtgtatcatattgctttgaggacagaccaaacagttttctgaagtagctgtaccgttttatcaaatacattcccatcagcagtgtatgagggcttcagttgctctacctcctctccaacaagtttaatttttctgattttctatgataactatcccagtagttgtgaaagtggtatctcactatagttttgatttgcattttccttatgactaaggacattaagcatctttttatatgcttattgaccattcatgtcttctttggagaactctccagattctttgctcatttttaaatttggttatttgcctttttattgctaagttataagagttctttatataatctggatacatgtctcgatgagcctcatttttgtcacccaaatttaatgatattcaaaatattctacttactaagataggaaactattctgtttgaaaaacagtataaataacaacgttttaaaaaaaagaaagatgcccatttgattttatcaaattttgaccttatgatactactaagtaaatctgatatttcttttttctgtaatcatactatattttagctgaaataattgataaatatacctgtcaagtctcaaataatattctaattaatttttgtatgttaattttgtcttaaccatgccagtggcttactcatagcttccaaaaataaaaggtaactcttagattgaaaaatactttcaaagtgggtgggtttgcctctagggaggagaatgctggatcacaagagggcaggagaaagagaattactttctgctgtattttacacttatatgcatgtagcgtcatttaaaaaaaaataaattttggaggctgggcactgtggctcatgcctgtaattgcagcactttgggaggctgaggcgggtggatcacctgaggtcaggagttcaagaccagcctggccaatatggcaaaaccccgtctctactaaaatatgaaaattagctgggtggggtggcatacgcctgtaatctcatttactcaggaggctaagagaggagaatcacttgaacccaggaggcggaggttgcagtgaactgagatctcaccattgcactccagcctgggtgacaagagtgaaactctgtctcaaaataattaattaattaattaatgttggggccaggcgtggcggcttatgcctataatcccagcactttgggaggccgaggtgagcagatcatttgaggccagcagttcaagaccagcctggccaacagtgaaactctgtctctactaaaaatacaaaaattagcagggcgtggtggcaagtgcctataatccctgctactcgggagcctgaggcaggagaatcacttgaacctgggaggcggaggttgcagtgagccaagatcatgccattgcactctagcctgggcaacagagcgagactccatctcaaaataaataaataataaaacataaattttcagcaaaatttaaatgtggactattgtattagtccattttcacactgctgataaagacatacccgagactgggaagaaaaataggttttatggactcatagttccatgtggctggggaggcctcacaatcatggtggaaggctaaaggcacttcttacatggcagtggcgagggagaatgagagaggagcaaaagcagaaaccccttataaaacatcataactcatgagacttattcactaccatgagaacagcacgggggaaaccacctccatgatttaattatctcccaccaggtccttctcccaacacatgggaattatgagattacaattcaagatgagatttggatggggggacacagacccaaaccatatcaactatagattagatcatggtattatatcattttacatttcctgatttcgataattgtactgtattatataaaaggatgtccttgtttttaggaaattcacactgatgggcttatgggtaaaggaatgacttgtatgcaatttagtcttcccaaacagttcagggaaaaaatgcttatgggtatttataaataaataattacaaagcaaatatggtcaaatgataggaagggtatcctggactttttagcattccttccctttttctgtgagtttaaagttatttcaaaattaaagtttaaaaaaaaatttaaaagaaagacacttccggaatattcttttatatataagagcttccagaatattcttttatatatttgatatatattaatatatttgatacacttaatattaggaaagaaataaaaatcataaataaaaactcaagaatggaaaaacttagttgtttttttggggtttttttttttttttttttttttgagatgaagtctcactctgtcacccagtctggagtgcagtggtgcaatcttgactcactgcaacctctgcctcccggcttcaaatgattctcctgcctcagcctcctgagtagctgggattacaggcatgtgccaccattcccggctaatattttgtatttttagtagtgacaaggtttcaccatattggccaggctgctgtcgaacttctgacctcagatgatctgcccgccttggcctcccaaagtgctgggattataggcgtgagccaccgcgcccagcctctttatgacttttgtaatcaggaaaaatacaagtgaaccttacttcttaagatctacacaatttgttgcgcatggtggctcatgcctgtagtcccagcattttgggaggccgaggtgggtgaatcacgaggtcaggagtttgagaccagcctggccaacatggtgaaaccccacctctactaaaaatacaaaaattagcgggacgtggtggcgggcgcctgtaatcccagctgctcgagaggctgaggcaggagaatcgcttgagcccaggaggcagagattgcagtgagcgaagaccgtgccattgcactccagcctggctgacagagcaagactccgtctcaaaaaaaaaaaaaaaaaaaaaaaaaatccacacaattcttttaacaagttttttttttaatattaaaaaggtcagggcttttaatatttcacatatcttcaattaataggtaaatatgtacaaagacaggattatgtgcagttcccaggttcccagacgcgggaaagacagagattataatgtcctcagtggcctcctgttcagcttggaggcttagacaggaacctcagaggatgcctttagatggggagttttcagaagaggtgagctctgatttaaacctggaaggggtcgcagaggaagaggagagatgaagcccaccttccccagccctgccctcagctctaccacccagggaagaccataggctgctgttggttccctccacatggccaatggccagccttctgccaactctcccaacaccaatatcacactcttctccattttctttttttttttcaaatattttgttccagcaaaaccttcccatggcaaatttccacaggttaaaaacataactttgattttaatggggaaaaattttgtatatccatgagcccctaaattaatacccaattttaacactataaaaatggagcaagctgggcacagtggctcacatctgtatttctggcactttgggaggccgtggtgggtagatcacctgaggtcaggagttcaagaccagcctggccaacatggtgaaaccccgtctctacgaaaaatacaaaaattagccaggcatggtggtgcacacctgtgatcccagctactcgggaggctgaggcaagagaatcactggaacccaggaggtggagattgcagtgagctgagatcacgccactgcactccacagcctgggcaagagagcaagactccgtctcaaaaaaaaaaacaagaggaccagttacttcaacagtttcaacagttaacactggttatatcacaacaaaacaatggtggcttctcttcagatgactctccaatatactgtctacctgcattcctttggcttttggtattgtcgtagttactaagggtgtgctccagctatcctcacagaggacataacacagtgctctgtgtttatgtggttcactgctactccaagtgtggtccttgaaccagcagcgttagcatcacctgggaacttgtcagaaatgcaaatccatgggctctatgccagactctggctcagaagctttgtgggagggatccaagaaatttcattctaaccagcccaccaggggattctgaggcacatgtaagtttgagaaccactgatgtaattgaaaaagaagaaaaaaagagtaaaaaggggaaaaaaagaaaaatcatcagtgctaatgatgcacaaggttatcttttgtaaactagggtagtgtaaatactgtaaattgaagcagcaagaactaatcattcaaagtcaaagataactaatgagcccctagattcacatcctcccaccactcacaaggcatgggacccacagatcccctctcccaaatgcaatgaggtatctcgtgtgctggtagagagagaaaatgcacttctagtaaaactgaatactatatattttttttttgagacagagtctcactttgttgccgggctagagtgcagtggtgcgatctcagctcactgcaacctccacctcctgagttccagtgattcttctgcctcagcctcctgagtagctgggactacaggtgtgcaccaccacacccagctaatttttgtatttttagtagagacggggtttcaccatgttggccaggatggtcttgatctcttgacctcgtgatccgccggcctcagcctcccaaagtcctgggattacaggcatgagccaccgcgcctgggctaaacccaaactctttaaactcaagtgaccatgtctccaggcataaccatatttccttcaaattctcaaaattgtttatccccaaaagctgcccacctcaccctctttaggactttggaggtgtctttagattttgttctgggggcctcatgcccatcattcatctttatttttccagcaaagggttaccttccagttcaacatttaccttggaagaggggaccatctacttgaccgctgagcccaacactctggaagtgcaggatgacaatgcttctgtgcttgacgtctatttagtaagtaattttttagtttcctctcctccacttctggtttgtaaatggatccaggccatggcttacacaagaacaagttcaataaaaccaggcatgcttgggttttaaaagaaatgatggcgccctttcacttctgcaaatggtgcttcttttcacaagcaatgttttcctacaatttattacacaaaagaacatctaggtcaatacgaaatcaccacgtataacaagagaacgaatcctctaatgttgaggcaaagtagggctccttagtgttattcccagcgaggaaatgtttccctttgactcagccgtgctccctgatgtttgaatcttctgtgtgttggcgttgctcccttggtaagttagtaggccgagaggcgcagaactgggtcatgggaagaacccaaattcagtgctggagaatcttggctgattctctcctcagttgtcaccaaccagctgtgtgatttgggaaggaacctttctgactgcctaaggagggaaataatgcccaccctgcctaccttacaaggctgctttgaggatcatgagtgaccctttagtgcctgtcaaattacctgtatcagcttaatcgaactgttagataatgcctagaaagataccctgatgggctacactgtaaaagagtattttctgtgccaagtgcatcttgcatgtatgctacgtctttgtatgcctgcacaaaaaaaaattttttttgggggggggcagagttttgctcttgttgcccaggctggagtgcaatggtgcgatctcggctcaccgcaacctccgcctcccaggttcaagcaattctcctgcctcagcctccctagtagctgggattacaggcatgtgccaccacgcctggctaattttgtatttttagtagagacggggtttccatgttggtcaggctggtctcaaactcccgacctcaggtatctgcccaccttggcctcccaaagtgctgggattacaggcatgagccactgcacccggcctacctgcacaaaattacataaaacaggggaagtgttcttttggaattttctgggtttttttaagttttgctaaacctgagccaatactctgtgtcgctcctggtgtacaagtgcaacttcaggaatcagcaccgagtgatgcatgtctcacagcagctccctgagcctccttgagcctgcattttatgcttttccatatccctgacctagcactgtaatttctcacaagtgctctgcagggcatcagtcacctaagatgctactcctagcaatactggagtagtatccaaagtcctggccaggcatggtggctcatgcctctaatcccagcactttgggagtctgaggcaggcaaatcacttgaggtcaggagttcgagaccagcctgaccaggatggtgaaaccccatctctactaaaaataggaaaattaggcaggcatggtggtgcatgtctgtagtcccagctacttaggaggctgaggtaggagaatcacttgcacctgggaggcggaggttgcaatgagccgagatcatgccactgcattcccacctaggcaacagagcatgaccctgtctcaaaaaaaaaaaaaaaaaaaaaaaaaaaaaaaagtcctggctgggcgcagtggctcacgcctgtaatcccagcactttgggatgccgaggcaggagcatcaggaggtcaggagttcgagaccatcctggctaacacggtgaaaccccatctgtactaaaaatacagaggaaaaattagccgggcgtggtggcaggcgcctgtagtcccagctactcggaaggctggggcaggagaatggcgtgaacccgggaggcggagcttgcggtgagccgagatcacgccactgcactccagcctgggcgacagagccagactccgtctccaaaaaaaaaaaagtcctccaggccctgcatggtctggtctcccctgcatctccgacctgccccctccctgggtctccctcttccttgctgatgctattctagccacactggcctccttggtgttcctctcacagaccaagcacatctctgccttgggacttttgtgtttgccattcctgtctgtgtattcttttccacctatcccatgctccctcacttccttcaggtctcagcccaagtacctctttttcagataggcttttcttgaccgccccctacgtaaaacagcaggtcccccaccaaccgttgtaaaaagattttttctctgaatatcctagtttttgcataaacaaatttttttgcactgagcaatgctccaccctaccattgcccccgctttaaaaaaaataagattgtagcagatcacaaaatccttacagaaaagttggtccacccccaaccaagaaaatggggaattaaatagggaaaaaaatacatttttggtcccatgttggattcatctggaaccagaaatcaggaaagcctttcagaaagaagctaagtaaaatctcatcttcatgagctaaggattcatgccactttcatgtgtctttacaaaaactagattttcaccagtcacggaggtgcaatattcctaagtgagccaaaactcaaattcagctccatgtgtggtcctgcctaaacttgaacccaggagcaccctgttgttgttattgaccataaatataagtctcacgtccatctcattggaatcatgtgtcttacaagagtgagggaaggatacagaaaggaaggaatgagggggttttattgagaatattttttgtaaaattctttcactgttttttcctgaattttttttttttttttttttgagatggaatttcactcttgtcgcccaggctggagtgcagtggcgcgatctcgactcactgcaacctccacctcccaggttcaagcgattctcctgcctcagcctcctaagtagctgggattacagggacctgccaccacgcccagctaatttttcgtgttttcactagagacggggtttcgccatgttggtcaggctgattttgaactcctgacctcaggtgatccgcccgcctcggcctcccaaagtgctgggattataggagtgagccactgcacctagccaaaattgtttaagtattcattaatttaaaacagtaatctattatatgttaaataatgtttttatgaatattattatattttccaaaacaaaaataaattttgtgagaaaggtggcattcttttatatttctgcaaatccctaatgtctggcttaatggaagaaaaaagattctcacatctgtttctgtatctgtcttcttgatatatataacacatcatttcatttctagaaagctccatcgtacatccatgaaagggaatgagaataaaaaggcaaacaacatctttgtattattaggaaaatagtttgacctcatggacccccagaaatgatccctacagagtttttctcatattttaacttagtctcttcacctgttgcaaaaccaagtgaagcataaattaattagagacaaataggcacctggagtctgtgctggtctctgcctctcattaatcgtttcccttgaattcagtgatctcagttttctcatctataaaatgaattattaaatcaggttcattctaaattacaaagagatatagaaataagattttccaaggtgggaagattgcttgaggccaggagttcgagaccagccaaggcaacacagtgatacctcatctctacaaaaattaaaaaaaaaaaaaaattagccatgcttggtggtgcatgcctgtagtcccagctacttgtgaggctgaggctggaggatccctcaggcccaggagtctgaggttgcagtgagccatgatctagtcactgcaccccagcctaggcaatggagtgagacatggtctctaaagaaattgaaagaaaagaaagaaaagaaggaaaggaaggaaggaagggaagaagggaagggaagggaagggaggggaggggagaaagaaagagagaaagaaagagaaaaggaaggtttccaaagtatctaccgttgtttctccaaattttgctgtttaatcacctcctgtaccataaactttcacattctttaaacttaaattttatggcagtacatctagaaagtcctgcaccattaacttgtaattccagaatgtgttttcatgctggaaaattttattttttgttttgcgtgctcttctagatcagaaagggtacagctcattgccctcccttcagtattttcatttgcatctccatatgaaaaagcaaatggaggccgggcacagtggctcatgcctgtaatcccagcactttgggaggccgaggcgggcagatcacctgaggtcgggaattcgagaccagcctgaccaacatggagaaaccctatctctactaaaactacaaaattagctaggcgtggtggtgcatgcctgtaatcccagctactcaggaggctgaggcaggagaatggcttgaacccaggaggcagaggttgcggtgagccaagattgcgccattgcactccagcctgggcaacaagagcaaaactccgtctcaaaaaaaaaaaaaaaaggaagaaagaaaatggaaaagaaaagcacaagaaaggaaaaccaatcttgcctttgcattgtctcttttttccttttgacataatttgagtgctctgaatcacagccatctttatctgaagggcagttggaagcttctctagtgacttcctgtacagtgttgtcaccaaacgtggtcaggtttctcttgtaatgcttcttctcctttaagatagcatttctctattagtagttgtagcctaatcccctagtgcttttatttatacagtaatgtataataccatttacctttgtgtaaaaatacataagtttaaacccaaatgacgtatgcccaccagataacatatgaaatatccttttaaggatccatccacacattatgtgtgtgtgcattaggctagctctcctgctttttcctgtaactcaacatgaaattaaaaaggattggtgagttgaaaaggcagctaattgttccatcatccttagtgagacatttagttcagattttatgtatctagttattctgcatggctttttaaaggccattcaccttcacactgtagagtcccaagctatttgactcattttcaaatattcaaatcaagggaagtgttttctaagatgatttttatccagtgaccaaagatgtgtttttcattgaattttgagttgatgacacagattagggtatttaaaagaatacacagagatgagcaggctgtattgatttaaaatgggcaatcacgcagtcttcataatagagcaagattctactttgtaaatagtcccagatattctaaggcaccggatgctgtcacagtggctgttatttccgtttctaaggcggcttctttgcctgatgtagaatgcaatttggttttcgtggaaagaggaacaaccaacaaaaagccatttctgctgaaaagtgtattgggagagaatatccttttatgactagctgggaatggctgggtaagtgggagataatgggattgcttttttaataatatagaagtttgaaagatggctgccagaaaacagtgacttccttgcttctactattcatacccaaggttatgcccttacactttccatattaacatcctctcaataatatgtactttcatccagttttgcttctctgcaaaatggctgtttgaaatacaaaaatagctgtgagcaaaggagaagaaacagttaagctgttttttagccacgccagtattggagattagcgctctgatgggcagctgttggacggcttgattatttaatgtgttttcagggtagttaataatactctttgatcatgggaagaagggtggcagagaagtgaaaatgattgaattaacagcttatcatactattatgtatggaaaaagcgtgagaaagagaagaaaaacactttaaattaggtcacaggggtcttagaaaattcagtggaacttttttggcaaaagaaactgcatttctggatttgaatccctcagcgttgaggttaatgacttatattgggtctctttaatcattccttgttggagccagtatccgctgcttcaaggggtgtttatttgaaacagtggcatttcttattccttctcaggagagaactcgatcccctaccaaccaaagatgctgctcgggtttttggtagattttagtgagagcagagtaggaaggagaaaagacaaacactgcgtttggtgtagaaggcatttgaccagaagcccctttccttctgccaggtgatcacattgttgagaagtgaagagattttggaaaggataaattagggcccttgtttgtttccagaaatgcttggcccctaagttattgacaaataatatttctaagacatgtggaagagctgagaaaatggacctcccattgcccgagtctcacagcatctacaagttattcccattcttgaaataaaagtgacgcaagcttcaaattaatgaggcaacctgtcagtctagattaggaggtcacccataggatttttttaaaaaacaaacagcattaaactgctgtttaaggattagcgtagggaattccagctggagttataaaggcacactggctttccagttcaattaggctcagagttagcaattgaatgacagtttgcagggctgcagtagctttttttctttttttttttctgttaggtcctagctttacagtgaatcttggcttgcaggctagcttgatttctactttctttttttctttttttcttttttcttttcttttttttttttgtttttcagacaggatatctctgttgcccaggcagaagtgcagtggtgcaatcttggctcactgcaacctccaccttccagattctagtgactctcctgcctcagcctcccaagtagctgggactacagactcacaccaccatgcctagctgaatagagatgaggtttccccatgttggccaggctggcctcgaattcgacctcaagcgatccgcccacctcggcctcccaaattgggattacaggcatgagccactgcacccggctgatttccactttcttaaaagctagttctgctccagtttgcctgggtcttttattattatacatccaggcgcgggttgcccctcatttttcattcttttcctcctaagactggcctctcttcccttcccttatccctctagactcttcctattgcttctctttgtggtttctatttttgtcttccttgtcagagaaagccagtgtttgccattttctggaaactttccaactcttgggaatagtgtttgaggaagaacagcctgtaatggtgtgaacttggggtctgcgaggccctgagcctgcagaaaacaaacagcagacttagaaagaaccagattagaacaaacaagaacttttaggaaaacaagtttagatcacacccatggacctagtaaacaggactgttctcattcgtgccatttccccttctgggctctgagggggaatgggaaaatgcttaaggactattcggtttataaaaaataaagccccccaagtgtgatgaatggcacgagtaggagtaggcagctgagggcctggcttcccgtggtctgcttctgcctctgctggtttccaaggcctgctatcacaaatgaccacagacagaaatggattgtctcacagttctagaggccggatgtctgaaatcaaggtgtcagtagtgccacacttcctctgaaggctccaggggaggatccttccctccctcttttagcctctggtggctccacatgtcccttggtcctttgatctgcgtcactgctgccatgttcatatggccttcttccctgtgatgttctgtgcctctgtgtggcctctcttcttataaggatgtcactcatttgatttagggttcaccctaatccagtatgacctcatcttaactaattacatctgcaaagaccctatttccaaataaggttacggtctgaggctccaagtggataagaatattggggggacacaattcagcccacccctctaccttaccgagggacctgtgaattaactgctccttaccacacatagcctcgttttcttgttcacttcccttctccctggttgtcactgtgacgttagatagatgtttccaaattagtttgtattcctcacaaagaggtatcaggtaaatgactatatgaacagagtcagtcacctgttggggacataatttgtgttcgaagtaaaatccctgggggtggactgaggcattggtattttttaaacctctacacacaccagagctgagatcccctgagcttattaacagggtccttcagctctgagcatcctggaattcttgtatgctaatgtaagggggaaccgtgtgactcccctggcaagatagctgtcccattacacgtgcctctaatgtagaagcaaagcctaggaagctcctacaccctcaagtttatgatctgggcttgccaatgagttcctgctttcagcaagccctctactgccacctactgataatcaaggcggggaaggagtgatggagcccctagagttgaaacgtaatgaagagcaagtgtgtgtctcaatggagttcccactccatgtacttgattgtagcctttcagtgttgtacgtgcaaggtcagcaggcggcgggggtatgtccttcagaggtcaaaggcagcttactctgacaggcccagctccaccacctttcaagttggactggaggctacaattacaatgtggcgcaaaaatgaaggtgttaccttccctcaggtccaagtgtgcccccctcatccatcaaggccagttctgcttgagcctttttgaaaggctcccttggcagattgggattcaacacagaaaatgcttctttctactgtttaggcagcaattttaacaaagtatcaacaaatctggggtggagaaagccattcttcaccttcggtcttccacaggtcctcgcctacagccatggaactcccaggtgattgtggcttttgaagtaactttagtagagaacagaattaaatataataagataaaaatatgtggggtttttttaaagacttcctaaatcccagtggttgctattttattagttttctagggctgctgtaacaaagtaccccagatttggtgtcttgaacagaaatttcttttcttgtcattctggaggccagaagttcaagatcaaggtgttggcagggtggattccttctgagggctgtgaggcaaggatctgttctagcctttcgctggtttgtaggtggccttcatctccctatgtcttcacatcacatcttccccctgtacgtgtctgtatccaaaattcccctttgcataaggacatcagccatattgaattagggcccaacctgtggcctcgttttaatctgattacctctataaagaccctgcctccaaataaggtcacattctgtggtgacaacagttaggacttttaacatagaaattttaggggaacacagtttagcccgtaacagctacttgggtgtttttgtaaaggaaaatgccgccgaggaaagtgctgagatggaaaaggcttgatgggagcacaactttttttttttttttctttttttgatggaatcttcctctgtcacccaggctggagtgcagtggcgcaatcctggctcactgcaacctccacctcccaggttaaagtgattctcgtgcctcagtctgctgagtagctgggaattataggcgcacgccaccacacccggctaatttttatttttattttttttttgtaatgacagggtttcagcatgtgggccaggctggtctcgaactcctgacctcaggtgatccacctgcctcggcctccccaagtgccaggattacaggtgtgagccaccacacccagcctgggtgtgcagcttctaatttccaccctctgggtcttggcagagggcctctggtgcattccttcctgtgggtgagagagaagccagtggcgttgtcctcaggcagtgctccttttcaaatgaaaccagtaccatattcctccccccacatttttcaaatgtggctgaagcaggggtcagagtggattgtgttgcagcaacagatctatgtgatgtgttagatgataaggtgtatcagtccattttcacactgctataaacaactacccaagactgggtaattaataaaggaaagcggtttaattaactcatagttccacatgactggggaggcctcaggaaacttacaatcatggcagaaggtgaaggggaagccaggcacatcttacttagtggcaggagagagacagaagtggcaatcaccagacattttcaaacaaccagatctcatgagaactctgacatgacaacagcaagggggaagtctgcccccatgaatcaatcgcctcccaccagaccactcccccaacacatggggattacaatttgacatgagatttgggtagggacacagagccaaaccatatcatgaggtaaccacccagatttacaattagcaggagtcactcaagtgctgaaaagtccactgcagaactgtccaccagtataaatcactgatgctctcaggcttctcttgggtccttaggaaacaaattaatcagtcagggagctgtgttaaaatgttaccacattaacagttttgaaatgagaggccaaatcttaaatccatcccaggagacggcacagacgagtgtcagctgcgtcttgggtctgctctcaccttatggctcatctacctgctgcttagtgtgggatgctttaatgaggcatctggaggccggcaggaggcctggcactccatgtgctgccaacaccccagaattcaaccaacagtctaccagatctggaacaaaatagctgtcttcatcccaattgtacacatccttcaaggatggcgaaagtcctgccttctgcctcaaggcttctcggttgaagccttgtagtccctggtccttggaagagagtaacgtcacctctaatgctgcgtccaaatatattttttaagtacaaaggtaggaaatttggatctgagcgtgcctaagtttcctttcggcaatgcagttccatagcactgtgattttcttctgttcacactgctatgtcctgattctgcagcactagcacgtgtatttgtttccatgcctaacaaaatggtgagcttttgggtccctgctactactggaatccaatacaacgagaaatcccccactgcactacatccccaaatgattgtgccttgtgaagtaattcccaatagaggatagatatgaatataataaaatatagagctttatttaaaaaaaagagagagagagagactctggacttcccagaacccaaaggtgataccttgtgtttaaaacttagggatctcaaccaggcatggtggctcatgcctgtaatcccagcactttaggaggccgagaggggcccatcacttaagtccaggagttcaagaccagcctgggcaacatggtgaaaccccatctctactaaaaatgcaaaaattagctgggcatggaggcgcatacctgtaatcccagctacttaggaggctaaggcacgagaatcacttgaacgcaggaggcggaggttgcagtgagccaagatcatgctgttgctctccagcctgggtgacaaagggaagctctgtctcaaaaaataataataaaataaaattcagggatctctgggaaagaaatcgggtgaacccagagatgaaggggaccccggagccaaggagatgatgttggggtgagatatcctgagccttaatatggatttgtggtgatgtgtgagttttgactaacgtgggcagagggaggcgggatgagttgatgtgatctcatggcaacgagaggaacatcagacaaaagaatcaggacaatagaaatagaaaggaaacagagcagacctggaaaaaaagagaattcagaattgatgacagaaacaggagctgtgtgtaggaaaatgaaacacgggactaagcctacgatggccgagagaaaagctgatgctttcgtcaaagatatttgggacaaagaatttcaacttgaaaccaaagtgaggatttcctggacaccagagaaagctcttgctttaataaggcctcaggactgaaacctgaggtaattatagttaaaaaaaaaaaagggggggggatatcaccccaagggttgactgctcagggatcatggagacctcacaggacttgtcagtgctgttcatcttggccaacctaactgtggtgaagttccgcctctctcagcactgccctaaaactccctcacaccacatcccagatgttcagaaattctcgatatgtttgtaagccagtcggttgatgggggcaagggtgtcaagggaaggcttgagaaaggcaagcaggagtggaaggaatgagtctaggaaaaaagtttcttggaaaagaaactcctcaccttctcatgcccttcctgtggctctgaaaagtaaaccgaggccatctgagttgggaagccctcctgggagtgtttcctgcctgggctcccctccaggggatccgacttcacagtacagtcagccccctagaaagggcttctgggttaattagtggacagattgcttttgatttgctgttttcccttattgctctgtattagtgtttaattatttaattttaaataactttttaaaataaatgttgaaaattatttaattgtaatattgaaaagctttgtaatctctgaccccttgtgtacatactattgtgtagtttcaatcatagaatcaagcattttattttaggtagaaataaaaatacacctttctctttcttataccccaacatatgtgtgggatgaataacactgggatttaggctgaaatactctacttttactttttatggcaactattaacgacactttttactgtcaggtatcagaattttaaatagttcatgaattctcagagtatctcagtgcataggcaaaaatgctgcacctttgtgggcgtgtgtgtgtgtgtttttgtgtgtgtgtgtgtgtgtgtgtgtgtgtgtgtacagaggttcacctggggacagagctgaaatgtcactccagggtctgtagtctctgagctcctctgccaaagcaccagcactgagagggaggaacttcaccacagttaggttggccaagatgaacaacactgacaagtcccgtgaggtctctgatccctgagcggtcaaaccttatttcagtctctacacccattcggtcaggatgggtctgaatcttggttgaccttgaggagaagctgctaatcttttgggcaataatgccctgaagagtccatctgcgtgctggggagcagaagggacttctgcgtgtaccacactttgaagaatgagctcaagctatgagttagtttccttccagggtagagaactgatgtttgtgtctctgcagtgatggctaatataggactcctgagttatgaatttgaaggaaggaaaattatggcaccttttatgctaaggaaggaataataaaatggtttctgcatacttctcactgtggccatgtttacaagcaagaagacgctgtgctttcagatcccacagatacctctccatctcattttaacagggttataaattaatgcaaaacagacacgttcatgtatccagatcatgtcatccaagaattacattacaacatgggtggagagttggcagtgctcacccaattttgacattcttgagccctgagggtgagagtgagtgtttataggagcttatagaaacttctatgacatccttagtttaaaaaaaaaaaactaaactaaacttcctgtgtgcatgcaaaggacattttatgaccaaagctggaaatcattctttatttttaatactgaggagagtatcttttattattataagaccctgtgtgtttttttattaaactataaatttaaccaattttatgagagacatcaaggtattaaattcttttcagatcgttcccgttgcataagtcaccaactgtttacagtattctgagttattcagtggtataaatttacagcaatttattttattttattttatttttgatatggagttttgctcttgttgcccaggctggagttcaatggtgcgatctcagctcaccacaacctccgcctcccaggttcaagcaatactcctccaagtagctgggattacaggcatgcgccaccacacgcggctaattttgtatttttagtagagacggggtttctccatgttggtcaggctggtctcgaactcctcccgacctcaggtgatccgcctgcctcggcctcccaaagtgctgggattacaggcatgagccaccacacccggactttacagacaatttttaatgggatcttgtggttgaaacagaacttcatagtcatctggcccaagctacccacaagtgcccaagtcctctctactgtgccttctgggtgctgggtcaggataaacagtttctgcctcagctctcctggggctgatccctaagtgacagcaactgctccttctttagtgaccactcatttctttctttttttttttctttagagacagggtctctctccgtcacccaggctggaatgcagcagtgtgatcatagctcactatagcctcaaactcctgggcttaagcaatcctcccaccttagcctcctgagtagctgggaccacaggcacatgccaccacacccagctaattattttattttattttttatttttgtagagacagggtctcactatgtggccaaggctgttcttgaactcctgggctcagccccacaaagtgctgggattatagacgtgacccatcatacccagcccactcattttttttactccggttaaaaagcacttctagcttgagaaaaaactggcttccatgcagttgtcctgggttctggcttctgggatcattctcaaccactgagtctcagcagatggcatgctgggcccttgtatctagggagggcttgcgtcatgtacacatgacatgtgctgggggaggacataaatttcaggatccttaatgaagaaagagtggagggggtgcagctttacaactctacgcccttcacacattctgagattccactcacctcccgaccccaggatcacagcatctgtgccactattgctggtgacagtgtcacatctttcagcaataccgggactaaactaatacctaagcctttcttccctgaggctagtcttcagagactcaaagacaactattatgccctgtctctacctctcctattttctagaccaaaaagcccaggcctttagccattcccctggggtcctggctccagggcccttcactggtggatctcctcaggcatcactcaggttactcactgtccctctcagagtctggcactggaaatgagacacagaactccagtgtgatctatagaacgaggaaagcaaaactatcacctctttttgtttttattctgctttgttttttaagaacgcaggacttctaaatctaatcagtaggacctcatcattttatgtgggttgttttgtatgtcactggttttgtgagagacctgcaccatacatcaaagttatcagactgaggctgaatgaaatccaccagtccaccttaaagacagctatcctgggaatgtgggcaacgtcccacttgcccactgctatagcttatagcaccttacactcacctcttcctacagattatttttgagtaacagcgtgaccatgttgtgcatttagccaagcaaacctttctagcttaggtgaatgagagggagcggccaacgtataaaacaaaatagtaagttcataaaaattacagtgcacaatagtctcagataaaatattaattgttaaacagaattccctgtatgtgacatgttctctttcctaataattttcagttatttcaaactttttactcaagttttttcaagcctccaattaaaggtgctgagctgcaccagtctctgtgacccccagctccaaccttcttcactacaattttgggggtactagcacatgccaggtacagtactcaattataaatatatgatttgtgtatatcgtgtgtgtgtaaaacacttcattttccccatggaaaaatttatccctcaccaccaccctataaagtagagtttgttacctccactttatagatgaaacaacaaggttccaagaagatgttgcataatattctacagatgaaataattaggaaatcaggccgggtgaggtggctcacgcctgtaatcccagcactttgggaggccaaggtgggcggatcactaggtcaggagttcaagaccatcctggctaacacagtgaaaccccatctctactaaaaatacaaaaaattagccaggcgtgatggcaggcagctgtagtcccagctactcgggaggctgaggcaggagaatctcatgtacgtgggaggcagaggttgcggtgagctgagatcttgccactgcactccagcctgggcaacagagtgagactccatctaaaaaaaaaaaaaataggaaatcagatgatttgacccaatgtgtctgtctctaaaggctgaatataatattgctttccccacatatatcatagtgctgctgtcacaggttgagttagctggctctgattttaaatagctaccatttaaatagctaccatttgctgaacatattgttaccacccagccacagtgatattgtttggaaaaaaacatttacaagttcaaggccatgttcaagttgttctttttggcttcagatctaatataccacagcacatcccctcatccctgtgcacttggagggcaggagggtgtcttagtcagtgttgcttccttccaagtcccgagcacagtgctgtgatgtagtcaggactcaatcttgataaacattggtgtaattaacaggtttcaggtccaccaaagaagtatatgctatgctgatcattgcagaagaatcccaaacataatgcaccccattttccagacacaagtgattgggagaaataacgaacttatgttgcgactcatggggagaggttacaaattgatgccaaaatctagtctcacacctgcttttttgctccccccagtaagtgaaaatggtgatcacctaagcacatggatgagacgtgagcacagttatggcagagaagtttctccgcaccagaattatccacagcaacttggctgagccccactacacacagagaaatcatcaacctgacttaagagttttcaagatgtcaacttcaggctgatcagcagatgggatgtgaaaaatactaccctattctatcatttgctgttgcttgctgaactgtgaagaactgcatgaactatatttaagctgctttctgtaccattgccaatcacctttttggagttggaagtgctattttcctatggacttttgcattatttcattgtgcatgcatccagtgattatacataagcaacatatgtaatctgcttatatatttttaaaaatccatccacacacatggtaaattaagtataaattcttttgcaaaattatagttcatgtcattgaaagtttaaattggtttcatttaaagatcaatatactaggtctgccttcactttatagaaaactagcttctataaagattttttcactgtttactagtgaaatgagaaaagcaaagctatttataaaaggccttatgtcgtgtacatacattgtctttgaaatatttgtgatctagtttattgcttgtaaaagagaaattatataatttatttagtaaatactactgtaaactatagttttgtgagagaaataaaatattttgttctca

SEQ ID NO: 422 - DNA, 1591 bp, Homo sapiens
ttgttttaattttttattctagcaaacagcccactgaacatggcactaaacctctctccttcccaggcaggattacgccaaagggtaggtgtgcttttcattcatcctctcttagtaagtggtgcctgttcagggctggagttaagtttgagcccctctttccacaccgtgtcccttgatacaacagcaagacctggcctgaatagagctgagaaactcgtttaaaacaggcagaagggggctggggcaagggggaccctgtgggaggagaaagagagaagcacagagggaccaggaaggcatgggggggggtgagggagcagctggtgtttctgttcctccaaatatctgggcttcctgctcccccaaccctggagggtggggtgaggatgaaattagatacaaggaactctggggccctctggctgttcaatccaaccctcccatcccccaaaccaccaaaaacaaaaaggaaagaaaacccacaggggcacaagcacacccctaaaactcagaaaactccttggcacacttctcattgatggagatccggagctcttcctcctcgtagtcgtcaaagttactggcatccccagggcctgtgtacttcgggatgaagggagcttccaccttcttctcatagatggcgatccagctggttgtggcgaaccacttgtggttcttgatgtcgccaaccccgttcctgaggtttccgaagcgcttggtgaggtccacctgcagcaggctccgcagcagatgcttgaggtcagagctgagtttggagggaaaccgcaccctcccagagacgatcttctcgtagatctggatgggctggtcggcgtagaagggtgggaagcccacggccatctcatagatgagcacccctagggcccaccagtccacggccttgttgtagcctttgctcaggatgatctcgggggccaggtactctggggtcccgcacaaggtccaagtgcggcccttcacgcgcttggcgaaaccgaagtccgtcacctgcaggtagccctgctggtcgatgaggagattctcgggcttcaggtcgcggtggatgaggtcgagcgagtgtaggtactggacggccaggacgacctgggcggcatagaaacaggcatggggctcgctaaaccttccgacgcgctgtaggcgggagaacatctccccacccggcacgtactccatcaccaggtacaggtaggagttgtccttaaaggagaactggagcttgacgaggaacggaaagtcgatcgcctgcaggatgcgcttctcgttcagtatgtgctcgacctgcttcatcttcaccaccttctgcttgttgaggatcttcatggcgtagtggccgccggtctcctggtgcctcaccagcatcacccgcccgaaggagcccatgcccagcgtcctgagccgttcgaactgatccgagctggcggtgttttgagcggggtttccccatctgtagaggaaatctcctctggctttggctaggaactcgttcacgctctcctcctgctcggtgtccttcttggcgggggcgttgcccatggcggtggcggcggcaggggcgggggtctcg

SEQ ID NO: 423 - DNA, 43515 bp, Homo sapiens
agtctcccttgggtcaggggtcctggttgcactccgtgctttgcacaaagcaggctctccatttttgttaaatgcacgaatagtgctaagctgggaagttcttcctgaggtctaacctctagctgctcccccacagaagagtgcctgcggccagtggccaccaggggtcgccgcagcacccagcgctggagggcggagcgggcggcagacccggagcagcatgtggactctcgggcgccgcgcagtagccggcctcctggcgtcacccagcccagcccaggcccagaccctcacccgggtcccgcggccggcagagttggccccactctgcggccgccgtggcctgcgcaccgacatcgatgcgacctgcacgccccgccgcgcagtaagtatccgcgccgggaacagccgcgggccgcacgccgcgggccgcacgccgcacgcctgcgcagggaggcgccgcgcacgccggggtcgctccgggtacgcgcgctggactagctcaccccgctccttctcagggcggcccggcggaagcggccttgcaactcccttctctggttctcccggttgcatttacactggcttctgctttccgaaggaaaaggggacattttgtcctgcggtgcgactgcgggtcaaggcacgggcgaaggcagggcaggctggtggaggggaccggttccgaggggtgtgcggctgtctccatgcttgtcacttctctgcgataacttgtttcagtaatattaatagatggtatctgctagtatatacatacacataatgtgtgtgtctgtgtgtatctgtatatagcgtgtgtgttgtgtgtgtgtgtttgcgcgcacgggcgcgcgcacacctaatattttcaaggctggatttttttgaacgaaatgctttcctggaacgaggtgaaactttcagagctgcagaatagctagagcagcaggggccctggcttttggaaactgacccgacctttattccagattctgccccactccgcagagctgtgtgaccttgggggattcccctaacctctctgagacgtggctttgttttctgtagggagaagataaaggtgacgcccattttgcggacctggtgtgaggattaaatgggaataacatagataaagtcttcagaacttcaaattagttcccctttcttcctttggggggtacaaagaaatatctgacccagttacgccacggcttgaaaggaggaaacccaaagaatggctgtggggatgaggaagattcctcaaggggaggacatggtatttaatgagggtcttgaagatgccaaggaagtggtagagggtgtttcacgaggagggaaccgtctgggcaaaggccaggaaggcggaaggggatcccttcagagtggctggtacgccgcatgtattaggggagatgaaagaggcaggccacgtccaagccatatttgtgttgctctccggagtttgtactttaggcttgaacttcccacacgtgttatttggcccacattgtgtttgaagaaactttgggattggttgccagtgcttaaaagttaggacttagaaaatggatttcctggcaggacgcggtggctcatgcccataatctcagcactttgggaggcctaggaaggtggatcacctgaggtccggagttcaagactaacctggccaacatggtgaaacccagtatctactaaaaaatacaaaaaaaaaaaaaaaagaagaagaagaagaagaaaataaagaaaagttagccgggcgtggtgtcgcgcgcctgtaatcccagctactccagaggctgcggcaggagaatcgcttgagcccgggaggcagaggttgcattaagccaagatcgcccaatgcactccggcctgggcgacagagcaagactccgtctcaaaaaataataataataaataaaaataaaaaataaaatggatttcccagcatctctggaaaaataggcaagtgtggccatgatggtccttagatctcctctaggaaagcagacatttattacttggcttctgtgcactatctgagctgccacgtattgggcttccacccctgcctgtgtggacagcatgggttgtcagcagagttgtgttttgttttgtttttttgagacagagtttccctcttgttgcccaggctggagtgcagtggctcagtctcagctcactgcaacctctgcctcctgggttcaagtgattctcctgcctcagcctcccgagtagctgggattatcggctaattttgtatttttagtagagacagatttctccatgttggtcaggctggtctcgaactcccaacctcaggtgatccgcccacctcgccctcccaaagtgctggaattacaggcgtgagccaccgcgtctggccatcagcagagtttttaatttaggagaatgacaagaggtggtacagttttttagatggtacctggtggctgttaagggctattgactgacaaacacacccaacttggcgctgccgcccaggaggtggacactgggtttctggatagatggttagcaacctctgtcaccagctgggcctctttttttctatactgaattaatcacatttgtttaacctgtctgttccatagttcccttgcacatcttgggtatttgaggagttgggtgggtggcagtggcaactggggccaccatcctgtttaattattttaaagccctgactgtcctggattgaccctaagctccccctggtctccaaaattcatcagaaactgagttcacttgaaggcctcttccccacccttttctccaccccttgcatctacttctaaagcagctgttcaacagaaacagaatgggagccacacacataattctacattttctagttaaaaagaaaaaaaaatcattttcaacaatatatttattcaacctagtacatacaaaatattatcattccaacatgtaatcagtattttaaaaatcagtaatgagaccaggcacggtggctcacgactgtaatcccaggactttgggaggccgaggcgagtggatcatctgagatcaggagttcaagaccagcctggccaacatggtgaaaccccatctctactaaaaactagctcagcatggtggtgggtgcctgtagtcccagctactcgggaggctgaggcatgagaatcacttgagcccaggaggcagaggttgcagtgagccaagattttgggggattctgtgacatacaaaaaaaatcagtaataagatatcttgcatactcttttcgtactcatatacttccagcatatctcaattcacaatttctaagtaaatgctctatctgtatttacttttataaaattcacaattaaaaatgaaggttcacatagtcaagttgttccaaacacacttaaatgtctcctaggctgggtgtggttgctcacacctgtaatcccagcactttgggaggctgagatgggcggatcacctgaggtcaggagtttgagaccagcctggccaacatggtgaaaccccgtctctactaaaaatacaaaaattagctggatgtggtggcactcacctgtaatcccagctactcaggaggctgaggcaggataattgcttgaacccgggaggtggtggaggttgcagtgagccgagatcgcaccactgccttccaacctgggcgacagagcgagactccgtctcaaaaaaaaaaaaaaggctcctaataactttattactttattatcacctcaaataattaaaattaaatgaagttgaaaatccaggtcctcagtcccattagccacatttctagtgctcagtagccacgggggctggtgaccaccacatgggacagcatatttagtacctgatcattggttctcagatctggctactcagcagaaccaagaatccacagaaacggcttttaaaagcacagccccacagcccccagccccagccttacctacctggaggctgggaaggactctgattccacgaggcagcctatgttttttgatggagggatgtgacaggggctgcatctttaacgtttcctcttaaatactggagacagcttcgaggaggagataactggatgtgtcttagtccatttgatggagggatgtgacggggctgcgtctttaacgtttcctcttaaataccggagacagcttcgagaaggagataactggatgtttcttagtccattttctgttgcttgtgacagaatacctgaaactgggcaatttatatggtaaaaaattttcttcttactgctctggaggctgagaagtccaaagtcaagtcccttcttgctggtggggactttgcagagtattgaggcggcaccgggcgtcatatggtaaggggctgagtgtgctacctcaggtgtctttttcttttcttataaagcctaactagtttcactcccatgataacccattaatctatgaatggattaatccattattgagggaagaaccttcatgacccagtcaccgcttaaaggccccacctctcaatactgccacatcgggaattaagtttcaacatgagtttcggaggtgacaaacattcaaaccatagcatgctgtctcttaaatgactcaataagctcctgtggcatccacttctgcatgccttgggcagcttttagacatctgtccattttcctagagggacaagaccaccacctgtgatcctatgaccttttggctttaggcctaacaagcaggttataccctcactcactttcaaatcatttttattgtcttgcagacaatttacacaagtttacacatagaaaaggatatgtaaatatttatacgctgccgggcgcggtggctcacgcctgtaatcccagcactttgggaggccgaggcaggtggatcacgagttcaggagatggagaccatcctggctaatacgatgaaaccccatctctactaaaaatacaaaaaattagccgggcgtggtgacgggtgcctgtagtccccactactcgggacgctgaggcaggagaatggcgtgaacccgggaggcagagcttgcagtgatccgagatcgtgccactgcactccagcctgggtgacagagcgagactgcatctcaaagaaaaaaataaataaataaataaatatttatactgcttataaactaataataaatgctatggtctgcatgtttgtgtcaccccaccattcatatgttaaaacctaatcaccaaagtgatattaggaggtggggcccttgggaggtgatgaggtatgagggtggagcccatatgattgggattagtgcccttctaaaatagcccaacggagcccagtgacaaggcatcatctatgaaccaggaaactggccctcaccagacaccaaagctgttggtgcattgatcttggatttcccaccctccaggactctaagaaacacatttctattgtttataagccacccagtggctggtattttgttataacatcccagactaagacaaataacaaatacttgtatccctgacaccaggttaagagatagaatttgtttgttcctctggaggcccttgtcttcaccccatcactgccctgtcctccctggaggaatctgccagcccgaattctgttcatcgtaccctccttttcttagagtttgacctcctctgtatctcccccaatccatgtattgcttatatacaaggtattctgctgtatctgttctgctatggcttgccccttttgttcaacactgtttttgtgcgtcatctgcattgatgcatgcagttgtcctttatttgttctcactgctggatagtatctggttgggtaaatatatcacactgtaaatcacactatccaggttcctttaggtgacatttggttgattgcagtgttctgttgttacgatggtgctgctgtgactgttcttgtgcatggacagaagttcctttcaggtgaatttctcagaatggaattgctgggcaaaggggcagccaataatcaactcatttgatgccaaaagtggtggtgccagttcatcctcccctgcgaggtatgggtcctgattcactcttcaagtgctgtggtttgacagggccgggggtgacaaggggacacctgggaaggaaagctgggctccctgctggccatccaggccagtccttaccagggggtaggcaatgattgggtcaagtggttcctgaccactgggcctgagacttcaggcccagaaactatctaatatttcctcaaatgcatcccatgagcaggcactgtgtgagtgagcacacacatctgaagcctcaagctaggcaagcctaccatgacttgtggtccaagggctcacgggtgacctggagttagagggagacatggctgccaggtggctttagaaagaacactcatcatggccaggtgcggtggcttacgcctgtaatcccagcactttgggaggccaaggtgggtggatcatgaggtcaggagtgagaccagcctgaccaacatgctgaaacctgtctctcctaaaaacacaaaaattagctgggcatggaggtgcacgcctgtaatcccagctactcaggaggctgaggcaggagaatcacttgaacccgggaggcggaggttgcaataagcctagattgtgccactgcattccagcctgggcaacagagcaagactccgtctcagaaaaaaaaaaaaaaaggaagaacactcatcctatgaccttgacctccaagctttgcctccctcaagcagaacagaatggagcctcccttaggcagaggcggaagtttgcctctcacctagttctccattcttttgttcagagcctgaataccctcaggctctgtacttggggtatttctgttctcttgttttatgctcacggttgtgaggtttgttgtgagtaccacgatcccttccttcagaggagtaaactgaggttccaaaaggtttagcagttgcccgaggaatattaaattggcaaaagcaggtagaatataaagcaaggagtatttggcaacggttcttttttatgattaaaaacagccgaagaaagacttctacttgtgcctttgaaggagtaactgcatttgaccttcccaccagtaacaaccatcaaatctctattaaattaaacacacacacacacaaacaaaaacagctattgtgaaggtatcagcgactaagacaactaaggtttgaggggccaggatcctggagagatggaaacttccctgaggtgagccccacattctcagacacttttccttggatgttttgagcactgctttaattcctgggaaaacaattccttccactgtgcacagactctggggccagacagcttgggttcaatcccagctctgccacttaatgtctgtgtatctgtgtaggcaagttaccctttggtgcgtcagtttcctcatctgtaaaacacaactatagttgatcctcattcgttaagagtctgtacttgttaatttgctcacttgctaaaatttgttaccccaaaatcagtacccctagccttttggggtcgtttcaaagatgtgtgcagagcggcaaaaaaatgtgagctcctccaggctcatgttcccagccaaggtccaacaaagtgctgccctgccttcttatttcagctgtcatagtgtaaactgtgtccttttcacagtctgattagtgccatgtttttcagatttttatgcttttttcttggttatttctctgttaaaattgtctccaagtgtagtgcaaagtttagcacgaggaggctgtgatgttccttacagagaaaatgcatgtgttagagaagctttgtcaggcatgagttaaggtgctgttgtcctgagatcaattaatttgttgttgttgttgtttgagacagggtctccctctgttgcccaggctgctggagtgcaatggtgtaatcatagctcactgcagcctctacctctctggctcaagcaatcctcccacctcggcctcctgagtagctgggactacaggtacaccccaccacacccagataatgtttttgatatttttttaggtggaattttgctcatcacccaggctggagtgcaatggtgcgatcctggctcactgcaacctccacctcccggattcaagcaattcttctgcctcagcctcctgagtagcacagattacaggcacatgtcatcacgccttgctaatttttgtgtttttagtagaggcggggtttcaccatgttggccaggctagtcttgaactcctgacctcaggtgatccacccgcctccgcctcccaaactgcagagattataggcacgaaccacaatgcccggcctcatgttttttatttttcaagttgaaatgaggtctctctatgttgcccaggttggtctcaaactcttgagctcaagtaatcctcccaccttggcctcccaaagtgcggggattacaggtgtgagctaccatgcccagccaagatcagtgttaatgaatcaactatatatattacataaggtgtctttaaacagaaataaggttatatattgatcgattggtaacaatgttgtgaccagcagcttacagggtacctagccttgtatttctcctataaataatttgctcgttgagtgtttgtggcaactttgtagcacataactaccaagaataaggactgtaataagagtacgtccctcacaggattgtaatgaagactgagtccatttacataaaggctgagagcagtgtcaagcagatggagaacactgtagaatgtgcgatagctctaacagtggttatcatggctgccctctcacttcttcagagacatgtgtttctaaggtctgcactctgccccaccctccccatccactgtcccccagcccgtttcctcctccacttacttcccagccctgtgccttctgccttctcttttctgagtttgctaagggcactgctggctcaagagcagtaactaacagtctctcgcctcttctctccatggcaaccagtgacctttggagaatgtaaaccttatcaccaatctcttaaagcccttcggtgccttcccaggatgacgtccagctgaggtccttggcaagacccagggcgccccctcctcgctccatcacctcccctgtcacctcccctgcatctccctactccagctgcaccactcttgtgccccagtggctcttgtctgattatttccttcatctccccagctggtcagcagagctggtggtaatcaactcagaccctgtcacctggatgtccagcagttagggactaaaaaaaatcaacaggtcacattctgtcctgcagatcatgataataagatctgtcagacagcagtcagcagtcagagccaaatcttctggacttcagcaggattctgcctcttgctatttcctgttgcctctcttagtgaccttttaagagcattgtggatgcctcccagcctcctgctaaccaccctgtaacctgaacagcctgcagcagccctgcccagtagaacttcctgatgtgatggaaatgctgtgtctgcaccactagccacatgtggccacaggattctcgaaactggtggtgcagttgaggagctgactttatattttatctcattaaatttaaatgtaaatagctacgtgtggcttgttggctagcctattggaaaacacgggcttagagagacacagggagaatcactgtaatgcactaaaagaaggtaaaaaaaaaaaaatcctaagaaatattcctaaaatactttaatatagggctgggtgcggtggctcacatccagcattttgggaagctgaggagggcagatcacttgaggccaggagttcaagaccagcctggccaacatggtgaaaccccgtctctactaaaaatacaaaaaatcgggtgcggtggcgggtgcctgtaatcccagctacgcgggaggctgaggcacgagaatcactcgaacccgggaggcgggggttgcagtgagccgagatcgtgccactgcactccagcctgggcgacagagcgagacttcatctcaaaaacaaaaaacaaaaaccaaaaaaaaaaacttcagcatgattatttaaccaaaatgcaggttagttgttcaccggatgcagagtccaattaacaagagcaaggcctggtaccaaaaaaagtgaatttactccgaaactagcttgggtgaggggtacaaagcatcctgcctttctttaaaagtgctgcttccccttggaagtagaaagtggacacttttataaggtaaggggggaagtgtgcaagggcaagtgggggggtccctctgctagttccgtgcatactctacaggacagttgacttggcaccttcctggttagtaataagctgtagcagtggccaagtgggcatgctttcagtatgccctcccagtgaatgaaagtcctgaggcaacccccaagggtggaagtgccaggccaccacccactggaggtgaaagttccgtgatgggtttgctttggtctgcgaatctactgtcatgtggagagatctgtgctctggaagagcatacagttagaaaagcttgccctgaagggaatgtatggtgaaggggaggtgaaaggttatatttgcatttctgaagggctaagtaggaaaccgggaaccaggggagaggagaagagaagagaggataattttttttaagaaaagcaacatattccctttttcttagaaaaaatggagcactcggttacaggcactcgaatgtagaagtagcaatatataaattatgcattaatgggttataattcactgaaaaatagtaacgtacttcttaactttggctttcagagttcgaaccaacgtggcctcaaccagatttggaatgtcaaaaagcagagtgtctatttgatgaatttgaggaaatctggaactttgggccacccagggtaagataaaacaccttccacgtcataggtatcttcctctctccttccctgcctctcccattagaacctggttttcttcctgagcagcaacaatcttaggcatctttccatgtgactgagtatccaccacattatttttaatgaaatagtattagattgcatggatgtgacataatccatttaacccatcccctactgttggacattcaggttgtttccagagtttcaatattattttatttaataccctaatagttagagcaggccatgctgctatcacaaatagacccaaatatttaatagctcaaaccaataacgtttgtgtcctcctctctgggcagtacagggttggcatacctcctgaagtgaattaggaactacactcattccagcttccagtttggtctttatctgtcagtgccttactgtcctctgcattgttgagtctcagtcaccttgtccaagttccattggccagaaagggctagaagcacagaagggctggaagtggcatttgttcctcactcacattctggtgggaagaacttagtggtgtggccttagctgactgtaagggaggctgggaaatatagtctagcgagtgccctggaaaaagccggcacggcattccccatggaaagctgtcaggcacggctacagtctaccccctgccaaccagtatctgcatggaccctccttccacactcagatgcatttacccccagccccaagagagccaaccgatgcccatgtggtcaccacagccacctccgagtccaagatttccaggtgacatgcagtctcctctctcccagctttaggaatggcttcttctgatctacacacagacacagacacacacacacagacacacacacacacacacacacacacacacgatggagaggggcaggataactgcaactgtaactccattcagaaaagaggcacagcactagctgcccgcagcactggagccctgctgggcagcactggatcaacctctgccctggcagaggagcatgttcctccacaaatccctgcttcagcctctcgagaggctcctccttgtctgttattttccttggccacaaggcaggcaggcagtgggaagtgtgccctcctccggggcaaggagccttcacagcccacttcctgctaataacagtttggggttccacagggtgttttaagactccagtcagctattttaggccagactcatttctctctctctctctctttttttttcttttatgaaatcacaccctgagacccaggctggagtgcagtggtgcgatctcggctcactgcagcctccgcctcccgggttcaagcaatcctcctgcctcagcctcctgagtagctgggactataggcgtgcagtgccacacctagctaatttttgtatttttagtaaagacggggtttcaccatgttggccaggctggtcttgaactcctgacctcagatgatccgcccgcctcggcctcccaaagtgctgggattactggcatgagccactgcgcccagcccagactcatttttctttgagagtaggcttttcccaaaagtaggcttctgagctattcactttcaggcagtcccatgtgccaggaaccacatccaaatttcctccgtggatgggagtctcaggctgccttatctccttgcatgtccccatgcccagctgtctcagcctaagggcaggtaccttgaagtcaagttaaacaataagattggagaccagcaatgccctcagcctggtttttgcagcaggactgagtcccttgttttggctcaatgggaagtctttgctgttcaaagccttagcttctctggctgagtgcggtggctcacgcctgtcatcctagctctttgggaggccgaggtgagcagatcactgaggccaggagttcaagaccagcctggccaacatggtgaaaccctgtctctactaaaaatacaaaaagttagccaggcgtggtggcaggcacctgtaatcccagctactcgggagcctgaggcaggagaatcgcttaaacccaggagatggaggctgcagtgagctgagatcatgccattgcactccagcctgggtaacgagcgaaattccatctctaaaaaaaagaaaaaaaaaaggccttagattctccctttgactttccacgtttgtgcagccttttatctccaatgctccatttcattccatctcctggcttattcttttcttgtcacatctactaaaagcaacaagaagccaccggtattcaggaacattctacctgtccccagagctatatgctcagtaggcatacagttggccctccaggttatctgagactcagatttccagagggctttgcatggctcacaaggtctgaagaacctctgagcctcccgcctgcggtgtctgttcattgactttgccacagtctcaaagaggcactgcatgctgcatgtttgaggtttttgctttggtggcatccatttccagcctcggcttccggcattcctcccccagcagactctctgctgctttccccttactccttctggcagttctgggaggttgcatagggcccttgcaggatgccccaagtccagctgcctctggcctctgggaagcacacccttgacctgccatgtgtaggaagacagcccgcttctgccagggcccaactctgccggcaggtagcaccttccaacctcttcactttggactttataactgtcaggtataaagtcggttgtgtccttacgtttctcaaattcttcaagacacgtcaaccagcctctcctacgcattctctccagctcagtctcaaaacacaccctttctctccagctcactctcaaaacacaccctatcaggccaaccactctttttaaaggacagctcctcaccaatccagtcaggtagccttccccacattgtatcctggaagtgggtgatggactgggtggggaagagggtcatatggcaaatctgtatgtcttacagtaattgtctagcagcccctggtgtcttactttaggccccctggaaactttcagatagtggagttgtctgatacatatcttataacctacagatattaatatatcctcacaggggcacaaaagctcttacaaggatgtttattataataatatttttattgttataatttacatgccataaaactaaccattttaaaatgtataatgcaagggtttttagtatattcacaagattgtgcagctgtcactactaattccagaacattttcattattccagaaggaaaccctattcatattagcaatcactcccccattccgcctttccctaaaacccagcaatcactaatctactttctgtctctgtggatttaaagtaattttaaatttgaaaaatagtatctataaggaaatgtatctagtcacaagcatacagcttgatgaatttgtaaaaattgaacagtcctatgaacataccctgtaagctcaagacatagaatgttaccagcccctgcaagcaagctgcctgctcacttctagtcattaacccctccctcttttccttctagtcattaacccttcagagtaactattctgattaccaatagcatagattagttctgcctgttgttttactttatataaactgtctcattaagtataaacatgtttgtgtatacttgtgtatttctttctatcacaatgatgtttgtgagattcatccatgctgttcctatagacaattctattttgcagcgtagtattccattgcatgactataccacaatttatctgtgatattacaaaggaatacttgggcagtttccagtttggggctataggatagttgtgatacaaatattttagtatagtacatgtcttttggtgaacctgggtacacatttctgttgtgtataccccttaagagtggagctgatgatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcttgcagtgagccgagatcgcgccactgcactccagcctgggcgacagagcgagactccgtctcaaaaaaaaaaaaaaaaaaagagtggagctgatgggtcatagcatgtaaatgcattcaactttagtagatactgtccaacagttttccaaagtgattgtccaacttacttgcctatcagcagtatctgaaaagtctagttgcttcttttcttggccaactctttttttttttttgagatggagttttgctcttgttgcccaggctggagcgcaatggcacgtcctctgctcactgcaacctccgcctcctgggttcaagcaattctcctgcctcagcctcccgagtagctgggattacaggcatgcgccactatgcccggctaattttgtatttttagtagagacagggtttctccatgttggtcaagctggtctcgaactcctaacctcaggtgatccgcccgcctcggcctcccgaagtgctgggattacaggcatgagccaccgcgccaggccggccaactcttttttattttattttattttactttaaagacagggtttcactttgtcacccaggatggaatgcaatggcacgatcacagctcactgcagccttgacctccctggctcgggtgatccctcccacctcaggctcctgaggagctagaactacaggcatgggccatgcccagctaattttttaatttttggtagagacggggtctctgttgtctcagattcctgggttcaagtgatccttctcccttggcctcccaaagttctggtattacaggcatgagccactgcacccagcccatggccagctcttgatacgatctgtctctttcttttctttttttttttttaatttgagaagtgttaaataatctttctttgatattatacataaaccacaccaaaatgtctttcagtaagtaaaatgaaccattttagatacagaaaattctaattagattggcatagttaaggccaaaaatataaagttgacattgctaccttatcttcagcccttgcctttaagaggcaaatgaacacaaaatacaggtgaatcttgcttggttctgagacagtgaaggactttcccccagtatttaaatatatttacataaccagttacataaatctaaatattaaaaaaatctccaatagattttagatggcattcaccatctttgtgaaaagttgaacattactaatgaaatctgatcatatctttagaaggataaacagtgatagcatttactgaatcagaataactgttttttggggttttctttgagacggagttttgctcttgttgcccaggctggagtgcagtggtgccacctcagctcactgcaacctccgccccctggattcaagagattatcctgcctcagcctcccgagtagctgggattacaggctcgccccaccatgcccagctaatttttgtatttttagtagaggcgaggtttcaccatgtcagccaggctggtcttgaactcctgacctcaggtgatccacccgcctcagcctcccaaaatgctaggattacaggcgtgagccaccaggcccagcctattttttttttttttctttttttgagacggagtctcactctgtcacccaggctggagtgcagtggcacaatgtcagctcattgcaacctccacctccggggtttcagtgattctcctgtctcagcctcccaagtagctgggaactacaggcgtgcaccacaagcccagctaatttttgtatttttagtagagacagggttttgccatattggcctggctagtttcaaactcctgacctcaggtgagccacctacctcggcctccgaaagtcctgggattacagacgtgagccactgcactgcctggcccagaaaggactattaattgtagttgcctctgggaatgggggctgcctgcttctttctgtaaccccttctgtgctgtttaaatttttttttttttttttttttttgagacagagtctcgctctgtcgcccaggctggagtgcagtggcgcaatctcggctcactgcaagctccgcctcccaggttcacgccattctcctgcctcagcctcctgagtagctgggactacaggcacccgtcaccacgcccggctaattttttgtattttcagtagagacggggtttcaccatgttagccaggatggtctcgatctcctgaccgtgttatctgcctgcctcggcctcccagagtgctgggattacaggcatgagctaccacgcccggcctttaaatttttactttgggccgggcacggtgccttacgcctgtaatcctaacatttcgagaagctgaggcacgtggtggatcacttgatgtcacgagttcagaccagccactgcactccagcctgggtgacagagtgagactctgtctcaaaaaaaaaaaaaaaagaaagaaaaacttttactttttacatgttattttcatcaatttaatgaatttaaataacaaatgtataaatttgatattaataaaatggaagcatttggtaatcatgttttgggttttgtgcttcctctgcagctctctagatgagaccacctatgaaagactagcagaggaaacgctggactctttagcagagttttttgaagaccttgcagacaagccatacacgtttgaggactatgatgtctcctttggggtacctcttgacttcttttatttttctgtttccccctctaagaattttagttcactaaaatgaagaatttccctccagcagagctaagcatcaagtagcatgtagttgtaggtaggattaaaagactagggttccgggaggtgaaggttgcagtgagccaaaatcacgccactgcactccagcctgggtgacagagcgagactctgtcatagatggatggatggatggatggatggatggatggatggatagatagatagatagatagatagatagctggatagatagataagatagataagacaagactaggcttcaagctgcagtccagctctaccaggcttgttgtgactctgggcaagtcactcagcctctctgagcctcattttccagcttcagtggatacccatgaaggcaaatcagagaggggcctgagtgtgtatttgtccagcaggcagatggagggaacaacaaactagacccgtagttcttcagtagggataagataactgcccaaaagttatttagattacaaagacttgagccctgctcctgtgagacagtgatggggtaggtcgggtgcattcctgggaagcatatttttgaaaagctcacctgggattctaatgtgtatccctaggtcttattcctagagattttgattacttggtctggggtgtggcatgacctgggcagggcactgggatttttaagctccacagatgattccaatatgcagctagtatgagaacttgtttttttttgaaggagtctcactctgtcacccaggctggagtgcagtggcgcaatctcggctcactgctccgcttcctgggttcaagcagttctcctgcctcagcctcccgagtagctgggattataggcatctgccaccatgcccagctaatttttgcattttagtaaagacggggtttcaccatgttggttaggctggtctcgatctcctgacctcaaatggtccacccccatcagccttccaaagttttgggataacaggcgtgagccaccaggtccggcctggtgtgagaacttctgagttggatgaaacattagccccagatcctagaagccagggaagtgctggtctttatcgactggccaccaggtggcagatttgggcaagggtctgcctttgggtttagaattattgcttaggccttaaagtagttcttttttgccagtgggagaaaatccctcaaagatggttttctgggttggttggtttgtttgtctgtttgtttgttttttgagacagagtctccctctgttattcagcctggagtgcagtggcatgatctcactgcaacctctgcctctcgggttcaagcagttctcctgcctcaacctcccaagtagctggaattataggcacacgcccccacacccagctaatttttgtatttttagtagagacagtgtttcaccacgttggccaggctggttttgaactcctgaactcaagtaatcctcccacctcagcctcccaaagtgctaggattacaggtgtgagccaccgcgcctggctcctcaaagatgttaatcctcttgatggcaattgactaataccagaaaatgtcacgaagcgtgcattttggattcaatcatggaattgttgaggacaatcagccatcagactaaagcgatagaaatagtattggaaattgcagcgggagcactgaatggagaaggcactccacataatggaggaggcaaccaagtcttagagaaggtatcaagcctgactataaggacagtgagggaattgaaaaaacaaaaaaggagcaatggagcagggaaggattgaatgcctttcaagtagattcagtaattgctgttagcagcaaaaaatgcagtagtgcctgggcagggctttaaagtgcttgcacaggcagccctagagggccgggctgcttgggaactcttacaaactgacctaccaacttgagcatccacagcctgatcagaggtgggggagttaagggccttctctcccctagcctctactagagcctgtaactgcagggaaaccaagttgcaggctaaactctgcccacacatgcagacattgattagcaagctacaaaaacagtcatgaaacctgtttttataggattagtgaagccccagtttgaccagagtactttgcatgaatgttttgttagaagcaaatgtgccaatattctagcagctgcgtttggtttacttcttcttcttctttttttttttttttgagttgaagcctagctctgtcacccaggctggagtgcagttgtgtgatctcagctcactgcaacctctgcctcccaggttcaagcgattctcccgcctcaacctcctgagtagctgggattacagacatgtaccacaatacagggctaagttttgtatttttagtagaaatggggtttcaccatgttggccaggctggtctcaaactcctgatctcaagtgatccacccgcctcagcctcctaaagtgctgggttaacaggcatgagccacggcacctggcaaaagtcatcttttggtttacttctattgaactgaaaaagtcacaaatatatttatatttaattaaatatatttatataaaaatatggtatttagtattattatttttagagacagggcctcgctctgtcacccaggctggagtgcagtggcacaatcatagctcactgcagcctcaagcttctgggctcaagtgatcgttccacctcagcctccctagtagctgggactacaggcacatgccaccatactcggctaattattttattttatttatgggtctcgctatgtttcccaggctggtctcaaactcctggcctcaagcgattctctcacctcggcctcccaaagcaccgggattacaggtgtgtgccagcacacccagccacaaatctataaatttagaaaggaggactatttctaaagagggtcccactacctgtaggcaggaagcagagcctctggccataactgaaaaacaagcacttccaagaaggggcaaagggaacatgaatttatgctgagaggcgtagctaagcatacatattcaacagattatgggaggatctatgaatattcacaaagggaggatctatgaatatgcacacatgtggagtaagctaacgtgtgcagcatgtctcccatgttcaccttaggcagaaacttaacactaacatgtattacagggcaacaaaatgagactgcatatctacataacctagctatttggtaggctgaagcaggagcatcacttaagactgggagttcgaggcagctgtgagccatgatcgcaccactgttctccagccaggatgacagggcaagaccctgtcttagaccactctgtggtcagtggttatcaggaaggaatgctagtcagttgtgctgaaaccactaaaaaggaagggcagaattaggtgatgagttgataccagtggtgaagtgagtcttttttttttttttctttttgagatggagtcttgctctgttgcccaggctggagtgtagtggtgtgatctcagctcatcgcaacctccacctcctgggttcaagtgattctcttgcctcagcctcccgagtagctgggattacaggcgcctgccaccacgcctggctaatttttttatatttttagtagagactgggttttgccatgttgtcaggctagtcttgaactcctgacctcaggtaatccaactgctttggcctcccaaagtgctgggattacaggcagctccaaagtgctgggattacaggcatgagccaccatgcatggcctgaaataatttttttgaaagggctagtttctatttagcccttaggggaaaaaaaactaatggcagttagggagggaatagaacgagtcctgtttgaactcctttcccatcatggccaaaacttaaaattttttttagatatctctgggctccccttggccaaaagatagtttgttgagtcagttgggagcttagaattttgtttttatttctcacatcattgaatcaatttgaaccaggcgacaaaaccttctgctcccagtagtgggtcagagaaccttcctgattcctgccctgagattgtctctctgaagacaacattaggctagtaggctttccagattctgtaacccattctttcaaaggaagagatgcctatatttttctagccaattcatataccttgagtatcactcaagggcaaaattatttctaacaaatcatttactaattagcaaatgcttaagtgtagatttagaaagctaaagctatacagtggctgccatctatagtttggacttgtgattaactacattgaaatgctaactctgtaccctagagtatgaattcctgattagagtccttcaggtgctaactaatttatgtatttcatgtttgataatattattacttgagctttgtgggagagcagtcttttcctcccctgagatatagctagaagttacctcctttgtgaagccttcctagatactccaagcagacacggtccttcctttctcccttgcccagcactctgaggttgactctgtggagcactgatccctctgtgttataattgtctatttacacgtcagctaccacctataacacactgagttcctcaacagcagggacactgtccattctttgatcccagtgtctggaacagtgccaagtacatagtagggacttaataaatattgattcatatgtaaatgagacttttccaaaacatgctttcgttgatgcctctcagcatttatacaccttttaccaactcgctactggccacatagacaaatgaaagcagtaatccagatacacccaagaggacatctgttcttttttctctctgtggagtgggagacttaagtggcttcttaactggtgtgtcgtctgatcaagtggtccaggtaacaggtggatgccaatgtctggcccaggcatcaccccttactggcactggtcattacagaagacactctaccagagctgaaaggacctcttgtcactaggcagctgtggagtccgctctacttgacctagtaaaatctgcctggagactgttagagtcaccccactacctgaagttacctccaggctgacctcttttttttcccaggtggagtcctggcatcttagatattttaataaggatttgcttgttgacatgttctttattcactaaggtgtcagcatattactgtcttagaactgagggttcttcatcttttttggatcaggacctccctctaagaatctgatgactgctctggtccctctcccaataaaaacttccatactcacctgttaaaaaaaaaaaaaactttaaacaaattaacagagttttattcagcaaagaatgattcataaatcgggaaggctgcaaccagaataggttcagagagactccacggtgtgccacgtggttggagaggatttaggatttatgcacagaaaaaggaaagtgacatgcagaaaatgaaagtgagggcctggtgctggtgcggtgcctcacgcctgtaatcccagcactttgggaggccgaggcgggcagatcatgaggtcaggagatcgagaccatcctggctaacacggtgaaaccctgtctctactaaaaatgcaaaaacttagccgggcgtggtggcaggcacctgtagtcccagctacttgggaggctgaggcaggagaatggtgtgaacctgggaggcggagcttgcagtgagccaggatcccgccactgcactccagcctgggcgacagagcgagacttcatcttaaaaaaaaagaaaagaaaaaggaaaatgaaagtgaggtacagaaacagccaggttggttacagcttggtgtttgccttaaacttggtttgaacagttggccgcctttgattagccaaaactcggtgattggtacaagagtagattgcagttcactatgtacagagaagcccttagatccgaactcaaaataggtaaggaggcagttttagctacacttaagttaacatactcaggagtaccattccagcttcaagctggaagtgtctgcagccccctgagaccacttaatcccaagttaaaaacccctgctcagaggcagcatctttttttttttttttttttttttttttgagagagatctcactctgtcacccaggctggagtgcagtggcacgatctcagctcactgcaaccaccacctcctgggctcaagggattctcttgcctcagtctcccgagtaactgggattacaggcgcgtgccactatgtccagctaatttttttttttgtatttttagtagagatggggtttcaccatgttggcctggctggtcttgaactcttgacctcaagtgatccactggcctcagcctcccaaagtgctggcattagaggtgtgagtcactgttcctggcccagtgaggcaccatctcattggatatggagacaaaggatctggcttagcatcctggatttgtattttctttccaagagtccttaagtgatatctaacttttgcgagctgcagtttcctcagctatgagatgagtgacattaacctcctctcttcagatttataagaggatcaattaaaatggcataggtaaaagtgcatcctagcaagttggtatctactttagaaatgaaggaggtcatatgtatgtgaagtctccagacccaacatgccatcttatatgtgtctatttctacaagtgagctagtgacaacagtaattgctatttttgctcctacatgggtagggctgatcttgactaggaggagtcaataagactcaccagccgggcgtggtggctcacgcctgtaatcccagcactttgggaggccaaggcgggcggatcacgaggtcaggagatcgagaccattctggctaacacggtgaaaccccgtctctactaaaaaaatacaaaaaaattagctgggcgtggtggtgggcgcctgtagtcccagctactcgggaagctgaggcaggagaatggcgtgaacccgggaggcagagcttgcagtgaaccaagatcgagccactgcactctagcctgggtgacagagcgagactccatctcaaaaaaaaaaaaaagactcaccagctgtggccactgtctgtgctaattggctagtgcctgcatctcagaaactgctacatattttgactattccccctgcacttaagggcatgcacactcccaaaatagactcagattgtctaaggaataatgatgatgatgaagagaaagccctctttatctggtctatttgtagtcagttccaaaagcattaagaatttctgctgaactaatgcagctagtttctttcctgtcaccactttccttccaaaatagtttcaagatctgtgggggaaaaaatctatttacagtgaacagactggtgggaggaagttgagcattggggttttctgccctgtgtaaccttgccctaagttgggcagatggtatcacactacctggacatcatctgctcattcactatttgaccagttggtcattcattcacaaatgtcctttttgcaggagggatggaggtgctagacctgcagatgctagcatgaaaagacagatctcctgctgctaaggtgcttaaagtagtggaggtcaggggacaagcaagcagtcaggcagctctgaatgcagaggcaggaagcaccacgaggcaatgggacccacagaggggtagcagggtagaggtgagtgggtctcatgtggggagggaggaagttgactgcagagaaggtgccagggggtgaaaatagcttgagagctgtggagctagaagggctctcacatttgcttattaatatgccctttgaaaaagagtggcctgatacctggagtcactcaaaagatttccaattccgataggaaaaagtcaattttggcttcagtggttgcatgtgcaccccctgatttgctgtatgctgaggcattgtggtgatggacgcaagtgcggagaccttgagcacgcatctgcccctagttcttgccctgagtcctcgaaggaggcaggagagacatcaaggcagacaggcgccgctcatcagtgatgagaccagacctggaactcgcgtcttatactcagtcctctgccctttctgctggattgtggccccccagtatagggtgcaacacacaactggagcatttaagggccacaaagagaacaaattaccaatgattgtgtgttgattctttgagctctttttttttattattatactttaagtgttagggtacatgtgcacaatgtgcaggttagttacatatgtatacatgtgccatgctggtgtgctgcacccattaactcgtcatttagcattaggtatagctcctaaagctatccctccccccttccccctccctccaccccacaacagtccccagagtgtgatgttccccttcctgtgaccatgtgttctcattgttcagttcccacctatgagtgagaatatgcagtgtttgattttttgttcttgcgatagtttactgagaatgatgatttccagtttcatccatgtccctacaaaggacatgaactcatcattttttattgctgcatagtattccatggtgtatatgtgccacattttcttaatccagtctatcattgttggatgagctctttatctcatggaaaaataatttataaaactctgtatgagaggagtgggaaatagtattaacgggtgcggggtttctttttgggacaatggaaatagctggaattagatagtggtgatgtttgcacactttgtgaaatactaaaaactcctgaattatacagttttaagaaacttttatttatttgtttttgagagaagttctctgtgtcacccaggctgaagtgtggtggcgtgatcaccggttattgcagcctcaatctctgaggctcaagcgattctcccacctcagcctaccaagtagatgtgactataggtgcgcaccaccacacccagtgaatttgtaattttttgtaaaaacaaggttttaccatgttgcccagtctggtcttgaactcctgggcccaagcgatcctccctccttgggctcccgaagtgccaggatacaagcatgagtcaccacatgcagcctcagttttaagaaacttttaaataaatgaaatatagtcataccaaaacagtaaaaatgggtttcaggaaaaaaaatgtttttttaaacaaacttacgtattgtataatcccagcccttttaaaaaatgctttcaaaaactggcagtcaactcataaaaggacaaatacttatgattccactgatgaagtagtcaaaagtagtcaaaaatcacagaaacaccaccataaatgtataatttttattttcaattaaaaaaacatcttttttttagtcaaaatcatagaaatagaaagtagacaggtggttactaagggctatgggatggggaaattagtgtctaatgggcatagagtttcagtgttacaaggtgaaaagttctagagttatgctgcccagcagtgtgaatatactttattgttctgtacacttaacatggttaatatggtaaatttagcgttatgtgctttttactatagtaaaattaaaaaaaaaaaaaatggggccgagtgcagtagctcacacctgtaacataatcccagcactttgggaggccgaggtaggaggatcacttgaggccagaagtttgaaaccagcctggtcaatatagcgagacctcatctctacaaaagaaaaatgttaaaattagacaggtgtggtgtctgtagtcccagctctctggaggcagggactgagtcagaggatcacttgagcataggggtttgaggctgcagtgagccatgatcctgccactgctgcagcctgagcaacagagcaagaccctgttgtaaaaacaaacaaacaaaaactggcagctgatacctgagagtgaatatcttttatcgctggttaatgggattgagagaatgcttcatcttatagaaagaacagtgtctttggacccacagagacctggatttaagattagctctgccaattactgagtactctttactatgaacctctgttttcctcatctgtgaaactggaataatgaatcctaccgccaacaattgtagtcaagttggaaacaatttacacaaagtgccaaacaccaagcctggcacagtaggaaccgagtaaatagtggttaatatttttatcagtgtctgcattgctgacgtctccatcatttctatacatttgtttttgaatcagaaaaagatgttattttaaaaaaataacccagtagtgccccttgtcccattcctatcagttatattattattgttactaccctctggaatttcaataactctttgttttttgggttttttgttttgttttgctttgcttttgagacaggatctctgtcgcccagtctggtgtgtagtggtgtgatctcagctcactgcagcctcaacctcctgggctcaggtgatcctcccacttcagcctcccaagtagctgggaccacaggcgcatgccaccacacttggctaatttttgcatttttagtagagacagggttttgccatattgcctaggccggtctggaacttctgggctcaagccatctgcctgcctcggcctcccaaagtgctggaatttcaggcatgagccatgcctggcctaaatagctctctgtgtttgcaaaagtgtgttataagaatcattcagagcctctcgattggatggaggctctagaatgcacagaaaaaggctgccaccgtgtatctctgcaagtcatgcacaagatggggaacagcaggcttccccctgcttaccagttcaaatacagagaactagccctgtagctgtttctttcatatctcacccattctaaagagaccacaggccttagaagtaaaggactcttttgttgaaagagtgttttcaaatttaaatgagcatttattggtcaaagatgcaccaactagtcttttgaagaattcaaggctctttagagaaaaataaagccttggaggagtatctgagaagcttgttagatgcgtgggaagagtctggaaataaaaaacttcatctggagtttctgccttctaccaacagagctgaagctaatgctctcctaagacaagcaaagcagatggtttgcatacttccttaccttccttttacttcctctgtaatagacttgtcatgtctgatgtttgagttgacgtggtactctaatagagttagagtctgcattttttttatgtcctctagtatgttctggttgatggttgagggcaacaaaccagcagtcccagatgccagcaccaagacctgagacaggtcacttaactctccgagcttcaccaccattctcaccttgcagacctcacagggaacagggaaagctctatgagatacaacatcattatgattaatcctattctgattctgaaagcaaagctcttcctacacaaactcctatttctaaatactaaaagacatttctttatggtgtattttgtgtacttgtagaaatggaaagtgttgagataaaacatgaagcaatgatgacaaagtgctaactttttcttgttttaatttctttatgctttttttccacctaatcccctagagtggtgtcttaactgtcaaactgggtggagatctaggaacctatgtgatcaacaagcagacgccaaacaagcaaatctggctatcttctccatccaggtatgtaggtatgttcagaagtcaacatatgtaattcttaaagacttccgaaatgtgacattgtggaccatttaagaaatgtcggctgagcacagtggctgacacctgtaatcccaacactttgagaggctgaggtaggaggatcacttgaggacaggagttcagaaccatcctgggcaacatagtgagtccctgtctctgtaaagaaaataaaaataaagtcacagctgggtgcaggcttacacctgtaatcccagcactttgggaggccaaggcctgtggatcacttgagctcaggagtttgagaccagcctgggcaatgtcacaaagccccacctctactaaaaatataaaaattagccaggtgtggtggcacacgcctatagtcccaactacttggaaggctgaggttgagcctcagcctgagcccaggaggtggaggttgcagtgagccaagatcgcgccactgcactccagcctgggcaacagggccagaccctgtcccaaaaaaaaaaaaaaagtcatcgtcttatgttagcatccttgtaagtgagcctttcctgatattttgcagcctgtctcattctcagtagaaaagtttactctagttacataacttctccctgctgacaatttggatactgtaagcaggcatcaggatattaagatctgaagtgagtagcttataacttttccaaatccagcctagacagttttcctctattaaattattgccctgactttaaaagaagctacttttgaccttgtagcgtttgaacaagttgcactttgtcttcaaagcaagttaaagtttgacctctacttgttttgagcctctcaggtaaagggttatttgaattccctttgcaggttggggttgtgtaccctgtggaggtggtagagtgttatatattgctgctccagggcatttaatccctcctgccttttccattgatgtgctttcaatctagaggaataaaagattgtgttggagacacaatgtggcctgcatagcatctgaaagcctgagaacatgcagggagagacatccctcatccctcagcagcctggctgctgttgaagtggttgtaagaaagtaaaagagaaatgcccacaaaacgttctcagatccagtcattcattagcacttccaaagagagcatgttgactgtgaattgggaaagggccagataaaactagcatagaattctttgaaagactaacggtatttgcattttttaaaaattataaccttactctaccccctaacattgacatcatttttaggtaattaatattttcccatttattattctgtgatctctaatgctttgttcagaataaatagtgtgtttcctttccccacactttcatccaagaagtgtgctagagttcaacaaaaacagcactagaaatcactgtcattctaggaaggccctaattcacagattgtattggtttttagacccagttagtgtgctggaggttggaggattttaacctctgtgggccaactagcctctgtggcctcagtcattcttcctgaccctggctgtgcttgagcctgtgtgttcttatccttcatctccgggggaacgaagtggatcagctcggtccagcgatcacttttggggatcagtggctttgtagatatcgggcaggcacttaccccaaaagaactttccccatatctgaagactgaaaacgtccatatcgtatttggacacactgcccagcaatacgctctagctgtgttcagaagcatgggaatttggaaagatctgctgagcatgccgtttactgtcacagatactatcttcctcaaaaaaaaaaaatatatatatatatatgggggacggggcaggttgagactgggtgagactgaagaggtgccttggccagagcaggccacacccagagaccacaggctccccggtccacctcaggcccctccccttcctgcgccgtttccggcagatccagagtggccaccgccggatgggagtcgggggaagggaggcagagaagcgggccctgaggacaagctctcagtgcttctgtgggaagtggcggcaagacggcagctcccagcgggggatggaggccgagtcagtctgctggtcactggaggccaggatgctgcctaacacagccgtcccgctccgggcctcaccaccagggcggctctccccactcccggcctgctgcccacacagactgcggggttccgggggagcaggacccaggccgttctgcgcctgtcttcttggaaggagcaggccggagcgcgggagcgccgtgtagctgtacctgcgaaggcacaggattccgcgggaagatcccgcagtttcgggccgtcgtcattgtttttatacctgtggcaaatggcatgaccagacacacggttatgtctggagaaacccctgtagaggagcaggaggttgtggacatgctgtggcccggacagtggctgccgagcagttggagcctgcacccgcccaacttggctaaagaagtccccatactctctgtggaaaagatttccagaagctgttgtgtcaatatcaaagcctcaaaacaacaacaacaacaacaaaaacatgaaattatcaacaataaagatcatccttgagtctgctttgaaaagtagggtgaaattctgcagaggcattcaactggcaagataccaccctcatagccagatctgcaggtctcagccatcatgccagggaaaatgctccattcaccactcctcagcttctgcttctggtttcagaggtctctgtattggaggggctttaaagcaagaagggtctttacccacttactcttattcacagatgtgaatatgcaggtccagtggggaaagtgacatgtcctaagtcagaatagagtcaacaagaaaacagggcccaaaatgacttagcctctagtgtataatgggcattgatgagctactggaaatacagagatgaagaaaacacagtcccatcttcaaggagctcaatctagcaagggagacagactctttgtaggtgggaccgggcttccctgcagcagaaggaagcttgaaattggtaacgagcctcagaagggacagaggcaggccaccatgctaccctgagaggatcgcatgtggacacggggctatgacctggccctgctttgacccactagctgtgctgtagggccaggtggagcctggagtggcctgtgctaaggggctactatgagctctttccactcccccaaggcattgcataaataatgtcactttctgtttgcacagcaaaatcagggacacaattttctagaacatggggtgcctcccctccccccagcccaacagaagttctacaatgactgatgggcccttgtttttgtttgagacggaacaccccacagggttccgagtggtgatttgtggcccacaggccactggcaagtggaggcagagctgcagagccctcgggagccacagagggcctgctggccgccacgacatgccaactcagctgctgctggccctcctgtgggcggcagtgctagtgatgtgcagaatcttaggactagtgccaaggaacctataaataccctgggtgacccaggcgtgcactgctgtggtggccttcacagtcagaagatgacaagctgagaaggggagaatcggcccaaggtgagatccacagaaaggccagggccaagatgcggccagcacctcaggctggtggtggtcttacgttgaccatgccagaggccagtccttgattgctccaaaccctctgttcgagggttccaaatgaaatgagcaggtcctcgtgtcaggacctaggttagtttctgaaaaagcatgaaaagcaggcctcctgaacttccccgagtgactgatgcaaagtgcgtcctgcatgcttcacagcaccatggagaggatcttcaggggcaaactgcagactatctgaatgacggcactgaccatcagcaaaccgcagagctgcctgaccaagaaattgcgagacagaagcaatgcttgcaggcgaagaagaaggggccagacacagtggctcacgcctgtaatcccagcactttgggaggccaaggcaggcggatcacttgaggtcaggagtttgagaccagcctgggcaacatagtgaaaccctgtctctactaaaaatacaaaaaattcgccaggcatggtggcaggcacctgtaatcccagctgcttgggagactgagacaggagaattgcttgaacccaggaggcgaaggttgtaacgaactgaaatcgtgccacagcactccatcctgggcgacagagtgagactgtctcaaaaaaaggaggagaagaaggaaaggccaaggcaggaatgaaacaggccatgaatgttggagtgaagcaactggcctcctcgtgctaagcggctactgtgagttctttccactcccccaagacattgcataaataatgtcactttctgacactcaccccgctgaatgtcctgcctctgctcaagggtggtatgatggggacttggcagtggaggggaacagggaaaccagacatggtggtctccccgcttcctggctacaagtccctctgaagaaatccaaaggagtaaagagcttggagagtaggcctctgtagggtgcaagggcacagctggagacggagctcctgaggctgcagctgatgctgcccgctctgcctgaactgcaccaaaaacgtgatgaggccatagcgggagtccacggaggaggatgcctactgcccgacctctagcagagactaagcaaggtgcatgaaaacttgaaccacatgtgtcacacccatgaccactacatgaagatggcccaaaacctggcccaggaattgaagaaagactcttccaatttgctgtaagaaaatggcccagggggcaagcacggtagctcacacctgtaatcctagcactttgggaagctgacgcaggcagatggcttgagctcaggagttccagaccagcctgggcaacatggtgaaaccccgtctctaccaaaaatacaaaaattagccgggtgtggtgatgcatgcctgtggtcccagctactcaggaggctgaggtggaaggattgcctgagtctgtggggcagaggttgcagtgagctgagatcacaccactgcactccagcctgggtgacacagtgagaccccatctcaaaaaaaaaaaaaagaaagaaaacggcccaggaaggctggagggccgccgtgtccattgagagagtgctccaggcactccaaaaagaaaatgaccacaatgggaagaaaccagctgaccatgagaccaagttccaaccttttacaagtggcctgtggctcctggcgccccgcccacagctgacaggggctcagaagtgctagggggaccatgggccaccagggccaccaggagggaggcaggtaacgatgcgagggcttggatgcagaacaccagctggtttgattctgttttccctgtacctgggtcctgaatgcccagaggctcagggaaacaccagccagtgctgctgcctttaaagcacttttgactgatctcttgttaatttagcaactgttattggttgatgctgcagttgctcttattgaagtttgattgatagcattaggatggtaaggcactatttttcaaataaaggttgtttaatataaaaaaaattttgtttttttttctctcagcctttcacattggttcaaaatatctttcatctggctgcatttctgatttttgttttgttttttttttcttaattttatttatttttaattaaaaataattttttttgtcaacatggggtctcactttgttgcctaggttggtctgaaactcgtggcttcaagcaatcctcccacatcagcctcccaaagtgctggggttatgggtgtgagccactgcagcagcctgttttttttgtttgtttgttttttttaatttgacaagttttcaggtcctgtgaaatcagcagtcttacctcccaccttgcgcaccctgaggaggttgcagaataaaggagaattctagggacacgtgggcatcagtgcctgtgctcagagcacctcaggcagtgtggaggggtctagaggttactcaggctctgcctggcaacccgatagcagtatcagagtatagggccaaggggacggtccttgggcttggtgtggtttattagtccttttcctgtgaccctgatggtttggttcactcatttttatctccatactgggaacaggttcaagccccagcatttggttgataatgcaggaatccttgatacttttattgcccaagcttcccttcctggtgacctcatcctagcctcagtctttggaaaagccctccttgagtgctcaggcagactcaggtgccctttcttctgggctcccatgcactctgttcttacctccatcagggtgccacatgcactagtgttatctgctgccgtggccaatcatccatgaggccatgaggaagtggaatgtacatctggtataagaagacatggcagaagccagcctccgatctgtccacacgaatacagcattcccaaagcaacgtgcatgtgccattattcactggatgagcttgaggtggatgaactagcccaccaggctctcaatgtcatgaatttaacactgaattaagaaaaatatgttttaaaaataatagtttaggtgattgctggggtgctaggagaggaaggaatggggaataactgtttaatgggtatagttggccttgtgtatctgtgggttccacatctgattcaaccaaccgtggatcaaaatatttgaaaataaaaaacaaaacaaaaatgatacaaataaaaaccaatataacaactattaacagcatttacattgtactaggcattataagtaatctggagatgacttaaagcatacagaaggatgtgcctaggttagatgcatgtatcgtaccatttcatatcagggacttgagtacccacggattttggtatctgcagatcctggaaccccttccctatggataccaaggaacaacagcactgggtctccttttggggtgatgcagatgttttgaagctaggcagaggtagtggttgcacaacattgtaaatgtactaaatgccaccaaattattcatttttaaatggttaatgtgttatgtgaatttcaccttaacaactaataatattataggtaaggcacaagttacatctgtagcacaaaaatggccctaatttttaaaacactgctccagcatagcaggtatcacatgtgaggtagcaaaagctggagatcaaagtgtgatacctggagacttatcagtaagggtcaaatgttttttcaggttttgagaatcattcttggaattgttccagaagatatatcgtataactcttcttagatgctaagataagaaggcagatatacactagctcattttgtgttattttctagagctttactccagtcaatttcttgggggcagcatttgtggaatcagtggttcatctgaagggctgtgctgtggaattactatgcatttgttttgtcttccagtggacctaagcgttatgactggactgggaaaaactgggtgtactcccacgacggcgtgtccctccatgagctgctggccgcagagctcactaaagccttaaaaaccaaactggacttgtcttccttggcctattccggaaaagatgcttgatgcccagccccgttttaaggacattaaaagctatcaggccaagaccccagcttcattatgcagctgaggtctgttttttgttgttgttgttgtttattttttttattcctgcttttgaggacagttgggctatgtgtcacagctctgtagaaagaatgtgttgcctcctaccttgcccccaagttctgatttttaatttctatggaagattttttggattgtcggatttcctccctcacatgataccccttatcttttataatgtcttatgcctatacctgaatataacaacctttaaaaaagcaaaataataagaaggaaaaattccaggagggaaaatgaattgtcttcactcttcattctttgaaggatttactgcaagaagtacatgaagagcagctggtcaacctgctcactgttctatctccaaatgagacacattaaagggtagcctacaaatgttttcaggcttctttcaaagtgtaagcacttctgagctctttagcattgaagtgtcgaaagcaactcacacgggaagatcatttcttatttgtgctctgtgactgccaaggtgtggcctgcactgggttgtccagggagacctagtgctgtttctcccacatattcacatacgtgtctgtgtgtatatatattttttcaatttaaaggttagtatggaatcagctgctacaagaatgcaaaaaatcttccaaagacaagaaaagaggaaaaaaagccgttttcatgagctgagtgatgtagcgtaacaaacaaaatcatggagctgaggaggtgccttgtaaacatgaaggggcagataaaggaaggagatactcatgttgataaagagagccctggtcctagacatagttcagccacaaagtagttgtccctttgtggacaagtttcccaaattccctggacctctgcttccccatctgttaaatgagagaatagagtatggttgattcccagcattcagtggtcctgtcaagcaacctaacaggctagttctaattccctattgggtagatgaggggatgacaaagaacagtttttaagctatataggaaacattgttattggtgttgccctatcgtgatttcagttgaattcatgtgaaaataatagccatccttggcctggcgcggtggctcacacctgtaatcccagcacttttggaggccaaggtgggtggatcacctgaggtcaggagttcaagaccagcctggccaacatgatgaaaccccgtctctactaaaaatacaaaaaattagccgggcatgatggcaggtgcctgtaatcccagctacttgggaggctgaagcggaagaatcgcttgaacccagaggtggaggttgcagtgagccgagatcgtgccattgcactgtaacctgggtgactgagcaaaactctgtctcaaaataataataacaatataataataataatagccatcctttattgtacccttactgggttaatcgtattataccacattacctcattttaatttttactgacctgcactttatacaaagcaacaagcctccaggacattaaaattcatgcaaagttatgctcatgttatattattttcttacttaaagaaggatttattagtggctgggcatggtggcgtgcacctgtaatcccaggtactcaggaggctgagacgggagaattgcttgaccccaggcggaggaggttacagtgagtcgagatcgtacctgagcgacagagcgagactccgtctcaaaaaaaaaaaaaaggagggtttattaatgagaagtttgtattaatatgtagcaaaggcttttccaatgggtgaataaaaacacattccattaagtcaagctgggagcagtggcatatacctatagtcccagctgcacaggaggctgagacaggaggattgcttgaagccaggaattggagatcagcctgggcaacacagcaagatcctatctcttaaaaaaagaaaaaaaaacctattaataataaaacagtataaacaaaagctaaataggtaaaatattttttctgaaataaaattattttttgagtctgatggaaatgtttaagtgcagtaggccagtgccagtgagaaaataaataacatcatacatgtttgtatgtgtttgcatcttgcttctactgaaagtttcagtgcaccccacttacttagaactcggtgacatgatgtactcctttatctgggacacagcacaaaagaggtatgcagtggggctgctctgacatgaaagtggaagttaaggaatctgggctcttatggggtccttgtgggccagcccttcaggcctattttactttcattttacatatagctctaattggtttgattatctcgttcccaaggcagtgggagatccccatttaaggaaagaaaaggggcctggcacagtggctcatgcctgtaatcccagcactttgggaggctgaggcaagtgtatcacctgaggtcaggagttcaagaccagcctggccaacatggcaaaatcccgtctctactaaaaatattaaaaaattggctgggcgtggtggttcgtgcctataatttcagctactcaggaggctgaggcaggagaatcgctgtaacctggggggtggaggttgcagtgagacgagatcatgccacttcactccagcctggccaacagagccatactccgtctcaaataaataaataaataaataaagggacttcaaacacatgaacagcagccaggggaagaatcaaaatcatattctgtcaagcaaactggaaaagtaccactgtgtgtaccaatagcctccccaccacagaccctgggagcatcgcctcatttatggtgtggtccagtcatccatgtgaaggatgagtttccaggaaaaggttattaaatattcactgtaacatactggaggaggtgaggaattgcataatacaatcttagaaaacttttttttcccctttctattttttgagacaggatctcactttggcactcaggctggaggacagtggtacaatcaaagctcatggcagcctcgacctccctgggcttgggcaatcctcccacaggtgtgcacctccatagctggctaatttgtgtattttttgtagagatggggtttcaccatgttgcccaggctggtctctaacacttaggctcaagtgatccacctgcctcgtcctcccaagatgctgggattacaggtgtgtgccacaggtgttcatcagaaagctttttctattatttttaccttcttgagtgggtagaacctcagccacatagaaaataaaatgttctggcatgacttatttagctctctggaattacaaagaaggaatgaggtgtgtaaaagagaacctgggtttttgaatcacaaatttagaatttaatcgaaactctgcctcttacttgtttgtagacactgacagtggcctcatgttttttttttttttaatctataaaatggagatatctaacatgttgagcctgggcccacaggcaaagcacaatcctgatgtgagaagtactcagttcatgacaactgttgttctcacatgcatagcataatttcatattcacattggaggacttctcccaaaatatggatgacgttccctactcaaccttgaacttaatcaaaatactcagtttacttaacttcgtattagattctgattccctggaaccatttatcgtgtgccttaccatgcttatattttacttgatcttttgcataccttctaaaactattttagccaatttaaaatttgacagtttgcattaaattataggtttacaatatgctttatccagctatacctgccccaaattctgacagatgcttttgccacctctaaaggaagacccatgttcatagtgatggagtttgtgtggactaaccatgcaaggttgccaaggaaaaatcgctttacgcttccaaggtacacactaagatgaaagtaattttagtccgtgtccagttggattcttggcacatagttatcttctgctagaacaaactaaaacagctacatgccagcaagggagaaaggggaaggaggggcaaagttttgaaatttcatgtaaatttatgctgttcaaaacgacgagttcatgactttgtgtatagagtaagaaatgccttttcttttttgagacagagtcttgctctgtcacccaggctggagtgcagtggcacgatctgggctcactacaacctccgcctcctgggttcaagcaattctctgcctcagcctcccgagtagctgggattacaggtgcctgccaccacacccggctaatttttgtatttttagtagagacggggtttcaccatcatggccaggctggtcttgaactcctgacctagtaatccacctgcctccgcctcccaaagtgctgggattacaggcgtgagccactgcacccagccagaaatgccttctaatctttggtttatcttaattagccaggacacttggagtgcatcccgaagtacctgatcagtggcccctttggaatgtgtaaaactcagctcacttatatccctgcatccgctacagagacagaatccaagctcatatgttccatcttctctggctgtatagtttaaggaatggaaggcaccagaacagatttattgaaatgtttattagctgaagatttatttagacagttgaggaaaacatcagcacccagcagtaaaattggctctcaaagattttcttctcctgtggaaagtcagacctctgaggccccatccaggtagaagtactagtgcaagaagggcctctgctgtccacttgtgtttctgtgatctgtgggaacattgttaacgccacatcttgacctcaaattgtttagctcctggccagacacggtggctcacacctgtaatcccagcactttgagaggctgaggcaggtggatcacctgaggttaggagttcgaggccagcctggtcaacatggtaaaaccccgcctctactaaaaatacaaaaattagctggccgtagtggcgcacgcctgttatcccagctactcgggaggctgaggcaggagaattgcttgaacctgggtggtggaggttgcagtgagccgagattacaccactgcactccagcctgggtgacaagagggaaactccattaaaaaaatgtaattcccgtgtctgccatcttaagtgtaaaggtggctaaattatatagaaaaataagacaatatcatttcccaattacattcctttcctaccgcactctatgatgctagctgagatttttccaaaagaaaatggcttaaataaaaccctaagagaaagaaaaactttaaatccctccaaagctcaaaagtaatagaaacagatgagtttggagtcaggatttctctgtaagattgcctaggctgtgtactgcacatctccaggtgccactgttgacagagattataactacaatgtgaagtgaatggtgccactgacagttatgcaaaccgtccagagcatagccacctgatcctgctgggattcctcttgccagtccatcagcagttccccttgaaagtttcaccaaacatcccttaaatctgccctctcctgcccgtccccagtggaggtcctcatcatttttcacctgcatttttgcaggagctttcttatatccaccttcctccttttctctcagcccatcatctagctacacagtctccagggtaagctttcagaaaggcaatctcttgtctgtaaaacctaagcaggaccaaggccaagtttcttagcctgaaaaatgtgcttttctgactgaactgttcaggcactgactctacatataattatgcttttctaccccctcacactcaacactttgactccagcaatcccaaatccccagatccctaagtgtgctgtgctattttcacgtggctctcagacttggccagtgctgtttccattttggtctttattccccacatctctgcctggggggtagattctaccctgaaaaatgttcttggcacagccttgcaaactcctcctccactcagcctctgcctggatgcccttgattgttccatgtcctcagcataccatgtttgtctttcccagcactgacctaccatgtgtcacccctgcttggctgtaccttccatgaggctaggactatgtgtctcctttgttgactgctgttgccctagcatcttgcacagttccttgcacacaattagagctctataaatgtcaaataaatgtgttataattatatgtttaagatagttgttcaaataaactctaaataaccccaac

SEQ ID NO: 424 - DNA, 43515 bp, Homo sapiens; identical to SEQ ID NO: 423

SEQ ID NO: 425 - DNA, 64616 bp, Homo sapiens
agtctcccttgggtcaggggtcctggttgcactccgtgctttgcacaaagcaggctctccatttttgttaaatgcacgaatagtgctaagctgggaagttcttcctgaggtctaacctctagctgctcccccacagaagagtgcctgcggccagtggccaccaggggtcgccgcagcacccagcgctggagggcggagcgggcggcagacccggagcagcatgtggactctcgggcgccgcgcagtagccggcctcctggcgtcacccagcccagcccaggcccagaccctcacccgggtcccgcggccggcagagttggccccactctgcggccgccgtggcctgcgcaccgacatcgatgcgacctgcacgccccgccgcgcagtaagtatccgcgccgggaacagccgcgggccgcacgccgcgggccgcacgccgcacgcctgcgcagggaggcgccgcgcacgccggggtcgctccgggtacgcgcgctggactagctcaccccgctccttctcagggcggcccggcggaagcggccttgcaactcccttctctggttctcccggttgcatttacactggcttctgctttccgaaggaaaaggggacattttgtcctgcggtgcgactgcgggtcaaggcacgggcgaaggcagggcaggctggtggaggggaccggttccgaggggtgtgcggctgtctccatgcttgtcacttctctgcgataacttgtttcagtaatattaatagatggtatctgctagtatatacatacacataatgtgtgtgtctgtgtgtatctgtatatagcgtgtgtgttgtgtgtgtgtgtttgcgcgcacgggcgcgcgcacacctaatattttcaaggctggatttttttgaacgaaatgctttcctggaacgaggtgaaactttcagagctgcagaatagctagagcagcaggggccctggcttttggaaactgacccgacctttattccagattctgccccactccgcagagctgtgtgaccttgggggattcccctaacctctctgagacgtggctttgttttctgtagggagaagataaaggtgacgcccattttgcggacctggtgtgaggattaaatgggaataacatagataaagtcttcagaacttcaaattagttcccctttcttcctttggggggtacaaagaaatatctgacccagttacgccacggcttgaaaggaggaaacccaaagaatggctgtggggatgaggaagattcctcaaggggaggacatggtatttaatgagggtcttgaagatgccaaggaagtggtagagggtgtttcacgaggagggaaccgtctgggcaaaggccaggaaggcggaaggggatcccttcagagtggctggtacgccgcatgtattaggggagatgaaagaggcaggccacgtccaagccatatttgtgttgctctccggagtttgtactttaggcttgaacttcccacacgtgttatttggcccacattgtgtttgaagaaactttgggattggttgccagtgcttaaaagttaggacttagaaaatggatttcctggcaggacgcggtggctcatgcccataatctcagcactttgggaggcctaggaaggtggatcacctgaggtccggagttcaagactaacctggccaacatggtgaaacccagtatctactaaaaaatacaaaaaaaaaaaaaaaagaagaagaagaagaagaaaataaagaaaagttagccgggcgtggtgtcgcgcgcctgtaatcccagctactccagaggctgcggcaggagaatcgcttgagcccgggaggcagaggttgcattaagccaagatcgcccaatgcactccggcctgggcgacagagcaagactccgtctcaaaaaataataataataaataaaaataaaaaataaaatggatttcccagcatctctggaaaaataggcaagtgtggccatgatggtccttagatctcctctaggaaagcagacatttattacttggcttctgtgcactatctgagctgccacgtattgggcttccacccctgcctgtgtggacagcatgggttgtcagcagagttgtgttttgttttgtttttttgagacagagtttccctcttgttgcccaggctggagtgcagtggctcagtctcagctcactgcaacctctgcctcctgggttcaagtgattctcctgcctcagcctcccgagtagctgggattatcggctaattttgtatttttagtagagacagatttctccatgttggtcaggctggtctcgaactcccaacctcaggtgatccgcccacctcgccctcccaaagtgctggaattacaggcgtgagccaccgcgtctggccatcagcagagtttttaatttaggagaatgacaagaggtggtacagttttttagatggtacctggtggctgttaagggctattgactgacaaacacacccaacttggcgctgccgcccaggaggtggacactgggtttctggatagatggttagcaacctctgtcaccagctgggcctctttttttctatactgaattaatcacatttgtttaacctgtctgttccatagttcccttgcacatcttgggtatttgaggagttgggtgggtggcagtggcaactggggccaccatcctgtttaattattttaaagccctgactgtcctggattgaccctaagctccccctggtctccaaaattcatcagaaactgagttcacttgaaggcctcttccccacccttttctccaccccttgcatctacttctaaagcagctgttcaacagaaacagaatgggagccacacacataattctacattttctagttaaaaagaaaaaaaaatcattttcaacaatatatttattcaacctagtacatacaaaatattatcattccaacatgtaatcagtattttaaaaatcagtaatgagaccaggcacggtggctcacgactgtaatcccaggactttgggaggccgaggcgagtggatcatctgagatcaggagttcaagaccagcctggccaacatggtgaaaccccatctctactaaaaactagctcagcatggtggtgggtgcctgtagtcccagctactcgggaggctgaggcatgagaatcacttgagcccaggaggcagaggttgcagtgagccaagattttgggggattctgtgacatacaaaaaaaatcagtaataagatatcttgcatactcttttcgtactcatatacttccagcatatctcaattcacaatttctaagtaaatgctctatctgtatttacttttataaaattcacaattaaaaatgaaggttcacatagtcaagttgttccaaacacacttaaatgtctcctaggctgggtgtggttgctcacacctgtaatcccagcactttgggaggctgagatgggcggatcacctgaggtcaggagtttgagaccagcctggccaacatggtgaaaccccgtctctactaaaaatacaaaaattagctggatgtggtggcactcacctgtaatcccagctactcaggaggctgaggcaggataattgcttgaacccgggaggtggtggaggttgcagtgagccgagatcgcaccactgccttccaacctgggcgacagagcgagactccgtctcaaaaaaaaaaaaaaggctcctaataactttattactttattatcacctcaaataattaaaattaaatgaagttgaaaatccaggtcctcagtcccattagccacatttctagtgctcagtagccacgggggctggtgaccaccacatgggacagcatatttagtacctgatcattggttctcagatctggctactcagcagaaccaagaatccacagaaacggcttttaaaagcacagccccacagcccccagccccagccttacctacctggaggctgggaaggactctgattccacgaggcagcctatgttttttgatggagggatgtgacaggggctgcatctttaacgtttcctcttaaatactggagacagcttcgaggaggagataactggatgtgtcttagtccatttgatggagggatgtgacggggctgcgtctttaacgtttcctcttaaataccggagacagcttcgagaaggagataactggatgtttcttagtccattttctgttgcttgtgacagaatacctgaaactgggcaatttatatggtaaaaaattttcttcttactgctctggaggctgagaagtccaaagtcaagtcccttcttgctggtggggactttgcagagtattgaggcggcaccgggcgtcatatggtaaggggctgagtgtgctacctcaggtgtctttttcttttcttataaagcctaactagtttcactcccatgataacccattaatctatgaatggattaatccattattgagggaagaaccttcatgacccagtcaccgcttaaaggccccacctctcaatactgccacatcgggaattaagtttcaacatgagtttcggaggtgacaaacattcaaaccatagcatgctgtctcttaaatgactcaataagctcctgtggcatccacttctgcatgccttgggcagcttttagacatctgtccattttcctagagggacaagaccaccacctgtgatcctatgaccttttggctttaggcctaacaagcaggttataccctcactcactttcaaatcatttttattgtcttgcagacaatttacacaagtttacacatagaaaaggatatgtaaatatttatacgctgccgggcgcggtggctcacgcctgtaatcccagcactttgggaggccgaggcaggtggatcacgagttcaggagatggagaccatcctggctaatacgatgaaaccccatctctactaaaaatacaaaaaattagccgggcgtggtgacgggtgcctgtagtccccactactcgggacgctgaggcaggagaatggcgtgaacccgggaggcagagcttgcagtgatccgagatcgtgccactgcactccagcctgggtgacagagcgagactgcatctcaaagaaaaaaataaataaataaataaatatttatactgcttataaactaataataaatgctatggtctgcatgtttgtgtcaccccaccattcatatgttaaaacctaatcaccaaagtgatattaggaggtggggcccttgggaggtgatgaggtatgagggtggagcccatatgattgggattagtgcccttctaaaatagcccaacggagcccagtgacaaggcatcatctatgaaccaggaaactggccctcaccagacaccaaagctgttggtgcattgatcttggatttcccaccctccaggactctaagaaacacatttctattgtttataagccacccagtggctggtattttgttataacatcccagactaagacaaataacaaatacttgtatccctgacaccaggttaagagatagaatttgtttgttcctctggaggcccttgtcttcaccccatcactgccctgtcctccctggaggaatctgccagcccgaattctgttcatcgtaccctccttttcttagagtttgacctcctctgtatctcccccaatccatgtattgcttatatacaaggtattctgctgtatctgttctgctatggcttgccccttttgttcaacactgtttttgtgcgtcatctgcattgatgcatgcagttgtcctttatttgttctcactgctggatagtatctggttgggtaaatatatcacactgtaaatcacactatccaggttcctttaggtgacatttggttgattgcagtgttctgttgttacgatggtgctgctgtgactgttcttgtgcatggacagaagttcctttcaggtgaatttctcagaatggaattgctgggcaaaggggcagccaataatcaactcatttgatgccaaaagtggtggtgccagttcatcctcccctgcgaggtatgggtcctgattcactcttcaagtgctgtggtttgacagggccgggggtgacaaggggacacctgggaaggaaagctgggctccctgctggccatccaggccagtccttaccagggggtaggcaatgattgggtcaagtggttcctgaccactgggcctgagacttcaggcccagaaactatctaatatttcctcaaatgcatcccatgagcaggcactgtgtgagtgagcacacacatctgaagcctcaagctaggcaagcctaccatgacttgtggtccaagggctcacgggtgacctggagttagagggagacatggctgccaggtggctttagaaagaacactcatcatggccaggtgcggtggcttacgcctgtaatcccagcactttgggaggccaaggtgggtggatcatgaggtcaggagtgagaccagcctgaccaacatgctgaaacctgtctctcctaaaaacacaaaaattagctgggcatggaggtgcacgcctgtaatcccagctactcaggaggctgaggcaggagaatcacttgaacccgggaggcggaggttgcaataagcctagattgtgccactgcattccagcctgggcaacagagcaagactccgtctcagaaaaaaaaaaaaaaaggaagaacactcatcctatgaccttgacctccaagctttgcctccctcaagcagaacagaatggagcctcccttaggcagaggcggaagtttgcctctcacctagttctccattcttttgttcagagcctgaataccctcaggctctgtacttggggtatttctgttctcttgttttatgctcacggttgtgaggtttgttgtgagtaccacgatcccttccttcagaggagtaaactgaggttccaaaaggtttagcagttgcccgaggaatattaaattggcaaaagcaggtagaatataaagcaaggagtatttggcaacggttcttttttatgattaaaaacagccgaagaaagacttctacttgtgcctttgaaggagtaactgcatttgaccttcccaccagtaacaaccatcaaatctctattaaattaaacacacacacacacaaacaaaaacagctattgtgaaggtatcagcgactaagacaactaaggtttgaggggccaggatcctggagagatggaaacttccctgaggtgagccccacattctcagacacttttccttggatgttttgagcactgctttaattcctgggaaaacaattccttccactgtgcacagactctggggccagacagcttgggttcaatcccagctctgccacttaatgtctgtgtatctgtgtaggcaagttaccctttggtgcgtcagtttcctcatctgtaaaacacaactatagttgatcctcattcgttaagagtctgtacttgttaatttgctcacttgctaaaatttgttaccccaaaatcagtacccctagccttttggggtcgtttcaaagatgtgtgcagagcggcaaaaaaatgtgagctcctccaggctcatgttcccagccaaggtccaacaaagtgctgccctgccttcttatttcagctgtcatagtgtaaactgtgtccttttcacagtctgattagtgccatgtttttcagatttttatgcttttttcttggttatttctctgttaaaattgtctccaagtgtagtgcaaagtttagcacgaggaggctgtgatgttccttacagagaaaatgcatgtgttagagaagctttgtcaggcatgagttaaggtgctgttgtcctgagatcaattaatttgttgttgttgttgtttgagacagggtctccctctgttgcccaggctgctggagtgcaatggtgtaatcatagctcactgcagcctctacctctctggctcaagcaatcctcccacctcggcctcctgagtagctgggactacaggtacaccccaccacacccagataatgtttttgatatttttttaggtggaattttgctcatcacccaggctggagtgcaatggtgcgatcctggctcactgcaacctccacctcccggattcaagcaattcttctgcctcagcctcctgagtagcacagattacaggcacatgtcatcacgccttgctaatttttgtgtttttagtagaggcggggtttcaccatgttggccaggctagtcttgaactcctgacctcaggtgatccacccgcctccgcctcccaaactgcagagattataggcacgaaccacaatgcccggcctcatgttttttatttttcaagttgaaatgaggtctctctatgttgcccaggttggtctcaaactcttgagctcaagtaatcctcccaccttggcctcccaaagtgcggggattacaggtgtgagctaccatgcccagccaagatcagtgttaatgaatcaactatatatattacataaggtgtctttaaacagaaataaggttatatattgatcgattggtaacaatgttgtgaccagcagcttacagggtacctagccttgtatttctcctataaataatttgctcgttgagtgtttgtggcaactttgtagcacataactaccaagaataaggactgtaataagagtacgtccctcacaggattgtaatgaagactgagtccatttacataaaggctgagagcagtgtcaagcagatggagaacactgtagaatgtgcgatagctctaacagtggttatcatggctgccctctcacttcttcagagacatgtgtttctaaggtctgcactctgccccaccctccccatccactgtcccccagcccgtttcctcctccacttacttcccagccctgtgccttctgccttctcttttctgagtttgctaagggcactgctggctcaagagcagtaactaacagtctctcgcctcttctctccatggcaaccagtgacctttggagaatgtaaaccttatcaccaatctcttaaagcccttcggtgccttcccaggatgacgtccagctgaggtccttggcaagacccagggcgccccctcctcgctccatcacctcccctgtcacctcccctgcatctccctactccagctgcaccactcttgtgccccagtggctcttgtctgattatttccttcatctccccagctggtcagcagagctggtggtaatcaactcagaccctgtcacctggatgtccagcagttagggactaaaaaaaatcaacaggtcacattctgtcctgcagatcatgataataagatctgtcagacagcagtcagcagtcagagccaaatcttctggacttcagcaggattctgcctcttgctatttcctgttgcctctcttagtgaccttttaagagcattgtggatgcctcccagcctcctgctaaccaccctgtaacctgaacagcctgcagcagccctgcccagtagaacttcctgatgtgatggaaatgctgtgtctgcaccactagccacatgtggccacaggattctcgaaactggtggtgcagttgaggagctgactttatattttatctcattaaatttaaatgtaaatagctacgtgtggcttgttggctagcctattggaaaacacgggcttagagagacacagggagaatcactgtaatgcactaaaagaaggtaaaaaaaaaaaaatcctaagaaatattcctaaaatactttaatatagggctgggtgcggtggctcacatccagcattttgggaagctgaggagggcagatcacttgaggccaggagttcaagaccagcctggccaacatggtgaaaccccgtctctactaaaaatacaaaaaatcgggtgcggtggcgggtgcctgtaatcccagctacgcgggaggctgaggcacgagaatcactcgaacccgggaggcgggggttgcagtgagccgagatcgtgccactgcactccagcctgggcgacagagcgagacttcatctcaaaaacaaaaaacaaaaaccaaaaaaaaaaacttcagcatgattatttaaccaaaatgcaggttagttgttcaccggatgcagagtccaattaacaagagcaaggcctggtaccaaaaaaagtgaatttactccgaaactagcttgggtgaggggtacaaagcatcctgcctttctttaaaagtgctgcttccccttggaagtagaaagtggacacttttataaggtaaggggggaagtgtgcaagggcaagtgggggggtccctctgctagttccgtgcatactctacaggacagttgacttggcaccttcctggttagtaataagctgtagcagtggccaagtgggcatgctttcagtatgccctcccagtgaatgaaagtcctgaggcaacccccaagggtggaagtgccaggccaccacccactggaggtgaaagttccgtgatgggtttgctttggtctgcgaatctactgtcatgtggagagatctgtgctctggaagagcatacagttagaaaagcttgccctgaagggaatgtatggtgaaggggaggtgaaaggttatatttgcatttctgaagggctaagtaggaaaccgggaaccaggggagaggagaagagaagagaggataattttttttaagaaaagcaacatattccctttttcttagaaaaaatggagcactcggttacaggcactcgaatgtagaagtagcaatatataaattatgcattaatgggttataattcactgaaaaatagtaacgtacttcttaactttggctttcagagttcgaaccaacgtggcctcaaccagatttggaatgtcaaaaagcagagtgtctatttgatgaatttgaggaaatctggaactttgggccacccagggtaagataaaacaccttccacgtcataggtatcttcctctctccttccctgcctctcccattagaacctggttttcttcctgagcagcaacaatcttaggcatctttccatgtgactgagtatccaccacattatttttaatgaaatagtattagattgcatggatgtgacataatccatttaacccatcccctactgttggacattcaggttgtttccagagtttcaatattattttatttaataccctaatagttagagcaggccatgctgctatcacaaatagacccaaatatttaatagctcaaaccaataacgtttgtgtcctcctctctgggcagtacagggttggcatacctcctgaagtgaattaggaactacactcattccagcttccagtttggtctttatctgtcagtgccttactgtcctctgcattgttgagtctcagtcaccttgtccaagttccattggccagaaagggctagaagcacagaagggctggaagtggcatttgttcctcactcacattctggtgggaagaacttagtggtgtggccttagctgactgtaagggaggctgggaaatatagtctagcgagtgccctggaaaaagccggcacggcattccccatggaaagctgtcaggcacggctacagtctaccccctgccaaccagtatctgcatggaccctccttccacactcagatgcatttacccccagccccaagagagccaaccgatgcccatgtggtcaccacagccacctccgagtccaagatttccaggtgacatgcagtctcctctctcccagctttaggaatggcttcttctgatctacacacagacacagacacacacacacagacacacacacacacacacacacacacacacgatggagaggggcaggataactgcaactgtaactccattcagaaaagaggcacagcactagctgcccgcagcactggagccctgctgggcagcactggatcaacctctgccctggcagaggagcatgttcctccacaaatccctgcttcagcctctcgagaggctcctccttgtctgttattttccttggccacaaggcaggcaggcagtgggaagtgtgccctcctccggggcaaggagccttcacagcccacttcctgctaataacagtttggggttccacagggtgttttaagactccagtcagctattttaggccagactcatttctctctctctctctctttttttttcttttatgaaatcacaccctgagacccaggctggagtgcagtggtgcgatctcggctcactgcagcctccgcctcccgggttcaagcaatcctcctgcctcagcctcctgagtagctgggactataggcgtgcagtgccacacctagctaatttttgtatttttagtaaagacggggtttcaccatgttggccaggctggtcttgaactcctgacctcagatgatccgcccgcctcggcctcccaaagtgctgggattactggcatgagccactgcgcccagcccagactcatttttctttgagagtaggcttttcccaaaagtaggcttctgagctattcactttcaggcagtcccatgtgccaggaaccacatccaaatttcctccgtggatgggagtctcaggctgccttatctccttgcatgtccccatgcccagctgtctcagcctaagggcaggtaccttgaagtcaagttaaacaataagattggagaccagcaatgccctcagcctggtttttgcagcaggactgagtcccttgttttggctcaatgggaagtctttgctgttcaaagccttagcttctctggctgagtgcggtggctcacgcctgtcatcctagctctttgggaggccgaggtgagcagatcactgaggccaggagttcaagaccagcctggccaacatggtgaaaccctgtctctactaaaaatacaaaaagttagccaggcgtggtggcaggcacctgtaatcccagctactcgggagcctgaggcaggagaatcgcttaaacccaggagatggaggctgcagtgagctgagatcatgccattgcactccagcctgggtaacgagcgaaattccatctctaaaaaaaagaaaaaaaaaaggccttagattctccctttgactttccacgtttgtgcagccttttatctccaatgctccatttcattccatctcctggcttattcttttcttgtcacatctactaaaagcaacaagaagccaccggtattcaggaacattctacctgtccccagagctatatgctcagtaggcatacagttggccctccaggttatctgagactcagatttccagagggctttgcatggctcacaaggtctgaagaacctctgagcctcccgcctgcggtgtctgttcattgactttgccacagtctcaaagaggcactgcatgctgcatgtttgaggtttttgctttggtggcatccatttccagcctcggcttccggcattcctcccccagcagactctctgctgctttccccttactccttctggcagttctgggaggttgcatagggcccttgcaggatgccccaagtccagctgcctctggcctctgggaagcacacccttgacctgccatgtgtaggaagacagcccgcttctgccagggcccaactctgccggcaggtagcaccttccaacctcttcactttggactttataactgtcaggtataaagtcggttgtgtccttacgtttctcaaattcttcaagacacgtcaaccagcctctcctacgcattctctccagctcagtctcaaaacacaccctttctctccagctcactctcaaaacacaccctatcaggccaaccactctttttaaaggacagctcctcaccaatccagtcaggtagccttccccacattgtatcctggaagtgggtgatggactgggtggggaagagggtcatatggcaaatctgtatgtcttacagtaattgtctagcagcccctggtgtcttactttaggccccctggaaactttcagatagtggagttgtctgatacatatcttataacctacagatattaatatatcctcacaggggcacaaaagctcttacaaggatgtttattataataatatttttattgttataatttacatgccataaaactaaccattttaaaatgtataatgcaagggtttttagtatattcacaagattgtgcagctgtcactactaattccagaacattttcattattccagaaggaaaccctattcatattagcaatcactcccccattccgcctttccctaaaacccagcaatcactaatctactttctgtctctgtggatttaaagtaattttaaatttgaaaaatagtatctataaggaaatgtatctagtcacaagcatacagcttgatgaatttgtaaaaattgaacagtcctatgaacataccctgtaagctcaagacatagaatgttaccagcccctgcaagcaagctgcctgctcacttctagtcattaacccctccctcttttccttctagtcattaacccttcagagtaactattctgattaccaatagcatagattagttctgcctgttgttttactttatataaactgtctcattaagtataaacatgtttgtgtatacttgtgtatttctttctatcacaatgatgtttgtgagattcatccatgctgttcctatagacaattctattttgcagcgtagtattccattgcatgactataccacaatttatctgtgatattacaaaggaatacttgggcagtttccagtttggggctataggatagttgtgatacaaatattttagtatagtacatgtcttttggtgaacctgggtacacatttctgttgtgtataccccttaagagtggagctgatgatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcttgcagtgagccgagatcgcgccactgcactccagcctgggcgacagagcgagactccgtctcaaaaaaaaaaaaaaaaaaagagtggagctgatgggtcatagcatgtaaatgcattcaactttagtagatactgtccaacagttttccaaagtgattgtccaacttacttgcctatcagcagtatctgaaaagtctagttgcttcttttcttggccaactctttttttttttttgagatggagttttgctcttgttgcccaggctggagcgcaatggcacgtcctctgctcactgcaacctccgcctcctgggttcaagcaattctcctgcctcagcctcccgagtagctgggattacaggcatgcgccactatgcccggctaattttgtatttttagtagagacagggtttctccatgttggtcaagctggtctcgaactcctaacctcaggtgatccgcccgcctcggcctcccgaagtgctgggattacaggcatgagccaccgcgccaggccggccaactcttttttattttattttattttactttaaagacagggtttcactttgtcacccaggatggaatgcaatggcacgatcacagctcactgcagccttgacctccctggctcgggtgatccctcccacctcaggctcctgaggagctagaactacaggcatgggccatgcccagctaattttttaatttttggtagagacggggtctctgttgtctcagattcctgggttcaagtgatccttctcccttggcctcccaaagttctggtattacaggcatgagccactgcacccagcccatggccagctcttgatacgatctgtctctttcttttctttttttttttttaatttgagaagtgttaaataatctttctttgatattatacataaaccacaccaaaatgtctttcagtaagtaaaatgaaccattttagatacagaaaattctaattagattggcatagttaaggccaaaaatataaagttgacattgctaccttatcttcagcccttgcctttaagaggcaaatgaacacaaaatacaggtgaatcttgcttggttctgagacagtgaaggactttcccccagtatttaaatatatttacataaccagttacataaatctaaatattaaaaaaatctccaatagattttagatggcattcaccatctttgtgaaaagttgaacattactaatgaaatctgatcatatctttagaaggataaacagtgatagcatttactgaatcagaataactgttttttggggttttctttgagacggagttttgctcttgttgcccaggctggagtgcagtggtgccacctcagctcactgcaacctccgccccctggattcaagagattatcctgcctcagcctcccgagtagctgggattacaggctcgccccaccatgcccagctaatttttgtatttttagtagaggcgaggtttcaccatgtcagccaggctggtcttgaactcctgacctcaggtgatccacccgcctcagcctcccaaaatgctaggattacaggcgtgagccaccaggcccagcctattttttttttttttctttttttgagacggagtctcactctgtcacccaggctggagtgcagtggcacaatgtcagctcattgcaacctccacctccggggtttcagtgattctcctgtctcagcctcccaagtagctgggaactacaggcgtgcaccacaagcccagctaatttttgtatttttagtagagacagggttttgccatattggcctggctagtttcaaactcctgacctcaggtgagccacctacctcggcctccgaaagtcctgggattacagacgtgagccactgcactgcctggcccagaaaggactattaattgtagttgcctctgggaatgggggctgcctgcttctttctgtaaccccttctgtgctgtttaaatttttttttttttttttttttttgagacagagtctcgctctgtcgcccaggctggagtgcagtggcgcaatctcggctcactgcaagctccgcctcccaggttcacgccattctcctgcctcagcctcctgagtagctgggactacaggcacccgtcaccacgcccggctaattttttgtattttcagtagagacggggtttcaccatgttagccaggatggtctcgatctcctgaccgtgttatctgcctgcctcggcctcccagagtgctgggattacaggcatgagctaccacgcccggcctttaaatttttactttgggccgggcacggtgccttacgcctgtaatcctaacatttcgagaagctgaggcacgtggtggatcacttgatgtcacgagttcagaccagccactgcactccagcctgggtgacagagtgagactctgtctcaaaaaaaaaaaaaaaagaaagaaaaacttttactttttacatgttattttcatcaatttaatgaatttaaataacaaatgtataaatttgatattaataaaatggaagcatttggtaatcatgttttgggttttgtgcttcctctgcagctctctagatgagaccacctatgaaagactagcagaggaaacgctggactctttagcagagttttttgaagaccttgcagacaagccatacacgtttgaggactatgatgtctcctttggggtacctcttgacttcttttatttttctgtttccccctctaagaattttagttcactaaaatgaagaatttccctccagcagagctaagcatcaagtagcatgtagttgtaggtaggattaaaagactagggttccgggaggtgaaggttgcagtgagccaaaatcacgccactgcactccagcctgggtgacagagcgagactctgtcatagatggatggatggatggatggatggatggatggatggatagatagatagatagatagatagatagctggatagatagataagatagataagacaagactaggcttcaagctgcagtccagctctaccaggcttgttgtgactctgggcaagtcactcagcctctctgagcctcattttccagcttcagtggatacccatgaaggcaaatcagagaggggcctgagtgtgtatttgtccagcaggcagatggagggaacaacaaactagacccgtagttcttcagtagggataagataactgcccaaaagttatttagattacaaagacttgagccctgctcctgtgagacagtgatggggtaggtcgggtgcattcctgggaagcatatttttgaaaagctcacctgggattctaatgtgtatccctaggtcttattcctagagattttgattacttggtctggggtgtggcatgacctgggcagggcactgggatttttaagctccacagatgattccaatatgcagctagtatgagaacttgtttttttttgaaggagtctcactctgtcacccaggctggagtgcagtggcgcaatctcggctcactgctccgcttcctgggttcaagcagttctcctgcctcagcctcccgagtagctgggattataggcatctgccaccatgcccagctaatttttgcattttagtaaagacggggtttcaccatgttggttaggctggtctcgatctcctgacctcaaatggtccacccccatcagccttccaaagttttgggataacaggcgtgagccaccaggtccggcctggtgtgagaacttctgagttggatgaaacattagccccagatcctagaagccagggaagtgctggtctttatcgactggccaccaggtggcagatttgggcaagggtctgcctttgggtttagaattattgcttaggccttaaagtagttcttttttgccagtgggagaaaatccctcaaagatggttttctgggttggttggtttgtttgtctgtttgtttgttttttgagacagagtctccctctgttattcagcctggagtgcagtggcatgatctcactgcaacctctgcctctcgggttcaagcagttctcctgcctcaacctcccaagtagctggaattataggcacacgcccccacacccagctaatttttgtatttttagtagagacagtgtttcaccacgttggccaggctggttttgaactcctgaactcaagtaatcctcccacctcagcctcccaaagtgctaggattacaggtgtgagccaccgcgcctggctcctcaaagatgttaatcctcttgatggcaattgactaataccagaaaatgtcacgaagcgtgcattttggattcaatcatggaattgttgaggacaatcagccatcagactaaagcgatagaaatagtattggaaattgcagcgggagcactgaatggagaaggcactccacataatggaggaggcaaccaagtcttagagaaggtatcaagcctgactataaggacagtgagggaattgaaaaaacaaaaaaggagcaatggagcagggaaggattgaatgcctttcaagtagattcagtaattgctgttagcagcaaaaaatgcagtagtgcctgggcagggctttaaagtgcttgcacaggcagccctagagggccgggctgcttgggaactcttacaaactgacctaccaacttgagcatccacagcctgatcagaggtgggggagttaagggccttctctcccctagcctctactagagcctgtaactgcagggaaaccaagttgcaggctaaactctgcccacacatgcagacattgattagcaagctacaaaaacagtcatgaaacctgtttttataggattagtgaagccccagtttgaccagagtactttgcatgaatgttttgttagaagcaaatgtgccaatattctagcagctgcgtttggtttacttcttcttcttctttttttttttttttgagttgaagcctagctctgtcacccaggctggagtgcagttgtgtgatctcagctcactgcaacctctgcctcccaggttcaagcgattctcccgcctcaacctcctgagtagctgggattacagacatgtaccacaatacagggctaagttttgtatttttagtagaaatggggtttcaccatgttggccaggctggtctcaaactcctgatctcaagtgatccacccgcctcagcctcctaaagtgctgggttaacaggcatgagccacggcacctggcaaaagtcatcttttggtttacttctattgaactgaaaaagtcacaaatatatttatatttaattaaatatatttatataaaaatatggtatttagtattattatttttagagacagggcctcgctctgtcacccaggctggagtgcagtggcacaatcatagctcactgcagcctcaagcttctgggctcaagtgatcgttccacctcagcctccctagtagctgggactacaggcacatgccaccatactcggctaattattttattttatttatgggtctcgctatgtttcccaggctggtctcaaactcctggcctcaagcgattctctcacctcggcctcccaaagcaccgggattacaggtgtgtgccagcacacccagccacaaatctataaatttagaaaggaggactatttctaaagagggtcccactacctgtaggcaggaagcagagcctctggccataactgaaaaacaagcacttccaagaaggggcaaagggaacatgaatttatgctgagaggcgtagctaagcatacatattcaacagattatgggaggatctatgaatattcacaaagggaggatctatgaatatgcacacatgtggagtaagctaacgtgtgcagcatgtctcccatgttcaccttaggcagaaacttaacactaacatgtattacagggcaacaaaatgagactgcatatctacataacctagctatttggtaggctgaagcaggagcatcacttaagactgggagttcgaggcagctgtgagccatgatcgcaccactgttctccagccaggatgacagggcaagaccctgtcttagaccactctgtggtcagtggttatcaggaaggaatgctagtcagttgtgctgaaaccactaaaaaggaagggcagaattaggtgatgagttgataccagtggtgaagtgagtcttttttttttttttctttttgagatggagtcttgctctgttgcccaggctggagtgtagtggtgtgatctcagctcatcgcaacctccacctcctgggttcaagtgattctcttgcctcagcctcccgagtagctgggattacaggcgcctgccaccacgcctggctaatttttttatatttttagtagagactgggttttgccatgttgtcaggctagtcttgaactcctgacctcaggtaatccaactgctttggcctcccaaagtgctgggattacaggcagctccaaagtgctgggattacaggcatgagccaccatgcatggcctgaaataatttttttgaaagggctagtttctatttagcccttaggggaaaaaaaactaatggcagttagggagggaatagaacgagtcctgtttgaactcctttcccatcatggccaaaacttaaaattttttttagatatctctgggctccccttggccaaaagatagtttgttgagtcagttgggagcttagaattttgtttttatttctcacatcattgaatcaatttgaaccaggcgacaaaaccttctgctcccagtagtgggtcagagaaccttcctgattcctgccctgagattgtctctctgaagacaacattaggctagtaggctttccagattctgtaacccattctttcaaaggaagagatgcctatatttttctagccaattcatataccttgagtatcactcaagggcaaaattatttctaacaaatcatttactaattagcaaatgcttaagtgtagatttagaaagctaaagctatacagtggctgccatctatagtttggacttgtgattaactacattgaaatgctaactctgtaccctagagtatgaattcctgattagagtccttcaggtgctaactaatttatgtatttcatgtttgataatattattacttgagctttgtgggagagcagtcttttcctcccctgagatatagctagaagttacctcctttgtgaagccttcctagatactccaagcagacacggtccttcctttctcccttgcccagcactctgaggttgactctgtggagcactgatccctctgtgttataattgtctatttacacgtcagctaccacctataacacactgagttcctcaacagcagggacactgtccattctttgatcccagtgtctggaacagtgccaagtacatagtagggacttaataaatattgattcatatgtaaatgagacttttccaaaacatgctttcgttgatgcctctcagcatttatacaccttttaccaactcgctactggccacatagacaaatgaaagcagtaatccagatacacccaagaggacatctgttcttttttctctctgtggagtgggagacttaagtggcttcttaactggtgtgtcgtctgatcaagtggtccaggtaacaggtggatgccaatgtctggcccaggcatcaccccttactggcactggtcattacagaagacactctaccagagctgaaaggacctcttgtcactaggcagctgtggagtccgctctacttgacctagtaaaatctgcctggagactgttagagtcaccccactacctgaagttacctccaggctgacctcttttttttcccaggtggagtcctggcatcttagatattttaataaggatttgcttgttgacatgttctttattcactaaggtgtcagcatattactgtcttagaactgagggttcttcatcttttttggatcaggacctccctctaagaatctgatgactgctctggtccctctcccaataaaaacttccatactcacctgttaaaaaaaaaaaaaactttaaacaaattaacagagttttattcagcaaagaatgattcataaatcgggaaggctgcaaccagaataggttcagagagactccacggtgtgccacgtggttggagaggatttaggatttatgcacagaaaaaggaaagtgacatgcagaaaatgaaagtgagggcctggtgctggtgcggtgcctcacgcctgtaatcccagcactttgggaggccgaggcgggcagatcatgaggtcaggagatcgagaccatcctggctaacacggtgaaaccctgtctctactaaaaatgcaaaaacttagccgggcgtggtggcaggcacctgtagtcccagctacttgggaggctgaggcaggagaatggtgtgaacctgggaggcggagcttgcagtgagccaggatcccgccactgcactccagcctgggcgacagagcgagacttcatcttaaaaaaaaagaaaagaaaaaggaaaatgaaagtgaggtacagaaacagccaggttggttacagcttggtgtttgccttaaacttggtttgaacagttggccgcctttgattagccaaaactcggtgattggtacaagagtagattgcagttcactatgtacagagaagcccttagatccgaactcaaaataggtaaggaggcagttttagctacacttaagttaacatactcaggagtaccattccagcttcaagctggaagtgtctgcagccccctgagaccacttaatcccaagttaaaaacccctgctcagaggcagcatctttttttttttttttttttttttttttgagagagatctcactctgtcacccaggctggagtgcagtggcacgatctcagctcactgcaaccaccacctcctgggctcaagggattctcttgcctcagtctcccgagtaactgggattacaggcgcgtgccactatgtccagctaatttttttttttgtatttttagtagagatggggtttcaccatgttggcctggctggtcttgaactcttgacctcaagtgatccactggcctcagcctcccaaagtgctggcattagaggtgtgagtcactgttcctggcccagtgaggcaccatctcattggatatggagacaaaggatctggcttagcatcctggatttgtattttctttccaagagtccttaagtgatatctaacttttgcgagctgcagtttcctcagctatgagatgagtgacattaacctcctctcttcagatttataagaggatcaattaaaatggcataggtaaaagtgcatcctagcaagttggtatctactttagaaatgaaggaggtcatatgtatgtgaagtctccagacccaacatgccatcttatatgtgtctatttctacaagtgagctagtgacaacagtaattgctatttttgctcctacatgggtagggctgatcttgactaggaggagtcaataagactcaccagccgggcgtggtggctcacgcctgtaatcccagcactttgggaggccaaggcgggcggatcacgaggtcaggagatcgagaccattctggctaacacggtgaaaccccgtctctactaaaaaaatacaaaaaaattagctgggcgtggtggtgggcgcctgtagtcccagctactcgggaagctgaggcaggagaatggcgtgaacccgggaggcagagcttgcagtgaaccaagatcgagccactgcactctagcctgggtgacagagcgagactccatctcaaaaaaaaaaaaaagactcaccagctgtggccactgtctgtgctaattggctagtgcctgcatctcagaaactgctacatattttgactattccccctgcacttaagggcatgcacactcccaaaatagactcagattgtctaaggaataatgatgatgatgaagagaaagccctctttatctggtctatttgtagtcagttccaaaagcattaagaatttctgctgaactaatgcagctagtttctttcctgtcaccactttccttccaaaatagtttcaagatctgtgggggaaaaaatctatttacagtgaacagactggtgggaggaagttgagcattggggttttctgccctgtgtaaccttgccctaagttgggcagatggtatcacactacctggacatcatctgctcattcactatttgaccagttggtcattcattcacaaatgtcctttttgcaggagggatggaggtgctagacctgcagatgctagcatgaaaagacagatctcctgctgctaaggtgcttaaagtagtggaggtcaggggacaagcaagcagtcaggcagctctgaatgcagaggcaggaagcaccacgaggcaatgggacccacagaggggtagcagggtagaggtgagtgggtctcatgtggggagggaggaagttgactgcagagaaggtgccagggggtgaaaatagcttgagagctgtggagctagaagggctctcacatttgcttattaatatgccctttgaaaaagagtggcctgatacctggagtcactcaaaagatttccaattccgataggaaaaagtcaattttggcttcagtggttgcatgtgcaccccctgatttgctgtatgctgaggcattgtggtgatggacgcaagtgcggagaccttgagcacgcatctgcccctagttcttgccctgagtcctcgaaggaggcaggagagacatcaaggcagacaggcgccgctcatcagtgatgagaccagacctggaactcgcgtcttatactcagtcctctgccctttctgctggattgtggccccccagtatagggtgcaacacacaactggagcatttaagggccacaaagagaacaaattaccaatgattgtgtgttgattctttgagctctttttttttattattatactttaagtgttagggtacatgtgcacaatgtgcaggttagttacatatgtatacatgtgccatgctggtgtgctgcacccattaactcgtcatttagcattaggtatagctcctaaagctatccctccccccttccccctccctccaccccacaacagtccccagagtgtgatgttccccttcctgtgaccatgtgttctcattgttcagttcccacctatgagtgagaatatgcagtgtttgattttttgttcttgcgatagtttactgagaatgatgatttccagtttcatccatgtccctacaaaggacatgaactcatcattttttattgctgcatagtattccatggtgtatatgtgccacattttcttaatccagtctatcattgttggatgagctctttatctcatggaaaaataatttataaaactctgtatgagaggagtgggaaatagtattaacgggtgcggggtttctttttgggacaatggaaatagctggaattagatagtggtgatgtttgcacactttgtgaaatactaaaaactcctgaattatacagttttaagaaacttttatttatttgtttttgagagaagttctctgtgtcacccaggctgaagtgtggtggcgtgatcaccggttattgcagcctcaatctctgaggctcaagcgattctcccacctcagcctaccaagtagatgtgactataggtgcgcaccaccacacccagtgaatttgtaattttttgtaaaaacaaggttttaccatgttgcccagtctggtcttgaactcctgggcccaagcgatcctccctccttgggctcccgaagtgccaggatacaagcatgagtcaccacatgcagcctcagttttaagaaacttttaaataaatgaaatatagtcataccaaaacagtaaaaatgggtttcaggaaaaaaaatgtttttttaaacaaacttacgtattgtataatcccagcccttttaaaaaatgctttcaaaaactggcagtcaactcataaaaggacaaatacttatgattccactgatgaagtagtcaaaagtagtcaaaaatcacagaaacaccaccataaatgtataatttttattttcaattaaaaaaacatcttttttttagtcaaaatcatagaaatagaaagtagacaggtggttactaagggctatgggatggggaaattagtgtctaatgggcatagagtttcagtgttacaaggtgaaaagttctagagttatgctgcccagcagtgtgaatatactttattgttctgtacacttaacatggttaatatggtaaatttagcgttatgtgctttttactatagtaaaattaaaaaaaaaaaaaatggggccgagtgcagtagctcacacctgtaacataatcccagcactttgggaggccgaggtaggaggatcacttgaggccagaagtttgaaaccagcctggtcaatatagcgagacctcatctctacaaaagaaaaatgttaaaattagacaggtgtggtgtctgtagtcccagctctctggaggcagggactgagtcagaggatcacttgagcataggggtttgaggctgcagtgagccatgatcctgccactgctgcagcctgagcaacagagcaagaccctgttgtaaaaacaaacaaacaaaaactggcagctgatacctgagagtgaatatcttttatcgctggttaatgggattgagagaatgcttcatcttatagaaagaacagtgtctttggacccacagagacctggatttaagattagctctgccaattactgagtactctttactatgaacctctgttttcctcatctgtgaaactggaataatgaatcctaccgccaacaattgtagtcaagttggaaacaatttacacaaagtgccaaacaccaagcctggcacagtaggaaccgagtaaatagtggttaatatttttatcagtgtctgcattgctgacgtctccatcatttctatacatttgtttttgaatcagaaaaagatgttattttaaaaaaataacccagtagtgccccttgtcccattcctatcagttatattattattgttactaccctctggaatttcaataactctttgttttttgggttttttgttttgttttgctttgcttttgagacaggatctctgtcgcccagtctggtgtgtagtggtgtgatctcagctcactgcagcctcaacctcctgggctcaggtgatcctcccacttcagcctcccaagtagctgggaccacaggcgcatgccaccacacttggctaatttttgcatttttagtagagacagggttttgccatattgcctaggccggtctggaacttctgggctcaagccatctgcctgcctcggcctcccaaagtgctggaatttcaggcatgagccatgcctggcctaaatagctctctgtgtttgcaaaagtgtgttataagaatcattcagagcctctcgattggatggaggctctagaatgcacagaaaaaggctgccaccgtgtatctctgcaagtcatgcacaagatggggaacagcaggcttccccctgcttaccagttcaaatacagagaactagccctgtagctgtttctttcatatctcacccattctaaagagaccacaggccttagaagtaaaggactcttttgttgaaagagtgttttcaaatttaaatgagcatttattggtcaaagatgcaccaactagtcttttgaagaattcaaggctctttagagaaaaataaagccttggaggagtatctgagaagcttgttagatgcgtgggaagagtctggaaataaaaaacttcatctggagtttctgccttctaccaacagagctgaagctaatgctctcctaagacaagcaaagcagatggtttgcatacttccttaccttccttttacttcctctgtaatagacttgtcatgtctgatgtttgagttgacgtggtactctaatagagttagagtctgcattttttttatgtcctctagtatgttctggttgatggttgagggcaacaaaccagcagtcccagatgccagcaccaagacctgagacaggtcacttaactctccgagcttcaccaccattctcaccttgcagacctcacagggaacagggaaagctctatgagatacaacatcattatgattaatcctattctgattctgaaagcaaagctcttcctacacaaactcctatttctaaatactaaaagacatttctttatggtgtattttgtgtacttgtagaaatggaaagtgttgagataaaacatgaagcaatgatgacaaagtgctaactttttcttgttttaatttctttatgctttttttccacctaatcccctagagtggtgtcttaactgtcaaactgggtggagatctaggaacctatgtgatcaacaagcagacgccaaacaagcaaatctggctatcttctccatccaggtatgtaggtatgttcagaagtcaacatatgtaattcttaaagacttccgaaatgtgacattgtggaccatttaagaaatgtcggctgagcacagtggctgacacctgtaatcccaacactttgagaggctgaggtaggaggatcacttgaggacaggagttcagaaccatcctgggcaacatagtgagtccctgtctctgtaaagaaaataaaaataaagtcacagctgggtgcaggcttacacctgtaatcccagcactttgggaggccaaggcctgtggatcacttgagctcaggagtttgagaccagcctgggcaatgtcacaaagccccacctctactaaaaatataaaaattagccaggtgtggtggcacacgcctatagtcccaactacttggaaggctgaggttgagcctcagcctgagcccaggaggtggaggttgcagtgagccaagatcgcgccactgcactccagcctgggcaacagggccagaccctgtcccaaaaaaaaaaaaaaagtcatcgtcttatgttagcatccttgtaagtgagcctttcctgatattttgcagcctgtctcattctcagtagaaaagtttactctagttacataacttctccctgctgacaatttggatactgtaagcaggcatcaggatattaagatctgaagtgagtagcttataacttttccaaatccagcctagacagttttcctctattaaattattgccctgactttaaaagaagctacttttgaccttgtagcgtttgaacaagttgcactttgtcttcaaagcaagttaaagtttgacctctacttgttttgagcctctcaggtaaagggttatttgaattccctttgcaggttggggttgtgtaccctgtggaggtggtagagtgttatatattgctgctccagggcatttaatccctcctgccttttccattgatgtgctttcaatctagaggaataaaagattgtgttggagacacaatgtggcctgcatagcatctgaaagcctgagaacatgcagggagagacatccctcatccctcagcagcctggctgctgttgaagtggttgtaagaaagtaaaagagaaatgcccacaaaacgttctcagatccagtcattcattagcacttccaaagagagcatgttgactgtgaattgggaaagggccagataaaactagcatagaattctttgaaagactaacggtatttgcattttttaaaaattataaccttactctaccccctaacattgacatcatttttaggtaattaatattttcccatttattattctgtgatctctaatgctttgttcagaataaatagtgtgtttcctttccccacactttcatccaagaagtgtgctagagttcaacaaaaacagcactagaaatcactgtcattctaggaaggccctaattcacagattgtattggtttttagacccagttagtgtgctggaggttggaggattttaacctctgtgggccaactagcctctgtggcctcagtcattcttcctgaccctggctgtgcttgagcctgtgtgttcttatccttcatctccgggggaacgaagtggatcagctcggtccagcgatcacttttggggatcagtggctttgtagatatcgggcaggcacttaccccaaaagaactttccccatatctgaagactgaaaacgtccatatcgtatttggacacactgcccagcaatacgctctagctgtgttcagaagcatgggaatttggaaagatctgctgagcatgccgtttactgtcacagatactatcttcctcaaaaaaaaaaaatatatatatatatatgggggacggggcaggttgagactgggtgagactgaagaggtgccttggccagagcaggccacacccagagaccacaggctccccggtccacctcaggcccctccccttcctgcgccgtttccggcagatccagagtggccaccgccggatgggagtcgggggaagggaggcagagaagcgggccctgaggacaagctctcagtgcttctgtgggaagtggcggcaagacggcagctcccagcgggggatggaggccgagtcagtctgctggtcactggaggccaggatgctgcctaacacagccgtcccgctccgggcctcaccaccagggcggctctccccactcccggcctgctgcccacacagactgcggggttccgggggagcaggacccaggccgttctgcgcctgtcttcttggaaggagcaggccggagcgcgggagcgccgtgtagctgtacctgcgaaggcacaggattccgcgggaagatcccgcagtttcgggccgtcgtcattgtttttatacctgtggcaaatggcatgaccagacacacggttatgtctggagaaacccctgtagaggagcaggaggttgtggacatgctgtggcccggacagtggctgccgagcagttggagcctgcacccgcccaacttggctaaagaagtccccatactctctgtggaaaagatttccagaagctgttgtgtcaatatcaaagcctcaaaacaacaacaacaacaacaaaaacatgaaattatcaacaataaagatcatccttgagtctgctttgaaaagtagggtgaaattctgcagaggcattcaactggcaagataccaccctcatagccagatctgcaggtctcagccatcatgccagggaaaatgctccattcaccactcctcagcttctgcttctggtttcagaggtctctgtattggaggggctttaaagcaagaagggtctttacccacttactcttattcacagatgtgaatatgcaggtccagtggggaaagtgacatgtcctaagtcagaatagagtcaacaagaaaacagggcccaaaatgacttagcctctagtgtataatgggcattgatgagctactggaaatacagagatgaagaaaacacagtcccatcttcaaggagctcaatctagcaagggagacagactctttgtaggtgggaccgggcttccctgcagcagaaggaagcttgaaattggtaacgagcctcagaagggacagaggcaggccaccatgctaccctgagaggatcgcatgtggacacggggctatgacctggccctgctttgacccactagctgtgctgtagggccaggtggagcctggagtggcctgtgctaaggggctactatgagctctttccactcccccaaggcattgcataaataatgtcactttctgtttgcacagcaaaatcagggacacaattttctagaacatggggtgcctcccctccccccagcccaacagaagttctacaatgactgatgggcccttgtttttgtttgagacggaacaccccacagggttccgagtggtgatttgtggcccacaggccactggcaagtggaggcagagctgcagagccctcgggagccacagagggcctgctggccgccacgacatgccaactcagctgctgctggccctcctgtgggcggcagtgctagtgatgtgcagaatcttaggactagtgccaaggaacctataaataccctgggtgacccaggcgtgcactgctgtggtggccttcacagtcagaagatgacaagctgagaaggggagaatcggcccaaggtgagatccacagaaaggccagggccaagatgcggccagcacctcaggctggtggtggtcttacgttgaccatgccagaggccagtccttgattgctccaaaccctctgttcgagggttccaaatgaaatgagcaggtcctcgtgtcaggacctaggttagtttctgaaaaagcatgaaaagcaggcctcctgaacttccccgagtgactgatgcaaagtgcgtcctgcatgcttcacagcaccatggagaggatcttcaggggcaaactgcagactatctgaatgacggcactgaccatcagcaaaccgcagagctgcctgaccaagaaattgcgagacagaagcaatgcttgcaggcgaagaagaaggggccagacacagtggctcacgcctgtaatcccagcactttgggaggccaaggcaggcggatcacttgaggtcaggagtttgagaccagcctgggcaacatagtgaaaccctgtctctactaaaaatacaaaaaattcgccaggcatggtggcaggcacctgtaatcccagctgcttgggagactgagacaggagaattgcttgaacccaggaggcgaaggttgtaacgaactgaaatcgtgccacagcactccatcctgggcgacagagtgagactgtctcaaaaaaaggaggagaagaaggaaaggccaaggcaggaatgaaacaggccatgaatgttggagtgaagcaactggcctcctcgtgctaagcggctactgtgagttctttccactcccccaagacattgcataaataatgtcactttctgacactcaccccgctgaatgtcctgcctctgctcaagggtggtatgatggggacttggcagtggaggggaacagggaaaccagacatggtggtctccccgcttcctggctacaagtccctctgaagaaatccaaaggagtaaagagcttggagagtaggcctctgtagggtgcaagggcacagctggagacggagctcctgaggctgcagctgatgctgcccgctctgcctgaactgcaccaaaaacgtgatgaggccatagcgggagtccacggaggaggatgcctactgcccgacctctagcagagactaagcaaggtgcatgaaaacttgaaccacatgtgtcacacccatgaccactacatgaagatggcccaaaacctggcccaggaattgaagaaagactcttccaatttgctgtaagaaaatggcccagggggcaagcacggtagctcacacctgtaatcctagcactttgggaagctgacgcaggcagatggcttgagctcaggagttccagaccagcctgggcaacatggtgaaaccccgtctctaccaaaaatacaaaaattagccgggtgtggtgatgcatgcctgtggtcccagctactcaggaggctgaggtggaaggattgcctgagtctgtggggcagaggttgcagtgagctgagatcacaccactgcactccagcctgggtgacacagtgagaccccatctcaaaaaaaaaaaaaagaaagaaaacggcccaggaaggctggagggccgccgtgtccattgagagagtgctccaggcactccaaaaagaaaatgaccacaatgggaagaaaccagctgaccatgagaccaagttccaaccttttacaagtggcctgtggctcctggcgccccgcccacagctgacaggggctcagaagtgctagggggaccatgggccaccagggccaccaggagggaggcaggtaacgatgcgagggcttggatgcagaacaccagctggtttgattctgttttccctgtacctgggtcctgaatgcccagaggctcagggaaacaccagccagtgctgctgcctttaaagcacttttgactgatctcttgttaatttagcaactgttattggttgatgctgcagttgctcttattgaagtttgattgatagcattaggatggtaaggcactatttttcaaataaaggttgtttaatataaaaaaaattttgtttttttttctctcagcctttcacattggttcaaaatatctttcatctggctgcatttctgatttttgttttgttttttttttcttaattttatttatttttaattaaaaataattttttttgtcaacatggggtctcactttgttgcctaggttggtctgaaactcgtggcttcaagcaatcctcccacatcagcctcccaaagtgctggggttatgggtgtgagccactgcagcagcctgttttttttgtttgtttgttttttttaatttgacaagttttcaggtcctgtgaaatcagcagtcttacctcccaccttgcgcaccctgaggaggttgcagaataaaggagaattctagggacacgtgggcatcagtgcctgtgctcagagcacctcaggcagtgtggaggggtctagaggttactcaggctctgcctggcaacccgatagcagtatcagagtatagggccaaggggacggtccttgggcttggtgtggtttattagtccttttcctgtgaccctgatggtttggttcactcatttttatctccatactgggaacaggttcaagccccagcatttggttgataatgcaggaatccttgatacttttattgcccaagcttcccttcctggtgacctcatcctagcctcagtctttggaaaagccctccttgagtgctcaggcagactcaggtgccctttcttctgggctcccatgcactctgttcttacctccatcagggtgccacatgcactagtgttatctgctgccgtggccaatcatccatgaggccatgaggaagtggaatgtacatctggtataagaagacatggcagaagccagcctccgatctgtccacacgaatacagcattcccaaagcaacgtgcatgtgccattattcactggatgagcttgaggtggatgaactagcccaccaggctctcaatgtcatgaatttaacactgaattaagaaaaatatgttttaaaaataatagtttaggtgattgctggggtgctaggagaggaaggaatggggaataactgtttaatgggtatagttggccttgtgtatctgtgggttccacatctgattcaaccaaccgtggatcaaaatatttgaaaataaaaaacaaaacaaaaatgatacaaataaaaaccaatataacaactattaacagcatttacattgtactaggcattataagtaatctggagatgacttaaagcatacagaaggatgtgcctaggttagatgcatgtatcgtaccatttcatatcagggacttgagtacccacggattttggtatctgcagatcctggaaccccttccctatggataccaaggaacaacagcactgggtctccttttggggtgatgcagatgttttgaagctaggcagaggtagtggttgcacaacattgtaaatgtactaaatgccaccaaattattcatttttaaatggttaatgtgttatgtgaatttcaccttaacaactaataatattataggtaaggcacaagttacatctgtagcacaaaaatggccctaatttttaaaacactgctccagcatagcaggtatcacatgtgaggtagcaaaagctggagatcaaagtgtgatacctggagacttatcagtaagggtcaaatgttttttcaggttttgagaatcattcttggaattgttccagaagatatatcgtataactcttcttagatgctaagataagaaggcagatatacactagctcattttgtgttattttctagagctttactccagtcaatttcttgggggcagcatttgtggaatcagtggttcatctgaagggctgtgctgtggaattactatgcatttgttttgtcttccagtggacctaagcgttatgactggactgggaaaaactgggtgtactcccacgacggcgtgtccctccatgagctgctggccgcagagctcactaaagccttaaaaaccaaactggacttgtcttccttggcctattccggaaaagatgcttgatgcccagccccgttttaaggacattaaaagctatcaggccaagaccccagcttcattatgcagctgaggtctgttttttgttgttgttgttgtttattttttttattcctgcttttgaggacagttgggctatgtgtcacagctctgtagaaagaatgtgttgcctcctaccttgcccccaagttctgatttttaatttctatggaagattttttggattgtcggatttcctccctcacatgataccccttatcttttataatgtcttatgcctatacctgaatataacaacctttaaaaaagcaaaataataagaaggaaaaattccaggagggaaaatgaattgtcttcactcttcattctttgaaggatttactgcaagaagtacatgaagagcagctggtcaacctgctcactgttctatctccaaatgagacacattaaagggtagcctacaaatgttttcaggcttctttcaaagtgtaagcacttctgagctctttagcattgaagtgtcgaaagcaactcacacgggaagatcatttcttatttgtgctctgtgactgccaaggtgtggcctgcactgggttgtccagggagacctagtgctgtttctcccacatattcacatacgtgtctgtgtgtatatatattttttcaatttaaaggttagtatggaatcagctgctacaagaatgcaaaaaatcttccaaagacaagaaaagaggaaaaaaagccgttttcatgagctgagtgatgtagcgtaacaaacaaaatcatggagctgaggaggtgccttgtaaacatgaaggggcagataaaggaaggagatactcatgttgataaagagagccctggtcctagacatagttcagccacaaagtagttgtccctttgtggacaagtttcccaaattccctggacctctgcttccccatctgttaaatgagagaatagagtatggttgattcccagcattcagtggtcctgtcaagcaacctaacaggctagttctaattccctattgggtagatgaggggatgacaaagaacagtttttaagctatataggaaacattgttattggtgttgccctatcgtgatttcagttgaattcatgtgaaaataatagccatccttggcctggcgcggtggctcacacctgtaatcccagcacttttggaggccaaggtgggtggatcacctgaggtcaggagttcaagaccagcctggccaacatgatgaaaccccgtctctactaaaaatacaaaaaattagccgggcatgatggcaggtgcctgtaatcccagctacttgggaggctgaagcggaagaatcgcttgaacccagaggtggaggttgcagtgagccgagatcgtgccattgcactgtaacctgggtgactgagcaaaactctgtctcaaaataataataacaatataataataataatagccatcctttattgtacccttactgggttaatcgtattataccacattacctcattttaatttttactgacctgcactttatacaaagcaacaagcctccaggacattaaaattcatgcaaagttatgctcatgttatattattttcttacttaaagaaggatttattagtggctgggcatggtggcgtgcacctgtaatcccaggtactcaggaggctgagacgggagaattgcttgaccccaggcggaggaggttacagtgagtcgagatcgtacctgagcgacagagcgagactccgtctcaaaaaaaaaaaaaaggagggtttattaatgagaagtttgtattaatatgtagcaaaggcttttccaatgggtgaataaaaacacattccattaagtcaagctgggagcagtggcatatacctatagtcccagctgcacaggaggctgagacaggaggattgcttgaagccaggaattggagatcagcctgggcaacacagcaagatcctatctcttaaaaaaagaaaaaaaaacctattaataataaaacagtataaacaaaagctaaataggtaaaatattttttctgaaataaaattattttttgagtctgatggaaatgtttaagtgcagtaggccagtgccagtgagaaaataaataacatcatacatgtttgtatgtgtttgcatcttgcttctactgaaagtttcagtgcaccccacttacttagaactcggtgacatgatgtactcctttatctgggacacagcacaaaagaggtatgcagtggggctgctctgacatgaaagtggaagttaaggaatctgggctcttatggggtccttgtgggccagcccttcaggcctattttactttcattttacatatagctctaattggtttgattatctcgttcccaaggcagtgggagatccccatttaaggaaagaaaaggggcctggcacagtggctcatgcctgtaatcccagcactttgggaggctgaggcaagtgtatcacctgaggtcaggagttcaagaccagcctggccaacatggcaaaatcccgtctctactaaaaatattaaaaaattggctgggcgtggtggttcgtgcctataatttcagctactcaggaggctgaggcaggagaatcgctgtaacctggggggtggaggttgcagtgagacgagatcatgccacttcactccagcctggccaacagagccatactccgtctcaaataaataaataaataaataaagggacttcaaacacatgaacagcagccaggggaagaatcaaaatcatattctgtcaagcaaactggaaaagtaccactgtgtgtaccaatagcctccccaccacagaccctgggagcatcgcctcatttatggtgtggtccagtcatccatgtgaaggatgagtttccaggaaaaggttattaaatattcactgtaacatactggaggaggtgaggaattgcataatacaatcttagaaaacttttttttcccctttctattttttgagacaggatctcactttggcactcaggctggaggacagtggtacaatcaaagctcatggcagcctcgacctccctgggcttgggcaatcctcccacaggtgtgcacctccatagctggctaatttgtgtattttttgtagagatggggtttcaccatgttgcccaggctggtctctaacacttaggctcaagtgatccacctgcctcgtcctcccaagatgctgggattacaggtgtgtgccacaggtgttcatcagaaagctttttctattatttttaccttcttgagtgggtagaacctcagccacatagaaaataaaatgttctggcatgacttatttagctctctggaattacaaagaaggaatgaggtgtgtaaaagagaacctgggtttttgaatcacaaatttagaatttaatcgaaactctgcctcttacttgtttgtagacactgacagtggcctcatgttttttttttttttaatctataaaatggagatatctaacatgttgagcctgggcccacaggcaaagcacaatcctgatgtgagaagtactcagttcatgacaactgttgttctcacatgcatagcataatttcatattcacattggaggacttctcccaaaatatggatgacgttccctactcaaccttgaacttaatcaaaatactcagtttacttaacttcgtattagattctgattccctggaaccatttatcgtgtgccttaccatgcttatattttacttgatcttttgcataccttctaaaactattttagccaatttaaaatttgacagtttgcattaaattataggtttacaatatgctttatccagctatacctgccccaaattctgacagatgcttttgccacctctaaaggaagacccatgttcatagtgatggagtttgtgtggactaaccatgcaaggttgccaaggaaaaatcgctttacgcttccaaggtacacactaagatgaaagtaattttagtccgtgtccagttggattcttggcacatagttatcttctgctagaacaaactaaaacagctacatgccagcaagggagaaaggggaaggaggggcaaagttttgaaatttcatgtaaatttatgctgttcaaaacgacgagttcatgactttgtgtatagagtaagaaatgccttttcttttttgagacagagtcttgctctgtcacccaggctggagtgcagtggcacgatctgggctcactacaacctccgcctcctgggttcaagcaattctctgcctcagcctcccgagtagctgggattacaggtgcctgccaccacacccggctaatttttgtatttttagtagagacggggtttcaccatcatggccaggctggtcttgaactcctgacctagtaatccacctgcctccgcctcccaaagtgctgggattacaggcgtgagccactgcacccagccagaaatgccttctaatctttggtttatcttaattagccaggacacttggagtgcatcccgaagtacctgatcagtggcccctttggaatgtgtaaaactcagctcacttatatccctgcatccgctacagagacagaatccaagctcatatgttccatcttctctggctgtatagtttaaggaatggaaggcaccagaacagatttattgaaatgtttattagctgaagatttatttagacagttgaggaaaacatcagcacccagcagtaaaattggctctcaaagattttcttctcctgtggaaagtcagacctctgaggccccatccaggtagaagtactagtgcaagaagggcctctgctgtccacttgtgtttctgtgatctgtgggaacattgttaacgccacatcttgacctcaaattgtttagctcctggccagacacggtggctcacacctgtaatcccagcactttgagaggctgaggcaggtggatcacctgaggttaggagttcgaggccagcctggtcaacatggtaaaaccccgcctctactaaaaatacaaaaattagctggccgtagtggcgcacgcctgttatcccagctactcgggaggctgaggcaggagaattgcttgaacctgggtggtggaggttgcagtgagccgagattacaccactgcactccagcctgggtgacaagagggaaactccattaaaaaaatgtaattcccgtgtctgccatcttaagtgtaaaggtggctaaattatatagaaaaataagacaatatcatttcccaattacattcctttcctaccgcactctatgatgctagctgagatttttccaaaagaaaatggcttaaataaaaccctaagagaaagaaaaactttaaatccctccaaagctcaaaagtaatagaaacagatgagtttggagtcaggatttctctgtaagattgcctaggctgtgtactgcacatctccaggtgccactgttgacagagattataactacaatgtgaagtgaatggtgccactgacagttatgcaaaccgtccagagcatagccacctgatcctgctgggattcctcttgccagtccatcagcagttccccttgaaagtttcaccaaacatcccttaaatctgccctctcctgcccgtccccagtggaggtcctcatcatttttcacctgcatttttgcaggagctttcttatatccaccttcctccttttctctcagcccatcatctagctacacagtctccagggtaagctttcagaaaggcaatctcttgtctgtaaaacctaagcaggaccaaggccaagtttcttagcctgaaaaatgtgcttttctgactgaactgttcaggcactgactctacatataattatgcttttctaccccctcacactcaacactttgactccagcaatcccaaatccccagatccctaagtgtgctgtgctattttcacgtggctctcagacttggccagtgctgtttccattttggtctttattccccacatctctgcctggggggtagattctaccctgaaaaatgttcttggcacagccttgcaaactcctcctccactcagcctctgcctggatgcccttgattgttccatgtcctcagcataccatgtttgtctttcccagcactgacctaccatgtgtcacccctgcttggctgtaccttccatgaggctaggactatgtgtctcctttgttgactgctgttgccctagcatcttgcacagttccttgcacacaattagagctctataaatgtcaaataaatgtgttataattatatgtttaagatagttgttcaaataaactctaaataaccccaactccaagagtgttagcaagaaatataaattttacagaagaatggttggaggtggggagggtgtccacggagtgagttacctcacacaggcacggaaaaacttgaacctcctaaggacatttttaagctctctttcccattttctctcctggattcccattgcctggtctcatttctctcttctccaccacaccacttcctcaaaaattcctttagggtttgttcttaagcttagataggtttcccattctgaaatacaaaggcctgataattagccaacttaccttgttggggatgtggaaggcaagactctcagactccatgactcaggtatattgcaacaattaggctgaaagttccttgagagtaagtgtccaaatcttttcatgtttggttcccagggctcactacagttgttggtatatcataggcactctaatatcttcttaaagaatcaatatcattaaaatggccataactgcccatagcaatttacagattcaatgctatttctatcaaactatcaaggtcatttttgttttattttttttctttgagatagaatctcgctattgtcacccaggctggagtgcagtggcgcgatctcgactcactgcaacctccgcctcccgggttcaagtaattctcctgcctcagcctcccgagtagctgggattacacgtgcctgccaccacacctggctaatttttgtatttttagtagagacaaggcttcaacatgttggccaggctggtcttgaactcctgacctcaggtgatccacctgccttggcctcccaaagtgcagggattacagcatgagccactgtgcccggcccatggtaatttttcacagaatcagaagaaactattctaaaattcatatagcggccaggcgaggtggctcacgcctgtaatcccagcactttgggagacagaggcaggaggatcatctgaggtcaggagttcgagaccagcctgtccaacatggtgaaaccctgtctctactaaaaatacaaaaatttgccagtcgtgatggcgggcacctgtagtcccagctactcgagaggctgaggcaggagaattgcttgaacccgggaggtggaggttgcagtgagccgagatcacgccactgcactccagcctgggcaacagagtgagactccatctcaaaaaaataaataaaataaaataaaataaaattcatatagaaccaaaaaagagcccaaatagccaaagtaatcctgagcaaaaagaacaaagctggaagcatcacattacccaacttcaaactctactacaaggctatagcaactaaaacagcatggcactgctacaaaaacagacaggtagactaacggaacagaatagacaactcagaaataaagccacacacctacagccatctgaacttggacaaactcaacaatattaagtaatggggaaaggactccctattcaaaaagtagtgctgggataactggctatccatatacagaagaatgaaactagactgctacctatccccatatacaaaaattaaatcaagatggattaaagacttaaatgtaagatctcaaactaaaaaatcctagaagagccaggcgcggtggctcatgcctgtaatcccagcactctgggaggctgaggcggatggatcacctgaggataggagttcgaggccaggctggccaacatggtgaaaccctgtctctactaaaaatacaaaaattagctgggcatggtagtgtgtgcctgtaatctcagctactcgggaggctgagacaggagaatcgcttgagcctgggaggcagagtgagcccagatcgcaccattacactccagcctgggtgacaggagcaagattccatctcaaaaaaagaaaaagaaaaaaaaaatcctagaagaaaacctagtaaatgcccttcttatatcagccttgacaaagaagttatgactaaatcctagaaagcaattgcaacaaaaacaaaaatttacaagtgggatctaattaaactaaagagattctgcacagcaagagaagctatcaagggagtaaacagacagcctacagaatgggagaaaatattcacaaattatgcatctgacaaaggtctaatatccagaatctataaggaacttaaatcaacaagcaaaaaccaaataaccccattaaaaagtaggcaaaggacacgaacagacatgtctcaaaagaagaaatacaagtgaccaacgaacatgaaaaaatcctcatcatcactaatcatgagagaaatgcaaatcaaaagcacagtgagatatcatttcataccagcaagaatgactattaaaaaagtcaaaaaataacagatgttgcaagactgcagagaaaagagaacgtttatacactgttggtaggaatgtaaatacattcaaccactgtggagaacagtttggagatttctcaaagaactgaattgaactaccagtcgacccagcaatgccattattgagtatatgcccaaaggaaaataaattgttctatcaaaaagacaaatacacccatgtgttcatcacagcactattcacaatggcaaagacatgaaaccaaaccaggtgctcatcaatggtggattagattgtgtacatatataccaccatatggtacatatacactgtggaatactatgctgccataaaaaagaatgtaatcatgtattttgcagcaatatggatgtagctagaggccattattctaaacaaactaacacagaaacagaaaccaaataatgcatgttctgacttaaaagtgggagctaaacactgaatacacatgggcataaagatgggaacaatagacagtgggggctattagagaggcaagggctgaaaaactacctattcggtgccctgctcactatctgggtgacagagtcattagcactccaaagctcagcatcacacagtatacctttgtaacaaacctgcacatgtaccccctgattctaaaataaaagtcgaaggaaaacaacaaaaacaaaaagaaataactcctgagttggggtctccatctcttagttcagcctattggcagtcccctttttcaagttctaaggagcctgtactagactactcttcatttagtcccataataatccctctttcaattattttgccttcaaacctatagggaagggattggaaatgaagtttcagtcattccctaagtaaaatgtatatacatattttaattgaaacaggatttcactctgttgcccaggctggagtgcagtggtgtggtcatggctcactgcagcctcaacctcctgggctcaagcaatgcttccatctcatcctcccaagtagctgggactacaggctcgtaaattttttagagaacaaaaacacagtctttagatttaaacatgtgaaagcagaaattttaaaaatacaatgaaagagttggaagacagagttgaaattgttcagaaattacagtaaaaatactaagagataggaaatagtcaacttccaaatgagaagaatcacgaaagagagaacagaaaagatagaaaaaaaattatcaaagaaataattcaagaacatttccttaaagtgaagggcatgagattccaggtatattccacatatagaaaaatatcccatacaaaatcacattgttatgaattttcataacatgagggacaaaaaaagataatataagtaaccagagagggaaaaaataaataaacaaaacaagacaaataggtcatatacaaagtaatattcatcacaatagcttcatagttctcaataataacaaaaagcctttaaaattctggttgaagcagttcagacaatgccatcacccaaaaatatgccattttggcatactgattattattagctgaaagcacttgagaaacagcagactgtacaggaagggctttccaacctcctcttttctacctaaaaacaggctagaaaatttcccatgataaaggtgccctccctctactagaaagagaaaaacatccttatcaccagagatagggaatcaatgccaaaatggatctgaacaaacttattggaataacccttgtcttccactacttatccccaatatagctcttagtaatttccccaagcccctttgtcttgtcatttcttcacaaatttatcatttctttgtctaaaacatatataaacttgtctgctatggtgacttcttcgggtctacatttgcttgtgaggactcccaggtacatgtaaaattgtaataagacttgcgtgcttttctactgttaatctttcctgtgtcagtttaattcttaggcctagctggaaacttaagagggtagaacagaaatttttcctttcctacatggtgaagggacattctgtaataaaactagcctcaacattaaaaaaatgtgatgtaataaaaaacaaaggaaaaagaaaacaaaacagaaaagcaattaataacactaggaaacacgaggcattgtacaggataggaaacgtcctgttatgttacacaatgcaacagtgggtattgttttcatcattattataatgaaaatgctaaatagtgatttgaccaacaatccagtttaaaacatttggaggaatgtgaatgtttatggccagaaaatggggagaaaaatggttaaggaaacaaaatctcatcatctagagtgggaaggagactgataattcctaatatgaaccaaaaactcaaacttttttttttttttttgagatggggtctcgctctgtcgcccaggctggagtacagtggcacgatctcagctcactgcaacctctgcctcccaggttcaagagattctcctgcctcagcctcttcagtatttgggactacagttgcacactatgatgtctggctaatttttgtatttttagtagagatggggtttcgccatgttggccaggctggtctcgaactcctgacctcagatgatcagtccgccttggccccccaaagtgctgggattacagacatgagccattgcacctggcctgaaaactcattttatttagatatgttaagggaaatctcaaaataatcagctagaaaaattgaaaatggttgcccatgaggaggggagaactgttattatttatgtcaaataaaatttgtaggaagccattgatttggactgtgctcctgcactaggccccaatagaccaaaccacatggagtcactcttgctaaagttccacgtcaccaaaccaaagctaagtagtttatcttaccttctgggaaattaggggagagaaataatagacaaatccccaaacaggccagttttagctggcatataaggaagtcctctctgttttaaccgtattaggagagtaactttgaaaagaccgtccactttttggtccctgtttctgttttcttctgccttttctgcctataaagctaacttcctctgcccagctcactggagtaccttctctgaatttttagaagacaggctgccctgatccatgaattgcaaatgaaagccaattagatcatttaactaaattcattgtaattttgtcttttgacatttgtaaacaagccttgtagtacttgctaaacaatgggctgggcgcagtagctcacacctgtaatcctagcactttgggaggctgaggtgggtggatcacctgaggtcaggagttcgagaccagcctggtcaacatggtgaaactccgtctctactaaaaattcaaaagttagatgggcatggtagcatgtgcctgtagtcccagctactcaggaagctgaggcaggagaattgcttgaatctgggaggcagaggttgcagtgagctgagatagtgccactgtactccagcctgggcagcagagcaacactctgtctcaaaaaaaaaaacaaaaacaaaaacaaaaaaacaacttgctaaacaacatatgtttattatttggtaaattataaacaataaattcaaaactttaaaaagaaaacattttattgatagctcactgaatacaaatttataaaatattatttatgcattaagtttcagttacacattttcacccatcattacagatgtcatatggagttgctagagtatgagaagagcttcttcatcccaacagctttcaaagtgaagaggcgactcatgcctgtaatcccagcactttgggaggctgaggcgggtggttcacttgaggtcaggagtttgagaccagcctggccaacatggtgaaacctcgtctctactaaaaatacaaaaattagctgggcgtggtggcgcacacctgtaatcccagctactcaggaggctgaggcaggagaatcacttgagcccgtgaggtggaggttgaagtgagccaagatcatgccactgcactccagcctgggtaacaaagcaagattctgtctcaaaaaaaaaaaaaaaaaaaaagtgaacatctgggtcccccagatctcttcagagatatgtaatgttctcctttttccaactacataactctttaagctgggttttcttcatatactccaatgaaaacaacatattgcaacagatggaatgaagaggcaagtagaagaatccagctgttttctattaagccaaacattacaattgtcagctgaagaattctgagattcataaatttggaaagaaaagcttcatttctcataaaagattgcagcctgcagggtggccattctgacaggctaagaaatgtagtctctggccagaagccaaaaacagacactgagggtcagaagaataagatgggcatttatgctgaataggatggccaaatatacatattcaataaactacagtcatgaatattcatgaaaggagaaacatgcacatgctcaattgagcttcatgcctctccatgggacgcgtgtgcaaaaaatggcagcattagcatgatcagagggtggagttttctgtcctctgatatcaaaaggtgaaacagaggacacagaaaccctcactgcacatcctctgtaaactggccagaaccactccattgtgggcagtctgttatcaggaaggaatgctggttagttgtgcagaaactgcaaaaggaaggggcagtgtcagaccattggttgatatcagcggtgcagctcgtctttccaaagggctggtttctgtttaacctgtaggaaggaaatcctaatggcgtttagcaatggagagggtataacaacacatcatggcaagaactcagttttcaaggtttctctggggtccccttggccaagaggtggtgcatccgtttagtcagctgggggacttaggatttcatttttatttctcagagttttataaaactctaaaataattatttgacagccaggtgggagggggtccctggagaaactccaaccagcctgcctactagggtggagccttgggagtttgcagcagggaggagcctggcgcctcctcttcctatgtgaacctgggattctagcagcctggtgggaagcactgtagcaggagactctggccttgcagaggatccctgttcccctcatccctttatttccccttttcacttaataaaaccctgctttactcaccctttaaaccatctgcaagcctaaatttttgtggctgtgggatagacaagaaccttctctttagctgaactaaggaaaagtcctgcaatgatcccattcttcacaccaaatatgttttgtttcaaaagtatagttatttatcataaatatgtcattaatattgttaaatcaaatttagcctaaagctgcctccttatatagtttaagcttgacctaaaggtttctctgtacttagtgaattgtagcctacccagatgtgtaaacaagactgtgaactactcttgtgacaaacattggattttggccaatcaaaggaggtcaactcttgacactgctttcaaataaggcaaatattgagctgtaaacaatctggctgtttctatacctcacttctgttttctgtacgccacttttctgtctctgtccataaatgttcttccaccacgtggctgtgctggagtctctgaacctactctggctgaggaggctgcccaattctcaaactgttcaattaaactcggttaaatttaatttgtctaaggttttcttttaaccatataaacaagtgagtttatgattgttatgtcttttttcttttcttttttgagacaaggtcccactctgtcccccaggctggaatacagtggcatgatcacggctcactgtagtctcgcactcccaggctcaagcgatcctccatctcagcctcctgagtagttgggagtacaagtgcatgcaaccatgcctggctaattttttttttttttgtattttttgtagagatagggttttgctacattgcccaggttgatctcgaactcctgagctcaagtgatcctcttgcctcagccttccaaagtgctgggaccacaggcatgagtcaccacacccagctattatttctaaattaatgaacagatgaacattttcaaaatttctcagttttaattttaaatatgattaaaaggatagatataacacacaaacaaaagctctatggagtcctctataactcaagaatataaagggtcctgagatttttctttaaagagaaccactgcactctcctggcctactagctctccgcaatccatcctgcttctccccttggcaggagagacctgttctagaccctcaaggacccctcataacatcacctagctattatctaaggaatctttctccatttggacttcccatttttttcttccccctttaaggtccccttattcttttcatctaattttgtgtgccacctgcagagtccttcttcttcttcttctccttctccttctccttcttcttctcagagtcttgttctgttgcccaggctggattgcagtggcacgatctcggctcacttcagcctctgccttctgggttccagtgattctcctgcctcaggctcctgggtagctgggactacaggtacccaccatcatgactggctaatttttttgtatttttagtagagacggggtttcacaatgttagccaggatggtctctatctcctgacctcgtgatccggccgcctcggccttccaaagtgctgggattacaggcatgagccaccgcacccggcgactaatttttttttttttttttttttttgagacggagtctcactctgtcgcccaggccggactgcggactgcagtggcacaatctcggctcactgcaagctccgcttcccgggttcacgccattctcctgcctcagcctcccgagtagctgggactacaggcacccgccaccgcgcctggctaattttttgtatttttagtagagacggggtttcaccttgttagccaggatggtctcgatctcctgacctcatgatccacccgcctcggcctcccaaagtgctgggattacaggcgtgagccaccgcgcccggccggcgactaatttttatatttttagtagagacggggtttcgccatgttggctgggctggtcttgaactcctgacctcaggtgatccgcccgccttggcctcccaaagtgttgggattacaggcatgagccaacgcacccggcctgagtcctgcttcttccagatctggtgcccagtcctgacgccagaaagggggtcttgttccagaccccaagagtgttcttggatcttgcctgggaaagaattcagggtaagtcgcagagtataatgaagttaagatagttaattagaggctactcaattacagagtagggcatcctcagaaaacaagaggaggaaggcgctaccttaaatgtagtgcttgcttatgtaggttgtataagaattgtgtactttattacaaaggcttgtgatcagcttgtgacaggctattggtactgttattttcctgttactattgatttcagcaagaatttatgagtacactattatatttaaggcaaaacctattccttaagaatgctttttgttcttaaaatactgggacatttccataagttctgagtctttagttagcaacattaactcattccctcaatcataaacatctcatgaccaagagtgcccagttcctggggaatgtaacccagcaggtttggctttattcggcctttattcaagatggagtcactctggttaggacacctctgacagtccctggaaatccaaaggaacccttctgtgtggcacagggaatggaagaaagaaagagatgaggcaggaaaatagggtctggaggcagaaaacataagccgattcacacttcagctatgacaggaaatatcctctccatagggcgtatgcctgtaactttacttcatcctcttcatttacataggacgtatcctaagtaaccaatggaatcgtctagagggtatttaaactcccaaaaattctgtaacagggcctttgagcccctatgctcgggcccgctcccacactgtggagtgtactttcattttcaataaatcccttcattccttccttgctttctttgtgctttgtgcattttatctaattctttgttcaagacgccaggaacctggacgccctcccctggtaatagagagatgagcctttcaaatgacctgactcctttatcccagccaggtgtgtgcccgaccctgaaaggaggaatagggagggggacgttcaacccggcctcccgctctgtgttagcagcgtctggatgggtcagggtggaggtgggggtgttctaccctgctatttgctcctagagaagcttctctgcttcactagtctcacagttctaaaggcaagaacagccctagtgggatcttccaaggattttagaaaagaatgaataagggaaaaattaaaatattgcagggtgccataaaaacatcccagtaaaacaaacacctttctagatgctcattggaacgtaaatggagctcagcccccatcccttcacaccagatccagtcttcatctttgtggttcactgccccctcaccactcaggaggaaaaccccagcttctgttctggctccccttctctcacttagaatttttcaccagagtttcagaaagatttgtcaggaccactccatgcccaaggtaaaaagtgtaagtggtacaaaaaggtagaaactcatcagacccccaaagagtgtcatttaaccatacaaagccctgataaactccagggcagaagaaaaagctgcatccttgactccactggggcattcttatgtaaactaagatccaagaactgcatcaggagagaaatcaagagccctggggatgttaggatgagccctagaggtgctaagacaggttatttgaaaaaccaaaaagtagactgagattcccttccttttcagggaagaattgagacctttcctttcttactgttcagagtgggggctgataagggtaattatttcctggagccactggctactgccctgggaaggaaatccgctgggttgggggagggaggaaggcagaaccaggcattaactctccctccactacatccctttcccgtacccctcccctcctctccttccccccactccctgcccccgccctccgaaaatgacacttggcctgagaaaggaggaaggtagaataggtggacacttcccttgtcctgctccaggggtgtctcagtgacaaggagatgtgaaaaaagaaggaatcccaaggctccccttggaaagaagggagatctccaggggctttgggaagtcaggttagtactgggaaggctgaagactcccagtagatagcgttcagggctgcatttggctgcaatcctataaaatacattcttctctaaggttggatacaagcatttagaagactggccattaaaaaaataaacagtattaataatattaataatcatgagtgtcagtagtgttgaattttttctggaatcctttcccaagttgcctaatgcccagagaaggaaaataacagtgtttagtagacataaattataggattagtgcaagtagctattgagatgatgagccaaggcttgtaaattggttttgttttggttttcctaattagatgtttgcgcctatctgtgtatgtgtgtgtgtgtttgtgcgtgtgcatgctcgcatgtggttaatttcatgacttttgcctctggctcttcctgattaaaaaaaatacttaaaatggtaggaagtggcacacacccttgatggacctgtgtttatattaaagaattggcttagtaaatttaactgggacaaggaaactgtgaaggactgtatttttgccattatttaataattcatatattcaaccgttactgattgcctattttgaaccaggccacgtgctaggatacaatggttaacaaacacattccctcccctcaaggaattcatggtctagtgaaatacagagatagaaaagaaatagaaaagtatatcaataaaatgcattgtggaaagagttatggtcatagtgtgtactatatgcttatagaggctgcctttgtataaacatacataagactgctttttaaattataaaaggcagtacataggccaggcgtggtggctcacacctgtaatcccagcactttgggaggccgaggcgggtggatcatctgaggccacgagttcgagaccagcctggccaacatggtgaaaccccatttctactaaaaatacaaaaaaaaaaaaaaaattagccaggtgtggtggtgggcgcctcatcccagctatcaggaggctgaggcgggagaatcacttaaacccagacggaggttacagtgagctgaggtggagccattgcactccagcctaggcaacaagagcaaaactccatctcaaaaaaaaaaaaaaaaaaaaaaaggcagtacatagtacaaactgcttgggttttgttgttgttgttttactgtaccatataggttggagatcattccacctagtagctgaacattttaagcagatcatctggctacaggcagtgagtaggatgaactgggagagtgatgagtgagttagagagttagggagggagggtgctgtcggagtgttaccggaaaggggtcccgatccacaccctaagagagggttcttggatctcgcacaagaaagaattcagggcgagtccatacagtaaagtgaaagcaagtttattaagaaagtagagaaataaaagaatggctactccatagacagagcagccccgagggctgctgttgcccatttttatggttattccttgatgatatgctaaacaaggggtggattattcatgcctccctttttagaccatatagggtaacttcctgacgttgccatggcatttgtaaactgtcatggcgctggtgggggcgtagtagtgaggatgaccagaggtcactctcgtggccatcttagtgttggtaggttttggccggctccaacaccggcttgttgttttatcagcaaggtctttatgacccatattctatgcccacctcctgtctcatcctgtgacttagaatgccttaactgtctgggaatgcagcccagtaggtttcagccttattttacccagctcctatttaagataaagttgctctggttcacacgcctctgacaagaacatcttcatgcctgtgcctggttgagagagggaggcctctgcgctgctgctggatctagtgaagattcactcagtctctcaaattcctctacagtttctctaatggaagagaaaagtggtgttattgctgctagggagcaacctagaagttattttatttatgccatagatatggtgggctaagcactgtgccaacgttcaataagtcactgcagattctccataaattattgtgacaagtacaattgtttgtaaggcttagatctaggtgtgtaagtccaaagaagggtgtgaagcatctgtatttctgttatgtagttattaggaaaaaggatgttggggccttaaaatggccatttttaacatttccaaacttgtgttgaattctaagattttataattgtatgtttccagttgagaagagctttgatattggtagctctaaataaataaataccgttgacctggaagagaaggtaaagtttagggagaggcctttttttagctttatatttaaacattttttataaatgtgattcatgggccaggcctggtggctcacacctgtaatcccagcacttttggaggccaatgcaggtggatcacttgaggctaggagttcgagagcagcctggccaacatggtaaaaccccatctctactaaaaattagccaggtgtggtagcacacacctgtaatcccagctactcaggaggctgaggcaggggaatcacttgaacccaggaggcgaaggttgcagtgagccgagattgtgccactgcactccagcctgggtgacagagtcagactccgtctcaaaagcaaaacaaaacaaaatgttattcataatgctcgggttgtaactatagtacttatctagcaaaagcttgcttttttttttttggctttgactaattgaaactgcaagagcttactggcagagtggtgtactggtcaatatttaaccaattctccaaaggggaaaaaccctgatttgtatgtaggatttgtcagtttccatggtataaatagtcttcccacagctggtagggtgaccaacttgttctggtttgccaggggctttcccatttttaggcctgaaagtcctgaatcccagaaaattcctcattccccaggaaatagcttgattggtcaccctaatggctggttgcaagctcccgatatgacagaactggacgagaagttgggcagagatgtgcacatggtaccagcctatgccaggagcagcggcctccagcaccccactgtcagggagtccttggcccagtagaggatggttagcagggcccggctgttgttcatattagctctcaaatttaccaccaaccctgtattagtttcctggagctgctgtaacaaagttccacaaacgggggtcttaaacacagaaatctattatctcacagttctggagggcagaaatagaaaattaaggtatgagcaggactctgctcttttgatggctctagataatccgttgtatgtcttttcctcagcttctggtttcacaggtaatctttggcgatccttgacttgcatctgtgtaactccagtctctacctccatcatcctgtggcattcttctttatttttctttctttttttcttttcgagacagagtttcgctctgttacccaggctggagtgcagtggcgtgatctcggctcactgcaacctctgcctcccaggttcaagcgattctcttgcctctggctcccgagtagctgagattacaggtgtgcgccaccacacccagctaatttttgcatttttagtagaggcggggtttcaccatgctggccaggctggtctcgggctcccgacctcaggtcatctccctgccttggccttctaaagtgctgggattacaagcgtgagccactgcactcggcccatggcattcttcttttggtgcctttgtcttcactgacttcttgtaaggaaatcagtcgtattggattagaggcctaccttattccagtatgatctcattgtcttaatttaactaaaacatctgcaacaaccttatttctaaatgaggtcacattctgaggtattagggtttagtacttcaacatatcttttttttttttttgagacagggtctcattctgtcactcaggctggagtgcagtggtgcaatcacacagctcactgtaactttgaactcctgggctcgagcagtcctcctatctcagcctcccagataggtaagattacaggtacatatcaccatgcctagctaatttttcaaattttttataggggctgggcccagtggctcacaccttgtaatccctgtaatcccaacactttggtaggctgaggcgggcggatcacttgaggtcaagagtttgagaccagcctggccaacatggtaaaatcccatctctactaaaaaaaatacaaaaattagccggatgtggtggtgggtacctatcataccagctactcacaaggctgaggccggaaaatccctggaacccgaggggcggagatcgcagtgaaccgagatcacgccatgcactccagcctgggtgacagagcaagacataaccttaaaaaagaaaaaaaaaaatgtagagatgaagtcttgctgtgttgcccaggctagtctcaaatgcctgggctcaagcaatccttctgcctcagtatcccaaagtgctaggattacaggcatgaggcactgcaccaggcctacatcctcttttttttttttttttttttttttttttgagatagagtcttgctctgtctcccaggctggagtgcagtggcacgacctcggctcactgcaacttccacctcctgggttcaagtgattcttctgcctcagcctccagagtagctaagactacaggcataatatctctcttagatatgacaaataatatcacagagtgtacacccactgtgatgttaggagtaatacctccctatgatattacaagtaatactgcctttagatactacaaataatatcacagggtgtacatctactgtgatattaggagtaatacctcccttagatattacaaataatatcacagggtatacacccacggtgatattaggagtaatatctctcttaagcgatcctcccatctcagcctcacagaattaaaggaattacaggaagagctgctatacctggctggatctatgttttaaaaatataacccagataaccctgtggtcagtgtctaagatgaattggattagaccaagggagaaaaactaaagatgggaatactagtttgggactttgcttgcttgcttgctctcatttagaaaacatttagtagttctacaatgctcaggcactgttctgggagtcacaaatataggattgaataaagtaaataaagcacttgctctcctggagctcacttttcactgggggaatgcagatagtagacacatacatctatagtatcagtaagtgctaatagaaaaatgaagcaggtgagatggatcatgctgagtagaatgtatcttcttttccttccttccttccttccctccctccttccttctttccttccttctttctttccttcctttcttcttttctctttcttcctttctctctctttctttgctttttattgtcttaaaatgtacataacataaaatttaccctcttaaccatttttaagaatacaattcaaggccgggcatggtggctcacacctataatcccagcattttgggaggctgaggcaggcggatcatgaggtcaggagtttgaggccagtctggccaatatgatgaaaccccatctctactaaaaaatacaaaaattagccaggcttggtggcacatgcctgtagtcccagctacccgggaggctgaggcaggagaatagctggaacctgggaggcagaggttgcagtgagctgagatcgcaccactgcactcctgcctggacaagagagcaagactctgtctcaaaaataaataaataaataaataataataataataataatacaattcagtagccttaagtacatttgcattgttatgcagccatcaccaccatccatctccagaatttttttgagtggagctctttttaatagagtagttgaaggcctctgtgacacagtagcatctgagcagaagcttgaatgaagtgagaaaagaatccttttgcatagtttaggggaagtatgttccattcctggtcctggaaatagttaagactatcacaatagtgcaggagaaagatgatacaatacagtttgtgtagctgaaaccccgtcttcagaatgtaaaggagaacagatgggaagtcatgttcctcccagaagtaattcatgtagcagagaagccaatgcagatccacgagacagacaattcagtgctctgcacaagaactgtgctttaagcatggagaggatttttgtatctgtcctgggatcctacatcaaacagcatgtggtgattgtgaacacaaacgtacaagactgtgaaccctaccaagtttccttcttccattagatatgaataaggagtcatgagtttcctttggaatgtcctttagcctgttggtacatgttttgcctgtgacgaatgcagttactcataaatcattgagcacattgggtacagagggcaaaagataaattcctgtatttcctctattcggtcaacagaaatacctctaggccataatccattcatccaatctaataattttgccatccataaaaccttcaggtgttctgaattcaacatctttttttttttttttttttttttttgagacagagtcttgctctgtcacccaggctggagtgcaatggcaggatctcggcttactgcaacctccgcctcccagattcaagcgattctcctgcctcagcctcccgagtagctgggattacaggtgcccgccaccacgcccagctaattttttgtattttcagtagagacggggtgtcaccatgttggccaggctggtctcgaactcttgacctcaggcaatccacccgcctcagcctcccaaagtgctgggattacaggcgtgagccaccatgcctggctgaattcgacatcttgcacctaattcctgttcagttaaagacccaaatcatgatctctgacttacctggatatttgaaagattaacttgctgtggtgataccatactagagtcacaaaatcaagccctaccctgccacagccacctaaaggaaattaggtgatatacaaaagaaattgaccatattgttgtccttttagtgactctcctaattttcttcccctgaaaacttacagagaaatttgagtatgtttgccttaggtggatgcttgtttttttattgatatgaaaagcagtaagaggaaatggagttttttggcctgttaaggaagggcagccactgtaaacacagttgagtgcaaattcacagtgttagaatgttgaagtgtatataatgattttgcaaaattttctacaaggctgatacagtatccaatcaggactaggattagatatattgtcatgtatgtttgcgcaggaaatgcagagactctaaggtgctacaactgcaatttgacatgtgggatagttcactggtaactgttgatctccctgaggtttaagtttacagttccacagctctttatctgaaactcttgggctatgtgttatggaatttagaattttttccgaaatacgttgcatatattgtatattatgacatgatacctccaagaaagacttggagtcacatcctataaacaaacacatgaatatatcccagtgaaatgtatgactatttttactaaaacaaatgagaatcataaatagacttacattacttcaggtcagattttgctgccgaattagtttgggcatcgaacttttggtttcagagacaaaactgtgaaattttagattatattatggggttgtggacccatgtaaccctcctctccgtaattcctaaaagcaagcaattgcatcaaccagtctcatgagtagctgcgattctagaaatcaagaatccggatctgaaattagccgggcatggtggcaggcacttgtaatcccagctactggggaggctgaggcaggagaatcgcttgaacccaggaggaaactgcagtgagctgagatcgtgctgctgcactccagcctgggcaacagagtgagactctgtctcaaaaaaaaaaaaaaaaaaaaaaaaagaatccagatctgggcaggaccgaattgctgacatgcccccggtatagcagagacgttttgcctacatgttacacacctgagtaatagttgtcagcagctgatgaagaagatgaatgtgctcttaatgtccatctttgatttccagtcattttgcttctgggtcttggcttcctgaggaaagaagtctccagtaggtgaatgcagtgatatggagaatactttcttctggctgcatgcagtaactcacacctgtaatcccagcacattgggaggctgaggtgggcagtgcacttgaggttgggagttcgagaccagcctggccaacatggcaaaaccccgtctctactgaaaatacaaaaattagctgggcgtggtgacagacacctgtcatcccagctactcggtaggctgaggcatgagaatcacttgaacttgggaggtagaggttgcagtgagccgagatcgtgcctctgcactccagctgggcaacacagcgagactctgtctcaaaaaaaaaaaagtgtgtgagagagagtactttcttcctgtttcctcataggccagttctctctggcatgtgagtttaacatcagtcacctccttcacacacagcgggtgcattcgtaataggaggtccttagctgggagtttttatggcacatcagtggggcgtgaaaacaccacataggagctaatatatctttgctggctgctttctccggctccgcagcagacagaaaccctatgaatcatatccaggggtcaggtgcaggcaacagacaactaatatctcccaagtgagttgaaaaggatcttgttacccagcatcctaaggaggttgtagccttgggaaccacaggcaagaataattaactcagctcctcggttagtgcctcttcagttcgagatggaatttatttgcaggcatggctccttaatatgccaaacccatgctcaagacatactccttctcctggaaggttaacgtggctcctgtggctgttccatccctgaggaaaagtgaggaccatgctctccaaacaggccatgtgctggactacctctgtttctgtctcctgggattccaatcagcaagtgagcaacgaagcaacccagacagtgtggttcataggatggctgggtaagtggctgtttgttttttccttactgtggatatgtatcagtgaaggaatctgtagaacattcttgatgggaacatttagtcatatcaagtcaataaattaatgtttaggctggg

SEQ ID NO: 426 - DNA, 133945 bp, Homo sapiens
caccctctccgcctttcccgacaccccaaagtagcgctgcgagcagctgcgtctccctcccggggctcgcgcgcccagaaccctccggtctcaaggaagcaggtgacagccgccgcccacccccttcccctccccgccgctgctctctggctcgccaccgcccaactccccctgcccccaccctggattttttttccccttctctcaaacctctaaacaggaaatagcccgaatcacaataatatacgggagcagccgcggaggccgctggcgccctcccattcccggggagcttcccgcactccggcttgggtgaagtgcagccagcgacgcgcgcagggagcgcagggggacaccagcccagcagctagcgccgcgccgcccagcgccccggagagccgccttcgccctcgcccagcgcccgacaccgccggccgcggcggcggccgccaccggctctaggcaagtaccctcctctctctccctccccggcccaggtgctgcctgccgcacgccccgggagagccgccgaggcgcggcagcctgtgcccaggcgtcgccgggatgccttccctcctgtcccgactttggccagggaatgatttggtgggcgcgaattcgcgctggtgccctgggtcgtttgtgcaggcggggtgaggggcagcgcgagtaaacgggttgacatcccctaggtttctctgcagagtgcgctgtgtacttcatcgggcatttactttttcactgcttcctcatcgcccccggggcggcagcgcctcacagggtctctctgggggaatcatcaacaggtgtgcctgaacacgcacctgcggcagccacaggtgtctgggagccaccttttttcttctccctggcctggcaccctttcactcaagggatggaaactgtttcactttctgctgagcttctcttttacccgattaaaagggcctttgaatttctgttggcgcagccaactgcatcgggtgggggcaggagccggtgccttggagtgacgcgggcggagcgcggcgctggttattggaagctggtggggctgcttgagtgcccgctgagcctccgccgcggggcttgaaaactccgcactccagaaagcttgaccgtacagccctgggggtgctcgccctgcccgcgtggtccgcaaaacggggatctcctccgcctaacgcggcagagacttagaaaacatttaaacaacaaaaaaattttcactttctgacccatttgtaagggaggggccgagcttgtcagcatatacagggcgttgtaagtttcccagggctgcattgcaaggttcttctatagggagctctcagtcaaaaccgagttggagatctttatgttggaaaaaggccactgaattccaggcattcttcgagcttgagaagggcattttcaagactattttgaagtttgcacgagggctttctgcgcaactgagtatctcaactatccttattgtctgtggctacttcccagtcccagaggtgggcgagttccgtagggaggcctccgcaggcaggtcttctgtccaggtttctgaacgcatttccacaaacgtggtcggtaggtaagttaagcccttaaccaatccacttgagagatactacctatcctcttcgtttcctggtgaggaacctgttattctagttgctgatagggtgacattctgggtactttcaagtgttcacgtgtcttgccactttaaggtcacgggtgcattacctgtcgaccttttgaaatgcaggatctcaggccccacccagatctgctgaatcaggatcacccaagggatccgtttgcacattaacgtctgagaagtactggcctaggtatgttggagtgaagttttctgtccagtgtcaaggagtgctttacatttccatccggttatgtatttgaatctttgttttgcccaccaggacactctacagccgcatgggttagagcacctgcaccccagggtgacaggatatgtgattaacatactggccggtgatgtttttgattctgtggtaaaatatacataaagtaaaatgtagtattttagccgtttaaaaatggacccttaattcaatattgtgccaccatcaccactacccatttccagaactttttcatcatcccaaacagaaagccattagaataccttattttctcctttccccagcctctgggcttctggatacttttaattattattatattttttggagggaacagaagatgttgactaagaatgtacagtaaatgtctcaaaaaataagagaatgtatagtaaatgtgtagtagaatcacgctggcagaatatgaacaaacatttgggaattcctgggtagacaaaagcactatagctcaaggttcttagagtgcacgtactttctttaatagagacaactataaaccttcaagcgtttcctattttgactgaaatggaatggagttacccagtgctcaacctgctctaattaactaggcatagatgcttgatgatctgtaactctgtgattcttttaactggcctcattttaggtgtcctgttgatactgggtttagtttgtttttgttttttaattattttattttattttatttatttattttgagacggagtctcgctctgtcgcccaggctggagtgcagtggcgccatctcggctcactgcaagctccacctcccaggttcacgccattctcctgcctcagcctcccgagtagctgggactataggcacccgccaccacgcccggctaatttttttgaattttttttcttttttttagtagagacggggtttcaccgtgttagccaggatggtcttgatctcctgacctcgtgatccgcccacctcggccttccaaagtgctgggattacaggcctgagccacggcgcccagccttattttattttttgagacagagtcttgctgtgtttccaggctggagtgcagtggtgtaatcttggttcactgcagcttcaacctctcaggctcaagtgatcctcccacctcagcctcccaagtagctgggactacaggtgcaaactaccatgcctggctaattttgtttatttttgtagaggctagtttaaattattattattatttttttctgtagattgggttcttgctttgctgcccaggctagtcttgaactcctggctttaagccatcctcccgccttggcctcccaaagtgttgggattacaggtgtgagcccccgctattttttcttgacccttgcctcttcttgtgttacgactttcatcacaatgaggttatcaacttgtagtaagaatttacagcttcctttgattgaaaagtccctttgaaatggtgaatgaagataattcaaacggcaagatttggcagaacattctctcttaagaagactcctgcattcacagactttcagaatgttattacttccttttaattctagtaaggcaagagagaaaaggtttaccctcctatagtatgttctcttctgaacaatatagttcagagttttatttggtaaatggatgcattttgcaatctacatgagaaaacatttcttagaaaatgtccagtgaatggttttatcagtgatttcagtgatgtttggggaatcacctggtagcttaataaaaatggaaactctccaaatattccagatttattaagtcaaactctttttttgttgttgttgagatggagtttcgctcttgtcacccaggctggagtgcaacggcgcgatcttggcttactgcaacctctgcttcccaggttcaagcgattttcgtgcctcagcctcccaagtagctgggtttacaggcatgtgccaccacgcttagctaatttttgtatttttagtagagatggggtttctccatgttggtcaggctggtctcaaactcctgacctcaggtgatccacccacctcgacctccaaaagtgctaggattacaggtgtgagccactgcgcccggccaagtcaaagtctttatactacaatctgtgcgtttaatagcaccctgagtgatttttttttttttttttttttgagatagagtctaactctgttatccgggttggagtgcactggtgccatctcagctcactgcaacctctgcctcctgggttcaagcaattctcgtgcctgagcctcccaagcagctgggactacaggcatgcaccacaatgcccagctaatttttagtagagacgggatttgtccatgttggccaggctggtcttgaactcctggcctcaagtgatctgcccacctcggcttccaccttccaaagtgctgagattacgggcatgagccattgcacctggctcaccttgattctgatatgtaattaggtttgggggtcactagaataaacacatgcacacacacacactcgaatgtgagtgcaaaccaagatataaaattaatctgaagttacaagataacacaattttatatacaacatgaaataaaattaacaatagtttcttccttataattaggtagacagttcaagtttggcaaatctaattggcaccttttgatattgatcatcactgaactttagaatccccagtgtccagaactactggtctccataggagatatcaaggtactggactagtatttgatttagcattaatgaacactagttgtgtacccattgtgaaacagggattttcagatatactgtcgttaaatctttacaacaaccttgagcatggtatttctttttttctcattttacggaagagaaaattgaggccactttgggtcttcttgcttgaaaccatggttcttttcctggtcctcccattgtagaataagaaattcctacctactcactccccttcacctccagcagttatattgagatgtaattcatgacaagctatgtacagtattcataaattcttcatgcaaatcttttggaacatcaggtactgtgctaggccctgaggcaaataaaaagatgagccaaaatggaaataaatttcaaaagagcaaaggactcaagagccaagggttcttttcatggtaccctgagacctctgatgagttagattatacttgaatggggtcttaggttggctgggccagctccccagaaaatcaagtcgtgggcatttgcttattgagatgggtcagaagtactctgcatgacagtacctacctggcaccctgaaatgccacacagtgtaaaagaaaggacccaggctttaggtgtggaagaactgacctctgctacaaccagctgaatgaaccacagtaaatctcataagctcgaagctgccacatgctggtatataaaataaaggaaataattatcttgctcctgaattatagtgaagactcaaaaagaccttatttgtacaagggcttgtaaaatgtaaaatgataacaaaggctacgcacctccatttgggagaaatttataatgcaaaggaaacagaaaaagccataaatttacctagcacttttcagtgtactttttagttaactgaggctgttgataattctcttttagctttggccatttttgttttaaacagttacattgagatataattcacatactatacaattcacttatttagtctacaattcaatgtcttttaggatatttgtggagttgttaaccatcaccactgtcaatattaagatattttcaaggctagatgtggtagctcatgcctgtaatcccagcagtttggaaggctgaggtggaaggattgcttgagcctgggagttcaagtccagcctgggcaacatagggagacccctgtctctctctctctttttttttttttgaggcaaagtctcactctatcgcccaggctggagtgcagtggtgcgatctcggctcactgcaagctctgcctcccgggttcacgccattctcctgcctcagcctcctgagtagctgggactacaggtgcccgccaccacgcccggctaattttttgtatttttagtagaaacggggtttcaccatgttagccaggatggtctcgatctcctgacctcgtgatccgcctgcctcagcctcccaaagtgttggaattacaggcgtcagccaccgcgcccggccgcaagggagacccctgtctctacaaaaactttaaaaattagctgggcatggtagtttatgcctatagtcccagctactcaggaggctgagttgggggatcacttgagcccaagagatcggggcttcgccaagctatgatcatgccactgggctctagcctgtgcgacacagtaagatcttgtctcaaaaaaaaaaaaaagatgtttttaatgccccctcagagaacattttccccagtaaaccccctctaccccttagctggctcctgtcaatattccccctctacccctgaccagggtaccaggaatctactttctgtccctatagattagcctattctgaacattttatataaatggaatcatagactatgtggcccttcattgtctggcttctttgacttagcatgtttgcaaggtttatctatgggagccgtggtttactccagtaatcccactcctttgggggaccgaggtgggaggatcacctgagtcctgggcaacatggtgactaaaggcttatgtacattgtagtatgtatctgttccttttttttttttgagtcaggatcttgctctgttgcccaggctggagtgcagtggcacaatcatggttcactgctgcagccttgaacttctggtctcaagcagtcctcctgtctcggcctcccaaagtgctaagattataggtgtgagccatcatgacaggccagtactttattctttctattgctgaataatcatccattgcatggacatgtcatagtttgcttatccattcatccattatgggcatctggattgtttctgctttctggctattatgaataatgttgttatgaacactcatgtacaagtttttatgtggacatacattttcatttgctagagtacatacctagaagtggaaaatatatggtaactccatatttaatattttcaggatttgccatactgttttttagagtggccatattcttctacagtcccatcagccaggtatttggagttccaatttcatgtctgcatccacatacattattactgttgtctgtctttttaaattttaaccacgctagttggtgtgtgattttggtttttacttctctgatggctaatgatgttgaatatttattttttcatgtgcttattagaccattttttttttttttttgagatggagtctggctctgtcgcccaggctggagtgcagtggagtgatctcgtttcactacaagctctgccttccgggttcacaccattctcctgcctcagcctcccgagtagctgggactacaggcgcccaacaccacgcccggctaatttttgttgttatttttcagtagagacggggtttcatcgtgttagccaggatggtctcaatctcctgacctcgtgatccgcccgcctcggcctcccaaagtcctgggattacaggcgtgagccactgcgcctggctattagattattattcctggacttttttcttgattcttttccaagggaaaaggacatagggaaagaggaaattctgttttgaataaattctccagtttcaatggtttagattagaagcatactgaaaatgtaaattgagccatttgctcttttggaatttattgcggcttaggcctctgggcctagtgtaatacctgatgttcctaaagatttgaatgaagaattaatgaatacgtagtttcttggggttgatggggagtacgtaagcagggacttactattctacctgctgatttaatgtccatgaaaataatcatacactaaaatgttaataatacatacacacaaacggactagtgtacatggtggacattttaaactctttcaccaaaatatttattgattaacatctgtcagggccagatgaggtggttcatgcctgtaataccagcactttgggcagatcacttgaatccaagagttcgagaccagcctggccaacatggtgaaacccagtctctactaaaaatatgaaaaattagccaggcatggtggcgtgtgctgtccttccagctactcaggaggctgaggtgggagaatccttttagcctgggaggtccaggctgcagtgagctgtgattgcaccactgcactccacctgggcaacagaacaagaacctgtcgcaaaaaacaaaaaaaaaccccgtcaattctacttactaaaatatacaataatatagtttaaaaatcatattaatacattgtctatatattttattagggtactctttattttattctcaagtactgccaaaagaagagtagactaaggctgggtgcgatgtctcacgcctggaatcctagcactttgggaggccgaggcgtgcggatcacttgaggtcaggagttcgagaccaaagccaggctcacgcctgtaatcccagcactttgggaagctgaggcaggaggatcacctgaggtcaggagttcgagaccagcctggccaacatggtgaaaccctgtctctactaaaaataaaaaaattagctgggcgtggtggcgtgcctgtaatcccagctgcttgggaggctgaggcaagaaaatcgcctgaacccgggaggcggaggttgcagtgagccaagatcacgccattgcactccagcctgggggacaagagcgaaactctgcctcaaaaaaaaaaaaaaaaagaaaaagaaaaaaaagaaaaagaaagtaaaaaaagagtagattaataagacatttttcacgagtcagtgcatttttgttccttgtttcccaagctgcacggcagtgtttttcctttgtagccacagagaattttcttcattctctacagtcacaagccagtattgagtttcttaaatatctgttgtgttttggaggctcgctataacctgacctcaggttatactgtttggatcttgtattatggggaaatgttggtaatagcagagaactagggaagtcagctggatttagaaaaagaaaacttccatttgagggttctttgagacagtagtgggataggtgagtggaagtgtgtagcgcagtgattctcaaacattagtttgcatctgaaccatctggaaggcttgtcaaaatacagattgcaggcccccctcctggagtttctgattgcgtagatctggggcgggggctcaagaatctgtgtctctaacgagtgcccacccaggtcatgctgctgctgctgctctgggaatcccgctttgagaaccagtgctttggaggcctttggaagtgcaggtctggaacttgcatgacggaaggggccgggcttgaggctggtctgggcatcctgtgtgtgcaggggcttggtggagctgtggaagtgggtaccagccaaagcagggcgcatagacaagtgctgaggacgaattgaggaatactgtggggaggggtggctgcgaggaagaacagagctgagagataaggaagaaatggacagagggttatgaggagacctgggtgagtgaagacccacaaactcctatgtaaaggttcaggagagtgaggacatgtatgggtattggtgtcaggggagggactgagtggtcacccggatggtaggtgttgtagctgtgcaggcctggcctttccaccattctttcaggaagggcagcatccccgggcagtgggatgtgctgcttgtggccacagagtcacatgtggactttcctgtaagaaagggaattcttttagtctttctggccgtagtcccagggatcatgactaagttctctccctctttctgcctgtcactgataattaacgtaaaaccaggatgagttttgcaaaccagaagcaagatttctttgtgcgaggagtgactgtcatctctaaaactggagtttgtgtccttgtgtgtatttgcctgctcagcttaatagctttaggcatgcagtcatcttagcataacttgatataagccgattctgagagtgggtgctgacatatggaagtgtttttgacagtccacgttgtgaaggtcaggaggtttgctacaggaaagaaatccaagaagggcagtggcccactggtgttgggtcctctgagagtgagctgtgttctactcttcccactcacgtcacaaagtcgagagaaacatcccctaatttgattgtatatttcattttaaaggaatcctcattgcgtctgaggatgtaaaatatttctcttgggtttcggaaagaggccaaagcctgccccaaggtgttctctgttatcatttggggcatctgttgttagtagagagcaaagtgatttaatatcagtgcttgtaaaccaactgcctggtgacttgctgtatggtcaggaactgagtagcagctccttagtttagactttccaatttgcctttgatcccactcagccctttgcacagatgaacattcctgctggcccctgtaggccctgggtgtgtgattcctctggttaatggacaggactggaaaggaaatatttcacaaccctgcatctgtggagagggagtgtcctggaatccccaagaccacccccagtttcaatgattcactaggaggactcacagtactcagcacagagttgtactcatggctatgatttattatggctcaaagatgcaaagcaaaataagccaaggggagaagtactggagcgaagtccaaggcaagcaggcacaagcttccaaggctcctctcccagtagagttacacatgatgtgcttaattccctggcaactagttgtgaccacacatgtgaaatgttatcaaccagggaagcttataagggactcactgccccgggtttttactgggggattgttacactggtgtcctctgcctaccagctacccaaatttcagactcacacaaggaaagcagctgttcagcataaaccacatggttgtacagtttaaggacagtgtgagactcttaccagtcctggcagtggtgggaatccaaattcccaggcatcagctgagagccaccttgtaagtgggtctttcaaaggataacagtcaggcttgctatgttaccttttggatggggatgagagtggcaggtgaggatggtggtggggacccctgaacttggagaagggatctgttaatgcagcctcggggcctggtgctgcaggagaaggtggaaggaagtgaactggggttttgcacctagatcctgggttcagaatgataactgggattcctgcactacacggatagagaagggtggaaaagagttcaaagtcctgtgcattcattcatccatttattcattcttaacaggcgcttatcaatgcctatgccctttgaggcactgtggcaaggtgctaaggataccacggtgagcagggtaaattctctgctctcatgagacccacttctagagggaatgaatgaggaaaggggcagttaaattcattgctatggggatataccaaaggccctagggtacctacctggtaggcttagtgggagttcagaaggcatgaattttataatcagaccaacctgggtaggaatcacacctctactacttattacctgtgtgccttgggcaagttacttagtcacctggtgcctagatttcttcatttcttcatctaaaaacagggagaatttattgccttttttttaagatagggtctcactgtgttgctcaggctggagtgcagtggtgcaatctcgactcactgcaacttctgcctcctggattcaagtgatcctcctacctcagcctcccaaacagctgggactacaggcatgtgccatcacacctggctaatttttgtattttttgtagagacagggttttaccatattgcccagcctggtctcgaacgcttgagctcaagcaaccctcctgcctcggcctcccaaagtgctgggattacaggcatgagccactgtgcccatcctttcttttaaggctgttgtgagaactaaacaaggccgtgtatgtagagtgcttatttcaggggctggcacagtagaaatgttcactaaataatggcttagcgacgcctagccaaggataggtgtgtattctccggaaagactggcgtctgctgcatcttcactctgcaagtcacttcagaggcatccccttcagccctgggctcatgggtgcacacaagcctgcattcctgccacactgctccgcttgctggtctaagaatgctttcctgtttcatttttctggctttttttttttttttttttttttgagacagggtctcgctctgtcacccaggctggagtacagtggcgcgatctcggctcactgcagcctctgcctcccgagttcaagcgattctcctgcctcagcctcctgagtagctgggactacagcgtgcaccatcatgcccagctaagttttatatttttagtacagacagtgtttcaccatgttgtccaggctggcctcgaattcctgacctcaagtgacccgcctgcctcagcctcccaacgtgctgggattacagatgtgagccaccatgcccagcctcatttttctggctcttgaacacacttttctctttacctggatgccccagatttcttttgtcagcctaaggaatatgtactcctattattaagacccaactcaagtactttctcttttctctctttctctttcccaagccaagtccctcggacaggattgctcatgctctcctatgtcctaccctggttccatggtcactcacatccgtattacagcatgctgggtcgcagttgcttgttgcagcattagactgggtgatttttgaaggcaaggatggcttggtattatttgaatctccagtgccaatcagactgtttgatagggaccagctcaggggatgtagagggagtgaatgaatgagtgtggagttggactggaacacccaacgtgaaatggatacaacgtcagcaaaataggtctctgccctcagagcagagcttacagtctggaggaggcagatggtgcacaggtaaacataaatataacaattagagactaagcagtgacacaagtcccacagcaggtgcagggagtctctcctgggaagagggagaaataggaagttggaatgttgataccctgggcaatgtggggctgttgtctggagtgtgagtggtgttggaggcctgaagggctggtcctgtggggtgcacacctggagagctaggaggcggatagtgaagcagtggtcactggcacctcagctgccagagggcaggattgcagcaagatctaagtgtccacttggaaggctgaagtgctccactcaagcaagacaaactgggttcgaggaacccagggtcaatagaggaagtaccacccagcgagctgaaagacctgtctgagctgggcctacgacctgtgtcttagtcagctcgggctgctataatgaagtaccaatgactgggtgggttaagtaacagacatttgtttctcagcgctctggagacatgaggtttgataccaggtgccaggatggtcaggttcgtggtgagaacccttttcctggcttgcagacagccaccatcttgctgtatgctcacatggcctttcctggatgcattgtgtatggagagagagggagaagagagaagaggagagagagagagagagaagagagaagaggagagagagagagagagagatctgtttctctcattctctctcttgttgtagggacactaatcctatcatgagagtcccaccctcatgacctcatctaaacctgattacctcccaaaagtcctatctccaaatagcatcacactggaggttagggcttcaacatatgaattttggggagatacaaacactcagtccttagcaacccaggccaataacgatttgctgagtaaataatcatggctggcactcttaatagctctttgaatgggacaggacctaaatgttttgcatatagtcattaaaattcattctcaaacaatctcactaggtatggccattatttattatccccggtttacagatgaggaaacccaggccctgaagaatttaagtgatttgctaattaagtgtgaagctgggattctgaccaggcagtctgcttctagggtctaggattttgttgttgttgttgtttgttttttgaggcagagtctcgctctgtcacccaggctggagtacagtgacacgatctcagctcactgcaacctctgcctcccggattcaggtgattctcctgcctcagccccctgagtggctgggattacaggcatgcaccaccacacctagctgattttttttttttcttttgagacggagttttactcttttgccaggctggagtgcagtggcgtgatctcggctcactgcaacctccacctcccgggttcaagcaattctcctgcctcagcctcccaagtagctgggactataggctcgcgccatcacgcccagctaatttttgtatttttagtagagatggtgtttcaccatgttggccaggctgggctcaaactcctggcctcatgtgatccatttgcctcagcctcccgaagtgctgagattacaggcgtgagtcaccgtgcccagccaagtgtagggtcttaatcattatacttgcctgactcttaattaagaagtaaactctaatattattggacgtcagtcaagtgctagttcctgagtgaggagagatattagagatagaaggatgactatgacatcatacctaccttttaggctatctcagaatgctcaaagagatattatttcttgatgtcaattcaaatttgataccaccaagaaacttttatctttgtcttgtaactgtggtccatagaaccaatagcagaggaaagtgttttgcaatttcaaatgtgtctcgtggctgaactgctgacaaaaaaatatgttttttaagaataatgggtgcagtggctcatgtctataatcccagcactttgggaggccaaagcgggaggatcacttgagaccagaagtttgagaccagtctgggtgacatagtgagacttcatctctactgaaaaaaatgaataaataatgagctgagtcatcaagttaaaatgtacagttcattttagtagagtgtatactataatgacaataacttcaatgatggtaaaaggtatcctaaaatttataatactaatcaaatcataatacagtttgagaaaatatagaaccatttatgtaaaaaagtttttttttagctaaaaataaatgtagatgatttggaaatattttacaggaaaatttagaacaaagtgtcttaaagactttgcggtgtttctggatcttgactactagggtcatgtgcaagctcagtgaatgcaggaggaaactacatccatttcctggttgggggtgtctgggaaaaactcagcccatgagggagaaggagaggatgaggaggacagcggccctttggtgagaagcctggtgatggtggtagggtgtgttcactcaggcttcctggagaaggagaaggaagaggatatcctcttgtcatgaactccacatttggattcactggaaacagatttgggaaagagcaggaggagagggaagaggttgggggtgtgggaccctcctgtctccgaggaagcagcaccactgctcagggcaacgctttgtgtgtgtcatcagatgctagaggatccacttccagaaggcactgagcagagtggaaggagtcagccctgctgcgtaggagctgtgcgatccaggccaggttccttagctctgcctgatccctgaattatgtggctcgagtttcattgttctgttggttattctctttctcaggtcggcagcctctcgtcatgagctgaggttttgtccagctgcccacactcttcaaccaatgatcatgagcttctttgttttctttccttctttctttctttctctctctctttctttctttctttctttctttttctttctttctttctttctttctttcttttcttttcttttcttttcttttcttttcttttttttttttgagacagggttttgctttgttgcccaggctggatggagtgtgcagtggtgtgatcacagctcactgcaacgtgtgcagtggtgtgatcacagctcactgcaatgtctgcctcccaggctcaaacgatcctctcgcctcagcctcctgagtagctggaaccacagatgcgcaccaccaggcccggccaatttttgtatttttttgttgagatggagttttgtcatgttgcccaggctggtctcgaactcctgggctcaagtgatctgcccgcttcggcctcccaaagtgctgggaatacaagcatgagccactgtactcagctgagctttttttttcaagggacagaatctggccttgagaagaagaaactttccagcttttcttcaaggtctttgaatctctttctgtgggtccccagatctcctggtcacagctcatcttgtcatttgcctcagatctttcctcctcttcctctactttgacaggtaatatctcagcaggctccatttctttctcgtgacaatgtgcagtcatttcatttcctctctccagaagactttgggcagctcaatccagacatcttaagatgcccctttgggtctgcttttctgttctgttcttccacagggttagtatagaattgatttttctctcccacttggttggtcagaggcatgcttgactttggaacatcaatcactttctggcctcatcgttctgcctgtcatcaacaggatctccatcctgattccaacttaacagccctgttctcttctccaagaggcattaccagttctctcatcttgaaccaacgttccgcccgttccatacccagaccctccatgctgtctggaggtcccatgtctttgtttgctcataatagttataagtgggttttagcttcttcctcttgagtttggatggatttggcttctgctgccagagcctagattgttctcacgtatcagacattggcttatcttgagggtggaggattttcttttcccagctggtttgctataaagtatataatgggctcagtcacagggctggacagatccaggccatcaggaacttctgggctttcacctttttccatcacaagacaaaactggatgagaactttacaaaaaaaaaaaaaagggccagggaccatggcttatgcttgtaatcccagcactttgggaggctgaggtgggcggatcacttgaggtcaggagttcgagaccagcctaaccaacacggcaaaatcctgtctctactaaaaatacaaaaattagccaggcagccgggaggctgggcatggtggcttacacctctagtcccagcactttgggaggccaaggcgggaggatcacctgaggtcgggagtttgagatcagcctgaccaacatggagaaaccccatctctactcaaaatacaaaattagccaggcatggtggagcatgcctgtaatcccagctacttgggagactgaggcaggagaattgcttgaacctgggaggcggatgttgtagtgagctgagatcgcaccactgcactccagcctgggtgacacagtgagattccatctcaaaaaaaataaagggggctgggtgcagtggctcgggcctataatcccagcattttgggaggccaaggcaggcagatcacctgaggtcaggagttcgagaccagtctggccaacatggtaaaactcctgtctctactaaaaatacaaaaaaattagctgagtgtggtggctcacacctgtaatcccagctgctggggaggctgaggtgggagaatcgcttgaaccctggaggcggaggttgcagtgagctgagattgagccactgcactccagcctgggtgatagagtgagacttcatctcaaaaaaaccaaccaaccaaacaaaatgttttactttagtcagtgttatgggttgaattatatttcccacctccaaaatttctatgttcaagtcctaacccccagttcctcagaatgtgcctttatttggagatgcggtgtttatagaggtaatcaagctaaaatgagatcattaaggtggcccctaatccaatctgttcttataagaggaggaaatttggacacagacacatacagagggaaggtaatgtgaagacatagagaaaagatgggccttcccaagccagagagagtggcctggagcagctccttccctcacagccctcgcaggacctaccttcccagcaccttggtcttggactcgcaggcatgagataatgaatttctgttgtttaagccacccagtctgtggtattttgttgtggcagccccaggaaactaattcaggcagaataagaaattctacctaaaaccaagagagctattaatgcagcagctcatggcacagccaccatctcccattgatgagcagtgagagcgagaccaggtctcccatagccaggtccttgtctcgaactcggccgtgtcttctaggtttaccaagagcaatagctctgtagcaggacaaagttcctccatagggccctatactgccacagagtcccctggggccttcctggccagcaggaaggtcacaacactgtggtcactgggcaggcttctgtctggagccaaaccttcgtctagagcaagtaggcgaccgctgccgtgagcgttgggggcaggcttagatcagtatggaactcaaacaccctcagagctgccctggcctccttctttcctcctcaggtgcttaaacacattttaagtcatcgtgttccagttttaattgatgaagcccaaagtatgtgagagggcagaataggaacaccaaacccagtctggggattcaacgaaagaaagctttttggaagaaatgaagccacaactagtcagcaaagaaattaaaatacacttacacggtgtatattatgtgctggatgttacatgtgctcagtgctttccatgtaataactggtgtaattttaaaaacaactctatgaggtaggcactattattagccctgctttacagataactgaggcagagacattgactcttccaaagccacacagctagtcagtgatggagctggacttcaatctcaggcagtgtggccccccaattcatgctacagagtgggaggggtgtgtcagcaggtgcagcgtgggatcatgtgaactactctctccagctgctgtcagccaactgctgtatctcaacacctcatacccggtatagtcactaccaagttcccagttctgatgtgaggggtgttcctttcctaaaattccagagcagaggtgactgatattcccctcacccaatgaatggccaggccacacttgtcttaaaccagctcctgccaagattctgaattctgtgcaacacctcatcgctcatgtgctcccaggcaagggaactgctagaatcctacaattctaggctcatagtagaaacagcgtaggatcaatttctaccaacagtaatagggagcggtgttccctcacataaggagttcaaagttttttatttctctttgtttttttgggagacggagtctcgctgtcgcccaggctggagtgcagtggtgcgatcttggctcactgccacctctgcctcccaagttcaagtgattctcctgccttagcttcccaggtagctgggactacaggcgtgcaccaccatacccagctaatttttgtatttttttagtagagatggggtttcactatgtgttggccaggctggtcttgaactcctgacctcaggtgatccacccgcctcagcctcccaaagtgctgggattacaggcgtgagccactgcacccggcctgaaagttttttatttcttaggactgagagtactcagagaatccatgaattattatatatatgcaagttgtttgggaagggcagtcaattaagtgattttaatgttggcttgaactattcagtagcaggggttaaaaatctaggacgtatcacaaccataagggagggcctccccagttggcccaccagagccaggcccctttcctctgctcccccgagcaggacccaggagcctactttcctttctttgtggtgttttccaccgcccactccagcccttgggtccctgtaccctccagccagcctgtctttcagtctcactgtttttcccacaaggaccactcttcctgaagaggcattaggaatggaaaaagaaggacagatgggagagaggaagggagggagggatgatatccaccgaatgtatatacattacggcattatttattaattcattttgagacagagtctcactctgtcactcaggctggagtgtagtgtcatgatcttggctcactgcaacctccacctcctggttcaagcgattcttatgcctcagcctcccgagtagctgggattacaggtgcccaccaccatgcccggcttttttgtatttttagtacagacagagtttcaccatgttggccaggcaggtcttgaactcctggcctcatgtgatccacccacctcggcctgccacagtgctgggattacaggcgtgagccacagcacctggctgcatttattatttaaaacaagccctgtgttgtggtcttagtctagctgtacgaatgatggaacagaggttcagaaaggtcagtaacttgttcaaggtcaccaggtcttaaacagtagaggtgggattcaaaccaagtctttcccctgtgtcatggggttggtatgactggggacacacaggaatggatgagggtgtcttcaaggtctcatgctgggtgaaccaggaggtggatgcacagaagccggaaaaggcaaggggcactgtagctggcgctgggcacatgggttatttccaatagatactgggttgtgccagaggacaggattggaacgataaatttgatgacatccagttgaaggtaatagtttaaacctagtagtgaatatgttctgaggatgaatgactctgaggagagaaggctagtttgggctgagcaggtgagtctaaaagagccacactaaactttattaactctttggtaattcttttacatcacgtaatctgcttttcttacagtgtattggtggggcatctgagtagcaaatatgtaaagatattatttatgagcatattaaggaggagagaaatgaaatgcttttttcagtagagctaaaaaagcaaaaacaaaaaaattgctgtttccctaactcttctacttttagttaaagcttttttcagctcctgaaaagcagaccacaccctataaaacagactgtacagggcattagttcatttccctttttatacttccaaagcacagtaactgttaaaacacccagtgaagaagcatggccactgtctttctccagaagaaataaagtagaaatattagttgaaaggaaatgtcagtctgatctgtgaagttttatgttcaattttaatcatccagaaagaaaacttgagcatcctgacttaaaagctttttttggatcatgtatatttaaaaacacttttaatagataaatgatttttagttaatagttccagttataaacaatttctagaattgtaagggaattaacccaatatatgcatatttctaaataatttctagaattatgaagtgtcatatctggaaggggtattttggctagatttgttatttcctgtgttattaaccttatgtataattatgagagattccacacaaagatgacaattttaaaaaatgaataaataaattagcaagttgaacagtctgatttatggaagaaaagcaaattctttctaatatttgctaaggcagaattattttcctaatgaaagacacaattttaattttatgtgaaatcatcatagataagaatcactttgtaagagctgcatgttaaatgcatcgaaaattccaataaaaaatgaaactttaaaacatcccatttgcaaaatatcatgtcacttttcactgcaggagaacagcttccaatgggtaacaagtttaagttgattttttcttgttgttagctcaggctttgttacttatttagagtgttgtatagtaatttttatcatgcgtcatcagaaatacaatttgttagaacaatgactgttgtgtgagtgtaattacatcttcctgtatgattaaatgagggctgtatgggacctttactcagaggtggcagctgtagccaaccaagttcagcctataaaagaattcctgggactaactggtactaattgtttgcagaacaaccagtgggagtaatattcatgaatactatggaaatgaaatattccaagaccaaatgctttagcccttgttttttactttattgtggtcagattatattaattgcataatcaggccaagtgaagtgggagctcttggtcttttgttgtttttggaagaaaacttagccttcatctattcagtcctctcatcttataaacagggaaattgaggcttagggagtagttgaagggttatttaaagtcaccaaactgtaatataccctgtcagagttttaagtacactcatatacccctgtcagatttttaagtacactctaccgtatacatgagtatattagtttgtaaatagtgtaccttattacaatttaaaagatattagttctcaaggtaaatattatgaatattcaaaacacaaacattcaattttattttttatttttttgagacagagtctctctctgtcacccaggctggaataaaatgacacgattatagcttactgcagcctcgaacttgtgggctcaagtgatcctcctgcctcagcctcctaaagtgctaggagtacagatgtgagccacgtgcccagcaacactcaaatttttaaagcatgagagaagaaaagaggaaatagatggcataatactttcttcccacatcccaaagattgttggtatgtgcacctcactttggagatttaggtcatttaggtcaaaagaaacttgctattgaggaaagagaatctgtagaagtagggtttaagatttgcggggatggggaagggtttgggacactcactttggacatctaggttaatcagagttactgcataatggctccccttctattttgcttccctttatgtatgggtttgtttagacaaggagcagcatgactcttgtatgttgccatagcacatcaaataggaaaaaaaaatagcttgaagaagttggtgaggaaggagctatttaagtcagaactctcagagtgacaaactcaactaaaattaaatttcacaaaagtcaatttattagctttcataaacgataactgtaatctcctagggtgacagtggcctccggcatagctggatccagaagctcgagtgatgtcatgacatttttcttggtactgtttttctcaactattgtaatactagtgaagagccctctccatgtggcggggcacatgactactatcaagagctccaacttcctatcagccctggttagcaaatccaatggaaacaggacatttccctcctacagtcatctgttcaccccagggaagactggttgacccagtatgtggatcatgtgtaccatggcccattgagtgggccaccatgataggtggtccacctttacccatggacaaagggtaaggaagctcttcaaagccaagaggagacttaaagaaaatggagatgaggtagattctgaacctctccaaacgatatattttcatgatggcagggatcacacatgttgggttctagaggtatttaaaaagttgtttttaataataattttaaaaacccaccaaattgtttcttaattaattaatctttgctattgacccaagcaaggagtttatagtgcttagaaatgcattgctataaaatgacaactagaattccttcctcacttgtcaaagcacaggcttttagagagagagatatttgtagaaagagcaaatctgtttctgattttagttcatccagtggcaggcaggctttttggaccaattattaccagaccttgagataaatcacctcatgagccattagttcttgaaggattagcggcctcaaagatttatgtgcggattaattggagtgtacattagatcgccgtgtttaaaaccgcagtcattcctgcaaatcattttcattagtgctttattcagaattatttagccttgtataatactgccattgcagggaaatctgaaagacgttctctttatttgtggtctgcccccccatcaccacggttgtgtttaatagatctagctagggctacatagagaacatccaaaggaacagcagcttccattaaagattagttcagttgcttcaggtgaacagtgactgaaatttacaggaccttgtaccgagagagacaagatgaggtacaagaaatatatcggtattctggaagcagcagttggtattaccccacttaacaaaagagaacttctacctgagagcagaagacacgtgaacctttggcaacaacctgggtaagcagaggaggctggaagcttctcactatagatgtaaatactttttgtctgttttggggacccatatagaaaaaagggtcctctgtcttgtggggataataaatgagttcttcattaagaacttgtttcttcttggtggagaatggaactcctagactgatttaaaaataggaatgaaattgttggataatattctaatacccaagaagatgaataatgggtgtgtctagagcccatttttacaatctagacatttaattttctgattttgaaaatgtttttttaacatggtttacaaatgtagcaattcttaagaatgaagaaaatatgccttattactataatgtttttcaacaatacaagtgtttttctgattaaagtgtatgtgcagactatgcttcggggaaatactttgcttgaaacagcagttttccttccacatctctttctgcagccccactgatttaccatgatgaagaaaggttgagaagttctttatgcatagctacaagccttagttctaactttcttctctgaagtcttcttttgtgcttcttacacattaaagacaaggtgaatttaaggtgcctttatggtagacgatatttttagggcctgaatttaattttcaaactgaatgagtcacacagtagcatgtactgatcaacttgcatctgtgtagcaaatatttctttttaacaattagatagttactagcttatttttatcatatgagcaatgtacattcattatagaagatttagaaaatacagaaaaataagggggaaaattacccattgtcctatctccccaagagaactactagaatcgtttaggtcagtggttgtcaacggggaggtggaaatagggaattttgctccccaggggacaattgtcaatgtctggggcattttttttgttgttatagcccaggggttgctattggcatctagttggtagagtctggggatactgcccaacatcccacaaggtacaggacagccccctgcaacaacgaattatccagcccacagtgtcaacggtgccactggtgagacatttgatttagataggttttcttcccatctgtaaaagggtacattttattagaaaaaaataaatatttctttgggaaatcttagagatgctttagaatggaattctgaggcaacattttaattatattattgttattctactgttattgtcttgaaagtaaatggaagtgtgtatatgcgtggagagggcagggggcatacagagactctatcagagtccatgtaggttaatgctgttcagccagggctgtggaaaacattgtaatgactaaactgagattctccaagtagcctctcgtgattgggcatgcggtagcctagaccttagtctcagaatgacgaaagtttagaactgggaggacctttgccagggatggcaaacaggtttcatgtggaagacaggtgccagttgatggttggctgcttggagtatctagctaggaggacctggaggccaaacctgggcttagcgggaaaggaatatcgcaactgattagggatgtttgttctgaacctatgattagggaattggggagatgcaagccgtggcctatatatttaccattcctgaattctagtttagtgttcgaattttacaagtgggaaactcagcctcattggagtcatcctgatcaagggcctggctctcagacagaaacgggatgttcttagtttctgcctcagggtctttcatgaagggattcggcctaaacaagctcccatgattcagatgtgcaagttgattgctagattattaatttttgttcagagataacctctactagcaattggaataagtaccctaaatagacctaaatagatctctgcttctcctcatttccccaaatcaaaccaaacagaagtcaaattattacaaagtagcccttaataagggaagttgaatgtgccttttttttgagagagagaacgtttccttaagctggatgaaatagcattggatcagaggacgaacaagatcttccttgtacctataatactctttgagttctgtgaatacacagggataaaacatttcactgatcacttttttttttttttttgagacagtatttagctcttgctgcccaggctggagtgcaatggcacaatcttggctcactgcaacctccgcctcccgggttccagagattctcttgcctcagcctcccgagtagcttggattacaggcatgcgccaccacgtctggctaattttgtatttttagtggacacggggtttctccacgttggtcagggtggtctcgaactccttaccttaggtgatctgcccatcttggcctcccaaagtgttaggattacaggcatgagccactgtgcctggccctttcttttttatattttttttaatttttttttttttttgagacacagtctcaaaaaaaaaaaagccacaattggaagtcaggttataatccagtatttaaaacctcaaggaattcattcattcttctcatgcttccccctctgtaatacttttttttttttttttgagacggagtcacactttgtcgcccaggaggctggagtacagtggcaggatcttggctcactgtaatctctgccttccgggttgaagcaattctcctgtctccacctcccaagtagctgggactacagataccaccatgcctagctatttttgtattctcagtagagatgcagttttaccatgttggccgggctagtctcgaactcctgaccccaagtgatccacccgcctcggcctcccaaagtgctgggattataggcatgagccaccgcccccctctgtaatactttttcttgctgtctgcaagcagggatgtgcttgggcttctattctgcaaactgtacagttgcatgattggccaaaacgaatggctaccaaccgacaattgactgagtattgcaagttcattgaaacagagattggatgatttacacatgtgtatatttgcccattgcccagcacatggtaggtgctcaacaaatattttccagtgctaactcggtttcagtatagccacaatggagaaagatagaataaaaataattgatacccaaatactaacctaaaatacccagccacctatgaatcttccttttgaaatctgtaaagtttttcagctttaactcatgttacctgacaattttacattatctctcaatactattgaaatccaagaatatattttatttctttctgccaaatgttcttttaatttagaggccctattcaataatagtgtattttagaaacaactgattgttattgggggtttgtatacatgaaaaaactccttggattattatagagaaagttaaagccaggatacattagaaatgcagaaaactccttaaattaaaaagcaagccattttaataaaagaaataagctctccttggagctgatacctgtagaaaagtttgcatatgaagccaaaagcataactaagtacctctcgatttgtaagccatttatttatctttggaagtaataatagaaaccatgtatgggctgggctttaatcccgttgcttgctttgtaggatgtccagatggcatagctttagcctttgcctacatttcctgctgatcctgggagaagggaaatgtgcctcccgcctgtacaaataaaactgacaccatcttttctttctatttcatcgtgtagggagtagagtgttttgcacagacgccacaatatcagtttgtctagcaaacagaagagtatgtccagaagtggtgagaggctgcattcttcctcccactgaaagtttttcctgtgactgcccgagtgaagctgccttcacaagctcaacccagaaaggagcttgcctccttgtggtattcgaaaggcacatgcaggcttcataagaatttgcagaaggggtatttcttgggttttcttggtcttaggggtaaaacgagaaagtatttgccatctttcctgctggtgagcaacccataaatataaacacaagcctaggccagttgcggtggctcatgcctgtaatcccagcactttaggaggccaaggtggatggatcacttgaggtcaggagttcgacaccagccgggccaacgtggtgaaaccctgtttctactgaaaatacaaaaattagccggccgtggtggcacgtgcctgtaatcccagctacctgagaggctgaggcaggaaaactgcttgaacccaggaggcggtggttgcagtgagccgagattgtgccactgcactccagcctgggcgacaagtgagactgtctcaaaaaacaaaaccataaacacaagccagtgttataaatgctatgaaaaacaaattcccttttggtttaaaatgttttctctgtagtatactttggaatggtaaattttatgttatgtgtattttactataataaaaaatttttttcttttctttttttttttttgagacaagagtttcactcttgtcgccaggctggaatgcagtggtgagatctcacctcactgcaacctctgcctcctgggttccagtgattctcctgcctcagcctcctgagtagctgggattacagcacctccccaccatgcccagctaatttttgtatttttagtagagatggggtttcaccatgttggccaggctggtcttgatcgaactcctggcctcaggtgatccacccgcctcagccttccaaagtgctgggattacaggcgtgagccaccatgcccagcctaaaatattttgttctagctattttctcacccgctgatatttgtttaacctgaaaggcgaattcttataagatcttgtttctcagagtgaccctcaggtggactggtgataccaaagtttaggtggcaattcactttctccattttttgaagactgaaaacaggggcagcaattccattatttctgagagaaatgaaaacatatgtccacataaacaattgtacacaagtgttcataatgaccaaagagtagaaacaacccaaacttccaccaactgaagaatagataataaaatgtggtatatccatacaatgtaatattatttggccataaaaaggaatgaagtgctgatgtatgctataacatcaatgaaccctgaatacattatgctaagtaaaagaaggcagtcacaaaaggcctcatatcatatgagtccattcatatgaaatatccagaatagataaatctatagagtaaaaaattagattggtggttgcctagggccaagaggcagagagagaattgggggctcagggaatgatggctaatggttatggggcttttcttgtggggttaatgaagatcttctaaaatggattgtgggccgggcgcagtggctgacgcctgtaatcccagcactttgggaagtcgaggtgggtggatcacctgaggtcgggagttcaagaccagcctgaccaacatggagaaaccccgtctctactaaaaatacaaaattagccgggcgtggtggcgcatgcctgtaatcccagctttccgggaggttgaggcaggagaattgcttgaaccagcaggcagaggttgcggtgagccgatatcacaccattgcactctagcctgggcaacaagagcaaaactccgtctcaaaaaaaaaaaaaaaggattgtggtgacagttgcataactctgtgaaggtactaaaagccatcctaaaaacgggcaaattgtatggtatgtggacttcagtgcatttcccaaaatcttaccattgcagggaatgagcatgttggatttttaacaacactgtcttttccagggtgcgaagtaccacattactgtcatctccctgtgagtgggattggcaccccggctgcagctccaggagcaagtactccaggaagcacagagctgtaccagtacacggcccacgttgccaggtatttgcttatttaatctctcatcaacctagttactggtctcccccaaaatttgttcgaatagttaccgttttcacattctagaggtagtcagagttaccatttttgatgttgctgatatatacattttcatagaaaatttaatggtaatgtcctatttaccaaagaatagaaacatcttacctgaattaatggactgaattgataggtataactttgccatggttggtgaatgcttattgaggatgacctttctggcatgtaagtaagtacaacttctgtggttcaaaataaatgcctaaattggcatttggtgctgatgatgtctgggattggaggtcattttaataggttatattttttcattatcattgaggtagtaaaattatataacagtggtaagcactttgatgaaaagataaaggacatcagtcacactggcttctaaagattaattatgtccaagcttttagtgaaagagctaggagcgagtattatctatttactgattcacttttaagagtgaatcaaatgagatttacaaggtcttaaattttgacagatgtgggatgcatttgttttttgttacactttgacctctgtttataggccaggccatggctagctggaatggggttgtaatttttttcatgtgcttgttttataattcctgtctgttgaagttggcagcccctacttgggtggattccagataaatgtgtgaactggagtttagtggagtgtgaatggcacactccagaagagcagatagtcgttcagatcctagtcctgctgccttctaattgtgtgatcttgggcacatgtcttaatgcttctgagcctcagatccttcatctgtaaaaagggaacgtcgacatgaaactaaatgagttaatgggcccagcaagtaccaggcccatgctaaggcctttctcagtgtctagttgtccaaatgaggacattcaagtgggggaagtcctcattttccactgaattaacagggctggatgtgggttttgtttactgaaatgttctctctggagctctttttttttttttttttttttttttttttttgagacggagtctcgctctgtcgcccaggctggagtgcagtggtgcgatctcggctcactgcaagctccgccctctggagctcttaaaggtcccagccaggcaaggcagctcatacctataatcccactgttttgggaagtagaggtgggaggatcgcttgaggccaagagtttgaaaccagcctaggcaacatagtgagaccctgtctctatttaaaaaaaaataataataataatttgctgggcatggtggtgtgctcctgtagtcctagctacatgagaagctgaggtgggaggatcgcttgagcccaggaattcgaggctgcagtgagctataattgcaccactgcaccccagcctgggcaacagagtgagactctatctcagcaacaaaaaaacgtcccaaacatgagaagacagatacctgctcagactccagaaattgttttccttgtctgggcgcggtggctcatgcctgtaatcccagcaatttgggaggccaatgtggaaggatggcttgagcccaggagtttgagaccagcccgggcaacatggcgaaaccccatctctgcaaaaaatacaaaatattagccaggcgtggtggtgcctgccagtaatcccagctactcgggaggctgaggcacgagaatcacttgaacccaggaggtggaggttacagtgagctgagatcgtgccactgcattccagccttgcgatacagagaaactgtctcaaaaaagaaaaaaattgttctcctaaaatctttagatttctagataggatctgttgattattcaaataaattggaggggtactatagagtatggcaaagagagattggagctagcattgtctgttggaggaaaggctctttctgactctagccagcccctcctgataaatacctcccttgttctggttccctgtacctgcactatgaactgcatgcctttccaacatcaatttgattgcctaagtcagtgccttactccagagttctttcatgtgtaaacacttaagcttggctttctgggacgaatcagccttgggtgagcttgagtgatgtggatttttttcccaggcatctcacgtcgccctagtttcagatccagcaaacactcattaagggccttttatgtgccaagcaaggggcaaggtgctttcacccatatggttcctcctcacaacaaccctaagaggaaagtattaactagctcccatttgtaaataaagaacttgagattcaaagattttaaatgattcctttgtggttgcacagcccctgacttccaagttcagtgagatttgtatttctatactaattctacagagcttgaagacttaactccttaactcagacgagtaaaaaggtttctctctaaggccagtttggatcaattgctaggtggctgcctggagttaaggatttgcaagtgccgctcaagtttgttgagcaagaatgttgtgatcgattggcaatgtccggcgtgggtggagcaggtgtctgccaaaccgctctggacctgaggtttctaatcatcagcctctactcattctgctctcctctgccattctggagtctctcctctgatgagcactgtttgcctgaggctggatttttgcaactttaaggggctttgattatcacctttctgacttggcaggatcatctttgccttcagaaataatgctaaggctttgggaggctgaggcgggaggatcgcttaagcccaggagttcaagagcacctgggcgacatagaccgaccctgtctccattaaaaaaaaaaaaagaaggccaggcatggtggttcgcacctataatcatagcactttcagaggctgaggcaggaggagcccttgagcccaggagttcaagaccaacctgggcaacataaggagaccctgtctctttttcaattttataattttatataaaaaaattaataaataaaaattaaaaaaaagatgctaatagtctggtgaagagcttcattttctagatacgaaatctcattgttaggcaatttagataccttaaagttatcactgactcaccccatcatataggcttagaaaagtgagttgaggttggggtcagtggctcacgcctgtaatcctagcactttgggaggccgatgtgggtggatcacctgaggtcaggagttccagaccagcctggccaacatggtgaaacctcatctctactaaaaatacaaaaattagcctggtgtggtgctgggcacctacaataccagctactcaggaggctgaggcaggagaatcacttgaacctggtgggccagagattgcagtgagccgagatcgtgccacttcactccagcctgggtgaaagggcgaaagagtgaaactccatttccaaaaaaaaaaaaaaaaaaaaaaggaaaagaaaacaaaagaagtgagttgaaggtgaaagctcgaaacttttacttctgtgcacctgggagcccctctatagcttctttccctcttccctaggggctcctcggtttacaggaattctcagggaaatcactccagcagccaaacttccatactgggatggacagacccagagcagtggcacatcggtatcgcctggagggcgtgttaaaacacggattcctgggccccacccccagggtttctgcttcaggcagtctggggtaagtcccaggaatttgcatgtctggtttccactactttgacaaccactaacctggagagtacttgtaatggctggtttagagcatgggcttgtttacagatggtgtgtgtggccagtttctctatctgtggggaagggattctgtcctcaaatatttaatgagcatctcgcactgtgctgctgagggaaatgtagaggaatattaagcttgtccctggtagactttggagcctaatttggaatcagtaaattgcattgctgtgtgtaaagtactgccctcacccccttaagaggatgtggcagaaggcctgaagcagtgactaagtcaggggaggattcctgcggcaggtgatatttgaaaggaaacctgaggctaaaaagttattggctatgtgcacttatgggggaagagaaactcggagcagagcctgtacattaaaagagtctggagatgctgcactaggtgagaagaaaaggtttgtgtttgttctgagaattccattgtgactcctatatgtaaaccagaaagtatcagagacaaagtctcaatcaacttagagagtttggccaggcagggtggctcacgcctgtaatcctagcactttgggaggcccaggctggaagatcgcttgaggccaggagtttgagaccagcctggccaacatggtgaaacaccatctctactaaaaatacaaaaattagctgggtatgtggtgtgcacctgtaatcccagcttcttgggaagctgaggcaccagaactgcttgaacctgggaggcagaggttgcggtgagctgagattgccactgcactccagcctgcgcaacagagtgagactctgtcccaaaaaaaaagaaaaatttagaaagtttattttgccaaggttacaggacatgcccataacacaggctcaggaggtcctaacgacatgtgcccagggtggtcagagtacagcttgcttttatacattttagggagacataatacatcaatcaatacatgtaagattttttttttttttttttttttttttgagacggagtctcgttctgtcgcccaggcgggagtgctgtggcgcgatctccgctcactgcaagctccgccttccgggttcacgccattctcctgcctcagcctcccgagtagctgggactacaggcgcccgccactgcgcccggctaattttttgtgtttttagtagagacggggtttcaccgtggtctcgatctcctgacctcgtgatccgcccgcctcggcctcccaaagtgctgggattacaggcgtgagccaccgcgcccggccaatacatgtaagatttactacattggttccatctggcagagcaggacaactcaaaaggggtagaggggctgccaggtcataggtactctactctaggggtacctaggggctgccaggtcataagtactgctattctaaagcctccaagtaacaggctttagagaataaactgtaaacatttcttatcagacttcaggtcagtgttgatgttaatattggaggggtatgatggggcatgtccaacccccacttcccttcatggcctgaaccagtctttcaggttaaattttagggttccccggccaaggaggaagtccattcagatggttgcaggggcccttcaaattttatttttggtttatagatatgaaataaagatgcaactgtataatgatcatgatgaaatgtgggtgcttactgtgtagttggtgctgtgctaaacatgttactcaaacatgttacttccatcgtcttatttctcatacccatcccatgaggtggaggtccaactctaatccccatttgtagtagtttgccgaagccacagtaacaaagcaccataaactgggtggcttaaacagaaattaacataaattattgtctcatggttctagaggctagaagtctgaactcaaggtgtctgcagagttggtttttttttttttgagacagagtctcactctgtcgcccaggctggattacagtagcatgatcttggctcattgcaacctccacctcccgggttcaagcaattctcctgcctcagcctcttgagtagctgggattagaggcacacgccaccatgcctagctaatttttgtatttttagtggagacgggtttcccattttggccaggctctaactcctgacctcaagtgatccatctgccttgacctcccaaagtgctgggattacaggtgtcagccaccacgcctggtccttattctttcttgctttctaatgacttaaagctaaacatattttccaaacagaaatcagagtgtgtgcttttttactcatgaaccaacaagacagagtgctggtcatttggcctatccttggaaatctgtgatgtctggacatcttaagcatagcatgtagatgagtaatactcaagctaggttctgaagcataatttaattatactcctgcatgtttaaaagaattcagaacctaagaattaaaagctgacccagaggcaggcacagtggctggccgggtgcggtgattcactcctgtaatcccagcactttgggaggctgaggcggtggatcacctgaggtcagagttccagaccagcctgaccaacatggtgaaaccccatctctactaaaaaacaaaaacaaaaaattagccgggcatggtggtgcacgcctgtaatcccagctatcccagctactcgggaggttgaggcaggagaatcgcttgaatccaggaggtggaggttgcagtgagcctagatggcgccactgcactccagcctgagggacagagcaagactttgcctcaaaaaaaaaaaaaaaaaaaaaaaaagctgacccagagccctagatctcttaacttttcacagccaaatcttaaaaggcttctctgtgctttttgttccttttcctcactatcacctgcccttctgacactttctcctctacctatgccagaaacttagaggcccagtaagtggtttcaggtgtcctatgggctgcgcacagcactaaataaaagcacttcccttagctcttcccttaaacgttgctgtttaaggaagcttattcttcttcttattttcaagacagggtcttgctctgttccccaggctggagtgcagtggcatggtcatagctcactgcagcctccatcccctggcctcaagcaatcctcctgcttcagcctcccaaagtgttgggattataggtgtgagccactgcaccaggctggaagcttatcttatgatttccatttcatctgataaaattgagatgaagaatttgcttctagttctggctggaatgggggggttcttcactcacatcggttttgattcttcactcatatcagttgaatggttggtgacaaaacttttcagttcagtcaaaatttttattcatttagaggtaatctgattgtgtagtgagattaggcaatccccttgggcaggattcaccgccccccccccatcaaaattatttgatatttgaaaaaaatatgccgggcacggtggtttacacctgtaatcccagcactttgggaggctgaggtgggcagattgcttgagctcaggagttcgagaccaacctgggcaacatggagaaactctgtctctacaaaaaataccaaaaagaaaaaaaaatagctgggtgtggtggcgggcgcctgtaatcccagctacttgggggtgctgaggcaggaagataacatcacttgcgaccaggaggtccagactgcaatgagccaagattacgccactgtactccagtctgggtgacaaagtgagaccctgtctccaaaaaaataaaatagtgatgtttgaaaaaatatatacaatttttattataattattgctgtttgatattgatatttgaaatataatattgatattgatatacaagtaatcaaacatttatgcatatataaaattatttttacttcacatcttaagactggttacttaaaataattaactctgtcaatacgctttgaaagaggctttgtaaattgttaaagttacatttgtctcttctgatagctttagctcagcagaataaatatggtaatagttggctgggtacagtggctcacgcctgtaatcccagcactttgggaggccaaggtgggcatatcaagaggtcaggagatcgagaccatcctggctaacacggtgaaaccccgtctctaccaaaaatgcaaaaaattagccaggtggtggaacgcgcctgtagtcccagctactcgggaggctgaggcaggagaatcacttgaacccgggtggcagaggttgcagtgagccactgcactccagcttgggcaacagagggagactctgtctcaaaaaaaaaaaaaaagaaagaaatatatacatatatatatatatgtgtgtgtgtgtgtttctttttttttcctagagtgtgtatatatatatagcaataaagagggatgctttcccaagacttagaacaagaaatcaaaatactttagcaactgaaggatgattcaagcaaaggcagaactcgatcaagaagggagaagatatgtaaaaaataaagtgtcattgggaagaatagctaggattggctctggaaaaaataatagaaaaacactctgcttatgtgatttagtgtttacaatgtaaatctgaaggacttctgaatcttttggaaataaacctggattgacttgtttaaaaacttagatcatgtctcagtgacagagctcagcaaaaaacaaaaacaaaaacaaaaaacagaaacaaacaaaaacttagcttatgactttggaggtaggaaaagctgaaagctccctacattcctgaaattaaatgaaagatttcactcttgtgtttaacctggccttcagatcctagattagcaaagaatttgatgtaccttctacaaacctgattttgttcattatgactccacaccttgcttgctttccttcactactctaggaatgtggaaaagtttagctggatgtagtcctggcctaccagcaagctctcccagagagcatgggacagaaaagctcagagaccaaaaccaggtgttaaaatcacacgattcactcaacttgaaaacatagtgagaagcaaggggaaaaagatggtgtattagtctattttcatgctgctgataaagacatacccaaggctgggcaatttacaaaagaaagaggtttaattggactcacagttccacatggctggggaggcctcacaatcatggcagaaggtaaaaagcacgtctcacatggcagcagacaagagaagagagcttgtgcagggaaactcccttttttaaaaccatcagatctcgtgagacttattcactatcatgagaacaggatgggagagacttgcccccttgattcaattacctcctactgggtccctcccataccttgtgggaattcaagatgagatttgggtggggacacagccaaaccatatcagatggagactaacaggtaggtgaggatacaaatggggtgagagatccacacttctggaaccctatgcttgcagtgtcagctttccctgctgatggtgtggtcacaaaaaccaaagttaaggttgaacaaggggcttcaacggatgggaagtatctgaagtcagcacatgcgtgctgtgtcggagggatgcaaggtagtatgcctggccaatagctgtaggtcatcagtgatgtgtgtgtgtgtgtgtgtgtgtgtgtgtttaagatggagtttcgctcttgttgcccaggctagagtgcaatggcatgatcttggctcaccgcaacctccgcctcctgggttcaagccattctcctgcctcagcctcccaagtagctggggctacaggcatgcgccaccacacccagctaatttttctatttttagtagagatggggtttcaccatcttggctaggcaggtctcgaactcctgacttcgtgatccatccgcttcagcctcccaaagtgctgggattacaggcatgagccactgcgcccggcctgatctgtgttttatctacattttggggcagagtatatgtggggccagaactgaacatgatggatgtcacctatgggtgatcaatttaggaatgacatagctgtcaatcttggggtaacatgagctgagcactattatatattattaatatttatgaagtgtctattattaacaatgtaaatcataatctagaaaaatactttatatataattatatattatataaacaatatataattgaccgggtgtggtggctcacgcctgtaatcctagcactttggaaggccgaggtgggtggatcacctgaggtcaggaatttgagaccagcctggccaacatggtggaaccctgtctgtactaaaaaatacaaaattagccggcgtggtggtgcatgcctgtaattccagctacttgggagggtgaggcagaattgcttgaactcaggaggcagaggttgcagtgaaccaagatcatgccatggtactccagtctgggtgacaagagcaaaaactccatctcaaataaataaataaataacagcatataattatacaaattatatttttataaaattgtattatataataaatataatttttatatattatatatgaatatatatgcctttatatattatatatatacataaagtataattttgtattatatattatatataaaatacaattataagttaaatatttattaactttactattaagtaaatattgtaagatttaaaatttatttcattcctccatttctttgtatgtataagtaaaactctcatttgtttcattcttttaatctatatttaacacaggaatattctattctgtttaacatcttacaggttattatcttacatgtcttacaacttactgtttacacttaacacatcttatgaattctgcgtgagtcttacaagctacttatttcctcattatctatgctaaatgaatcaggagtttcattcatctgatttttaaattgtcctctatactagtttgaaggagaactttaaatgaaagtatttattcagccaattatggtatattcatacaaatggaatattatgcagttagaaaagatgatgatagagatctagttcatgaaacaaatagtcaaactctattcttatgtagaaataggttgcaaaagagcaaatttggtgtatcccaagtgtataccccaggtgtctaagttgtgtacaatatgtacctacttgtctgtgcagagagatacctggaaaggtgctcagtagttggctctggatggtgacattttagttgtactttaccactttttggtgatctacttactgcatagtttgagtgaataaacaattatcacttatattaaaaactgaaatccaaatgtgtgtttgtacaaacatatgtaaataacataaaaagaattgtaagaccagacccttttcttctgaaaaacgtacacagcattttgcaaataattattttttaaaaagtatctttattttattttatttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttttgtatttttagtagagacggggtttcacccttttagccgggatggtctcgatctcctgacctcgtgatccgcccgcctcggcctcccaaagtgctgggattacaggcgtgagccaccgcgcccggcctcagtatctttattttaaaacatttttagctgagtgcggtggctcaggcctgtaatccctgcactttgggaggccaaggcaggtggattgcctcagttcaggaattcaagaccagcctgggtaacatggcgaaaccccatctctacccaaaagacaaaaattagctgggcatggtggtgcacgcctatgttcccagttacttgagaggctgaggtgggaggatcacttgagcctgggaggcaatggttgcagtgacctgagattgtatcagtgcactccagcctgggcaaaagagtgagagaccctgtctccaaaaaaaaaaaaaaaattgagatggggtttcaccatgttgcccagactgaactcaaatccctgagctcaagccatccatccacctcagccctcccaaagtgctgggattacaggcgtgcgtgagctgccatgcccagctgcaaataattatttttttaaacttcaaaatgttttacctgacttcaaaattgtaatctttctgtcttgtgtcagagaattgtaatgatgtccctttagcagaatttcctaaacctctcccatgatgagaatcacctgggggggcatgtgaacgctgtcagatcccaacgcccttctcagacccactgaattggaatctctagcaagggacctaggacactggttttaacaagtgcctctggtgattcctatcatcagagaaatttaggacactgtcttatagaaccataaattttatgagccacgttttcaatttttattgaacatctcccggaggtgccttttccaggccagtttcctttgtttaaagaggcccatgcaaatttgcatggctaccctggaaagctatttgcttgcaggttttttctaaggccactttcagatccgaaaattctttgtgaatctaagatactcttcaactttaatctgtgttgatcgaggatcctgaattcttagagctagccgattctggtgataagttttttaaagcaattcaggaatgcagagggccctctggtttccccagagtactggacagtcccctgggccttgctcaccttatattccctcttagagcccctgagaggagggcctttttatttagtgaaaatttttgtttactgaagtgtttttcttaaagtattttgggggtgaagggagctctgaaactcagttagacaatagaacggcatttgaatcaaggattctctcgttggagtcaaatcgcatttgtggcattgacctttttaatatttcataggaagagtttcacaaacttgattccccagcattgcttggataaaactcactttagttgctgcgagagcaaaaatcgtcttgcattctgttaaaagaagctaaaaggaaagcaacaataacagccacacctctcctcccaccccatgcaattgttttactgggtagaggcaaagaatagaggggccggaaagccgggaagtgaatgggctttgaatctgacagacctggacctggattttttttcttttttttgagatggagtcttgctctgttgctcaggctggagtgtagtggtgcgatcttggctcactgcaaactccgcctcccaggttcaagcgattctcctgcctcagcttcccgagtagctgggattacaggcgcccatcattacgcccggctaatttttatatttttagtagagacggggtgtcaccacattggccaggctggtcttgaactcttggcctcaagtgttccgcctgccttggcctcccaaagtgctgggattacaggcttgagccacggcgcctggctggattctttctttttttgagacagggtctcagtctgtcactgaggctggagggcagtggcacaatcacggctactgcagcctcaacctcttggactcaagtgattcttctgtctcagcctctggagtagctgggacttcaggtgtgtgccatcacgctagctcatttacttttattatttttattttttgtagagacagggtcttcctatgttgcctaggctggtcttgaactcctgggctcatgtgatcctctcaccttggtctcccaaagtgctgtgattacaggtgtggccaccatgcccggtgggtttggattccatctgcttgaggacaaccatgggcaaactgctttctctgaagcatagtttcttcacgtataaagcaggggcaagaatactgactatatagtcactacattgaatgacttagtatagtatatgaaaagctcttggcacagaatatgcatttagtcaatcattgtttatcagagtttctccactgcttctcagtggagggctaacaaggggtctctatccccgaaaagagagtgtggctttcatatattctgcagtgtaaacagcagtaaaatagtaaaagctgtcatactttggagcaccttggagtgcctctgaggacccagggtgtcctgccaggaagaagtgctccctcctccatgttgcaaagcacgctccccagcaggtatgtctaaactagaacgtgtgccataggatgcttcttggctttccaggagtggatcagggttacgctctgcctcagccccaggcggagcaccaccgtggcctctgcccaccagcctgagcacacccagatgagccctataagtcacctaggagtctgcatgtggtcagcctagactacagtcatctccttccaacccaggactctccccaaacaccagtctagggcaccccagcttcttaatccgttcaggccatagctgactctgaattgcacagctaattcttttttatttttttttgaggcagggtcttgctctggcacccaggctggagtgcagtggtacgatctcggctaggcagcctctgctttccaggctcaagccatcctcttgcttcagcctcccaagtagctgggactacaggtgtgtaccaccaggcctagctgttttttgtagagatcaggtcttgctatgttgcccaaggctggtcttgaactcctgggctcaaacaatcctcccatcttggcctcccaaagtgctgggattacaggcgtgagccatctgcctaaccttatttactgtttttaaacagtaaacagtaaaacagttttaaacagtaaaacaacacagggccaggcaccgtggctcatgcctgtaatcacagcactttgggagaccaaggtaggaggatagctagaagccaggagtttgaggccagcctgtgcaacatagcaagacctcatctctactaaaaataatttttttttctgagtagctgggattacaggcatgcgccaccattcctggctaagttttgtatttttagtagagacggggtttcaccatgttggccaggctggtcttgaattcctggcctcaagtgatctgcctcccaaagtgctgggattacaggcgtgagccaccgtgcccagccttaaaaatatattttttaaaaaattagccaggcctggtggcatgggcctgtagtcccagctacttgggaggctgaggtggaaggactgcttgagcccaggagttggaggctgctgtgagctatgattgtgccactgcactccagcctgggccagagtgagactttttctgaaaaataaataaaataggctgggtgcagtggctcacgcccataatcctagcactttcggaggccaagacgggagaatcacttgaggtcaggagttcaaaaccagcctggccaacatggtgaaaccccgtctctacgaaaaaaaaaaccccagaaaaattagctgggcgtggtggcacatgtttgtaatcccagtttgggaggctgaggcaggataattgcttgaactcaggaggcggacgttgcagtgagcctagatcatgccactgcaccccagcctgggcaacagcaagactgtctcaaaaacataaaaataaaaataaataaataaaaataatactgtagtgggatctcatttttgtaaacatttttcgtttcttgataagtcatccatgtggtcttctgtctgtatatatgtctggaatgttcacctaatgtcgaagacaggtattaggactttagtttttaaatttcttggtgctcttctgaactcctcagatgctttataatgagcaccttattcttgcaaaactcagtggtctaaaaaattaacaaaaatgaaaatagtttttagtaactatggaacaatgtaaatagccttacaccttaagttacttgctttaataaatagaagaatgtctacctggcctggtgtggtggctcacgtctgtaatcccagcactttgggaggccaggaggctgaagcaagcagatcaattgaggctaggagttcaagaccagcttggccaacgtggtgaaactccacctctactaaaaatacaaaaattagccgggcatggtggcacatgcctgtaatcccagctacttgggaggctaaggcacgagaattgcttggacctgggaggcagaggttatggtgagccaagattgcaccactgcactccagcctgggcaagagagcgagagtctgtcaaaaaaaaaaaaaaaaagaagaagaagaagaatgtctgcgtgaaaatttgttctgttctttgagatactagaaacgtagatgccaacgtgttgggtttaatggcaaaaaccgcaattactgttgcaccaacctaaaataattgaaaagtggcaacttagagcagctttgttctttctacataatatcaagatgtgggaacaatcctgaagacaggtagtctgaaaattacttatgagtgatccactgaatgtttctaaaggaaaagcaagaatcttcagttgcccaaaagatggaggaggtctgagagttcttagagtggtttagaatgtgttcctctgtgctggaagatagcttgaaaatactttgctgtctttgtaatctttatacatctatgattgctataaagtcagctttgttctctatttctagaaccatcatgtattggaatgaggagcatctcaattcacaggtctattatttcttgggggtgggtgtcagagggcatatggcattagaagcagctctgtgtacaactgaaaacagtgtcgaagctatttaggatctgggaagtgtacaagttaattacccccaccctcaaaaaagaaaaaagaggaggactttaacaaactttgaaagtgatcatgagggcaggacgcggtggctcatgcctgtaatcccagcgctttgggaggctgaggcaggtggatcacctgaggtcaggagatcgagaccatcctggccaacacggtgaaaccccatctctactaaaaatacaaaaattagccaggtgtggtggtgggcgcctgtagtcccagctactcaggaggctgaggcaggagaatcgcttgaacctgggaggcagaggttgcagtgagctaagacggcgccattgcacattgcaatccagcctgagcaacaagcgcgaaactgtctcaaaaaaaaaaaaaaaagaaaaaagaaagtaatatataataactaaaagtgaaagcataagggggaagcagaacgttagatgccgctctcctggaggtaatcacaggggccattgagtggggtgattattgtgggaggaagcctgcaggtgaaccgggtggttattgttaactggtgtttggactgaggaagatgggtggagccaggagaggagatgaggctacctggaagtgggggcggggacgggggaggacacaaggcctttactgaaaaaacatcaggtccttctggcggagttttagctgctgcctcagcactttagtcatctctgtagttgagcaattctcctaacgtgtcacaatgtgtttacatatcgttgtcttcaacacactgtgagcaggctcccttttataaattgtcattatcttctgtatagctaccccagggtatatggtaggcattcaagaaaggtttgttaaaggagagttacgattccagtctactttacagtgtacacgttaactaaattgtttggtgaacctgtaaacttttctctttttttttttttttgggggggggatggagtttcactcttgtcgcccaggctggagtgcagtggcgtgatctcggcttactgaaacccccacctcccaagttcaagtgattctcctgcctcagtctcccaagtagctgggactacaggcgcctgctaccatgccagctaatttttttgtatttttagtagagacggggtttcaccatgttagtcagggtggtctcgaactcctgatctcagttgatccatccgcctcggcctcccaaagttttgggattacaggcgtgagccaccgtacccggctgaacttgtaaacttttcagtgttagttttctttgctcccagttgatgatactttataaccatattgcagatatatacatatatatatatacacacacacagatatgtttcttaagatctccacattcttgagaaaatatgactaaaaggcatttagtttatctcattaaggtcttctgaccaacttatttcttattttttgagacagtgtctctctctgtcacctaggctgcagtatagtggtgcagtcatagcttactgcagcctcaaattcctgggctcaagcaatcctctcccctcagtcctcgagtagctgggactacaggcacatgctaccatgcccaggtaattttattttattattagtttttgtagagacagaatctcactatgttgtccaggctggactcaaatccctaggctcaagcaatcctcctgtctagcctcccaaagtgctgggattacaagcatgagcccctgcacctagctgaccaacctatttcagagaccttatatattgtaatatacactgaaaagttgaaaaaaattgtccattgcacaaacaataactaaatttaaaaagaaaaatatatgcacaagcctgtcttttcatgaagtcatttttttgcatactttccagtttttattttttttataattttatcactgtcatcatcatacattagatgtaatttgtgtttttttgttgataattatagcattatcattctccttgttgtatagacttccttattacaattttaaatgatggtctgctatgccaattatgttgatttactgtaatttaatagcccagcccaccatcattggacattggtggtttccatcattcattattagatacaggcatatagtgaagtgctgcctcatacctagtcatccactgtaatctaacctccagtcgtatctttccattgaaaagctctggccaagataagcagtggtcctccacttaatgaacatcatcagttcttaccttaattgacctcctcgaaattccatgttgttggcctctccctctttcctgaagtttgttctttccttggctttttggacactctcctccagaagcgttttctttcctttctggcagctcctctttggtctctgttctggcaactcaagtctgccccctaaatattggcattcccagagatgagtcctgtccttagtcctctcttggcttaatctacatcacgtctctgaatgtgggattgtcccctcccaagacttcaacttttatgatacattgatgatacccaaatcactcccaaatctctctcctcaaatactcatcagtgcctagcacataggagacacttgatacatatttgttaaattactgaacatcttcacctggatgacccatagcacttgaaaatcagtctgtaactaaactcatcatctttcttcaagctcctcccaagatctgctcccactcctgtgttctgttttgataaaagccaccgtcatctcctttaagtaagccagaaacctgagagtcagcgtaggctcacttcccgctcgcgtctccccatatctagtcaggcagtcatccagcctgctgatctacttccttagtttctctagaatctggctcccttttgtctaacactgcctaacttcatagccacgtcatctctcacctgcattcccacaaaaatgcatttttggccggtcttgtcattcttactaacattctcctcccccaccaacccctgtcccccaccaactgtcaaatccatctttatacttgcctgggcaacttcaccttctggcacctcaagagtaagcctgctgtctcttccttccttacttctctctgtgttatttattccccttacctggaaggcttttttccttctttgtgtcttaaaaactcattccgacctctcctttagaatgtataagcaaccccatctctggaaagccttccctaagtctctcctgctagaccactctgagcctgccaggaatctcagtgcttacacagtttatcattacttgttgattgtctactgcaatagactgagtttcctaaggcaggatcctgagtattttatcaaggggttgacagaggtgttcagtaagtacctgttgagtagaagaatttttttttttttttttttttttttgagacggaatctcgctctgtcaccaggctggagtgcagtggtgcaatctcgtctcactgtaacctccgcctcttgggttcaagcgattctcctgcctcagcctcctgaacagctgggactacaggcgtgcgccaccacgcccagctaatttttgttatttttagtagagacggggtctcaccatgttggccaggatggtcttgatttcttgacctcgcgatctgtccgcctcgacctcccaaagtgctgggattacaggcatgagccaccgcgccctgcggagtagaagttctttggataaacacattctaggagtggggtcaaaatgtgcaaacccacacgtgaagaagatgactaataaattgtttctccaaagagttgtattgatttacactgccaccagcaaaaaagctaatatatcaactgaaccgtgtttctaacaaccatttactgaatgcttatcatctgtcaggtgttgtgccagaagaatggagtttgtctataaatatttcatcatttcgagtagtgcagtccaacagaactttctgcattgatggaaatattctatatttgcactgtccaatagggtagctattagccacatgtggcttctgagcccttgaaatgagacaagtgtgactgaagaactgaatttgtcatttcctctaattttagttaatttacatgtaaatgtaaacacttactggtggcaagtggtcatcttattgaacagtgccgctctagagagaaaaaaggaaatcagtcagtagatgtaactgccacattctggattattttttaaatgttagtggctctaagcccacatcattaaggtgtggccacctttcaagtgctatcatttttattagtcagcaccacctaatttgggaaatattttatttttttttccttttttttgattaaaacaatttttaaaaaatagagatggggtctcactatgttgcccagactggtctcaaactcgtgggctcaagtgattctcctgccttgccttcccaaagtgctgggattacaggcatgagccaccgtgcctggccagatttgggaaacattttataaataggtgcttagatcaggagagcaatgccttacatcaggaatacaaccaaaatgtctaagtccggagactcgaggcaaagtgggaaacgttactcacagtgctttttatccagaggcgtggacttagttactccaaaggagtccagaagcataacacttctggagaggcatctactggacttgtttttccacgaaacttctagacttgttttgatcaggcaggaagtgaagcaacttttcagggagagagcccagcatctgcatctcctctgggacagaccacaccttttaccttctacttgtgagcctaggacgagttttgctttccaattaagggaagagcagggcaggcaaaactattctcttacaagatggttttttaagatttcaaacccaaggttatatttttaatcggtacctgtttggattctccaaattaatttatatgctcttaaaataaagacacttaacgtcactgcacaattctttgcacatggaggacttcgaaaggaataagcacactgaattgcattagatgaatcctgtcagataagcacttgtgacctactggcaaccttttataagctgatgatgggagaggagtttcaatctctttattggagttgttggaaatgtgccaaagagataacctggaatatattgtcctgaaaagtcctgttttaatatttaatacgaacatcttataaccctcggaattcgggtaggcagttgttgggctgagaaatgtggggtacaaggccgtgtatgtgttggttagccgggcaggcctctagacaggacctaaaactttgaggttttcccagttcgactcttcgtaggagaactgaagctgcctgtgtgaggccctgcgaacctcgccaaaaagtcttcctacaggatgcccccgcgacctcaccggggaaacaccgcggacagtcgggccagcagcgcccggagctcactccaggtctccaaacttgcagcacttcccagagcgcgcgcgctcggagcgggacctgcttgctccagtgcacgccgcggagcgaaccatcgggctggcgggggtggaggggtgcaggcgtgggggctgcgggccgctcgggccttgggcttctcctgccgccgccgccgcctcccgcccccggccaggagtcgcgcgtgacgcggttcgccgcaggagcctcgaaggcgcggcgccggcgagcccttccccggcaggcgcgtgggtggtagcggccaatttgacagtttcccgggccgggcggccagcgcggaggcgccacgctcgggtcgggggcgggctgacgccgccgccgccgcgggaggagggacaaaggggtgggtccccgcgggtcggcaccccggcggttgggctgcgggtcagagcactgtccggtggtgcccaggaggagtaggagcaggagcagaagcagaagcggggtccggagctgcgcgcctacgcgggacctgtgtccgaaatgccggtgcgaggagaccgcgggtttccaccccggcgggagctgtcaggttggctccgcgtaagtgcctccttgtgccgcgcggttgggaggagggtcgtgagcgtgagcgtgggagcgctgggggctctgctcgcgtgctgctctgaagttgttccccgatgcgccgtaggaagctgggattctcccatccggacgtgggacgcaggggaggggtaggtttcaccgtccgggctgatgactcgtggcctccggggctcctggaacctttactctgaagtcacttgggctggagattaaggcgcgagtaggggacactgtcttgaacccggtgtcctggatttctgctggcttggaggcatctcgtgtctgttgtgtcgcttgcatgtctttgtgttttccttctctatttcaaaccacactcggtattgatgcaaagttacaggcttgtgtacgtgagagaaactgaaaactcatcacagagcagaatcccttttccctttcaatcagctgcgtctgtaatagaagtaaaagttgtttttttttttttttttttccagtagggaatggggatggaggtttggaaggacccacaaaagaggagtgtgatgaatgctttgtattctagtactagcctacctgtcaccagttctttttatgtcttcatttgtcaagtttctgcttttacacggtagtttaagttataaataatcagggatttctaccacagggttttaacattcttgaaatgtggacaaacttgggagtgagtgctcccgcgcttagtaatggaatacagcctcccacctctatttcagcttcagttcttaggctaggctgcttttctggcagctgtctggcctgagtaatgatggttgtggtttccctgaagttcccagcggagagtcatcccatgatagaaactgccttgcgcttctcactcacgctctcagcccggggaatcccagcggggaggagggagggaggtcgttttcttcagctccccaggtggtctgtgctgggtgtgctgacggtccttttgggaaaacaggtccacctttgccagcgtaattcagaaagagatgtaattttctgagagcacacacctgggcaggagatcgcttgaagtgagaaattcgtagtggtaaatgtatttgtagcaaagtaccactgcatatcctgcttgagaggatgaaatttgattatttagtaagttttcatgaacaactccacttcagtgtggggattacgcagatgagcaagagcgtggctctgtcacacagtcccgttgggaaagcctgcaactcattaagaatccgatgagtgccatttagaaatgtggacagggtactggagcttcctcattgtggggagatggcagaagcggaggtgctttactaaagcaccggtggcttttgaggtgtttcttgtgtttttttcagaactacttctgcagtggggccactttatttcttttcagagctacttatgcagattgatgaaggggaactttcccctctgaaatgctgctgtaactttttcagtaccatccagatattataatactgaatgagcccctactcctgccagtcactgtgggggatacaaagatgaacaagattcaatttctgcatttaggggtctagtggacctgaaactgttagactttactctgcaatctgtgtcgggattcctgagactgagggagggaatgtatgatgccgatgcacactctgcaatacagaaatttagcaaagagtgggattggtcctatatgcattcccttcaggggattcttgctgggaataaagggcatttgaacagttacctcacccgagcaagccactatagaaaatggggccagtaatgcgcccacctcaccgggctgagtgaggtctgaatgaaatgacagagagtacaaggcatgtggtggatgctacgtaaatggtggtagctagtaataggaacaaaacgggtgctgaaaactcttaagtgttgggtcctgggttgataagggaggtgagatctaaagatacaagtaggaggtgccaggtaggtgtccaggaaaaaactgaaagagttgttgttcacactctgttaaaaggccttgaaggccataacgaagctttgggtggggggaagtcagaaatccctcatgtattaaatgacttgactttccctacaaaagaagcgaaccagtttcccagtaaacatcccaccccataactatttttgaggcattcataggcttaagaccaatgaatttttacatcacccccgggggaattgcatttgcaatgacttctgcctacatttaacttttgatctagttctttgtacactgacaaaagttcacagccaaccatttctcttcaggacaagtgtgagaactttctgcatactgctgaaggcaagggagattttgagtttagcaaggttttctctccttaagaaggttatctttttacgagacacaagttattgaaactaggcggggccactttagtcctgtgtacaataatatgtgtagtaatataaatagtaatttaaaaagtcatgcagacttggttggggagaggcatgaagtttgggtgtggtgggggcggggtgaagcggtagaagggttcgcaatcactgctgaaactttcaacatattctaccaacaatatgagccaccagggaattccttgcctcatctctagaacgaatcccattaagcagttgtggctacagatgaatttatctaggttgagagctgattcccaataacatgcctcattgatttgactctaagcagtaatcaggggcccaacagttgttggaccaaccagccttgattttccagagaaggtgatttggtatatggtagtgtctgagggtgagattgccccagatgggagtggagggaagcagaacagttttctctggtgttttactgagtttttgtcttgatcctaaatccaagggttagggtcagaaacacagactcagaggttagatttaacacccatttagtgggttaaacacatcaatggttatgtgaactttgttaaggtttaaaaagctatttagggcctgtttctccctcataggaatttttgcaatcagcctttttagtagatgcccatatagaaagtgaatttgggagggtctaaggtggtattactattaaactttttgaaaaggctgtgtgatagcaatggaaaaaaaaattcaggcatggaaatccaatatgcagtattgcagtagctagttttaattttatttttgtttttttggttttttttttggagatggagtcttgctctgttgcccaggctgaagtgtggtggtgcggtcttggctcactgcaacctctgcctcccgggttcaagcggttctcttgcttcagccttcaaagtagctgggattacagaagtgagccaccgtgcccggccactagttttaattttggatggtacctaggaaagcagttgagctagtatgctgcatacattgtagtgtgagaggcagagttccgagttggagagtgtctgcttccactttttccatttgattaggaaaagcacttcttagaactgggtgactgacagctagagccccagaagacctgcacaagctggggcaatggctacccataacagtgacggctccattctgttttttaaagggattggtgtctctatcatccagctggccattaaacaaccaaagcttcatcatcctagataacctgtgagctctcagaggagacagagtaaggactatcatacccccaaaatacctaatcatttaataaagcattttctctaccttttatgctatcccaaaacagtgctttccaaagtctggtatacagacagacttacaggtggtgcagagagatacatattctatttttcaattatgatgcatgaatattatatgttaggaataaaaacagaaaaccagctaccacatccatttatttcatggctagattgcttagaatgaggcaaaaataaatattaagtaaagcagtgagtttgctttaagaaaaattatcaactctgggaatgagtaatatgaggctaaggcaaaaatggtaaagctagcccttgacatctgaggtgtgcataatactgcttaaaatatgagtgtggtgcttacttatagagagcctggtataccttgaccacgccttcaagaaagtcaaacacagaatggcccagaatagccaggaaagttgaatttgatggactttctgtcttaagcgtgtgcatcctgctcttatccactcagatctcttagatgtggttgcagacagtgtatttgtagagctagctgtttgttttaacgtctggcccaattctcattcctttctctgcttccacaagccattctgcagtttttaaaggtctgttggtatgatatttttgatatgatagagtgataggggaggaagtattttgacactgatgaaggacatcactgtattatcaagtgactcttgctcatgattcattgccgaagaatgtggacagccaaacagcctcacctgtaaatgcatttaatttctcaaagtctttcagaagaatgccaactggatgagtttttttttcttattttttttttaatatgaagcttgtattggtctgtaaaataggctttaacaaggattttcgtaggaacaggaagccttgaggtagaaaacaagtatccctgctttgacctagagagatgcatgctcatggcaggcgaatgaatcaaggagaagagaaaatactgtttcagtagactctctagtgatgtgtgtgttcacaccatttatgagaaatcctaagctttcaattagtaacttgtactttagtcatttaaaatcagcacagatgtttgtttagtgcctctgccagatggttaaagttaaatcaggttttttaacctgaaaaacgtaatgtagctttccttaaccatttacacaccattgtatattgcagaccatagtcagatacattttgttataatgaatgtttattttaccttttagctcaattagaatatcagtggttatggtttctattttgttttcctacagttactgtatgggggtgcagtaacagcggtggtggtgaaagtaagttacttttttctttttctttctttttttttttttttgagacggagtctccctctgtcgcccaggctggaatgcagtggtgcgatctcggctcactgcaagctccacctcccgggttcacgccattcagcctccccagtagctgggactacaggcgcccgccaccacgcccggctaattttttgtatttttagtagagacggggtttcaccatgttagccaggatggtcttgatctcctgacctcgtgatccacccgcctcggcctcccaaagtgctgggattagaggtgtgagccaccgcgcccggctgaaagtgaatctcttaatggatcttccatgaatcaaatatttgtgttttagtaagttaggctgaccaaaagatttcgaatcatacctttaatcatggcaaggatcttatgtcacattcttgagtacacatgttcactaaattttacctatatgtgtatgtgaacatggacttcagaattaattagtgtggtaattattatttctattgtagactttaatcagccatattaaatatatgcattatgttcacagagaaaacatggtatcatctttggaaactttacagtatgctctatattatagataccctatataactatggtactaaacacacgagttagtgacaagtcaggcatttggagggaatgtttgtaacccattgtgggagagagttattagaatagttattcttactggtaggtaacagttatggctgtaatgaatagaatgtgactaaaatccagttatgcctttgccatcgtattaaaagctttggtggagacgtgagaacattgcagatactttggattttgtcacttgagttgaaggtaaacagagaaaacagtactttctagtcatcagtaggaattaactcttccaggacatgtagcttcaaggaccttctaggttcttctgagggggaaataatgttccacttggggccatttttttccatttgttgagagtcatttgttttcagagtattaaaggaagtgttccgagttctaggttgtgtttctttgatgcctactaaagctgagcacacctgagaccctgggtggagctctacaatgggaataggagtaagtaatgtaggcttcgagagacaatcattctgctctcagtccttggaagactgttcctaggtatatatggcaaagcagatgaaattatttgagggaattaattagcaaaactaaacatttctgtttttgaaaggaatgaatcatttggaaggaacttcctggtgagctcagttttagcagcctggtttctgcgttacccttctgcagtctggctgaatcaattgtgttcttgcctgtgattggtgaggatgcacatgctagtatttattctagcccttatcacttcccatcagccctgagcccctccctggtctgagtcatcttggtaaccccagaagctaacagagcaccaacacatccactaaacgttggactgacttgatttggggcaggcttgttgtataagctagtaggaataagagactaattgagaaattaggacagtggattcctgacatttatatagtgagtagatgatcgtttgttagaattgcgaatttcatccagagaattttgtccaaaaaaaattatagaatttcatctagaccatttttgtaatggcatggaagcagcattagctgcaccactgattagctgggtggcttttgctgtcttgtgactctagtttgcaatttcttttttttttttttttttttttttttgaggtggagtctagccctatcgctgaggctggagtgcaatggcccgatctcagctcactgcaacgtctgcctcctaggttcaagcgattctcctgcctcagcctcccaagtagctgggattacaggcacacgccaccacaccctgctaattttttgtatctttggtagagacggggcttcaccatgttggccaggctggtctcgaactcctgagctcgtgatccgcctgccttggcctcccgaagtgctgggattataggcatgagccacctcgcctggcctagttctcagtttctttatcagaaaatgagtagttacagttgatcatctcaaagtcttttgtgcttaagattctgaaggttttgaagtttgagtataaagcctagagaacattctaaattatttccattggttcttctcatcttaaaatgtttttgtgctccttaaactacgtttgtgtttgcttgcttgctttcttttttttttagagatccagtggattatctctgaaaagcattttttaaaaagacagagtccaagagtggctggtagttgttttgctcataaagtgatggaaagatctattattcagttgcagcttaaattatgtaccagcaccacgtgtgctggattctcttccttactttgcagcttaagccagcaactgcaaccatcttgcagagcttcttgagaatccttcttcctcttcctcttcctctccacccccatggacttctccccgggcctcattgcctgtgacatacgcttggaaggaggggcaggcctgcagctgggagccctttctgatttgttcttcacaaatgtgttgaagatgagcctactggtcactgctgcaaaaaaccacattgttcactggtgtaaaatcactgctgtcatctgagtttcagcataacttcaggcatgttggagtttttcaacgtcacctcaggcagagcactttgccttccttgggctggtctgtttagtgtctgggtgagttttaagagaggagagacattgtggcatcttagacactcactgaaattttccagaaatggagctggaaacatttgtgcgtttccttctggtgttattgttaaagcctaaaaacaagggcaagtggcaacacattgaaatgaagaagccccaagtttgcaacacattgaaaggaagaggccccaagttcgttttgagcctaaattgaattttaatcaaaggtctgagagaaatatttagtctacttatactatttaagtgcacagtttggcagatgactttgggcagtgaaggatctggaagaggcaggaaaggtagactcaatctgccagacttagagctaaaaaaatttgcctggtatgtttccatgaagaaaattttcctgtagaagcagtggcacgacctctgttacaagtctgcttattgataatgaagctttttctgtgttatcaatttcgttgaatttatatgtatgtatatacatatacacacacacaaatctcaagtagagagcttgatgaatttctttttttttttttttttgagatggagtttcactcttgttgcccaggctgaagtgcagtggtgccatctcggctcaccacaacctgtgccctccaggttcaagcaattctccggcctcagcctcccgagtagttgggactacaggtgcgcaccaccatgcccggctaattttgtattttttttttttttagtagagacaaggtttcttcatgttggtcaggctgatctcgaactcctgatctcgggtgatccacctgcctcagcctcccaaagtgctggaattacaggcgtgagccattgtgcctggccagggaattttatttattgtggtaaagtacacataacattaagtgtaccattttaaccattttaaagtataaaattcaatggcatttaatacactcacagtattttgtaaacaccatcactctctagttccagaggtaggtgaatttttacatgaatgtattcacctgcatgattaccacctagattaaaaactagaattttccatcactctggaaggttctctcttgccacttttccaatgattaccacacctacctaaaagagaacttctcttctgacttctctcaccgtggaacacttttgcttgaacttgggagaggacccatatataaataaaatcaacattttatgtctgtcatctttcactcaacctaacctctgtgaaattcatccgtatttgttgcgtgagattcagtagttcttttttgccactgagtcgtattccatttatatgcatctgtcacatttggcttatctcttctgttgataggtatttgggttattttcagtgtttttgctattatgaataaagctgccatgaaaagcacctacacattgccttgtggacatgtacacccatttctcttgtgtgaattcctaggaccataggttagggattttttaaaaaacttattttagattaaaaaaaatattttttgagacagtctcactctgtcacccaggctggagtgcagtggcatgatctcagctcattgcgacctgtgcctcccaggttcaagtgattctcctgcttcagcctcccaagtagctgggattacaggcatgcgccactacacctagctaatttttgtatttttagtagagacaggtttctcttcaactcctgagttcaagcagtctgcccaccttggcctcccaaaatgctgggattataaatgcgagccaccacgcccagccaggttacagatgtttaactttgattctttacctctgaagtcaaataaacctgggtgtgaattcttttgtcctgccacttgcttgcttgactttgagcaatttacctttttctcatgttcagttttctcagttgtaaaataggcctaccctatcagtcatggttcagtcaagaagacatgtcattctagctatttcaaggagaaggggattcaatacagagtattagttgccttcaggacaaagaaaaggcgagatgcgcaaaaaatggaagcccaccgctggctttctgatttgccgcaaaaaaagttagaaagctgctgccacccagagaagactcagaaggtcttgcttgaccttccaccttctcagcatctccagccttgaggctggtgaaagggcagggaatctggacatgctgtaaagctcatgtctgaggaatccaacttttgcctgctactgctgctgtctgtaggaagaagaaaaacaaatggcttctgctttccttcatccttccaaatctcaaacacgtgtacctcgctggtagaaccctgttggcaagagagatgggggatctctggtagaaacagaaactcagtgccagcaaagaagaaatggcatagatgccacctggggttgctttgaggtgctcagtaaatggcagtggttataatttattattttcatcattcctcaagaactgctgctgcagttcagactgatttctctctctctctcttcttttttttttttttttttgagacgggcttgctctgtcacccaggctggagtgcagtggtgccgtcacagctcactgcagcctcgacttccctggctcaagtgatcctctcacctcagcctccgattagctgtaaccacgggcatgcgccaccatacctggctaatttttaaatattttgtagagatgaggtctgtctatgttgcccaggtgggccttgaactcctgggctcaggcgatcctcctacctcggcctcccgaagtgctaggattataggcgtgagtcaccacgcttgggcagcagactgatttcttttttttttttttttgagacagagtcttgctgtgttgcccaggctggaatgcagtggtgcaatctcagcttactgcgacctctgcctcccggattcaagcaattctcctgcctcagcctcccgagtagctgggattacaggtgggtgccaccacacccggctaatttttgtatttttagtagaggcagggtttcaccatgttggccaggctggtctcgaactcctgacctcaggtgatctgcctgccttggcctcccaaagtgctgggattataggcgtgagccaccgtgtccgacccagactgatttctgtaacggatgttcattcttttcactttatagtcacatggatgccactgtaagagctccgtgtcacataaggtgttgtttttctggaagggccttccagattctgtatctattgctctgtgattctaggtacttttctaaaggtataagcttgagaaattagttttcaagtctgtaagttaatgtagagctgaaaggtgacttaattctaagagttgctgctttaatgtataattttatggaacctaatgagtgttttctttttaaagtcattccactttattattaataaaataaaaggtaatatataaatctggctgatagatggggttacttttttccctgtctttagcttcctttgtgttctgataaatgagatggaagatttttatcatattttgtacctcaaatctctcgcggagggaacactgtagtctaccaaaacagctggcagaagtgtctgtcctattataagtttattttatgaaacatgagctataatgtagtcctttttttttttttttctttttttggagacggagtctcggttgcgcctggctaattttttgtattttttagtagagatggggtttcaccgtgttagccaggatggcctcgatctcctgacctcatgatccgcctgccttggcctcccaaagtgctgggattacaggtgtgagccgccgcgcccggccaatgtagtggttttaagacatttaaaaatcttgaaccaatgttggcaacagcctgtctgtaatgatgtcacatgtggaaagaaccgagtttttcttaactttagaatgtgaattttttcctccttcaaatactttttcctataacccagacctattttactttccagggaccctactattactgccctaaggtaatttgctagaaatggagtggtcaagatgtattgattaacgttttaggcatacttctgtagtactacttccgaaggctccttgcagagaaatttgaagtgataaggaaggcaaatattcgaaatggaaagataagtataaccagtgactatttcagccactggtttagcagttcaagtgagctggctgtttgtaaagcttgcttagtaaatgaatgtgctagaaatatattgacagaatttggttttatctctttttctccagacttttagtcggccagggctaacaatggatgtccaaacagtttacagtggctgatacacaatgcacaaagggcttcactgtttggagactggaaaatagagccagaggggagcttcttatgggcattgacctaattcactccttttggcaaaaatgcttggttttaaatcaatgtatgtatttctgacccaaatatctataaatatttcagctagtagtgttacagctggaggaagggacccgtggtgttgcttcgtgtattttgatttgacaatattctttagaaataaattgtcaagtgaactaatattacacaaaagttagggaaagttaagagaggcagctgaaattccatcagtttcctccttagtccctggaacctccccacaatcaggaatttgttagtcacctggtttttaaagataaatttctctgtgggcgtttctgctgagaaatgtggggaaacaggactgggctaaaaataaaattagttcaggcattgctaaacttctaagtatcatgtttgtgatgtacttttccaggaaacataaattggcaatatttttgctcctttttactaccacagaaagaatatttgcagtcagcatgcacggcctgaaagaatctctctcgcctattaatagaacagaaggaacatacacatgtctatgtgggggaaaaacatctcatttggcttagtagtaagctccaaataacaattgcattgttgttctgaattgtctttgagtgtgattggatgattaaatataaatgttgacctgattggattatatcacagcaatgaactgtcctgaaaaaacagctgtaacataccactccagactgttaccagacttagtcggctggctttatatttgtgttgtcaaaactgggatgctgtcatttctgtttctctgtctctttcgtctgttccaatttgagatatactgactatgttagtgtagtctgctacatggatagtcctttatctttcagcaacataagcaacataagctttttgactgagacgagcgtaatcaaaaggaatgctgggaaacagtgaactgtaaaaaatgtcctcaattagatacaggcttcagtgcatgggtttatcctttcagaagatcggtgtgttttcagtgagggtctaaacccactggcctggattccacctcttgttggatgggtggtcagttttaacattagggggtgttgattgtgagctcttgagagcagggctggttctttgcattcctaggtaggcatgatgtagagtagttgctcagtaaataggggaaggtgaaaggaagagaagggagaaggtgagtctcaaaagactggaatgtgataagcacacgtttatcacactgggggtgtattctctcccttttcttagagtattccttgcctcctgaaaaaagcactttgcaggaaatatggagatcttctgaacctgtggctttgtgttattggactgagaagtccaaaatgtgcattagcggagcttatagaactgctctgagaatgtgttcttgagttctacaaatattatggggtgcgttgggggctggctcactccagctcagttcccatgtgttaagtggaacttctgatctgttgaatgcctaaccatgacggagcccaggagacaaagtaaggtgtggtttgttttgctgtaagaccacgtttggttagcttttctctagcaaagctggggaaggagatcacagggctgatgtggtggtaggcccttggtgtagatctcactgacttttcccagtcaactaggagtaaatgttaaccctattttataggtgggaaacggaggctcagaaacattaagtaaattgcccagtgtcacacggcttgtgtgacagggaggggatttgagccaaggtccatttgatgaatttgaaacctgtagattctgtcaattccaccagtctctgctttttagaatcacagtggcaagaaaataggagaagctcaaggccctgtgttgattattaggagtttaaacatcatcgctgaaagtgcatagaaatatttgtattcctagagaatcttaagtaaaagtaacatatcaatgttgtcaagagatgtcttcattcatcagagacctctgtgtgttcattactgtatgagaccccaaagactctaagttgcctctaagacacagccttacagggaggtattaagtgattatgtatacagctagctaaaaccacaactttattatagaaatattaagaatatgtcttatcatgtgagagtattctttcttcaagtccatagcctccagttagaaatggctgtgttgtcccatcaaccccttcactcaaaaactatcattaatatcaggaaaaacttatggttacaaactcctgggttatagaattggaaggaaaaacttagatatgctgtgtttgggagcttgccttgaggattggaattccattgcaagttaccttggggtcaaagtacatcccctaaaacatcaaatacctccaagaggttttaggctatcagacagccacactttaatgtggagtagactagtcagctttcttctactatctaactgacaccatacacattgttaaagagataattttgattgggaatgaagatagggaattttgaagccagaacattctggtgatggagcagatactgccgagatgttggcctcgggacagcctggaggaggaggacactgataaacagagcaaccagcccaaggggtggaaagacctaggaagtctccacatacaaattttgcttctttcctgtttctccactgaaccctgggaagggtgcttatttctctcctcactgtctttccccaggacccagaattgataggttagttgagtttctgtgggcagtctaaggtagtgttactatttaaaatgttagtaacattttcagattcactgagattcttgctgagtgtggtggcatatgcctgtggtcccaactacttggagactgaggcaggcaggaggatcgcttgagcccaggagttggaggctacagtgagttctgattgtcctgtgaataggaatagccactgcagtccagcctgagcaccacagtggagactccactttttttttttttttaagtttaaaaaagttaaaaaaaaaaaaagacaaagaaaaaggaaagttgatttttggttctaactcagttgtgacaaacggtggatatatggttctgaccacattctaaattggacttgatggtgggcaagggaaacttccaatgcctatcccctcactttaaaaaaacttctcctgggccaggcacggtggctcatgcctgtaatcccagcactttgggaggccgaggtggacggatcatgaggtcaggagatcgagatcatcctggctaacacggtgaaaccccgtctgtactaaaaatacaaaaagaaattagccgggtatggtggtggacgcctgtagtcccagctacttgggaggctgaggcaggagaatggcatgaacctgggaggtggagtttgcagtgagccaagatggcgccactgcactccagcctgggcaacagagcgagactctgtctcaaaaaacaaacaaacaaacaaacttctcctgtagcagtttgctttgagttgtgggtgccacctccctcactgtctttttctgagggtacataaataaattgcatcctagcttgagatcaggagcaatggtttttagttctctgtgtccaacacaattcttctacacagtgtcttgcccaatacatgtgttggtaatactgacaaacatagttaatcttcttctttgaagattatctgaagcaagattttgaccttaggtcagcttcccctgaagtatgtgattggaaactgaacgagttcagattttagtttaggtaaaaatataaccagagaagttgctaccaagcatagttgactttgagctgacctaacttttggattatgtactcactaagaacttacctcttattaattaaacaaatacaaggaaataaataacccaataaaaacactcaaaacaagtttatccccaaatagtgtacttgatgctaaggacagacctaaagtttgttgaggatagaaatgaaaaatgaggcaaaagaaaccaggaattgagatgtgtgtgtgcctgtaccagcacccgtgtgagccccttgcaggtaacgacccatggtccctgcacatcagtcttctgttactaagttttgcataaattgagtctggtggttggcaagctacatatagccagctgcgtgtttgttgttttttctgcctgctagctaagaactgttcttgcattttaaatggttatgtaagtatctatatgatctccgtgattttgcctcttgtagtggcaagcctaaaatatttattgtcaggccctttgagaaaatgtttcctggctcctgcctcagacctcctggaagcagggtgttggcttgatttgtctcctgttctgcaatctgggaatagtagatcaggatgctgacttgtgggaagatgctggctgcatgagatgcccctgtctgcagtcactcatagcttggaaaagcaaaaaggaaaaagggttggatctgagcactgacagacaggtttgcttctggtttcaatgtagtaaggtgacctgataacaagggccacttgagaagttgcaaatgcagatttcctccgtgttaggtggtgaccaataaaagcatattttgtttttaggatgtagaaaggctataaaactgcaatgtctttgtatcatcaaacatttctgtgtttctgatgtttcagatgttcctatttctctggattgcaggatttcaactttgcaacatgtactgttgtgtttctgagttgttgactatttcagttccaaacagttcgttatttcctgtcagaggaaacttcagagtaacaataaagtgctggtgtggcttcaaaggcttggagaaatgaaaagcagtggagaaattttgtgaggttcctttggcttagaaggttcagaaaggctttgagcgaatgaatgtatgtatcagtcactgttactccaggtccgttagctgtttccagacctttctgtgtcctaaaaacaaacatcattttgagggtggggactgtgtcctatgttgacaggtctttgttttcaaagtctgatgtacaatagagactaaacgttcaatgactgaatgcagttcatttttaaaatttttttttttttgagacagagtctcactctgttgcccaggctggagtgcagtggcatgatctcagctcattgcaacctccacctcccaggttcaagcgattttcctgcctcagtctcctgactacctgggattataggcacgtaccaccacgcctggctaatttttgtatatttagtagagacagggtttttgccttgttagccaggctggtctcgaactcctaacctcaggtgatccacctgcctctgtctcccaaagtgctgggattacaggcgtgagccaccatgcccagccgtatgttttaaatcttatattaagcttataccactgttgattgccgttgctacagtggggcttatattaatattagaaacacccctcatttgagtggtactttacagtttatagcaacctctacataaagctgggcatggtggcacatgcctgtaattccagctgcttgggagactgaggcaggaggattgctccagcccagaagtttaagaccagcatgggcaacatagcaagaacttgtatcaaaaaaagaaaaaaaaaactttcatgttaaattctcacttgatcctcaccaagaaccctgtgaggtgagtgttattcactggatgcttagagaacctagagatcatacagctggctagtgcgtaccaggaacttgaactacttataaactggagcagtcggagaaagcttggtgtgtttgacattgtctgtctcttggtctccaggccccaagaggaagcaaaagcctaattcatcttggcaaatgctgtagaagttcttgcttggattttctttcgctagacagtttttggtggtggtttgttgctctccttcagataaacatttcttgatagtgcagtttcttccttcaatatgttcttattctggtgtgtacatccgtttctcagaatgtttagtaaacatttctgttgcataccctaatgccagtttcttacctactcctcagtagcgtgctgcagcagtggctttgggacctggtgtagacattatgggttgctttattcattcctcacagtgacaaggggatcttgattggtgctaagtccttggatggttcccttggcctcagtgactctgagagagccatcactgcaggtgtgatcagtgccagggtcttcctttcttccttctctctcactttttttttttttttttttgagatgtggtctcactctgtcacccaggctagtgtccagtggcacagtctcagctcacttgagcctcctgggctcaagctgtcctctcacctcaatctcctgagtagctggcactacaggcgtgcgccaccacacctggctaatttttgtatttttagtagagacagggtttcaccatgttgcccaggctggtcttgaactcttgagctcagacgattcacccaccttggcctcccaaagtgctgggattacaggcatgagccaccgtgcctggcttttattgtaatttttaaagtctatttctaatttcatctaaattatgttttgaaattttcaattcgtagggaaccggcagtctctccctttttatttctgcatgactgcaccacctagtggataatacatctgttaccaggcagtggcctttgatgatttcctatagctacaaattctacaaaaaggaaaattgggtgcctttttatgctttgaaatcacatataatttctgccagtaatttttgtttctaggcaagtacggactttttgagaggagcttaataacgtttaattcagaattaaaaaaaaaaacgtcagcccatacctgaagtttcccgtgtcaccaatggactaaggatgcagactgtcagtttcactcagtttatgtgataatggcatacaagatagaataatgaggtctttttctaagtttagaaacaaggctatttcaaacacctgaactttttttttttttttataacttgcttgaatttcatctgctgtgttttattaagtcaaaagaattaggaaggcttgttgatttttgcatggctttggctccacatttgatacaggaaacctcacctttcccctccctgtctcttgtctttgctgccccctgcctggatggagtatgttccagtatgatggagcaattgtttctttttgtctgttgatttccattaggtgcagtgggcattggtcattgtgctaagtataccatgcaagaacacattcagttattacgtttatggtattttaaatatgtaacatacttatgcagttgaaaccataaattgtaagatttttagtcttgtccatagattaacggtttaaaataaaattattgtgtctcttactgacagctggttaaatcagtattttcaaagtatcaatttactaagttttgtcatgtgcctctataaggaattcacagtcttcctctgcgctcccacagcctttttatttttccttcccaggaaaaattttagagacaccaaaaggattcttaaagtataaaaatgaatttcactgtttttgaaaataagtactatttttttcttaatacctggcattctgctcatggttgcagcactgtaaattgctgaaagttataggtcattacacatgaagaggcttaaaaatgccgtttgatctatagttaactacaaaatatggagggggagctatatgcacacagtgtctgccatagcattagttatactagcaaaaaaaaggaaatggcttaaatgactgctagggatatggttaattatatagtaaatattgctatttacaaatttaaattaactaaaattaaacattgcattcttcagttgcagtagccacatttcacatgttcagtagccacatgtggctagtggttactgtgttggacagcacagctatagaacatcgtcaccatggtagaaacttctgttggagagtactgctagacaggtgcttctcaaacattattttccccgtcacctccctgatgggaggtgcttctcaaacgttaatgtgcatattaatcacataggggctctagttagaatgcatatttttatcagtaggtccaagttagggcttgagattctgtatttttaacaggctcccaggggttggctacgtaatacccaaagggtggggttcttgcctttattctccaattctaataggaaaggcatgtgtttgaagctcaggactccgtatgtaggctcactggctttatgggattaaccaggctcattgctaggtggtactaatgtgtccctcttttctgtgggaaccatcatctgatggtgccccaggtctgggagggaacgattgaccttgtgtgtttcctatggggccaaccttgatggtgacatttagctgagcagctctaataattgttttttcaacctgcctttttgacaaagccgtttatgattatctttatcttggtgcctattatgggggtggtggtttgtatgtatgtttgtttttttaaagtgaagctatgttttagtgttatataagtttagtcaggtttaaaattatagggtacacagggctgtgcctgtgttgccaaattagcaccttccttttggcttattaatggcttctttgtaattacaaataagaatgatctgtttatagcttagcttagtgtatcagaactaggaacatagaggtcttaaatgtaactatcagctgatttttttttttttggtctcatatcttatgaaaattggactcatgcaaatttgcattcaaattgtgaccaggcacctgttagctgtggggccttgccatgggcaagttccttgagatctcaggccttctatttttgtatgtgaaaaaagcaggagtagggttagggtatagggtttttggaggattaataggcaatagccataaaatacttagcacggtgtctggcatattgttaatgtccaatcagtgatgatgtgtttcaggcccccccttttccatggtgttcacaaaggcgtaggcattagggagcttgtgcatatataccaaagctgactgttcaaacagccagaaataaaatccgactcgactccctttctgcaccctcttcttaccaactcactgcagaagacttattgggctgtgttgactggacccaggccagtggtgtggaaatagctatcatgcttgtgaagatgttctgagttgtcagagtgattgaatccatgattggtctggtgcccaagcaccaacaatcatgtttttgtttgtgtgtttgttttttaagagacagggcctcactctgtcacccaggctagagtgcagtggtgccatcatagctcactgcagtctcaaactcctgggttcaagcagtgctctctccacagcctcccaatgtgctgggattacaggcatgagacactgagcccagctgggatttcttttggtgtgaaggccagtgatcagtcactagtaggttttggaaggcacaataggtgtatagtggagaggcaaggttcttcagtggaaaggatataagctttctagtcacaccagcctgagttagaatctgtcctctgccactttttacttgtatgacctcaatcaacttactttacttctgacttcagtgtcctttctgtaaaatgagtctattaataatgatattgataatagctaaaattgagcatgtactatgtgccaggcattaccttgatttctctacatgcactgtctgattaaattctcacaacaaccttagagaggtgggtcttgttactgctactgcctctgctttacagatggaggaaactgaggcaaggagaaattaagtaactcgcccaaggtaaagggtggagcatggatttgaatccacactttctgactacagactctacgatgtgatcttttttttaaaaacagctttattgagatataattcatataccatacaataaaagtgtgcaaccagtggcttttagtactgtatattcacagagttgtgtggccatcaccacaattcattttagaacattttcttcaccccaaaaggaaactgcatacccattagcagtcactcctcatttcccccaaactcccatagtcttagggaaccagtaatctttcagcctctgtggatttgcccctccttgacatttcacataaatttgtcattttatgtcacataatttgtcattttatgtctgatttcttttgcttgttttatatatatatgtgtgtgtgtgtgtgtgtacacacacacacacacacacacacacacacatgttttctggaggcagagtctcactctgtcgcccaggttggagtgcagtggcacaatctgggttcactgcaacctccgcctccccagttcaagtgattatcctgcttcaccctccccagcagctgggattacaagtgccaccacacctggctaattttttgtgtttttagtagagatggggttttaccaggctggtcttgaactcctgaactcaagtgatccacctgcctcgacctcccacagtgctgagattacaggcgtgagccatcgtgcttggccctgcttatattatttttaaggatcatccatgttgtagcatgtgtagatactttggtccaccttattgttgagtaacagttcattgtatggatataccacatttcgtttatccagtcatcagttgatggacatttgggctgtttccacttgtttgctattttaaataatactgttatgaacatttgtatacaagttgttgtgtacacatgtattttcaattttcttgagttctgtgatgtacttgttggttttgtttttctttttttctaccatgtgttcgtaatgctcttctgagaggaagaaaacagactttcttacttgggagtggtcagcttatttgctgctacaatattaatgatggaaaacccttatcaagagtgcttatcctgtgatgggtactgagcaatgctctccagaagcattactttattcagttctcagaattctaatagggtagggatcttgacctcattttgcagataggcaaccaagtcttaccaagtgaactgttccagatcacagagcttggagagtgtgtagggggactgagcttagacccaggtgtgtgtgacggcctccagaactcctgccactgtgttatgtggacaccattgtctacctcccactggaaggtttaccagcctggattttacagagtgctttcatggggtttgcctggtttcaccctgtgaaatgggtgatgatgccatcgtttgatgaagcagcagtggaattgagtgagcgcccaagctcatgggtgaattgaggcgcagtcttggatggaggtctgtttttggagtttaaatttattgctgtttgcatttcaacacaactgctttgaaagctacaggttgcctcaggcaccctgtcatcctttcccaattcttttttttttttttttttgagactgagtttcactctgtcacccaggctggagtgcagtgacactatctcagctcagtgcagcctctgcatcccaggttcaagcgattctcttgcctcagcctccagagtagctgggactacaggcatgtgccactacacccagcgaatttttttattttcagtagagatggggtttcaccatgttggccaggctggtcttgatctcctgacctcaggtcatctgcccgccttggcctcccaaggtgctgggattacaggcgtgagccaccatgcccggccacctttctcaattctttattatctatttaaatgcacgctaaaaaatttaccttaggtaaataaaggagaatgtggttaaaaaacacaactcagtaaacctggcactcttcagtagtaggtctgggatctagttgtgttgattctggtgacctatcacaaacccctctctaagcttattgctttttgctgttaaacttggtcataagcaagctgtgtccattgtgaagtgtgtgctgtgagcacatcgcatacactagatttaatcatccactgccggcactcagtgcattgtgaagggagggtaaggagctggtgaaatcacatgtgaaactgaaatacttgtggaataaacgatgaaagggttttgtttgtaaaacaaacgctacagaaagtattgttggatgcggtggcaactagtttattgctaccaagaggggtttaagtttgaatagaccacaggtaagtgccctgaagccaaaaggacttggtttataatgttaaaaattattcgtttttggaagaacaagagttgaactcattttctgccttctctgggaaaaagcatttcctgttttgttattagacagctgtttcaaagttttgtccagtaagcagaattttgactaaattcttcacaatagttaaaaccaatttcctgggggcaggtggggaactataaaagtcctcttttcatctggaggtaggtttacctaccagcctaggccagctagctgtttctttacactatccctttctaaggatttgagttcgtttgtaaaatgacatagcagacacaacataataccagagggggctgaacgtggtggctcacatctgtaatcccagcactttgggaagccaaggcaggaagagtctcaggagttcgagaccagcctgggcaacatagcgagaccttgtctctactaaaattaaaaaaaattagccaggtgtggtggcatgtgcctttaagtcccagctactccggggctgaggcaggaggaccgcttgagcccaggaggttgaggctgcagtgagccctgattgtgccactgcactccagcctgggcgacagaacaagatcctgtctcagacatacacacacacacacgcatgcacgtacgcacgcaccagagggaaacatcatgcagaaaaccattggcccatttattggatggtgtcctcccgaagtttcacatctgctgtttggagctactgagaacctggctgatttcatttagtgctccctctgtcttactttgtctttccttcctttctttcctttctccctcctttccttctttccagctatccagtaacatgtattaaggactcagcatgtggaaagcacgcatgacattgttcatggagacgagggtctggagtcaggcagcagctcggatcccatctctgacagtggtgggctgtgtacactctctggcctcagcttccctatttgtaaaatggggatggtggtgctaactcacagggttgtgggcattcagggaaaaattgtatatttagtactgggtgtggtgccctgccaaatgttaatgacttccttcctctccagttttcacacttaccttgtctcccatttctgaggtgaatatgcattttaaggctcccaagccatagattaagctgttttgacatgtctgtccctgctgagaacgtgaaatcctgtgtgtgttattaaacagtttactgcccggccgcactgagtactcgcaatgtcttgaacacccttgcaggttacccctcctggctctgaacgggctgttccctctatgcagaatgcccacccacctgaccagttagtcatccttcagcatggagctgtgggagagggagcctccctgtggttgggacatacctccctccaccccaggcctctcatcctcagttaacaacccgcctgtgccatcaattacactgttttgtggttttttacacctttttttctagacacaggatctcactgtattgccaaggctggagtgtggtggcatgatcatagctcactgtagcctccaactcctgtgctcaagtgatcctcctgcctcagtgtcctgagcagctaggactataggcacatgccactgcacctggctagattttaacatttttctttttgtagagataggatcttgctttgttgcctagcccagtcttgaactcctgggctcaactgatgctcccacttcagcctcttaaagtgctgggattataggcttgagccaccatgggggctggcctcgcttcacattttatgtagttgctataaccccaccactcaccctgctccagcccatgtcaccttttctctttcctaaatgtactaagcttgtttcccaccccagggcctttgcatttgctgttcccgcagcaatctggagagctgttcagattttcctaggattaattcttcccagtctgccatcccatggcacttattactacctgagatgatgatatatattgactcttgtctgctttctctgctaaaatcctccctgtgaggaaacgagtttggcacatatcccctggcagcatctgacatggcataagtactcagggagtatatgtcgaatgaatgagcctcttggtgggctcttgtacttgcactgaattgtaattgcttgtttacacatcccacctccccactgggctgtgtgacttcctttgcatcataacttggggtgatttgtctttctgtccacagggccaggtgcatggttgcttttgggtctgtaagtatggaagctaggaatctttgagaaggcacatccttaaacccataagctcttctcatggaggtagctgtccaccacaaaatgtccttctgatgccattggtagaacaagtactggttggagcaggctgcagttgttcttacgttctgatggccatcctctactgtcccctcccccttttctttgtcaggtctttgccctgtgctgttctttggaccctgaacaaacccttctccccaccccgctaatcctgtcctttccttcagacctcatctcggtgtccctggctcatggaaaccctccctggccaacctgccttgatcagatgctggctcctgcaaagcttcctgagggcagtgctttatttgttttgctcttcatttgttcctcagagcacattgcacttggtcgacatttgttgaatgaatgagtaaagaattagtgatggcatatttacatacccatgttcatggcagcgtttttcactatagccaagaggtgaaagtaacccaagtgtctgttgacagatgagtggataaacaaaatatgtcatatacatacaatggaatattattcagccttagaaagggaggaacttctgacatacgccgccaccacgtagacgaaccttgaggacattatgctatgtgaagtaagccaatcacaggaagacaaatcttgtgtgagtccacttatatgatgtgtctaatgtagtcaaattcatagaatcacaaaacagaatggtggttgccaggagctgaggggagagggaaatggggagttgtttgataggcatgagtttcagttttgcaagatgaagagttcttgagttcagtatattctgaagtgtgaatatactactgtcttagtcaattcctactcctgtaactgggaagtttataaaaaacagaaatttatttgcccacagttttggctgggaagttgaagatcaaggcaacagcagatttggcatctggtgagggcagctctctccttccaagatggtgtcttgttgctgtatccttacatgacagaagaggtggaaagcaagggggtttagctcagtccctccagcccttttgtaagagcacaaatcccattcatgaggttggagccctcttaatcacctcctaaaagctcctccccttaacacttactgtattgggtcttaggttccagcacatgagttttggtgggacacatacattcaaaccttagcaggtgctacactgtataccctagaaaaatgagaggttaggagtgccgaccctcacacagtcaaaaatccatgtataacttttgactcccccaaaacttaactaatagcttgctgtttaccagaaaacttaccataacataaacagtcaatgaacgcattttatatgctatatgtattatatactgttttgtcacagtaaagtaagctagggaagagaaaatacatttattactcactaagtggaagtggatagtcctaaaggacttcatcctgattgtcttcatgttgagtaggctgaggaagatgacggtttggtcctgctgtgcccaggcggcagaggcggaagaggtggaggaggtgaaggggaggcaggggaggcaggcacactctgtataacttttattgaaaaaaacccatggataagtggaccagggcagttcaaaccttgctgttcaagggccaactgtacttagaaatggttaagataataaattttaggttatatattcttcagcacaattaaaaaaaagaattactgctgctagaaactatgacctctggaaatcactgtagaagaatctggaattcttaaattctaggacacctctgacttctgggtagtatgcatgaacttaagggaaagaagtatttatttcctcatgaggataagctcaggtgttttccttaggactgtcagagtgaaggagtgggctggcctgaaccctccccgagttgcctgggttctcaggctcctctgcacctggagctagtgagccagcccatgggctgaacctggctggtgtgtacagagcctgcacatgtctgcatagcctaggttgaggtttggacacttgcttagattccaaggtcctcctttgtacccatttatttatataataaataatttattattatttttttgagacggagttcactcttgttgcctaggctggagtgcaatggtgggatcttggctcactgcaggagaagtgattctcctgcctcagtctcctgggtagctggggttacaggcacccgccaacatgcccggattttttgtgtgtgtttttagtagagacgaggtttcaacatgttggccaggctggtcttgaactcctggcctcaggtgatcctcccacctcagcctcccaaagtgctgggattataggcatgagccacggtgcccagcctggattttttttttttttttttttttttgagacagggtctcgctctatggcccaggctggaatgcagtggcccgatctcaggtcactgcaacctccgcctcctgggctcaggtgatcctcctacctcagcctcccaagtatctgggactacaggtgtgcacaaccatgcccagctaatttttctatttttagtagagatggggtttcaccatgttggccaggctggtcttgaacttctggctcaagcgatctgcccatctcagcctcccaaagtgctaggattacaggcgtgagtgactgcgcctggcaaagtgtaggatttgaaacataaacttgtattcatttttgatctcatttaactgtcataacatgaagaactcaactcttagggaaggacacacatttcccagtgcctgtccagcaccagcacgagtgctttgtagagattgcctcatttcttgccgacattgcccttctgaagtgtagatggttttatcgccactgtataaagaagggtatagtgtatccaacgccccacagctaagtgacaggacaaggatctcactccagatcttgtgactttaaaaatcactttcttggctctgcttctccttgtttcctagatggtggccatctcatggtccagatttatatacatctcagcctcaaatcaaatggcacactttacatttgcacgctgtttggccaagcccattggcatataacatacactatggtagcaagaattggccagaggctccccaagaccagacttctgaattcctaaccccagctcccaagccccaggcatcccataaaatctttgctagatgttcagaaacctaaaatttgcttctccacccctcccttctccccaagtggtaaagacaaagaacagacggcagggctctttgttattcttttatctgctaagtttacaaaaaggttagacagtggaactttgctgagcaagcattctgtccctgagttgtctctgagcagcaccaaatgagtcttatcttccccttgttatctccaaggacgtaaaacattttcttttcatgctttttaatttctgtgtaacattagccattcagttgacctgaaacattgctagtttatttctagctggcgtgtgtgtgtgtgtatcagagggtctatactgtataaatacttctctaaatattcttttccataatgttgctctaaagtgtctcatttactcaattctgtcaacttagatgctgaatcattttatgtgcttaaaagaaatatctactcggatgctctagttccctggcaagggagagagagggagagaaagaaagctgttgaagtggtgcaaatccaaactgctttcttttttgctcataagtagtgcttttcaaagcgtttggcatccctgccatatggatgtgtcactgtgtgagatgacaacaggatttgctggaaatgtgggccactattgtatccgccttacgtaaccacatggagtgatggaaatgggtgagcagcccggaatgtaggcggtggcctggcccatgcatctccagagaccatgaagactgctcaagccctacataggatgtggatccaggctgttaaaaagttgaggagatggaaaggccgtgtgagtccctctgcaagctctccccttgttttccccaacctttcttcatgggaaggggagggaagcaaaaccattctcacagtgagtcctttatcctcagattgatttgtgcttctggcatctttcagcaacaaattgtgagattgtaggttgtagtcactggtgggtttttaaaaatacttgtattaattttagcagatctatgtgaaactgatagcctcttactggatctgtggatcaaaggctgctgttttccatgtgctaggaatctgtaatggttttgcttcctgggtagagcttaacatactggcttttgtgtttgttcatgtttgagaatttcttgttttgggataaaactttttgctttcttacactgcagaaatctatattcttattatgtctaggcttctaacttagaagaaaaagtgtttttcacatgttcttttttcctcttacagtttgaacatgtgtgagtgtttactttgatggcttgagacttttatgaagcatgtcccttacgtggacagcttgcgattaatctttggttttagctttgacctccatcactgggcagcagcagtctgtggatacagaatctaaaagccgcctgttcagggggactttgggcagtgaacacttcggtatctgttttggggttggcttttaacatgtttctacattctttatgtaaaatatataggatttttacctatctggccaagatttttcaaaggaaaaaagctttataaaaagattaaaaaaaaacacaataagtaactatttgccttagttcctttctcttcttttgtcacacaaaaaccttactgttaatgcattaagttttttgtttatggtagaaaagttagctcacttttaactttccatgaggtcttaagaatgacctgttagatataaagggggttgtcatgaacactacttacgtgaaaagtaaaagtgataaggaaagatgatgaaagcacattgaagatcctcctaatggatagaatgttgacacttggattaaaaaggtgacttggcgttttctgcatacacctccccccacaactccccagacctaacctgcgtccccactctgcccaccgcacctgccttgctttaccctctttgcccctttcaaattactggtaccatccttcaactcgccctccttccagttgaaattattatcccctcttcactttgcaaaattctaactgcattgaaaaatttgctgttaaatatactcgtacctcttgggtattagatccttcaccaggagtcagtattcattttggtgttcacccactcatctccctattttttatttatttatttatttatttaatttttttatttctttttgagacggagtcttgctctgttgcccaggctggagtgcagtggcgcgatttcggctcactgcaagctccacctcccgggttcgagccattctcctgcctcagcctcccgagtagctgggactacaggtgcctgccaccacacctggctaattttttgtatttttagtagagatggggtttaaccatgttagtcagtatggtcttgatctcctgacctcgtgatccacccgcctcggcctcccaaagtgctgggattacaggcgcgagccatcgcgcccggcctcatctccctattttttaaacttatgaaatgtttggtaccataaaagaattaaatatctaaatcatggagcataataattaaacaaatgccatgagcccattacacatatctgcagaccatcaccaagacaaaacacgaaggaaatttgtgtacctcccaccatactctgcctcctgcccaggtcacctcatcctgaatgttatgtttttcatttccttgctttttctttatatttccactgcatgcgtgcgtacacacacacacgcccctaaacaatagattaattttgttggcaattttttactatagtgaaaaacgcataccaaaatttactgtctgtaccatttgtaaatgtacagttcagtagtgttaagtatattcaagttgttgtaaaacattgttttttgagctatataaaaatggtatcacactctacaaatccttctggggtgtttttttgctcaactttatgtttgagatgcatcccttttgtggtggtctatgtgactggtttgttcgtcttcattgcagtaaaacattgtattttaataatgtatcaatttgtccatcctgcccttgagagatactgggatattttccaagttttggctgttgggaacattgctgctgtgaatactctatacatgtgtccttgtgcatttagtcacacggttctcccggtgcctctgcccaggtagaggaatcactgggtcgtggaatgtgcatacctttaattctgatatatgcgtgctctttctatgggcctgcctgtaaagctccccctggtgctaagcagctacctgctgtcattcagagagaggtcagatattgctagcaagtctgatctgcgcatagccaagcacaaggtggtgggtgggaccagagcccggtggcctagtttgaatgtcaggaccacagctctcagctaagctgctgcaccctggcagcctgtgcccagggatgttcctagagctgatgttctgaggaataaggatgattatgtggggtgctctgtgtttctgaaaaattatataaatgaggcaggaaagacactcagtagtttgctctttgggtacacttgtagttagttggtaagctgcccaagggctttggcgattttattcactgatgtctctgaagtgccacaaaccacttgcttggcagaaggtggatgcttaataaatgtttttgcataaatgaacaaatgagtgcacagtgaagagttttctgtgagaccttcccaaaaagtcacagttctgtaggctaaatatacatagttatggtgtatttttaatgttcaacagagctactaaaatttatttttgctctagttcccttcctttacaattaagattttctctttatcacttggcttagcagagcatatattctttgaatattatgttaagtagctaatagttaattttattacccgttaaccataggtaagaagaagcctcgcaatctgattggtttcaggcaccaggcaagttaatagcaaggtctgattggtggtggtagtggtaggagattaatcgtctctctgacaaatttaatttaaattacgcttgcaggcatcacaggacacttaaagatggtagcatcccattattgaagggctgtgaatttcaaaagccagattcattctacttgagccacatttaaaaaataaaattttgcaggaactcatttatttggctaaatgataaacaaatttaaatccaaaactttgaagagtttatagttttaaattccaaaatagaaatgtattttaaaagtaatgtactcataaaaatattctctataatagcacagctccttgggatattcaacatttttttggtatgtagcattgcccaatcctggggatgattgtcatagtcccagttagttttttttcctgataattttaaagtaagttttgtggggaggatgtcatgtaattttttttcccccttaattcatggggctataactatatccaaagaagagttggcaaatatatttattttaccacaacttctagattaattcactttgttgaaatttgacagctttaaggtacaagaaggcattgagaagatgagcttggagaagtgggcatgctcataaggtcatttctgggtggtagtggcttagttttactaaggccacatctaaaactgaagttggcaaggagttagtaaggtgttctatggaaatggaaaagggcaaccaattctgacttactgcaggagttcagttgagtgtctgctttctttttcttttctttctttattttttttgagacagagtctcactctggagtgcagtggcgcaatctcagctcattgcaacctccacctcccaggttcaagtgattctcttgcttcagcctcccaagtagctgggactacagatatgcgccaccacgcccggctaattttttgtgtttttggtagagatagggtttcaccatgttggccaggctggtcttgaactcctggccccaagtgatccacctgccttggcctcccaaagtgttgggattataggcgtgaaccatcacgcccgacccggtttctgctttctgtttccatttaagaaaactttttggccgggcgtagtggctcacacctgtaatcccagcgctttgggaggccgaggtgggcggatcatctaaggttgggagtttgagaccagcctgaccagcatggtgaaaccctgtctctactaaaaatacaaaaattagctgggtgtggtggcgcatgcctgtaatcccaactactcgggaggctgaggcaggagaatcgctagaacccaggaggcggaggttgcagtgagcccagatcgtgccattgcactccagcctgggctggagcaaaactccatctcaaaaaaaaaaaacaaaaaaactttttaacaaatatgtacaacttcattaaaatattggaaaatttattgtgcttccacatattggaaaatgctgttttagacacatgcagaattccagagaggtatggctatagagcacatctagaaagtcagaccatgagcacctgagtttttagttcacccacctcacgtatgctatcaaagaagcagagagccacgaatttgatacaaactttctttaagaaaatttgtaggctgggcacggtgtctcacacctgtaatcccggcattttgggaggctaaggcaggcggaccatttgaggtcaggagtttgagatgagcctggccaacatggtgaaaccgtgtctctaccaaaaatacaaaaaaatgagctgggtgtggtggcgcacaactgtaatcccagctactcgggaggctgaggtatgcgaatcacttgaacccaggaggcagaggttgcagtgaacctagatcacacccctgcattccagcctgggtgacagagtgagaccccgtccccccccccccccaaaaaaaaaaaaagtagcagcagtcagtgcttcagttatattaattgaatgatgaatgaatagtgtatccatctctagatgtattaaaaagaaaaaactttgagtgcctactctgtgtgccagacactgttgtagcagataatgggacaaagatgagtaggatacaaaaatttcacctgaaaattcacttttattttttaaaattgaagaacagtcgtcacagtgaacagactttaagtaattggggagttttacataatttagataataatcttttggaatgtttacatatttccttgtgttgatgggccttcatttaatctaaatcttgcacttttgggctgcttgcgtccctggcaccccaggccccattcaccacccagtcccaggattgctggtagcacagatctcttcttctggcctttttcaggtattttgagttctttttttttttttttttttttcttattaaatatacagatggggtctcactatgttgctcaggttggtcgtaaactcctgcactcaactgatcaccccgcctcagcctcctgagtagctgggactatggcatgtgccaccatgcctggctaactttaaaaattttttgtagagatggggtctcactatgttgcacaggctgcccttgaactcctaggctcaagcgatcctctcgcttcagcctgagtgctggaaatacagacgtgagccactgcacccagccctcttctaatttcttaaaacataaacacatagtccgggtggcttggtggctcatgcctgtaatcccagcactttgggaggccgaggcaggtggatcacaaggtcaggagtttgagaccagcctgatcaacatggtgaagccccatctctactaaaatacaaaaattagccgggcgtggtagtgcgcacctgtaatcctagctacccaggagactgagtcaggagaatcgcttgaacctgggaggcggaggttgcagtgagtgaagatcacgccactgtactccagcctgggcgacagaacgagactccgtctcaaacaaaacaaaacaaaacaaaaaaccaacatatacacatattatagatactccatttttgtctgtggctggtatttcaaatatttaaagtctttgattcttcagtttatgtttcttttacctctcactcatggtgatgtgcatgtttaaattgtgggctcatttccttggatacatactatctggggaatctttgagggctgtgtttgagtgtgatctctggagaggattcgcatctgcctctgtgtacttggtggtatggccagtgcagagccccagtaggcatgagtgtttggcagggtgtggtcacgtctgtaatatgaacgcccaaacctgtgtgaatacaggtctgttgatagaaattctccagggttttatttttagttatttccactctacccatagccaaggatgagacagtcactgcatctccatctgtgtgctggtatttttttcccctaatagatccacccagacctgatctcccaccctgtttggatccccagcctcctctaaatgcctgcttcagtgctggcttatctctgtggttctgagtgttcttggcatttctagctttctcacaggcagcctgcatttaatggattattatttttaaaatgataccaccagttgtagttttttctggatacctactttggaatattgtcagagatggaagtcccagtggtctatttatgaagacattcatctttcatactcagtgatacagatggagaaaaagccgaaagatcccgcagatcacccaattgggcataccctatgataaggctaaggatatttttagacataaacatgcagaaaacttgcctacgaggtcacctttgacaggaagagggggagaatgattttaaaaaaagaatctatttgaaactagatatttttaaaggggttttatgatgataatgttttggaatagtgataataaaaggactcagcacttaacattccattctttttagggtctgtctctcactatgtatttcacttacctttcaagtattgtttctagtttcatttcattgaaggagagtgtgtttgaaaataggtagcataatgaacagatattaactcttttttggtatagaaagtgtgagctggactttatgtcgaggcattttgaatgataattttatttctagcattgaaaaggttgtggttttcatcagattggttttgttcttttaaaacaggccccaggcatggaagagctgatatgggaacagtacactgtgaccctacaaaaggtgagttctgcacatttcatatattctacagtcatgttcttgattttacggatcatggatcttatttattttcacctacacacagttttggctttttttttcccttgaggtacataatgtattatagatactaactggcaataattgctatgttaacaaagatttgcatgctattgtattttttgattaaggactgtttagtatggaacattttagaggttatttagtgtatactcttatctccagctagaacaggttatgaaagagagaaaagaaagggaagaatgaaaatgacctgtactgtttaaggatgtggagggagctttttacaacttctgtaattttaattatgacatattatacataccttataactcttaaaaagtgtagcatccaagagactgtaagtcatttgtgtgaggctgagctggagaactgcactcgtggttctgcatttttttttttttttttttttttttgagacggaattgcactcttgtcgcccaggctggagtacggtggtgcaatttcggctcagcgcaacctccgcctcccgggttcaagcaattttcctgcctcagcctcccaagtagctgggattacaggcgcctatcaccacgcccggctaattttgtatttttaatagagacggggtttctccatgttggtcaggctggtctcgaactcctgacctcaggtgatccacccaccttggcccgcaaagtgctgggttgcaggcgtgagccaccgtgcccagacggttccgcatttttattccgtcaagctgccttccggtcatcatcactgtgattttcctggtttttctgcagggtttcttcttctggctctgaattcctccaaggtctgacatctcctagagggaccataagttcctcataggaagagttttcctttgaccctcagaactgtgagcttcaagctttgtcttctatgaaaattaaagacattcccgaatttaatgtttgttgaattaatccaggtagaaaaaaatgtctctgggccagtgcccaggtacccagacttccagatcagtaatcacaatttcctcatttgaggggttttgtctgcttaggtcttatttttcaactttcctcgtctttctgactctcctctgccctttccctgagcatttcatgcattccttgagttgtggacccaaaattggcagaggtcagagatttttttaggcttggcatagaggatggagctgcctctgtctaaaaccaggtgccggctggtggtgctgccaaattcaaagccatgtgattaatagacaacacccccaacctgttttgagtttgtaattgtgtataatcagtcagcatagtgggcctcacgtgggaaactttccttggaaaggaagattttcttttagtctcggagtaaatttttatataatcgaacccagatttaagaatatacagtcaaatatactcatattatctggatgaaactgggcttagatacatatatatatttttgaaatggagtctcattcagttgcccaggctggagtgtaattgcatgatctcagctcactgcaaccttcacctcctaggttcaagtgattttcctgctccagcctcctaagtagctgggattacaggggtgtgccaccacacctggctaatttttgtatttttagtagagatggggttttgccatgttggccaggctgatctcgaactcctggactcaagcaattcacccgccttggcctcccgaagtgctgggattacaggtgtgagccaccgcacctggcccagacttagctttttaaaacacaaatgaattaggattatgtattatctatgctcaccattgtgcattgctagactgatcatggatgtaataaatcttatttccgatcttccatgcatgaagaaaagggtttagtgctttgcttttcatgagatctcaacacatattttacgttcaaattttatctttaaaatccagttacgggccgggcgcagtagctcacgcctgtaatccccacactttgggaggcagagacaggtggatcacaaggtcaggagatcgagaccatcctggccaacatggtgaaaccctccctgtctctctactaaaaatacaaaaattagctgggtgtggtggcacatgcctgtagtcccagctactcaggaggctgaggcaggagaatcacttgaacctaggaggcaggggttgcagtgagccagcaccactgcactccagcctggcaacagagcaagactccatctcaaaaaaaaaaaaaacaaacaaatccatttacttctttttcactgtatgttgaaatgaaactaccaacacatctactttgaagttaaaggtatactttaaaaatataattttaggcagacataagaaagaacgaaatatgtcctttgcagcaacacgaatgtacctggaggccattatcctaagcaaattaatgctgaaacagaaaaccaaatactgcatgttctcacttagaagtgggagctaaacattgggtacacacagacacaaggacaggaacagtaaacactgggaattccaaaagtacggagggagggagaggagcaaagtttgaaaaactacttcttgggtactgtgttcggtacttgagtgacaggatcattagaagcccaaacctcagcatcagacaatacacatatataacaaacctgcacatgtactcctgaatctaaaataaaaataaaattaaaaaggattggctagcactgggaagagcagtcttttcccgcccagctagaaagttgtggttttttttttttgttttttagagacttctccatttgcccaatttaaagtgcaaaagctgccttggcttgttgaagccttgacctcacaggctcaggtgattctcccacctcagcctcccaagtatctgggactatggatgtgcaccaccatgaccagctatttttttctatttctagtaaagacagggttttgccatgttgtccaggctggtcttgagctgctggactcaagcaatctgcctgcattggcctcccaaagtgctgggattatagacatgagccatgagcctaggcagaaggtttttttttttttaatatgtcaaaacatcacaatatacagaagaattaaaaatatttacagtacaggccaggcacaatggctgtctgttgtaatcccagtgctttgggaggttgagacaggaggctcatttgagcccagaaatttgaggctgtagtgagtagtgatcacaccgctgcactccagcctagcaacagatcaaaactctgtctcttaaaaaacaaatacaataaggaaatctgaaaattaaaaaatacagttttagtacaggttcagtttttactgaagttgttccagctcgggccagcatgatgcaaagaggtacaactggtgcttcaaacagtacgtccctatttggactgaagacattgtttcctatcccggccagcttctagtgataactccagtctgcactatcaatcttttccagcctctacaggctgtttctttcagataaggaatttccctttataaacctgtcagctgacaatgactatgctttgttttgtttctcatttgtttctgtaagcccatctgttcctgaacagtctctggttattgatttgacctttattttattgagtgcttgtaataaatcctgaaagccacttattgaaggatttttaatatttctcctctctgatgtacaggattccaaaagaggatttggaattgcagtgtccggaggcagagacaacccccactttgaaaatggagaaacgtcaattgtcatttctgatgtgctcccgggtgggcctgctgatgggctgctccagtgagtgtcctccctcgctccgcagcccctaccagccctactggttggccctagacggggtattttggttggtgtccactttatttaaaaaaaagaaaaaaataacaaacttttatataatatttgaaaagtcttcaagctggaatggaagccataacacaccatgtttgaataatgcccaaaccttgggaacaccccagctttggagcgaggagggcagttgtttccgtaagaagatagttccaaacatccctcctaggtttaggaatcatttctgaacatggagttttaaattggcatgcttctcaaccccgatgcttaaccaacactgtttatgtttgttttaatttatattctttaagaatttaatgaggagactttggtttattgattatcttatttgtaagagtgatgtggaagttgggacaatttactataggaaaaccacaagttttccaactgccagctttctgacctgaagaagtaacaccattttattttaatttttaataaattttttcttttctttttttttttttttttcagacagagtcttgctctgtcacccagtctggattgcagtggtgcgatctcagctcactgcaaccatcaccttccgagttcaagcaattctcttctgcctcagccacctgagtagctgggattacaggtgcctgccaccactcccagctaatttttgtatttttagtagagacgggttttcgccatgttggctaggctggtgtcaaactcctgacctgaagtgatctgcccacctcggcctcccaaagtgctgggattacaggcatgagccaccatacccagctggtaacaccattttacatgatacatgcctgattcccacaggataacttctcaggacgaagtctaaagttaactgtatggctgcattggataaatagctcaaaagtttaggttttgttggtgtttaaagcctctgtgaactaagcacagtggctcacgcctataatcctgcactttgggaggctgaggtggcaggaacgcttgaggccaggtgttcaagatcagcctgggcaacctagtgagaccctgttgggatggcatgtacctactcgggtcccagctacttgggaggctaaggtgagagaatcctttgagctcgggaagttgaggttgcggtgagctatcatcagtcacactactgcagtccttcctgggtgagagagggaaaccatgcctcttaaaaaataaaattatagttaagaaagtctctatagttttatcaaagttagtagtctttcatatggagaaatgcaaaattttaaagtaatatttgggatgaactggaacaataggattctgtgatctcaaaatttcttaagaatccaaggcaagcccttttcctgcacaaaagcacaaatggatatacacctacttggaaggagtgtttttagacttttctgaagcccaccgtgcacctcaggcaataggggactgatagagaaattccttttgtgtccagacctcaccgtcatcaagtacctcctggtgtgatgctgtggtttggggagatcaggcctctctcttcccagatgatttccatttagacactcagaattgagctgtatggcccccagttcctttctttggaagatctcaggccaagttgactgggccttgggcgccactagacactgagccctttagaaagcctttcaggtctatttgctgcttctatttgttcctaaataaataatttacaatgaatagatgggagtttttcatgacccatttttatttcttgtttacagagaaaatgacagagtggtcatggtcaatggcacccccatggaggatgtgcttcattcgtttgcagttcagcagctcagaaaaagtgggaaggtcgctgctattgtaagtactgggtttgctttcagcttgccttaatagcattttggttttttgcccagaagaaaattaccccttgcttttaagcatttgacagaattacataacctagggaccgctgttcttggatcctcagtacttttggaggggtgtgaagatatgtgtaagttatcttcctacttttccttgtgtcttctcctgaggccagtgattctctgatctgagttagtttgccttaggaaccaagttaggcaattattccctaagagaattagctagattcagaatactggtaaaatagtattaatttagaaaaaaactttcagctcaaaaactcacttgtaaaggcccaagcaaggtatattatatcttcatagactaagagtttcattagaagactgtctataatcttcattcatctattccttcattcattcactggctgagaatcaactgtgagctggatgccattaggccctggggccaatctgtgttgcaagatgtgttcactccagtggggcaggtagacacacacagtgagaatggtaataaagtgtgcttaggggcaatgctagtaggcatatacccacatatatggttgtgtgtgtgtgtgtgtattttttttttttttttgagacagagttttgctcttgttgcccaggctggagtgcaatggcacgatcttggctgaccacaatctccgcctcctgggttcaagcgattctcctgcctcagcctcccgagtagctgggattacaggcatgcaccaccacacctgtctaattttgtatttttagtagagacggggtttcaccatgttggtcaggctggtcccgaactcccaacttcaggtgatccgccagccttggcctcccaaagtgctgggattacaggcgtgagccacctcacccggccacatatatggtatttaatgtttttcaactttatattatgaagattttcaaagaaaaaggaaagttgaaagatcagtgtaataaacatttatcttctaaaatattactattctgccatctttacttggtctctgtatgtatataaacactcatgtctttctgggcaaccatgcgaaggaaagttacagacatgacagttcatttctacttacttcacatgcatttcctatgaatgaggacattcatctatataatactattatccgatctaagaaaagtaataattttacagtattatctaaaatccagtccatatctcaagatgtctttttcatttttagagatgggatcttgttgtgtttcccaggctgatcttgatctcctgggttcaagcgatccttccacctcagcctcccaaggtgctgggattacaggtgtgagccaccatacgcagctctcaaaatgtctttgatatatgttttcttccctatccaggatccaaagttcactcattgcatttaatcattatctctttagttccttttaatctagaagggttcctctttccccttgcccctctaccccaccccccactttaaaaatggcattgggccaggttcagtggttcacgccagcactttgggagatggaggcaggcagatcacctgaggtcaggagttcgagaccagcctggccaacatggtgaaaccccgtctctactaaaaatacaaaaattagccaggcatggtggtgtgcgcctgtaatcccagctatcgggagggtgaggcacgagaatcgcttgaacctgggaggcggaggttgcagtgagctgagtacagtccagcctgggcaacagagcgagactttgtcttaataataaattaaataaataaataaataaggcattgacttttcttccttaaaattttaaaaatttatgcataatgcatagttatagggtatgtgtgattaatttaatacattaatatgatttgtaaaattcagatgagattgggcacgttcaggatggtatggctgtagacatgatttgtaaaattcaaatcagtgtatttggaatatccatcaccttaaataattgtcttttctttatggtagaaacgttcagattattttcttccagctattttggaatgtacagtagattcctgtaagctgtagtcaccctaccgatctaacattaggtcttatttcttctatcagaccatatatttgtacccatcaatcaacttctctttatccgcctttgcccccttggcagctatgtatagaatgtcacactttctggatttttgttttttgagttttataacttagtgatttgggcctctgagacttttcaaacttgagtagaagcagattttggagatactattttattattaccttaattcaaggccctgtactcagagcttcacggtcattgtcctattctaaccctgtgagatttttattgtccgtttccggatgaggaacctgaaccttagtgagtcggcagggatacggttttcctgaaaccagaaccagggctcttaaccactgccttctccacattcagttgtgattgtcctgcgtccacactgagtttgttttgacaacaggtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccgctctcggggaccccgaagccgcagccgcgagcacccgcactcacggagccccagccccgagcctagggggcggccggggcccatcggggtcctcctgatgaaaagcagagcgaacgaaggtaggcatgcttgatgtgggaagaaaagcactgttgtgatatgaataacctttgttttcttaatttttttttttcccccgaaagtgttgctctgtcatccaggctggagggaagtggcgtgatctcggctcactgcaacctccacctcccgggttcaagtgattctcctgcctcagcctcctgagtagctgggtctacaggcacccgccaccacgcccagctaattttatgtttttagtggagacaggtttcaacatgttggccaggctggacttgaactcctgacttgaggtgatccgtccacctgaatctctcacagtgctgggattacaggcatgagccaccacgcctggccaggaatagctactttttttttttttttttttgagacggagtcttgagtcttgttctgttgcccaggctggagtgcagtggcgtaatctgggctcactgcaacctccgcctcccaggttcaagcagttttcctgcctcagcctccctagtagctgggatcacaggcgtgcaccaccatgcctggctgatttttttatttttagtagagacggggtttcaccgtgttggccaggctggtcttgaacttctgacctcaggtgatctgcccactgcagcctcccaaagtgctgggattataggcatgagccactgcacctggccagctaacttttttttttttttgagacagagtctcactgtgtcaccctggctggagagtgcagtggcatgatctcggctcactgcaacctctgcctcctgggttcaagtgattctcctgcctcagtctccgaagtaggtgggattataggtgcctgccaccacgcccggctaatttttgtattttcagtagagacaggttggccaggctggtctcaaactcctgacctcaggtgatctgcccaccttggcctcccaaagtgctgggattacaggtgtgagccaccgcatctggccgagctatctcttaattgcacttaaccagcattgtacccagcattgacctaaatgcctaacaccaattcgttcgtttaatcctcagaactacctcatgagggaggactcttgtttctccattttatagacaaggaaactgaggcacaaaaggttcattgatatacacaaagttgtgtcatcattggaagagccaggcttcagaattttggctttaaactaggagaccagtggttctcaaagcagtgcatcacctgggcaccccttagaaatgcagactctcaggcccaacccagtcccaccagctcagaaaccatggggtggagccgggtgcagtggctcacacctgtaatcccagcactatgggaggccgaggtgggcggatgacttgaggtcaggagttggagaccagcctggccaacatgatgaaaccccatctctactaaaaatgcaaaaattaggtgggcgtggtggtgggtgcctgtaatccccacttctctggaggctgaggcaggagaatagcttgaaccccaaggggcagaggttgcagtagcagagatcatgtcactgcactccagcctgggtgacagagcgagactctgtcttgaaaaaaaaaaaaaaaaaaaaaagaaaccatggggtgggccctcagagtctctatgttaataagctctcctagtggccttgctgcatctcaagtggaaaaccacagtggaggacagtactccgcctaatcattgttgagtttctgctctatgcaagggctatgttgaatattcttttacgtagtcctcacaagaaccttgtgtgttaggaggcttcgtttctgttttgttttgttttgttttgttttgttttgttttgagacggagtctcgctctttcgcccagggtggagtgcagtggcgcgatctcggctcactgcaggctccatctcccgggttcacaccattctcctgcctcagcctcccaagtagctgggactgtaggcgcccgccaccacacccggctaattttttgtgttttaagtagagacggggtttcaccgtgttagccaggatggtctcgatctcctgacctcatgatccgcccacctcagcctcccgaagtgctgggattacaggcgtgagcccccatgcttggccaatgagtgcattttttaagaggattgaggaattgttgaaaaatgccagagagatgttatcactcaagcttgtctcactcagccttctgttctgggctgtgaggctgtttgaccactaggggctcgccatccatgaaagtagctttgcccttcccttattccattcttgactatcagcttcctaaaggactagggcatgggccacaacacttctaatctttgtggtaagatctggctgacaagtttaccgtaaatcatttaaaacttattttaaaattgacttcatacctttcctgaattgtggaaagttactttgttttgtaattataagatttttagtttgaacaataataaaaaattttgtgcctgttttaaaacctgctctgttgtggtagtttcctaaaatgtgaacagttattcttaaaataatgtatttttacaagtttattaagtaaaaccagaagagtcttaagtagcattgaaagtatttaaaaatatgcataacttagtaattacaatgtttttgtttttgatagcaattcagagtccataaactcccaaagctatgctggttttagttgaatgctttattaattactttgcctgacttctttaccccttttcttcacccactgaattcctttcaatgccaagcttcatataatctaaaatgctagattttttgcagtgccttcctgtagacagcctcattgtcagcagaacatgcctattaaggtgtgctgaattgtttttttttctccccaacattttatttgaaaagtgttaatttggccaggcgcagtggctcacacctgtaatcctagcactttgggaggccgaggcgggtggatcacctgaggtcaggagttcgagactagcctggcctacatggtgaaaccctgtctctactaaaatacaacaattagctgggcatggtggtgggcacctgtaatcccagctacttgagaggctgaggcaggagaatcacttgaacctgggaggcagaggttgcagtgagctgagatcatgcccctgcactccagcctgggtgacaaagcaagattctgtctcaaaaaaagaaagaaaaagaaaatgttaattttatagcaaataaacatataaccttcatctagttttaccagttgttaacattttgccacactttctttttcctcctcctttttttttctttccttctactccatcacccttcctgttacctctctcagtgggttttttggtactatttaagtaagttgcaggcaactcaccattacccataaatatttcagaggtatcttccaaagataagaacattctcctacatcagtcaccgtaataccattataacacttaagaagattaacattaatatccctttcatatattatagttcattttcagattgctccaaatgatgtaactcattcttcccccaccctccactggatcagggacctatggtagttcatgcattgcatttggtttttatgtaacttttaatctggaacagtttctctaccttttttgttttttatggcattgacttttttgaagagttcaggccagtcatcttacagaatttcccatatacaaaattaactttttaatacatattttaaaatagtcctataaaccagactaagttttttgaacaaattgataacatacgtgtatgtttatgtgtttgtctcctagagtatggtctccggcttgggagtcagatcttcgtaaaggaaatgacccgaacgggtctggcaactaaagatggcaaccttcacgaaggagacataattctcaaggtgggtagatgggggcagagaacggtagtgtgcatactgccgttcatcgcctgcatgtccacattcagcacccacacagtgagacttagatccagtgagagtcagtggtaagacagaggtggcaagagcagcataatgagacgatttttatcagaaaaaccagacattgagggtcgtaacagtttaatgtcagtttagaaaacaaaaacaaaaaaactccatgaatattttcttctttcctgtttaaagtttagatccctattccctaaactaaggaaagatgagaaggaaagttggtgatatatgaatgctgaatatttaataggtcttgtaaacctctccagtcaggaaacacgttccagtagtaaaccaaaccgttgtcttgagcttggaagttaaataaattagcagagtaacttacacctgtatttgggatccaggcatgcaggattatatttaatttaaacgacaattcatttttattgagtcatcctaaagccaatatctgtttgaatatctgagcaaagcctttacatttttagaaggggaaaatatgaattttctactgtgaataattttattgcatttaacattaccattttttataaacacagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaaggtaaaggaagaggaggctgtgagcttagctggaagtaaggaaggctgttgcttccccattcttctatttagtgtagctatccagctggaagttaaatttctaaggaaagaccccttgaaaccttaatctccaaaggtcactggttggttgttatttgcttattaaagtgcctattgaaattaggtttccaatacaaaattctggtgcatttgcgaactctcagagaactattaattaggcaattgaaagcaaaacttgtcagtaaaaaaatgtgtgtttgagtggttcaaagaactaaccatatcatttatatatttgctaattgcttattgtttttttttgagacagagtttccctctgttgcccaagctggagtgcagtggtacaatcttggctcactgcaacctctgcctcccaggttcaagtgatccttctgcctcagcctcctgagtagctgggattatgggcgcctgccaccacacctggctaatttttgtatttttagtagagacggggtttcaccatgttggccaggctggtcttgaactcctgacctcgtgatctgcccgtcttgtcctcccaaagtgctgggattacaggcgtgagccaccaggcccagccttaattgctcattctttaaaagtggctattaatatctctaatagagaagacaatttggaggatagctaaaacaagtagatgctcaaaaagaatcaaaatggctaatattgtggcattcattaattagcagtctgcatcacctcttcccttttaaagagctatattcattatttgaatatgaattatacataggataacattttaaccttgtaaaaattgccaataaaaatagttaatcacagtatattctactgaaccatctactgttgcttttatgcagagaagtttagaaaatattaagttacgaagttgtaaagcagacttttgttgatttttttttttaaaggaatttctttgtaaaaccttaaaacttaattcactttccagtgtatcagaagttgttgatgactgttacgggtgcagtgcaggaaaacaaaaggagcatgagaaataatgccagcatgttagggggtttgcagtttatttccttgctactcagtatgtggtcctcatcccccaacccctgaccccaatagcatctgcataatcaggtaactggatagaattgcagaatctcagtctcccctcaactgccccacaacaactgcatcctaacaagatttgtatgcaccttaaagtttgagaagcattgggctgcttgggaagaattagtgtatacatctatgatccaataatagaattttgactcttctgtagcagctttgatggaaaatgagacaaaagagaaatacacaattctaaatttgccttcccctttattaattaatgcctttcccttaaaacgagcaagtttttctccaggggaggactattagactaatagcacatttcctgcctacctcgtttccatttcccgtgtttcctacccagagaatagtgcaatttctctgggtaggagaatattttaaatattttatttaaaagtcttttcttatttttgaaactagatatttcagaaatagagtcaaaccgatcattttctccagaggagagacgtcatcagtattctgattatgattatcattcctcaagtgagaagctgaaggaaaggccaaggtaagatgacatgaatattctcttgtacatgtcattgtgaatgtacacacatatgtatttatgaaactgttatctcttgagacatttacgtatgacatgtgattcagttccagagaggacacgccgagcagattgtccaggatgggtgcgacacccactccctttaagtccacaggggatattgcaggcacagttgtcccagagaccaacaaggaacccagataccaagaggaccccccaggtgagccattaagaccactcagtttcaacagttgtgttcagaagtgtgtgctcacacagccataacaaagagtgaaatcatgtcctttgcagccacgtggatgcagctggaggccattatcctaagctaattaacatggtaacagaaaaccacacagcacatgttctgacttttaagtgggagctaaacattgggtacaaatggacatagaggtggcagtaacagaaactggggacaactagaggggaaactactaaaggaggagatggaaagggttgaaaaactattaggtatcatgctcacaccttggtgacaggatcagttgtaccccaaacctcagcatcatgcagtatatgcatgtaacagacttggacgtgcacccactgaacctaaaataaaagttgaaattatacacatatatgtaaatacatagatatgtatacatatatgtatgcatgtgtgtatatatgtatacagatatgtatgtacatgtatatgtgtatgtatagataagtgtgtacttaattccagagggtggctgaaagggaagaaggaaataaaaaattatatatggaagaggccttcctttctctcttttgacgttgacaaaatataaaataatagccttgtctaaatgccattagaattggtcacactttgtcatatttgatgagttgaggtcattgttttctcccatccttgatcctgacctcttcccccaacccttccccaccaccctacaattatcatcataattttatattcataaatatttaaggggaaacagtatcattattgtatgttttttaagttgttaaaaattctatgttcttgtgcatgtgattgtacaccttgcattttagaggttcattttttatctcttgtattttgagaaaccattggcacctgctaatacttcagagttaaacggcactttagagacttctttttgtttgtggtgacatatgtggcatagacttacattttttgtggattttgtgatttttctatttagaaacgcactcttgttagtccagattgataacagtagatgtttcttaacctacagctcctcaaccaaaagcagccccgagaacttttcttcgtcctagtcctgaagatgaagcaatatatgggtatgtatttccgtctctctttgttttcccttcttccttacagctctgtctctgtaactgaaatccagaagagtggtggtttttgcctagatggtgattttgtacactgtcagccacctgtaaccaatccccattggtagtgcttatgagaaagaggaatgatttgtgggaacagcaaaatgcggaagtgggtgaactttgtgatgttaatgttgtctgtttacctacctatctagctacctttccagagtgttactctgaatatttgcgtttgtcagataaattcactcccaaataggtgaagtatttattgctaaactacggtgccctgtggtgactgcactgatgtgatggtcccagtgtcagtccgtgtgggggagggaggaggagtgctgctgcgctctgcacttgataatcagaacccctagttcagcagggttcaagggcagcagcctcctggattaggattctgcttctttgtacccagactgtgtctttatttgacaagaatgcagtgcaagcgggccttcctttggaagaattttagccctaactctgccctttatttgctttctcatcttgaaagagttgctgtaaagattctataattctatgtcttcaccagtaaccagggacctactgatactcatctcatggtcccaagaaagataaaattgtaggatatatgagatagatgagaaaaatgagagggctttgtaaactataaatcactctgtagctagaagaaattaaatctctcatttgctaatgttgttctcccttttaaaaaatatctcccatctttcctttctgaaacggaacctattgcagccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtaagaacagcccagctctgtttctagaagttacttgtaaggagtgcacttttctgggtgttctttctgtaagggaagacaaaatggttcagctggtgaaatagagcagctgcaagtttgttgatgcccagcattgaagtctctgtattcctcaaatgcgtcctgtcttctcagtcttggaacccagaactcatccatgtatctgtgagaactgatagtgtttctgcccttgccaagattttattagtctgattaatgtgaaaatattgagactctaagtaagcacttacaggaaagatttttcaaaaagatttttctgatttttgcttttttcactgtgttccccctgcctgccatctttcttaaggcagtgtcctgaaattgaacaaaggtgagtggttggcatcagactgggtgattggaatttcgtcccagcctctgattagttctgtgaccctggttcaccctgagactcaggtttctgtatctgtttaatggggatgagaatacctgcctcgcagggactgtgggaagattagaccaggtaacacttacaaggcacctagcagagttccctggcacagaataggaaggtgagtgtccattcttttttcttattggaagataacaaatagctgctactcaatgttatttacatctaaaattgtccaagaaagggaattcctggttaatcaaatattgatacttttaaaattactatgtgtttgtataatctgttaaggaattaaaaaataactcaacttgacatttgtgtatgtgtgtgtgtgtgtgtagcattctttgttgacttcggaataaatttcaagaacatcaagtatctccttacaataaaaatatagagtactagggaactgttttttttgtttttttttgtttttgacagtctcgctctgtcacccaggctggagtgcagtggtgctatctcagatcaccgcaacctccgcctcctgggttcaagcaattcttagtcctcagcctccccagtagctgggattacaggtgaactcttaatttttgtctttttagtagagacagggtttcatcatgttgcccaggctggtctcgagctcctgagctcaagcagtccacatgccttggcctcccaaagtgctgggattacaggcgtgagccactgcgcccggctgggaactgtcttcattggaatttcttcctgcttctgcaaacttgcagttcatatatatgaggttttttttttcttgttaatgttagtaaaaaatccatatgtagtaaactaaggggtctggtaggggcttctaggctccaaggagaggggagaaaaaagttctagaattctcaaggaagcaagcagcagcaaagtacaaaagcaggtggcccccttccttcttggccccgttgcagtatttcagatttcatttctggagcagatgaagggcaaaccttgatcatgagctttgcaaaagcttttcagtgaaattctagaccctccttggccctggtcaggatctagaagactatgtacctgcacgaacctcatgttgccttatgatcctaggaaataccactcaccaaatgttactgatgaaaacccatctgagtgccagctcataccagtttactctttgcatatatgctgatgaaggaaaaaggcattttttctaactattgtgaggccataggatgatagctagaaatgtggagcttttgctcattaaggttcaatgataaaatattttcgtatgttcaggggctgggagattttctaaatttccgtgaagaaaagtagtgaattcacctagaggcttggcagtcagacctctctgtaagttgttgttagatggggagagtcgctttggtggataaaaagtcatggtatcagcatttatacttaaggtgttttgtttcttgttatcaccctggcaacacggaaggaactctgggaactggcttcttttgctgtcatcccatatggaggtcaggcaataggtggtcctcatttcttgggtgcgaataaattttctgttgactacaaaagaagctttccgttctagaaaggggtgaaaaagattgagtttgcctacgagggcggagaagctgctgcacaatactaagctgtggctgatacaggatcctcttcaggctcacagcagacacggctagaccctgtagactactaaatagctaatcaaagaggatatttattggaaaggactgttcaatgtaaccttcaagtagaaaagtgctgccctagccttttttcactttaatttgtttcaatgctccttttcatggccaaattgaatatataaagtgagccttatacacatgctaatcactttattctgttgtggggtttttaagtgtggctctttgttttgcaaaggtgacagcctaatgtgtggaatgaagacgtgagccagatatgtatattccttatcaataatggagatatatgtgcttttgctcattcctgcttggctgaactacctctttgcttgttatttatctgatagagttgtcatttctctttcagaaacttttatgggatggaaaagagaaaaaagacttctaagtttggttattaaccatgtagatttttaaaatataactaccatgtgtgctttaattttgaccattatagtttttggctatcgaagactgtgatcgagactgatctaaggttaatctcttgtggccagagagatggactgaaggactcccaaggtcctcccacagccttgtggccctgtcttatttaagtaaacaaatacaagcatgtatagtacatgtgaaaatatacatatggctatatgtagatacagatgtagataaacaaatggcacaagaaaggataccaaaatgggatgattcctaattgggggacagagaggtacaaatgacagtaccttaaatactaaatactgtttcaaaggaaaaattaactcaattgctttagcacatcactttattttaaaagcaccaaattagttttagtctaatgccgactttcacttaatcataaattttggccttaattaaggcccacccaactaaggataagtttcttctttaataaagcattactcttgtgattaaaaggattctgtaattgtcaatgactgaagaaaatatttcataggaattttatatctttatttctacaaaatattattaacatatcaggtactttaatatggtttttgcattttacttatttataattctgttttaaaataggctgaaagatacagaactatgggccaggcgtggtggctcacgcatgtaatcccagcactttgggaggcctaggtgggcggatcacctgaggtcaagagttcgagaccagcctggccaacatggtgaaaccttgtctctactgaaaatacaaaaaaaattagctgggtgtggtggcacatgcctgtagtcgcagctactcagggaggctgaggcaaaagaattgcttgaacccaggaggcggaggttgcagtgagccaagatcgcgccattgcactccagcctgggcgacagagggagactacatctcaaaaaaaaaaaccacatagcactatgatttcaaaatgtcttgttctttgtgctacatttcaattttacttgctttgtaactgtaaggctgatgctctttaatttgatacatacctttcaattttataaacacatgttaaacacttttaggtgatagaagctataggagaagggtagaattggtcagagtctttatttgcacacttttatttgaaccagtttaaaattagtgtaaatgctgggccagcatgctcagttgtcacagaccccaacactccccatgcttcatacttgtgtattaccttcttggccacctctgtgagagactcacagaagggagatggatagaaacaaccacaagaaattctattgtgatctggtgacagatccttgcttcaatggcttaacctctaaggtgcggttggcagtatggggaggcaggaaggtatagtgtgcaggcccatagcaaggtgctgggcgcgaggacttgaatagtgacattaaggactcatttgcatcttggctttgctctggacaggccctgatgaaaacaaacaaaagggtcagtggcatcttactataaacttctctgttttttctttctttctttctttctttctttcttttttttttttttctttttctgtttttccttcctaataggtgaacacacaggatttcagaggattagtgcgggaggatgccgttctctacctgttagaaatccctaaaggtgaaatggtgaccattttagctcagagccgagccgatggtgagcaaatttggtcatttagtttagttggggtgggggtggggagtgggaaggatgagagaggtgtcttggtaccagaataggcaaatctgggtattaaaaaattgagatggatctcaacacctagtccttgggccctaggtgtgtgaagaaaatgtgagtgccgtttaactttccataaaaatgttttctatgcatgcactgaaataattttactagttgtgtcaatttggaataaaactgccttcctgaacagtgatgcagccttatgttctgcctggagttattagtgagtttacatacgacatgtgcaaaggccatggctgctggctggtgcgcctgttacccctgtccagtctgacaagttgtttcacctttccaggccttgttcccatctgttaagtgggtgttgagagtgtcctccttgtctgcttcagagcttgattggcaactgtgttaatgttctccagagaaacagaatgataggagatattggaatcaataggaaagaaagagatttattataaagaattggctcacataattatggagactggcaagtgccaagatctgcagtgaaaatgggcaagatagagactcaggagagccagtgatttagttctagtctcagtctgaaggcctgagaaccaggagagccaatggtgtagttccagtaccaagtcagggaaaagagctgatgtcgccttttgaaggccatcaggcaggaagagtagtttcctcctaattttttatttatttatttatttatttatttatttattattatttttttgagacggagtctggctttgtcgctgaggctggagtgcagtggagcaatcttggctcactgcaagctctgcctcccaggttcaccccattctcctgcctcagcctcccgagtagctgggactacaggcgcccaccaccacgcccggctaattttttgtatttttagtagagacggggtttcactgtgttagccaggatggtctcgatctcctgaccttgtgatccacccaccttggcctcccaaagtgctgggattataggcatgagccaccacgcccagcctagtttcctcttaattgagaaggggtctgattgtcattctcttcaggccctcaactgattggatgaggcccactcgcattggggagggcgatcttctttgctcagtctacccatttatacgtgactgtcattcaaaaacaccctcagagaaaggcatagaataaagtctgaccaaatacctggttatttcatggcccagtcaagttgaaataaaattaaccattgcagcaagccgtgaagctggttatttgtccttgttcctgttggagctgtgactcccataggacttgtgcactgaatggaaggaaggtaaaggggagatcagagataggagaagctgtgttgagtgtctagtactgtaacttgtactaagctgaatgcaacaaacgatgcttttgtctttcagtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcaggtaacagagatcgcattctcacataccccttttaatccttccccctgcagaaaactagagaccgccccccttcccccgtaaaaggaaaccccacatgatgagttcattacttgtcaccatctatttcttgtttatggagagtggcctgaactgtaaatagccaccagccagtttattgtgagtaaatttagcatcatgtggttggttgctgaatgtggctgtttgaacaacttcctaaggagcatccactgccttgtaccgtatacaagagatatactgaatggccgtagcacaccagcacacctcttagagacaaggtacccttgtccggtgcccagtctccatccttggagaggtttatgcaccccagtgaacacttggtgtttggctgacagtgcaggaacctagaaaagaggcctgtatttgagcaggagttccaggtgtgtgtactgtgtacctgcatatcagaatgggccaaatttcacatgtttattgctgagccacttctgggagatttcacagagacccagcctttttctgctcccatttggaagtgaaggtccccacatttcccaccctctgaaacttcttcattgtcaagcggaatcttctctgagctcagaagtaaaattgactggatttgattaatgaaatgcatgttagctgcgttttctggctttagagatttacttcccgtggtttcttctcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaaggtgaggaagtcacatggggcctggaaatgaactgactgggctctgagcctgttcacctttattttcagactgtatggtcaagttctaacttatgtatgtcagttatgccaaaggcagtttatagagttgaaatcaaattctaacaaggagcatgatttataaaaagctgtttcagttcctaaattgaggcttatttctgcaacttaaaaaatgttttaataccactgttcaagagtttcggtatattggctgggcactgtaccttatgcctataatcgtagcactttgggaggccaaggtgggaggatcacttgagctcagaagttcaagactagcctgggcaatatagtaagacctcatctctgcaaaaaataaaaaaagtttccatatattatcaatgggaaagtttgtgtttaaaaatggtgaggagctaggcagtgtagtcccagctactcaggaggcttgagcctaggagtttgagtttagtctgggcaacatagtgagatcttgtctcttaaaaaaaaatctaggttagcatgtggttgaatgaaaagaaaaaaattgttttaaatggtgaggatagtgaaggcatattcttcagaacagagccaagctgaattggggagaaaccacagtttctttcgtttagttatgttatcaaaagcccatacaatacttttactgcttatcataacagctaggcaagtgtgtatgctttaatggcctttcttgtcatttcagctggtttcaagagacctgtggtcttattcggccccatagctgatatagcaatggaaaaattggctaatgagttacctgactggtttcaaactgctagtaagtctgtcagtgtttttttttcccccaaatttttattttgaaaaatttctaacagaggagttggaagaatcatgaacacccacgtacccttcacctggaatcaccagttgctgacattttgtcacgcattttctctcacccactgcctgcaccatagacacacatacacacacacatacacatactctttgaaaaatttctgcagaatcatttataacactttatccctgaatacttgtgtgaatctcctaagaacaaggactttctcccacataactgcaataccattatcacagccaagaaaggtaacattgatgtggtgtgattttgtatatagtccattttccacgttttcttaattgtcctagttatgtgcttcatagcttttttttaaattcagaatacaaccaaggaccattcatgacatttgatttttatgtctttttgtgatttttatgtctttccagtcccctcttttttctaaataactttgttacactgatattttgaagaatccaagctagttgtctcctagaatgcttcctgttggactggcctaaccgtttcttcatgattagatttccactaagcaggttatgtgggtccttcccactgaatcttgttaggagacacttaatgtcaggtgtgccatcattgcttgatgctaggtgggagtatttggttgtcactgttttctaaacaattatttagcttcctgtttttgcttttgcagaaacggaaccaaaagatgcaggatctgagaaatccactggagtggtccggttaaataccgtgaggcaaattattgaacaggtgagaaaattcatccacagaccgtgttttcagaaagaattagattatggtttgctgcagtcacttttaggatagtatctgtacttttaatcattaaatgttaataataaaaaattggccgggcacagtggcttacacctgtaatcccaacactttgagaggctgaggcgggtggatcacctgaggtcaggagttcgagaccagcctggccaacatggtgaaaccctgtctctactaaaaatataaaaaattagccgggcacagtggcaggtacctgtagtcccagccactcaggaggctgaggcaggagaatcgcttgaactcaggaggcggagtttgcagtgagcggagattgcaccattgcactccagcctgggcgacgagtgaaactccatctcaaaaaaatatatatataatgtaaatgcaaaccgtttcactgtgtggaaaccagtcactgttggcagtgagcggagattgcaccattgcactccagcctgggcgacaagagtgaaactccatctcaaaaaaatatatatataatgtaaatgcaaaccatttcactgtgtggaaaccagtcactgttactgttctctggcagtaacatactgtttttttttccagagttcccagcattataccaaataatgtgttaattcattttatcagaagttctaacacattggtaatattgaagtgggcattaggtagaaggaaatgtgttctgcttcttgatttaaatttacaagataggtggctcatgcctgtaatcccagcactttgggaggcagaggcgggcggatcacctgaagtcaggagtttgggaccagcctggccaacatggtgaaaccctgtctctactaaaaatacaaaaattagctggccatggtggtggcgggcacctgtaatcccagctactcaggaggctgagacaggataattgcttgaacccgggaggcggaggtcgcagtgagccaagtttgtgccactgcactccagcctgggcaacagagcaagaatctatcccaaataagtaaacaaacaaacaaacaagatatatctcatacagcctttacttattaaaacaaagtatttgatgctatattactttatatatccatttctctaacttttccccttttgtaaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacaggtaagtgaaatgtaaatgtagtccctttgctaaaaaatgagaaataaagaattgaagagtagaagaaataattaattaatctgaatggagaatttgaaattgtgttcatgactccttgaaaaatagttaatcctataaaatgggatattaggccaatggcatttatatattgaactttgtaattttgtctatttgaaaatgaccataaagatccatgatgtggtaataattagctattttgatgaagttcatattttcctgtgagactataaggctagtgattgagccaggccaaacacctatgtctctctagagattgtgtcattgttctctactcaccatcaatacatgcattaacttacaaagcgaaaggaacttggtttcattatttaaaaatattcctgtccagcatggtggataacacttgtaatcctcccactttgggaggccaaggcaggaggatcacttgagcccaggggttggagaccagcctgagcaacatggtgagatcctgtctctactaaaaggcctagcatggtggtgcatgcctatggctgaggttggaggatcgcttgagccaggaattcaaagctgcagtgagctgtgatggcactgctgcactcctgcctggtgactgagtgagaccctgtctcttcaaagaaaaaaaaaaaaatctagaaacttggacactctgaatattggatgatttaaagatttattatttctctttgttaggtgtgataataatattgtgatttttttaaaaacaaagttctttgaggaatgcatactaaataaaatatttatggttgacctaatataatgttgagaatttgcctaaatagtctgcagtgaggggagtagatgggattatagacaggacaagactggccaagacttggtagttgttagttgttgaactggttgatatgtacatcggagttcattaaactgctatctgtacttttgtacatatttaaagatttacctaatagaatatatttttaagtccatgaaatgaagagccattgctattactcatgaaagtaaaatggtctaagaacatgacatattttagtaacaatatatgcactgtctatataaatgattaattctgtgcatatgagattattaagagttttaaagggttacataaattttgtggtcatgcagggcattattttgttggggcaacacgaggagactgcaaggatatgatatccttaggatgaggatagctcattgagttcattgcccatcatcatccacccatgtcattttagtgtatctctgatactggagaggaaggggtgaatgattgtgttcacattagatgcttgttttagtgtaacttggtttttcttgttaaagagaggtgcactacttgccactgtggccaaatggagagagtttaaccaaatgcagaggaggaagtggtccatcataaactagatttctgtgaatgtagtcttacgtactcatactcttggtatatttatgaatatcctttctgtcctttttactactagtattataattattatgattattactattatagcaacagtaaagagtggtacagccttccatgtgtgctgtcttattaggccataagaaaggccagcacttttgcataatcacaattctgatgtatgactgagcccagactaaactatagcgtccctaactgtccaatattgtacatatgttacagcacagacatattctaatcccaaaaggggtcacgtaatgcagcccttccttttgacagattaaaaaactgaagccaaagtgattataaatgaagttaaaactatccccactttattttcccccctgcttttgtctgagtacactaaatagcgagcgtcttccctcagagagttaaatttgggattcacgtgaggatgtaggaaatcgggaagggaattacagtgcattgtagaggaagaactaggctgaaggcggctggacgaggagagcagggcagaagaaggcagccagtgactgtggggctctcccttgatctaacctgagtccgcatcatttgctcttgggagcacaggccacggtagctggctgagtgtgagtaagaatctagaggggtccatgtgtgtagaaggggttagcaacacctctgttagctccatagatggatttcaagatccttgaaggcagagcctgaacatttcccagcgttgtgtgcctgaggccagcatcaggactagcacatgggcaaggcataaatgtttgtaacttacattagaactgcccctggcacaccaagccatttcttgcctaaactcatcaggaagttgaaagttttagaataactcaagtcagagattggaatggaagcacacactgtaagcattgagtttcatctaaaacattgaagtgatcttatctcaccagaaattgccaatctcttatgtagaattgtacagtcttcaggatagatggtgcagggtgtgcagcaactttgaccagcaagctccaattttctagcaagtggtcttttacagtactcttccagacttcaaagtttgactccctacagctgtgtggatgactgcactaataattgcttttattccccatctcaccctcgtccctcttagcttgaccaggttttgacttgaggctgtgtgccatgtccagaaacactagtctttacatttgagcagtagaatcttcaggcagaattagtattttatagtttttgtttgtttttgagacatagtctccctctgtcgcccaagctagagtgcagtggcacgatctcggttcactgcaacctctgcttcctgggctcaaggcaccttccctcctcagcctccccagtagctgggactacaggcacacaccaccatgcctgggtaatttttgtattttttctggcaacagggtttacccatgttgcccaagctggtctcaaacccctgggctcaagcaatctgcccgtgttggcctcctaaaatgctgggattacaggcatgagccaccgtgcctggcctattttgtaggcttttaaaatgattttaagtgtatggcatttttgtgagttagtagttgagaataatagagtgctttgatgaacacagtaatttgaagtcaagctttatgttgcattagtctctttaggctcaatatccttttgttttcctttttgcaaagtaataagaaagctcctcttcctcacgagtatttaattatgacaatatgaaaatagttctccttacaagtcttacagtacttctcagttaaacaagagaagctttattctgagatttgcccaaaggcaagttgacttgtcataataagtttaagtgttaggtttgcctcccctactaccaatttttaaaaattttctataaaatacatttgcatatcacaaatttttatttttaaaaaacaaactttgaattacatgttttcttggaatcttcaaagtactcagtgcatggttcgaagatcatttaagttgacttatggatttagagacccaagtggggctacccttttatgctaattatagaattttaattcctgatttctcaaaggattatatagactagctagttgaccacagaaaagagaaggaagatgctgggccccctagctggatacctttgctgttgcatgcccatttagagggggtctagcgtgccactgttaaccgagccacgtgaaaagctttattgagttttgacttagataccatataatccacccattgaaagtatatagttcagctgggcatggtggctcacgcctgtaaatcccagcacattgggaggccaaggtgggcaggtcacttgagctcaggagtttgagaccagcctgggcaacatgatgaaaccctgtctctattaaaaataaaaaaattagctgggtgtggtggtgggtgccggtagtcccagctacttgggaggctgaggtgggaggatcacttaagcccgggagctggaggttgcagtgagccgagattgcactacagcactccagcctgggcgacaatgagaccctgtctcaggaaaaaaaaaaaaaaaaaaaaaaagtatgcaattcagtgggctttagtatattcagagttgtacagctgtcatcacaaccaatcaatcttagaacatttttatcatccccaaaagataccccatacccattagcagtcattccccatttctccctttccctaaaccctctagtcttagatgttaccttttgctgtcgctcttggtgcttccaaacctccttggctggggagggggaggtagcactgaccatacatgtcagggctgggcacacgtgccctcagaacctcagtattcccaactaaggcagtggctgagtcagcatcctttcagtatttcactttcttgagctcaaaagatagagtaagtctatccaaggggatataggcataacccagaggttaggagcaacagataattaactactattgctctaaggcaaagaatctgagaagcggaatgagagaatccaataataagctaaaggtacttaattcagcagagtcaagggaaggcagcttcatgtctgtgcacctgcctgttaaaaagaggtcaagtgcatgagttggatgttacttttatatgcagcttaggaagttagctactgtgaagctctcaatttttattcataaacttgactgttaatgtgaattcagtaagagcttttgtgattttctttattttatcaaggggcaagaacatatttcctgcatctcacaaaatgccgttttaactttaggttttctttatgatgaatgcagaccatacttatctcagacagctgcaacataaagctttaaaagactgcttaacattttgtatatatttagtgtaaatcactcattttgtctctggggtacaaaatctcacttctatttttaagtatcatattttagctatgagatgagcacagtaatctttgcagagtaccataataggaatagagaagtccgtggaatcaaagttaattttcttcgggttgtctaatggatcagtttatttcagtgctgtaaataattaataaccaaggaaattgtaagctcattcaggattttctaaggtcactgttagaacttcttaaacagaagaaagctatgttacttggaggaaaacctgaagcatcattgcttacaaaatttgcttaatggttctttttggctttagaagtgatagtacaataagaggccatggcaatgtagtttaaaagaaatcctaatttacctgcagtctgataattttaggggtacaatttgttattttggactaacttgcttgtctaatttatctccattaggtccataatacatattgctgaagaaatgacatatgttgtactttgttggtattttatatctgtgctctaaatttctgtttttagatgggccatgtagtgtggtggctgagaccataggctctgaaagcagttttctgagcttgcatccaagcttcacacttgcttggtgtgtggccttgggctagttaatttcactactttaccttggtttctcatctataagatgggcatcatagcaacacctaccttgcaaagtttgtgtagtcgtgaaatgagctaatccaggtaaggtacttggaaagtaactggttgatgcatagtaagtgctattatgtaagatatactttgttctgagtagaaaatgtatattctttgaatacacactggttgggtttgtttaatctatatgtatattctaaaatgtgtaagtctatcaaagtgatatacagtcagctctccatgtctgtggtttccacattcatgaattcaactagccgtgtataggaaatatttgaggggtaaaatggatggttacatctaaacgtgcagggtttttttcttgtcattattccctaaacaatatagtataacaacgatttgcgtagcatttacattgtattaggaattataagtaatccagagatgatttaaagtatataagaggatgtacataagtcatatgcaaatactgtgtcattttgtatcagatactcggcatctgtggattttggtatccaagtggggggtgtcccggaaccaatcctctacagataccaagggacaactttatgtttaagtgttacttttagtattttattggaggtagccaatacagtatattagtgtatactaattagtgtatacacctcagcctcccagagtgctgagattacaggcatgagccaccacacctggccgaaaacacatgttcttaaaaacatttttaaaagttagcctttctgaaaataaacattctaaaaatctatttttagctttatcacatccacctataatgtgaactcaaacagctacatgattagtagttttaattgcattcattaaaagggttttaatattcaaagatgtgcaaacatcttcttgcgtctgccatagtcttaaatatcacagaaatgagtgtaaattatgtcaaatagcatccttaataaacatgcctctggaaattaatgcagacctttttgtttatatttctatagctacaatcaacctaaattcagccaatgatagctggtttggcagcttaaaggacactattcagcatcagcaaggagaagcggtttgggtctctgaaggaaaggtatgtggcatagatatgctgctatgaggtgagagtccctgttctgaaacttttctcaagagggcagtgaatgtagtcaagccatgcccatttgaagtgatgctcacatgtgtgctaatcaagtttgaaatttcgtaaattctctgaccaagtaataaaaatgaagggacttttaaaagaagagcagaatgtgacatgtgcagccctacattcacttccctttcacttttaatgtagtaactagtgttatattccaagtacactaatcagagcttacaagatctcatgctgagctccacagcttactaaggacgtgggaaacttagagtgcagatgagaggtgaggttgagcaacttggagaatacggctaaacattaataaaaagaaaagctaatggagttagaattacttagaaaataaggttggttgagaatgtgccatcgttctgggagtttgaatgggtgatatgagaacgttagggaatttgtctaggcctctagaattggatcgcttctccctcggggagatagctcacacacagctgtgctgcagggaggagagagggagattctattacctgtggccgcttttattttagaagcttttggtgttagtatcctgttcaccagctgaactgaggtagttttgtgagacttgacagtgactattttgttgcagaattgactaagttttgctctttgagaactagatgtgtagtcaaagtatctggcatctatggagtgcttccagtttggaagggggatgcaagcttccctggggaggacaggttgaacaggacatagcttctgcctttgagggtctgagaatcttgtagaggcatggatgtgagtgtagcacaaggcagcgtgcaatgtgttgatattactaggagagtggtaccaggagaacaggctgcagaggagctggattcagaagaaaagcaagacagactgagaaagtgtggcttagccgcggtatggaggatggatggtagcacagataggctgcagggcccctaatttgagttcctgcacaaaaacgaccataatatcaacattgtaccaaagccaagtgatctcagggagaaaaataaaagatgccttccctggcgagcacatcaaggtttcagtcgcttggctgtgtccttgggaattttcttgagtccccactcccaggagccacatcagaccccactgaccgtccaacacaaattcctctagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggaggtgaggcgaggcaggccacgggcaggaacaggagagcctggtgttttccttgcactctcgtggacagctgtgtgttcagggtgctgtggaaggcattcctaagggttggagcagatgacttccagggagtctctcgctttgagtccacgctggcatggttgcagtctgtgggaaagtggggcaggcaggtggacttcagaagagcttgaggggtcagcactccgcacacccatgccctcaggtgcgatggataaacagaatggctttaggtgccgtctgtccaaattaccagcggaaccttccttcccatgcagtattgttgtatgtacttgtaacctttgattaggtttctctctgtactcttagatgtccttgcttttcttccccatcctgcctttaacctttctaatcttgccaaagctcttgagtgtttccccatcagtttccttctctcttatatttcagttttttaattgagttcatgatcaaaccttcatctgatcacatcacatgtactgtgcatccactgtgattagatagcttatgggatccttgaaatcacattgacaggcactgtaaagtcacagccaagttagcaattattagttgcacctcagagaatgttggaataatgatctttgaagatgggattgttcatatatttggataattattgctgtggatttctctctagcattttagctcattccagtaaatgatttttttctttatgaaatagaactaccaaaaaaaaaaaaaaaaaaaagttcaacaacaacaaactgaagggggagaaaaatacaccattaccacagcaacaaattagtttatgctagacaacttgtaaagaataaattaacttccaaatgcctatagacatggatattagtgacacaagagattttagacttttggagggttcttaaaaaattgtgctttaaaggaagagactctacattggatgcagccagtttttaaaaatgtgtctgaagcatttggtgatggtttctgcctgttcagtaaagaagcaccggctcagaacctcaacttctggacttactcaagtttgcagaactcctccaaagcagtcgagtgctctgttctctctgcttggatgttcttgttgtgaatgaacctttatgtcttgtagagcataaggaaacccagcccagagccacgagctcagatgaggagggctgctagcagcgatcaacttagggacaatagcccgcccccagcattcaagccagagccgcccaaggtacgtggctgggaagcccaggatgggaaggaagaggaagcagatgcctctgaagcctcctggacggccagggaggagcatgcacactgagatggtgtttaattacggttctgactcactgtgttctctattagagcctatcttttggcctgttgggtgaactcccaaattagggaagggcaaaaaggaaggaaaggcaatattaggagagcatatgattttaggactgttagtgtttatttaatttactcttcttgttaaaaaaagattgtaaagaaaaagattgaaaaatactgtactgtatacccagaatcaccaatcgcagaacgtgtttttcttttgctgtccagctaaagttttctgcccagtctgatttagatgcaccagataattcttactggtgatgtgctaaagagaataatcatcaccactgcttacaatgcctctcattaagagagctgcttatttgtttaataaatcattatccagagcagaatcaatataaagacacaagggcttatatcaaaagattatttacctttagtcagaatcagagctgtgactctatgtttttccttataccagaataaaacctatttaactcaataatttattatttattattactattttttgagacagagtctcactctgttgcccaggctggagtgcagtggtgcaatctcggctcactgcaacctccacctcctgggttcaagtgattctcctgcctcagcctcccgagtagctgggacttagaggtgtgcaccactatattcagctaatttttgtatttttagtagagatggggtttcgacatgttggccaggctggtctcgaactcctggcctcaggtgatccacccacttcggcctcccacagtgctgggattacaggcgtgagccactgcgcccagcctaactcaataatttagatgagaagaaagccataattgattgtgtgagccatcagaagtagtaaatgtgataggtactaagtaataataagtgacctcataaaatacatcagcgaaaatttgcaagccgggcaagactggaagtgtgaaggaaaagtggctgttagcgtgaagcagtgctctcctcgctccccaccccagtctcattcctcagctggacatgggtctcacctgggccggctcatgtaccctcagtgcagcagtgacctcagaagcccactcttcgagtcccaaagcctgaattgttctgagatcttctccaagatgctgatctcctctagaacaaaattattccaggtctgatcttacctccagcaatcacagccctcccagcactttccctattcctttttggcttcctgacattcctaatagactagtataggaagggaggtagggctcaggaagcctggccagtggctgtttgccctgctgtattacattccttgtcagaatggtatttgtggaccacctttggaaactgatcaggaaatggagtgtattaaatcactaatatagatttgaaaataaacttaaaagcccagggtgaaaacgtgtcattgctctccgcaggccaaaacccagaacaaagaagaatcctatgacttctccaaatcctatgaatataagtcaaacccctctgccgttgctggtaatgaaactcctggggcatctaccaaaggttatcctcctcctgttgcagcaaaacctacctttgggcggtctatactgaagccctccactcccatccctcctcaagagggtgaggaggtgggagagagcagtgaggagcaagataatgctcccaaatcagtcctgggcaaagtcaaaatatttgagaagatggatcacaaggccaggttacagagaatgcaggagctccaggaagcacagaatgcaagggtaattgtttttaaactacacatcatcaataagagttttaaataagtttgatttcaacataacagcgaacagcccctttgctgctgctgcagatgtggcagggatgcactgcaccaaaggcaggtgctgtgtatgtcacttcagattgccagctcccagcacgtcccttgttcttccaaagaagaaaacttgacaatataggggaagaagattctgctctttatacacagaactttgtatagagttctggaatgaggaagtgtgaggagggaatcagtgcctctcggaagtcgttttaattagaatgtgatttttttttcttaaacgtgtcttcattggctcccagatttgccgtagaaaccaagcaaactgggtgctaaaacagaaaggcccatagattgtactttttgagctgtttgaatttgtataccatatgcacatagaacttttcaaacaaagaagaatttaactaaaggtctgtggagtatatttgcccagtagatgtgggagttttctttcaggtctagcacaacagcagcagtacatctgagcatttttcttttcttgtcgtaaaatatacataacataaaatttaccatttcaaccacttttttcttttatttattttgttttgttttgttttgttttgagacagggtctccctctgtcaccccggctggagtgtagcagtgtgatcacagctcgcagcagcctccacctctcaggctcaggagatactcccacctcagcctcctgaatagctgtaaccacaggcacatgccactgcacccagctaatttttcgtattttttgaagagacaaggttttgtcatgttgctaggctggtctcgaactcctgggctcaagcaatgcaccctcctcagcctcccaaagtgctaggattacaatcatgagtcactgcacccagcctcaaccattttaaaacgttcggttcagcggcattaagtaccttcacattgctgttcagccatcaccaccatccatccccaaaacttttttatccttcccacgtgaaactccgtacccataaaatactaactcaccactctcctctccccgcagtccctggcacccactcctttactttctgttttttgtgaattggacagtgtaggaacctcctataagtagaatcatacactatttgtctttttgtgattggcttatttcccttagcatgatgtcctcaaggttcatccaggttgtagcatgtgtcagagtttcattccttttaaatagttttcctgtctgacgtgtaccgcacataaccatggaaatgaggaggccgcttctgtgtttcctcttcttgaaatgggatgggaaaataagtaggatatggggaaagggtgggaccagcaggaaaccagcaagcagagtgcccagtggttcattctttcactcttattcttttcttttttaattaccacagatcgaaattgcccagaagcatcctgatatctatgcagttccaatcaaaacgcacaagccagaccctggcacgccccagcacacgaggtaagggctgcctagtgggtacaggtctaaggcggggacttctcaaggactgggacttgaagaaagaatttcctttacccaaatttcagagtaacaggaggattttttccccacagattgactgtttgccttactcattccatcaaatttaattgtaaagattacagagtcaaaacttaagcatagtttgcttgtgtgctaaaactctgacaaagtgtaatcattgatgtttccagccagtacatttgacacattggagcctggttatgttacattgcacatggttagcacatgagcagaattcctacggcttagacctgttttgtcttgtttgctgactctcagccaaacttcttaattcctttgcatcatccagcaaagtcagaccgcttgtgctgccctggggtctaaagggaccgtgacaagcaaatgagcagtcttggtaaatgccacacaaacagtaggaatgttcacagtgtcttcctgttgaagttttatactggattgcttcctgcttccgagaatagaaaaaaaaaagtcacattttcttgtggccattcttttgttttttttggagacagagtgactgtcgcccaggctgaagtgcactggtgcaatctcagctcactgcaacctccgtctctcaggttcaagcgattctcgtgcctcagcctcccgggtagctgggattacaggtgtgtgccaccatatccagctagtttttgtatttttaatagagacagggtttcaccatgttggccaggctggtctcaaactcctgacctccgcccgcctcggcctcccaaagtgctaggattacaggtgtgaaccactgtacccagcctcttgtggccattctgactggaagctgaagtctagttttccagtgatagaaaactggaaacaaatttcttctttaccagctgagtggtaacacagtcaaccaggttgcctctggcaacaaagagttcttggttatgatggactgaaactggcagagacctcgctgctgggtgagactagccagggagcttaggggtaaggagggcaccccctgtccaacagggagattcttaggtcagggagcacctggctggcttcctcactcaccgccgaagtgggcattggatttgacctattacgaacctggagcaggaccagggatgccctggttgctctgcagaatgtggctcagaggtaagtgatctgctcgggatacccagtcactgtgctcagagccatgcctccccgggcagccggaggacatggatgtgctctggaatgtctttaacaccctttttttgttagttccagaccccctgagccacagaaagctccttccagaccttatcaggataccagaggaagttatggcagtgatgccgaggaggaggagtaccgccagcagctgtcagaacactccaagcgcggttactatggccagtctgcccgataccgggacacagaattatagatgtctgagcacggactctcccaggcctgcctgcatggcatcagactagccactcctgccaggccgccgggatggttcttctccagttagaatgcaccatggagacgtggtgggactccagctcgtgtgtcctcatggagaacccaggggacagctggtgcaaattcagaactgagggctctgtttgtgggactgggttagaggagtctgtggctttttgttcagaattaagcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaaagcagatacttgaggaaaacactatttccaaaagcacatgtattgacaacagttttataatttaataaaaaggaatacattgcaatccgtaatttt

SEQ ID NO: 427 - DNA, 75692 bp, Homo sapiens
gacgcggttcgccgcaggagcctcgaaggcgcggcgccggcgagcccttccccggcaggcgcgtgggtggtagcggccaatttgacagtttcccgggccgggcggccagcgcggaggcgccacgctcgggtcgggggcgggctgacgccgccgccgccgcgggaggagggacaaaggggtgggtccccgcgggtcggcaccccggcggttgggctgcgggtcagagcactgtccggtggtgcccaggaggagtaggagcaggagcagaagcagaagcggggtccggagctgcgcgcctacgcgggacctgtgtccgaaatgccggtgcgaggagaccgcgggtttccaccccggcgggagctgtcaggttggctccgcgtaagtgcctccttgtgccgcgcggttgggaggagggtcgtgagcgtgagcgtgggagcgctgggggctctgctcgcgtgctgctctgaagttgttccccgatgcgccgtaggaagctgggattctcccatccggacgtgggacgcaggggaggggtaggtttcaccgtccgggctgatgactcgtggcctccggggctcctggaacctttactctgaagtcacttgggctggagattaaggcgcgagtaggggacactgtcttgaacccggtgtcctggatttctgctggcttggaggcatctcgtgtctgttgtgtcgcttgcatgtctttgtgttttccttctctatttcaaaccacactcggtattgatgcaaagttacaggcttgtgtacgtgagagaaactgaaaactcatcacagagcagaatcccttttccctttcaatcagctgcgtctgtaatagaagtaaaagttgtttttttttttttttttttccagtagggaatggggatggaggtttggaaggacccacaaaagaggagtgtgatgaatgctttgtattctagtactagcctacctgtcaccagttctttttatgtcttcatttgtcaagtttctgcttttacacggtagtttaagttataaataatcagggatttctaccacagggttttaacattcttgaaatgtggacaaacttgggagtgagtgctcccgcgcttagtaatggaatacagcctcccacctctatttcagcttcagttcttaggctaggctgcttttctggcagctgtctggcctgagtaatgatggttgtggtttccctgaagttcccagcggagagtcatcccatgatagaaactgccttgcgcttctcactcacgctctcagcccggggaatcccagcggggaggagggagggaggtcgttttcttcagctccccaggtggtctgtgctgggtgtgctgacggtccttttgggaaaacaggtccacctttgccagcgtaattcagaaagagatgtaattttctgagagcacacacctgggcaggagatcgcttgaagtgagaaattcgtagtggtaaatgtatttgtagcaaagtaccactgcatatcctgcttgagaggatgaaatttgattatttagtaagttttcatgaacaactccacttcagtgtggggattacgcagatgagcaagagcgtggctctgtcacacagtcccgttgggaaagcctgcaactcattaagaatccgatgagtgccatttagaaatgtggacagggtactggagcttcctcattgtggggagatggcagaagcggaggtgctttactaaagcaccggtggcttttgaggtgtttcttgtgtttttttcagaactacttctgcagtggggccactttatttcttttcagagctacttatgcagattgatgaaggggaactttcccctctgaaatgctgctgtaactttttcagtaccatccagatattataatactgaatgagcccctactcctgccagtcactgtgggggatacaaagatgaacaagattcaatttctgcatttaggggtctagtggacctgaaactgttagactttactctgcaatctgtgtcgggattcctgagactgagggagggaatgtatgatgccgatgcacactctgcaatacagaaatttagcaaagagtgggattggtcctatatgcattcccttcaggggattcttgctgggaataaagggcatttgaacagttacctcacccgagcaagccactatagaaaatggggccagtaatgcgcccacctcaccgggctgagtgaggtctgaatgaaatgacagagagtacaaggcatgtggtggatgctacgtaaatggtggtagctagtaataggaacaaaacgggtgctgaaaactcttaagtgttgggtcctgggttgataagggaggtgagatctaaagatacaagtaggaggtgccaggtaggtgtccaggaaaaaactgaaagagttgttgttcacactctgttaaaaggccttgaaggccataacgaagctttgggtggggggaagtcagaaatccctcatgtattaaatgacttgactttccctacaaaagaagcgaaccagtttcccagtaaacatcccaccccataactatttttgaggcattcataggcttaagaccaatgaatttttacatcacccccgggggaattgcatttgcaatgacttctgcctacatttaacttttgatctagttctttgtacactgacaaaagttcacagccaaccatttctcttcaggacaagtgtgagaactttctgcatactgctgaaggcaagggagattttgagtttagcaaggttttctctccttaagaaggttatctttttacgagacacaagttattgaaactaggcggggccactttagtcctgtgtacaataatatgtgtagtaatataaatagtaatttaaaaagtcatgcagacttggttggggagaggcatgaagtttgggtgtggtgggggcggggtgaagcggtagaagggttcgcaatcactgctgaaactttcaacatattctaccaacaatatgagccaccagggaattccttgcctcatctctagaacgaatcccattaagcagttgtggctacagatgaatttatctaggttgagagctgattcccaataacatgcctcattgatttgactctaagcagtaatcaggggcccaacagttgttggaccaaccagccttgattttccagagaaggtgatttggtatatggtagtgtctgagggtgagattgccccagatgggagtggagggaagcagaacagttttctctggtgttttactgagtttttgtcttgatcctaaatccaagggttagggtcagaaacacagactcagaggttagatttaacacccatttagtgggttaaacacatcaatggttatgtgaactttgttaaggtttaaaaagctatttagggcctgtttctccctcataggaatttttgcaatcagcctttttagtagatgcccatatagaaagtgaatttgggagggtctaaggtggtattactattaaactttttgaaaaggctgtgtgatagcaatggaaaaaaaaattcaggcatggaaatccaatatgcagtattgcagtagctagttttaattttatttttgtttttttggttttttttttggagatggagtcttgctctgttgcccaggctgaagtgtggtggtgcggtcttggctcactgcaacctctgcctcccgggttcaagcggttctcttgcttcagccttcaaagtagctgggattacagaagtgagccaccgtgcccggccactagttttaattttggatggtacctaggaaagcagttgagctagtatgctgcatacattgtagtgtgagaggcagagttccgagttggagagtgtctgcttccactttttccatttgattaggaaaagcacttcttagaactgggtgactgacagctagagccccagaagacctgcacaagctggggcaatggctacccataacagtgacggctccattctgttttttaaagggattggtgtctctatcatccagctggccattaaacaaccaaagcttcatcatcctagataacctgtgagctctcagaggagacagagtaaggactatcatacccccaaaatacctaatcatttaataaagcattttctctaccttttatgctatcccaaaacagtgctttccaaagtctggtatacagacagacttacaggtggtgcagagagatacatattctatttttcaattatgatgcatgaatattatatgttaggaataaaaacagaaaaccagctaccacatccatttatttcatggctagattgcttagaatgaggcaaaaataaatattaagtaaagcagtgagtttgctttaagaaaaattatcaactctgggaatgagtaatatgaggctaaggcaaaaatggtaaagctagcccttgacatctgaggtgtgcataatactgcttaaaatatgagtgtggtgcttacttatagagagcctggtataccttgaccacgccttcaagaaagtcaaacacagaatggcccagaatagccaggaaagttgaatttgatggactttctgtcttaagcgtgtgcatcctgctcttatccactcagatctcttagatgtggttgcagacagtgtatttgtagagctagctgtttgttttaacgtctggcccaattctcattcctttctctgcttccacaagccattctgcagtttttaaaggtctgttggtatgatatttttgatatgatagagtgataggggaggaagtattttgacactgatgaaggacatcactgtattatcaagtgactcttgctcatgattcattgccgaagaatgtggacagccaaacagcctcacctgtaaatgcatttaatttctcaaagtctttcagaagaatgccaactggatgagtttttttttcttattttttttttaatatgaagcttgtattggtctgtaaaataggctttaacaaggattttcgtaggaacaggaagccttgaggtagaaaacaagtatccctgctttgacctagagagatgcatgctcatggcaggcgaatgaatcaaggagaagagaaaatactgtttcagtagactctctagtgatgtgtgtgttcacaccatttatgagaaatcctaagctttcaattagtaacttgtactttagtcatttaaaatcagcacagatgtttgtttagtgcctctgccagatggttaaagttaaatcaggttttttaacctgaaaaacgtaatgtagctttccttaaccatttacacaccattgtatattgcagaccatagtcagatacattttgttataatgaatgtttattttaccttttagctcaattagaatatcagtggttatggtttctattttgttttcctacagttactgtatgggggtgcagtaacagcggtggtggtgaaagtaagttacttttttctttttctttctttttttttttttttgagacggagtctccctctgtcgcccaggctggaatgcagtggtgcgatctcggctcactgcaagctccacctcccgggttcacgccattcagcctccccagtagctgggactacaggcgcccgccaccacgcccggctaattttttgtatttttagtagagacggggtttcaccatgttagccaggatggtcttgatctcctgacctcgtgatccacccgcctcggcctcccaaagtgctgggattagaggtgtgagccaccgcgcccggctgaaagtgaatctcttaatggatcttccatgaatcaaatatttgtgttttagtaagttaggctgaccaaaagatttcgaatcatacctttaatcatggcaaggatcttatgtcacattcttgagtacacatgttcactaaattttacctatatgtgtatgtgaacatggacttcagaattaattagtgtggtaattattatttctattgtagactttaatcagccatattaaatatatgcattatgttcacagagaaaacatggtatcatctttggaaactttacagtatgctctatattatagataccctatataactatggtactaaacacacgagttagtgacaagtcaggcatttggagggaatgtttgtaacccattgtgggagagagttattagaatagttattcttactggtaggtaacagttatggctgtaatgaatagaatgtgactaaaatccagttatgcctttgccatcgtattaaaagctttggtggagacgtgagaacattgcagatactttggattttgtcacttgagttgaaggtaaacagagaaaacagtactttctagtcatcagtaggaattaactcttccaggacatgtagcttcaaggaccttctaggttcttctgagggggaaataatgttccacttggggccatttttttccatttgttgagagtcatttgttttcagagtattaaaggaagtgttccgagttctaggttgtgtttctttgatgcctactaaagctgagcacacctgagaccctgggtggagctctacaatgggaataggagtaagtaatgtaggcttcgagagacaatcattctgctctcagtccttggaagactgttcctaggtatatatggcaaagcagatgaaattatttgagggaattaattagcaaaactaaacatttctgtttttgaaaggaatgaatcatttggaaggaacttcctggtgagctcagttttagcagcctggtttctgcgttacccttctgcagtctggctgaatcaattgtgttcttgcctgtgattggtgaggatgcacatgctagtatttattctagcccttatcacttcccatcagccctgagcccctccctggtctgagtcatcttggtaaccccagaagctaacagagcaccaacacatccactaaacgttggactgacttgatttggggcaggcttgttgtataagctagtaggaataagagactaattgagaaattaggacagtggattcctgacatttatatagtgagtagatgatcgtttgttagaattgcgaatttcatccagagaattttgtccaaaaaaaattatagaatttcatctagaccatttttgtaatggcatggaagcagcattagctgcaccactgattagctgggtggcttttgctgtcttgtgactctagtttgcaatttcttttttttttttttttttttttttttgaggtggagtctagccctatcgctgaggctggagtgcaatggcccgatctcagctcactgcaacgtctgcctcctaggttcaagcgattctcctgcctcagcctcccaagtagctgggattacaggcacacgccaccacaccctgctaattttttgtatctttggtagagacggggcttcaccatgttggccaggctggtctcgaactcctgagctcgtgatccgcctgccttggcctcccgaagtgctgggattataggcatgagccacctcgcctggcctagttctcagtttctttatcagaaaatgagtagttacagttgatcatctcaaagtcttttgtgcttaagattctgaaggttttgaagtttgagtataaagcctagagaacattctaaattatttccattggttcttctcatcttaaaatgtttttgtgctccttaaactacgtttgtgtttgcttgcttgctttcttttttttttagagatccagtggattatctctgaaaagcattttttaaaaagacagagtccaagagtggctggtagttgttttgctcataaagtgatggaaagatctattattcagttgcagcttaaattatgtaccagcaccacgtgtgctggattctcttccttactttgcagcttaagccagcaactgcaaccatcttgcagagcttcttgagaatccttcttcctcttcctcttcctctccacccccatggacttctccccgggcctcattgcctgtgacatacgcttggaaggaggggcaggcctgcagctgggagccctttctgatttgttcttcacaaatgtgttgaagatgagcctactggtcactgctgcaaaaaaccacattgttcactggtgtaaaatcactgctgtcatctgagtttcagcataacttcaggcatgttggagtttttcaacgtcacctcaggcagagcactttgccttccttgggctggtctgtttagtgtctgggtgagttttaagagaggagagacattgtggcatcttagacactcactgaaattttccagaaatggagctggaaacatttgtgcgtttccttctggtgttattgttaaagcctaaaaacaagggcaagtggcaacacattgaaatgaagaagccccaagtttgcaacacattgaaaggaagaggccccaagttcgttttgagcctaaattgaattttaatcaaaggtctgagagaaatatttagtctacttatactatttaagtgcacagtttggcagatgactttgggcagtgaaggatctggaagaggcaggaaaggtagactcaatctgccagacttagagctaaaaaaatttgcctggtatgtttccatgaagaaaattttcctgtagaagcagtggcacgacctctgttacaagtctgcttattgataatgaagctttttctgtgttatcaatttcgttgaatttatatgtatgtatatacatatacacacacacaaatctcaagtagagagcttgatgaatttctttttttttttttttttgagatggagtttcactcttgttgcccaggctgaagtgcagtggtgccatctcggctcaccacaacctgtgccctccaggttcaagcaattctccggcctcagcctcccgagtagttgggactacaggtgcgcaccaccatgcccggctaattttgtattttttttttttttagtagagacaaggtttcttcatgttggtcaggctgatctcgaactcctgatctcgggtgatccacctgcctcagcctcccaaagtgctggaattacaggcgtgagccattgtgcctggccagggaattttatttattgtggtaaagtacacataacattaagtgtaccattttaaccattttaaagtataaaattcaatggcatttaatacactcacagtattttgtaaacaccatcactctctagttccagaggtaggtgaatttttacatgaatgtattcacctgcatgattaccacctagattaaaaactagaattttccatcactctggaaggttctctcttgccacttttccaatgattaccacacctacctaaaagagaacttctcttctgacttctctcaccgtggaacacttttgcttgaacttgggagaggacccatatataaataaaatcaacattttatgtctgtcatctttcactcaacctaacctctgtgaaattcatccgtatttgttgcgtgagattcagtagttcttttttgccactgagtcgtattccatttatatgcatctgtcacatttggcttatctcttctgttgataggtatttgggttattttcagtgtttttgctattatgaataaagctgccatgaaaagcacctacacattgccttgtggacatgtacacccatttctcttgtgtgaattcctaggaccataggttagggattttttaaaaaacttattttagattaaaaaaaatattttttgagacagtctcactctgtcacccaggctggagtgcagtggcatgatctcagctcattgcgacctgtgcctcccaggttcaagtgattctcctgcttcagcctcccaagtagctgggattacaggcatgcgccactacacctagctaatttttgtatttttagtagagacaggtttctcttcaactcctgagttcaagcagtctgcccaccttggcctcccaaaatgctgggattataaatgcgagccaccacgcccagccaggttacagatgtttaactttgattctttacctctgaagtcaaataaacctgggtgtgaattcttttgtcctgccacttgcttgcttgactttgagcaatttacctttttctcatgttcagttttctcagttgtaaaataggcctaccctatcagtcatggttcagtcaagaagacatgtcattctagctatttcaaggagaaggggattcaatacagagtattagttgccttcaggacaaagaaaaggcgagatgcgcaaaaaatggaagcccaccgctggctttctgatttgccgcaaaaaaagttagaaagctgctgccacccagagaagactcagaaggtcttgcttgaccttccaccttctcagcatctccagccttgaggctggtgaaagggcagggaatctggacatgctgtaaagctcatgtctgaggaatccaacttttgcctgctactgctgctgtctgtaggaagaagaaaaacaaatggcttctgctttccttcatccttccaaatctcaaacacgtgtacctcgctggtagaaccctgttggcaagagagatgggggatctctggtagaaacagaaactcagtgccagcaaagaagaaatggcatagatgccacctggggttgctttgaggtgctcagtaaatggcagtggttataatttattattttcatcattcctcaagaactgctgctgcagttcagactgatttctctctctctctcttcttttttttttttttttttgagacgggcttgctctgtcacccaggctggagtgcagtggtgccgtcacagctcactgcagcctcgacttccctggctcaagtgatcctctcacctcagcctccgattagctgtaaccacgggcatgcgccaccatacctggctaatttttaaatattttgtagagatgaggtctgtctatgttgcccaggtgggccttgaactcctgggctcaggcgatcctcctacctcggcctcccgaagtgctaggattataggcgtgagtcaccacgcttgggcagcagactgatttcttttttttttttttttgagacagagtcttgctgtgttgcccaggctggaatgcagtggtgcaatctcagcttactgcgacctctgcctcccggattcaagcaattctcctgcctcagcctcccgagtagctgggattacaggtgggtgccaccacacccggctaatttttgtatttttagtagaggcagggtttcaccatgttggccaggctggtctcgaactcctgacctcaggtgatctgcctgccttggcctcccaaagtgctgggattataggcgtgagccaccgtgtccgacccagactgatttctgtaacggatgttcattcttttcactttatagtcacatggatgccactgtaagagctccgtgtcacataaggtgttgtttttctggaagggccttccagattctgtatctattgctctgtgattctaggtacttttctaaaggtataagcttgagaaattagttttcaagtctgtaagttaatgtagagctgaaaggtgacttaattctaagagttgctgctttaatgtataattttatggaacctaatgagtgttttctttttaaagtcattccactttattattaataaaataaaaggtaatatataaatctggctgatagatggggttacttttttccctgtctttagcttcctttgtgttctgataaatgagatggaagatttttatcatattttgtacctcaaatctctcgcggagggaacactgtagtctaccaaaacagctggcagaagtgtctgtcctattataagtttattttatgaaacatgagctataatgtagtcctttttttttttttttctttttttggagacggagtctcggttgcgcctggctaattttttgtattttttagtagagatggggtttcaccgtgttagccaggatggcctcgatctcctgacctcatgatccgcctgccttggcctcccaaagtgctgggattacaggtgtgagccgccgcgcccggccaatgtagtggttttaagacatttaaaaatcttgaaccaatgttggcaacagcctgtctgtaatgatgtcacatgtggaaagaaccgagtttttcttaactttagaatgtgaattttttcctccttcaaatactttttcctataacccagacctattttactttccagggaccctactattactgccctaaggtaatttgctagaaatggagtggtcaagatgtattgattaacgttttaggcatacttctgtagtactacttccgaaggctccttgcagagaaatttgaagtgataaggaaggcaaatattcgaaatggaaagataagtataaccagtgactatttcagccactggtttagcagttcaagtgagctggctgtttgtaaagcttgcttagtaaatgaatgtgctagaaatatattgacagaatttggttttatctctttttctccagacttttagtcggccagggctaacaatggatgtccaaacagtttacagtggctgatacacaatgcacaaagggcttcactgtttggagactggaaaatagagccagaggggagcttcttatgggcattgacctaattcactccttttggcaaaaatgcttggttttaaatcaatgtatgtatttctgacccaaatatctataaatatttcagctagtagtgttacagctggaggaagggacccgtggtgttgcttcgtgtattttgatttgacaatattctttagaaataaattgtcaagtgaactaatattacacaaaagttagggaaagttaagagaggcagctgaaattccatcagtttcctccttagtccctggaacctccccacaatcaggaatttgttagtcacctggtttttaaagataaatttctctgtgggcgtttctgctgagaaatgtggggaaacaggactgggctaaaaataaaattagttcaggcattgctaaacttctaagtatcatgtttgtgatgtacttttccaggaaacataaattggcaatatttttgctcctttttactaccacagaaagaatatttgcagtcagcatgcacggcctgaaagaatctctctcgcctattaatagaacagaaggaacatacacatgtctatgtgggggaaaaacatctcatttggcttagtagtaagctccaaataacaattgcattgttgttctgaattgtctttgagtgtgattggatgattaaatataaatgttgacctgattggattatatcacagcaatgaactgtcctgaaaaaacagctgtaacataccactccagactgttaccagacttagtcggctggctttatatttgtgttgtcaaaactgggatgctgtcatttctgtttctctgtctctttcgtctgttccaatttgagatatactgactatgttagtgtagtctgctacatggatagtcctttatctttcagcaacataagcaacataagctttttgactgagacgagcgtaatcaaaaggaatgctgggaaacagtgaactgtaaaaaatgtcctcaattagatacaggcttcagtgcatgggtttatcctttcagaagatcggtgtgttttcagtgagggtctaaacccactggcctggattccacctcttgttggatgggtggtcagttttaacattagggggtgttgattgtgagctcttgagagcagggctggttctttgcattcctaggtaggcatgatgtagagtagttgctcagtaaataggggaaggtgaaaggaagagaagggagaaggtgagtctcaaaagactggaatgtgataagcacacgtttatcacactgggggtgtattctctcccttttcttagagtattccttgcctcctgaaaaaagcactttgcaggaaatatggagatcttctgaacctgtggctttgtgttattggactgagaagtccaaaatgtgcattagcggagcttatagaactgctctgagaatgtgttcttgagttctacaaatattatggggtgcgttgggggctggctcactccagctcagttcccatgtgttaagtggaacttctgatctgttgaatgcctaaccatgacggagcccaggagacaaagtaaggtgtggtttgttttgctgtaagaccacgtttggttagcttttctctagcaaagctggggaaggagatcacagggctgatgtggtggtaggcccttggtgtagatctcactgacttttcccagtcaactaggagtaaatgttaaccctattttataggtgggaaacggaggctcagaaacattaagtaaattgcccagtgtcacacggcttgtgtgacagggaggggatttgagccaaggtccatttgatgaatttgaaacctgtagattctgtcaattccaccagtctctgctttttagaatcacagtggcaagaaaataggagaagctcaaggccctgtgttgattattaggagtttaaacatcatcgctgaaagtgcatagaaatatttgtattcctagagaatcttaagtaaaagtaacatatcaatgttgtcaagagatgtcttcattcatcagagacctctgtgtgttcattactgtatgagaccccaaagactctaagttgcctctaagacacagccttacagggaggtattaagtgattatgtatacagctagctaaaaccacaactttattatagaaatattaagaatatgtcttatcatgtgagagtattctttcttcaagtccatagcctccagttagaaatggctgtgttgtcccatcaaccccttcactcaaaaactatcattaatatcaggaaaaacttatggttacaaactcctgggttatagaattggaaggaaaaacttagatatgctgtgtttgggagcttgccttgaggattggaattccattgcaagttaccttggggtcaaagtacatcccctaaaacatcaaatacctccaagaggttttaggctatcagacagccacactttaatgtggagtagactagtcagctttcttctactatctaactgacaccatacacattgttaaagagataattttgattgggaatgaagatagggaattttgaagccagaacattctggtgatggagcagatactgccgagatgttggcctcgggacagcctggaggaggaggacactgataaacagagcaaccagcccaaggggtggaaagacctaggaagtctccacatacaaattttgcttctttcctgtttctccactgaaccctgggaagggtgcttatttctctcctcactgtctttccccaggacccagaattgataggttagttgagtttctgtgggcagtctaaggtagtgttactatttaaaatgttagtaacattttcagattcactgagattcttgctgagtgtggtggcatatgcctgtggtcccaactacttggagactgaggcaggcaggaggatcgcttgagcccaggagttggaggctacagtgagttctgattgtcctgtgaataggaatagccactgcagtccagcctgagcaccacagtggagactccactttttttttttttttaagtttaaaaaagttaaaaaaaaaaaaagacaaagaaaaaggaaagttgatttttggttctaactcagttgtgacaaacggtggatatatggttctgaccacattctaaattggacttgatggtgggcaagggaaacttccaatgcctatcccctcactttaaaaaaacttctcctgggccaggcacggtggctcatgcctgtaatcccagcactttgggaggccgaggtggacggatcatgaggtcaggagatcgagatcatcctggctaacacggtgaaaccccgtctgtactaaaaatacaaaaagaaattagccgggtatggtggtggacgcctgtagtcccagctacttgggaggctgaggcaggagaatggcatgaacctgggaggtggagtttgcagtgagccaagatggcgccactgcactccagcctgggcaacagagcgagactctgtctcaaaaaacaaacaaacaaacaaacttctcctgtagcagtttgctttgagttgtgggtgccacctccctcactgtctttttctgagggtacataaataaattgcatcctagcttgagatcaggagcaatggtttttagttctctgtgtccaacacaattcttctacacagtgtcttgcccaatacatgtgttggtaatactgacaaacatagttaatcttcttctttgaagattatctgaagcaagattttgaccttaggtcagcttcccctgaagtatgtgattggaaactgaacgagttcagattttagtttaggtaaaaatataaccagagaagttgctaccaagcatagttgactttgagctgacctaacttttggattatgtactcactaagaacttacctcttattaattaaacaaatacaaggaaataaataacccaataaaaacactcaaaacaagtttatccccaaatagtgtacttgatgctaaggacagacctaaagtttgttgaggatagaaatgaaaaatgaggcaaaagaaaccaggaattgagatgtgtgtgtgcctgtaccagcacccgtgtgagccccttgcaggtaacgacccatggtccctgcacatcagtcttctgttactaagttttgcataaattgagtctggtggttggcaagctacatatagccagctgcgtgtttgttgttttttctgcctgctagctaagaactgttcttgcattttaaatggttatgtaagtatctatatgatctccgtgattttgcctcttgtagtggcaagcctaaaatatttattgtcaggccctttgagaaaatgtttcctggctcctgcctcagacctcctggaagcagggtgttggcttgatttgtctcctgttctgcaatctgggaatagtagatcaggatgctgacttgtgggaagatgctggctgcatgagatgcccctgtctgcagtcactcatagcttggaaaagcaaaaaggaaaaagggttggatctgagcactgacagacaggtttgcttctggtttcaatgtagtaaggtgacctgataacaagggccacttgagaagttgcaaatgcagatttcctccgtgttaggtggtgaccaataaaagcatattttgtttttaggatgtagaaaggctataaaactgcaatgtctttgtatcatcaaacatttctgtgtttctgatgtttcagatgttcctatttctctggattgcaggatttcaactttgcaacatgtactgttgtgtttctgagttgttgactatttcagttccaaacagttcgttatttcctgtcagaggaaacttcagagtaacaataaagtgctggtgtggcttcaaaggcttggagaaatgaaaagcagtggagaaattttgtgaggttcctttggcttagaaggttcagaaaggctttgagcgaatgaatgtatgtatcagtcactgttactccaggtccgttagctgtttccagacctttctgtgtcctaaaaacaaacatcattttgagggtggggactgtgtcctatgttgacaggtctttgttttcaaagtctgatgtacaatagagactaaacgttcaatgactgaatgcagttcatttttaaaatttttttttttttgagacagagtctcactctgttgcccaggctggagtgcagtggcatgatctcagctcattgcaacctccacctcccaggttcaagcgattttcctgcctcagtctcctgactacctgggattataggcacgtaccaccacgcctggctaatttttgtatatttagtagagacagggtttttgccttgttagccaggctggtctcgaactcctaacctcaggtgatccacctgcctctgtctcccaaagtgctgggattacaggcgtgagccaccatgcccagccgtatgttttaaatcttatattaagcttataccactgttgattgccgttgctacagtggggcttatattaatattagaaacacccctcatttgagtggtactttacagtttatagcaacctctacataaagctgggcatggtggcacatgcctgtaattccagctgcttgggagactgaggcaggaggattgctccagcccagaagtttaagaccagcatgggcaacatagcaagaacttgtatcaaaaaaagaaaaaaaaaactttcatgttaaattctcacttgatcctcaccaagaaccctgtgaggtgagtgttattcactggatgcttagagaacctagagatcatacagctggctagtgcgtaccaggaacttgaactacttataaactggagcagtcggagaaagcttggtgtgtttgacattgtctgtctcttggtctccaggccccaagaggaagcaaaagcctaattcatcttggcaaatgctgtagaagttcttgcttggattttctttcgctagacagtttttggtggtggtttgttgctctccttcagataaacatttcttgatagtgcagtttcttccttcaatatgttcttattctggtgtgtacatccgtttctcagaatgtttagtaaacatttctgttgcataccctaatgccagtttcttacctactcctcagtagcgtgctgcagcagtggctttgggacctggtgtagacattatgggttgctttattcattcctcacagtgacaaggggatcttgattggtgctaagtccttggatggttcccttggcctcagtgactctgagagagccatcactgcaggtgtgatcagtgccagggtcttcctttcttccttctctctcactttttttttttttttttttgagatgtggtctcactctgtcacccaggctagtgtccagtggcacagtctcagctcacttgagcctcctgggctcaagctgtcctctcacctcaatctcctgagtagctggcactacaggcgtgcgccaccacacctggctaatttttgtatttttagtagagacagggtttcaccatgttgcccaggctggtcttgaactcttgagctcagacgattcacccaccttggcctcccaaagtgctgggattacaggcatgagccaccgtgcctggcttttattgtaatttttaaagtctatttctaatttcatctaaattatgttttgaaattttcaattcgtagggaaccggcagtctctccctttttatttctgcatgactgcaccacctagtggataatacatctgttaccaggcagtggcctttgatgatttcctatagctacaaattctacaaaaaggaaaattgggtgcctttttatgctttgaaatcacatataatttctgccagtaatttttgtttctaggcaagtacggactttttgagaggagcttaataacgtttaattcagaattaaaaaaaaaaacgtcagcccatacctgaagtttcccgtgtcaccaatggactaaggatgcagactgtcagtttcactcagtttatgtgataatggcatacaagatagaataatgaggtctttttctaagtttagaaacaaggctatttcaaacacctgaactttttttttttttttataacttgcttgaatttcatctgctgtgttttattaagtcaaaagaattaggaaggcttgttgatttttgcatggctttggctccacatttgatacaggaaacctcacctttcccctccctgtctcttgtctttgctgccccctgcctggatggagtatgttccagtatgatggagcaattgtttctttttgtctgttgatttccattaggtgcagtgggcattggtcattgtgctaagtataccatgcaagaacacattcagttattacgtttatggtattttaaatatgtaacatacttatgcagttgaaaccataaattgtaagatttttagtcttgtccatagattaacggtttaaaataaaattattgtgtctcttactgacagctggttaaatcagtattttcaaagtatcaatttactaagttttgtcatgtgcctctataaggaattcacagtcttcctctgcgctcccacagcctttttatttttccttcccaggaaaaattttagagacaccaaaaggattcttaaagtataaaaatgaatttcactgtttttgaaaataagtactatttttttcttaatacctggcattctgctcatggttgcagcactgtaaattgctgaaagttataggtcattacacatgaagaggcttaaaaatgccgtttgatctatagttaactacaaaatatggagggggagctatatgcacacagtgtctgccatagcattagttatactagcaaaaaaaaggaaatggcttaaatgactgctagggatatggttaattatatagtaaatattgctatttacaaatttaaattaactaaaattaaacattgcattcttcagttgcagtagccacatttcacatgttcagtagccacatgtggctagtggttactgtgttggacagcacagctatagaacatcgtcaccatggtagaaacttctgttggagagtactgctagacaggtgcttctcaaacattattttccccgtcacctccctgatgggaggtgcttctcaaacgttaatgtgcatattaatcacataggggctctagttagaatgcatatttttatcagtaggtccaagttagggcttgagattctgtatttttaacaggctcccaggggttggctacgtaatacccaaagggtggggttcttgcctttattctccaattctaataggaaaggcatgtgtttgaagctcaggactccgtatgtaggctcactggctttatgggattaaccaggctcattgctaggtggtactaatgtgtccctcttttctgtgggaaccatcatctgatggtgccccaggtctgggagggaacgattgaccttgtgtgtttcctatggggccaaccttgatggtgacatttagctgagcagctctaataattgttttttcaacctgcctttttgacaaagccgtttatgattatctttatcttggtgcctattatgggggtggtggtttgtatgtatgtttgtttttttaaagtgaagctatgttttagtgttatataagtttagtcaggtttaaaattatagggtacacagggctgtgcctgtgttgccaaattagcaccttccttttggcttattaatggcttctttgtaattacaaataagaatgatctgtttatagcttagcttagtgtatcagaactaggaacatagaggtcttaaatgtaactatcagctgatttttttttttttggtctcatatcttatgaaaattggactcatgcaaatttgcattcaaattgtgaccaggcacctgttagctgtggggccttgccatgggcaagttccttgagatctcaggccttctatttttgtatgtgaaaaaagcaggagtagggttagggtatagggtttttggaggattaataggcaatagccataaaatacttagcacggtgtctggcatattgttaatgtccaatcagtgatgatgtgtttcaggcccccccttttccatggtgttcacaaaggcgtaggcattagggagcttgtgcatatataccaaagctgactgttcaaacagccagaaataaaatccgactcgactccctttctgcaccctcttcttaccaactcactgcagaagacttattgggctgtgttgactggacccaggccagtggtgtggaaatagctatcatgcttgtgaagatgttctgagttgtcagagtgattgaatccatgattggtctggtgcccaagcaccaacaatcatgtttttgtttgtgtgtttgttttttaagagacagggcctcactctgtcacccaggctagagtgcagtggtgccatcatagctcactgcagtctcaaactcctgggttcaagcagtgctctctccacagcctcccaatgtgctgggattacaggcatgagacactgagcccagctgggatttcttttggtgtgaaggccagtgatcagtcactagtaggttttggaaggcacaataggtgtatagtggagaggcaaggttcttcagtggaaaggatataagctttctagtcacaccagcctgagttagaatctgtcctctgccactttttacttgtatgacctcaatcaacttactttacttctgacttcagtgtcctttctgtaaaatgagtctattaataatgatattgataatagctaaaattgagcatgtactatgtgccaggcattaccttgatttctctacatgcactgtctgattaaattctcacaacaaccttagagaggtgggtcttgttactgctactgcctctgctttacagatggaggaaactgaggcaaggagaaattaagtaactcgcccaaggtaaagggtggagcatggatttgaatccacactttctgactacagactctacgatgtgatcttttttttaaaaacagctttattgagatataattcatataccatacaataaaagtgtgcaaccagtggcttttagtactgtatattcacagagttgtgtggccatcaccacaattcattttagaacattttcttcaccccaaaaggaaactgcatacccattagcagtcactcctcatttcccccaaactcccatagtcttagggaaccagtaatctttcagcctctgtggatttgcccctccttgacatttcacataaatttgtcattttatgtcacataatttgtcattttatgtctgatttcttttgcttgttttatatatatatgtgtgtgtgtgtgtgtgtacacacacacacacacacacacacacacacatgttttctggaggcagagtctcactctgtcgcccaggttggagtgcagtggcacaatctgggttcactgcaacctccgcctccccagttcaagtgattatcctgcttcaccctccccagcagctgggattacaagtgccaccacacctggctaattttttgtgtttttagtagagatggggttttaccaggctggtcttgaactcctgaactcaagtgatccacctgcctcgacctcccacagtgctgagattacaggcgtgagccatcgtgcttggccctgcttatattatttttaaggatcatccatgttgtagcatgtgtagatactttggtccaccttattgttgagtaacagttcattgtatggatataccacatttcgtttatccagtcatcagttgatggacatttgggctgtttccacttgtttgctattttaaataatactgttatgaacatttgtatacaagttgttgtgtacacatgtattttcaattttcttgagttctgtgatgtacttgttggttttgtttttctttttttctaccatgtgttcgtaatgctcttctgagaggaagaaaacagactttcttacttgggagtggtcagcttatttgctgctacaatattaatgatggaaaacccttatcaagagtgcttatcctgtgatgggtactgagcaatgctctccagaagcattactttattcagttctcagaattctaatagggtagggatcttgacctcattttgcagataggcaaccaagtcttaccaagtgaactgttccagatcacagagcttggagagtgtgtagggggactgagcttagacccaggtgtgtgtgacggcctccagaactcctgccactgtgttatgtggacaccattgtctacctcccactggaaggtttaccagcctggattttacagagtgctttcatggggtttgcctggtttcaccctgtgaaatgggtgatgatgccatcgtttgatgaagcagcagtggaattgagtgagcgcccaagctcatgggtgaattgaggcgcagtcttggatggaggtctgtttttggagtttaaatttattgctgtttgcatttcaacacaactgctttgaaagctacaggttgcctcaggcaccctgtcatcctttcccaattcttttttttttttttttttgagactgagtttcactctgtcacccaggctggagtgcagtgacactatctcagctcagtgcagcctctgcatcccaggttcaagcgattctcttgcctcagcctccagagtagctgggactacaggcatgtgccactacacccagcgaatttttttattttcagtagagatggggtttcaccatgttggccaggctggtcttgatctcctgacctcaggtcatctgcccgccttggcctcccaaggtgctgggattacaggcgtgagccaccatgcccggccacctttctcaattctttattatctatttaaatgcacgctaaaaaatttaccttaggtaaataaaggagaatgtggttaaaaaacacaactcagtaaacctggcactcttcagtagtaggtctgggatctagttgtgttgattctggtgacctatcacaaacccctctctaagcttattgctttttgctgttaaacttggtcataagcaagctgtgtccattgtgaagtgtgtgctgtgagcacatcgcatacactagatttaatcatccactgccggcactcagtgcattgtgaagggagggtaaggagctggtgaaatcacatgtgaaactgaaatacttgtggaataaacgatgaaagggttttgtttgtaaaacaaacgctacagaaagtattgttggatgcggtggcaactagtttattgctaccaagaggggtttaagtttgaatagaccacaggtaagtgccctgaagccaaaaggacttggtttataatgttaaaaattattcgtttttggaagaacaagagttgaactcattttctgccttctctgggaaaaagcatttcctgttttgttattagacagctgtttcaaagttttgtccagtaagcagaattttgactaaattcttcacaatagttaaaaccaatttcctgggggcaggtggggaactataaaagtcctcttttcatctggaggtaggtttacctaccagcctaggccagctagctgtttctttacactatccctttctaaggatttgagttcgtttgtaaaatgacatagcagacacaacataataccagagggggctgaacgtggtggctcacatctgtaatcccagcactttgggaagccaaggcaggaagagtctcaggagttcgagaccagcctgggcaacatagcgagaccttgtctctactaaaattaaaaaaaattagccaggtgtggtggcatgtgcctttaagtcccagctactccggggctgaggcaggaggaccgcttgagcccaggaggttgaggctgcagtgagccctgattgtgccactgcactccagcctgggcgacagaacaagatcctgtctcagacatacacacacacacacgcatgcacgtacgcacgcaccagagggaaacatcatgcagaaaaccattggcccatttattggatggtgtcctcccgaagtttcacatctgctgtttggagctactgagaacctggctgatttcatttagtgctccctctgtcttactttgtctttccttcctttctttcctttctccctcctttccttctttccagctatccagtaacatgtattaaggactcagcatgtggaaagcacgcatgacattgttcatggagacgagggtctggagtcaggcagcagctcggatcccatctctgacagtggtgggctgtgtacactctctggcctcagcttccctatttgtaaaatggggatggtggtgctaactcacagggttgtgggcattcagggaaaaattgtatatttagtactgggtgtggtgccctgccaaatgttaatgacttccttcctctccagttttcacacttaccttgtctcccatttctgaggtgaatatgcattttaaggctcccaagccatagattaagctgttttgacatgtctgtccctgctgagaacgtgaaatcctgtgtgtgttattaaacagtttactgcccggccgcactgagtactcgcaatgtcttgaacacccttgcaggttacccctcctggctctgaacgggctgttccctctatgcagaatgcccacccacctgaccagttagtcatccttcagcatggagctgtgggagagggagcctccctgtggttgggacatacctccctccaccccaggcctctcatcctcagttaacaacccgcctgtgccatcaattacactgttttgtggttttttacacctttttttctagacacaggatctcactgtattgccaaggctggagtgtggtggcatgatcatagctcactgtagcctccaactcctgtgctcaagtgatcctcctgcctcagtgtcctgagcagctaggactataggcacatgccactgcacctggctagattttaacatttttctttttgtagagataggatcttgctttgttgcctagcccagtcttgaactcctgggctcaactgatgctcccacttcagcctcttaaagtgctgggattataggcttgagccaccatgggggctggcctcgcttcacattttatgtagttgctataaccccaccactcaccctgctccagcccatgtcaccttttctctttcctaaatgtactaagcttgtttcccaccccagggcctttgcatttgctgttcccgcagcaatctggagagctgttcagattttcctaggattaattcttcccagtctgccatcccatggcacttattactacctgagatgatgatatatattgactcttgtctgctttctctgctaaaatcctccctgtgaggaaacgagtttggcacatatcccctggcagcatctgacatggcataagtactcagggagtatatgtcgaatgaatgagcctcttggtgggctcttgtacttgcactgaattgtaattgcttgtttacacatcccacctccccactgggctgtgtgacttcctttgcatcataacttggggtgatttgtctttctgtccacagggccaggtgcatggttgcttttgggtctgtaagtatggaagctaggaatctttgagaaggcacatccttaaacccataagctcttctcatggaggtagctgtccaccacaaaatgtccttctgatgccattggtagaacaagtactggttggagcaggctgcagttgttcttacgttctgatggccatcctctactgtcccctcccccttttctttgtcaggtctttgccctgtgctgttctttggaccctgaacaaacccttctccccaccccgctaatcctgtcctttccttcagacctcatctcggtgtccctggctcatggaaaccctccctggccaacctgccttgatcagatgctggctcctgcaaagcttcctgagggcagtgctttatttgttttgctcttcatttgttcctcagagcacattgcacttggtcgacatttgttgaatgaatgagtaaagaattagtgatggcatatttacatacccatgttcatggcagcgtttttcactatagccaagaggtgaaagtaacccaagtgtctgttgacagatgagtggataaacaaaatatgtcatatacatacaatggaatattattcagccttagaaagggaggaacttctgacatacgccgccaccacgtagacgaaccttgaggacattatgctatgtgaagtaagccaatcacaggaagacaaatcttgtgtgagtccacttatatgatgtgtctaatgtagtcaaattcatagaatcacaaaacagaatggtggttgccaggagctgaggggagagggaaatggggagttgtttgataggcatgagtttcagttttgcaagatgaagagttcttgagttcagtatattctgaagtgtgaatatactactgtcttagtcaattcctactcctgtaactgggaagtttataaaaaacagaaatttatttgcccacagttttggctgggaagttgaagatcaaggcaacagcagatttggcatctggtgagggcagctctctccttccaagatggtgtcttgttgctgtatccttacatgacagaagaggtggaaagcaagggggtttagctcagtccctccagcccttttgtaagagcacaaatcccattcatgaggttggagccctcttaatcacctcctaaaagctcctccccttaacacttactgtattgggtcttaggttccagcacatgagttttggtgggacacatacattcaaaccttagcaggtgctacactgtataccctagaaaaatgagaggttaggagtgccgaccctcacacagtcaaaaatccatgtataacttttgactcccccaaaacttaactaatagcttgctgtttaccagaaaacttaccataacataaacagtcaatgaacgcattttatatgctatatgtattatatactgttttgtcacagtaaagtaagctagggaagagaaaatacatttattactcactaagtggaagtggatagtcctaaaggacttcatcctgattgtcttcatgttgagtaggctgaggaagatgacggtttggtcctgctgtgcccaggcggcagaggcggaagaggtggaggaggtgaaggggaggcaggggaggcaggcacactctgtataacttttattgaaaaaaacccatggataagtggaccagggcagttcaaaccttgctgttcaagggccaactgtacttagaaatggttaagataataaattttaggttatatattcttcagcacaattaaaaaaaagaattactgctgctagaaactatgacctctggaaatcactgtagaagaatctggaattcttaaattctaggacacctctgacttctgggtagtatgcatgaacttaagggaaagaagtatttatttcctcatgaggataagctcaggtgttttccttaggactgtcagagtgaaggagtgggctggcctgaaccctccccgagttgcctgggttctcaggctcctctgcacctggagctagtgagccagcccatgggctgaacctggctggtgtgtacagagcctgcacatgtctgcatagcctaggttgaggtttggacacttgcttagattccaaggtcctcctttgtacccatttatttatataataaataatttattattatttttttgagacggagttcactcttgttgcctaggctggagtgcaatggtgggatcttggctcactgcaggagaagtgattctcctgcctcagtctcctgggtagctggggttacaggcacccgccaacatgcccggattttttgtgtgtgtttttagtagagacgaggtttcaacatgttggccaggctggtcttgaactcctggcctcaggtgatcctcccacctcagcctcccaaagtgctgggattataggcatgagccacggtgcccagcctggattttttttttttttttttttttttgagacagggtctcgctctatggcccaggctggaatgcagtggcccgatctcaggtcactgcaacctccgcctcctgggctcaggtgatcctcctacctcagcctcccaagtatctgggactacaggtgtgcacaaccatgcccagctaatttttctatttttagtagagatggggtttcaccatgttggccaggctggtcttgaacttctggctcaagcgatctgcccatctcagcctcccaaagtgctaggattacaggcgtgagtgactgcgcctggcaaagtgtaggatttgaaacataaacttgtattcatttttgatctcatttaactgtcataacatgaagaactcaactcttagggaaggacacacatttcccagtgcctgtccagcaccagcacgagtgctttgtagagattgcctcatttcttgccgacattgcccttctgaagtgtagatggttttatcgccactgtataaagaagggtatagtgtatccaacgccccacagctaagtgacaggacaaggatctcactccagatcttgtgactttaaaaatcactttcttggctctgcttctccttgtttcctagatggtggccatctcatggtccagatttatatacatctcagcctcaaatcaaatggcacactttacatttgcacgctgtttggccaagcccattggcatataacatacactatggtagcaagaattggccagaggctccccaagaccagacttctgaattcctaaccccagctcccaagccccaggcatcccataaaatctttgctagatgttcagaaacctaaaatttgcttctccacccctcccttctccccaagtggtaaagacaaagaacagacggcagggctctttgttattcttttatctgctaagtttacaaaaaggttagacagtggaactttgctgagcaagcattctgtccctgagttgtctctgagcagcaccaaatgagtcttatcttccccttgttatctccaaggacgtaaaacattttcttttcatgctttttaatttctgtgtaacattagccattcagttgacctgaaacattgctagtttatttctagctggcgtgtgtgtgtgtgtatcagagggtctatactgtataaatacttctctaaatattcttttccataatgttgctctaaagtgtctcatttactcaattctgtcaacttagatgctgaatcattttatgtgcttaaaagaaatatctactcggatgctctagttccctggcaagggagagagagggagagaaagaaagctgttgaagtggtgcaaatccaaactgctttcttttttgctcataagtagtgcttttcaaagcgtttggcatccctgccatatggatgtgtcactgtgtgagatgacaacaggatttgctggaaatgtgggccactattgtatccgccttacgtaaccacatggagtgatggaaatgggtgagcagcccggaatgtaggcggtggcctggcccatgcatctccagagaccatgaagactgctcaagccctacataggatgtggatccaggctgttaaaaagttgaggagatggaaaggccgtgtgagtccctctgcaagctctccccttgttttccccaacctttcttcatgggaaggggagggaagcaaaaccattctcacagtgagtcctttatcctcagattgatttgtgcttctggcatctttcagcaacaaattgtgagattgtaggttgtagtcactggtgggtttttaaaaatacttgtattaattttagcagatctatgtgaaactgatagcctcttactggatctgtggatcaaaggctgctgttttccatgtgctaggaatctgtaatggttttgcttcctgggtagagcttaacatactggcttttgtgtttgttcatgtttgagaatttcttgttttgggataaaactttttgctttcttacactgcagaaatctatattcttattatgtctaggcttctaacttagaagaaaaagtgtttttcacatgttcttttttcctcttacagtttgaacatgtgtgagtgtttactttgatggcttgagacttttatgaagcatgtcccttacgtggacagcttgcgattaatctttggttttagctttgacctccatcactgggcagcagcagtctgtggatacagaatctaaaagccgcctgttcagggggactttgggcagtgaacacttcggtatctgttttggggttggcttttaacatgtttctacattctttatgtaaaatatataggatttttacctatctggccaagatttttcaaaggaaaaaagctttataaaaagattaaaaaaaaacacaataagtaactatttgccttagttcctttctcttcttttgtcacacaaaaaccttactgttaatgcattaagttttttgtttatggtagaaaagttagctcacttttaactttccatgaggtcttaagaatgacctgttagatataaagggggttgtcatgaacactacttacgtgaaaagtaaaagtgataaggaaagatgatgaaagcacattgaagatcctcctaatggatagaatgttgacacttggattaaaaaggtgacttggcgttttctgcatacacctccccccacaactccccagacctaacctgcgtccccactctgcccaccgcacctgccttgctttaccctctttgcccctttcaaattactggtaccatccttcaactcgccctccttccagttgaaattattatcccctcttcactttgcaaaattctaactgcattgaaaaatttgctgttaaatatactcgtacctcttgggtattagatccttcaccaggagtcagtattcattttggtgttcacccactcatctccctattttttatttatttatttatttatttaatttttttatttctttttgagacggagtcttgctctgttgcccaggctggagtgcagtggcgcgatttcggctcactgcaagctccacctcccgggttcgagccattctcctgcctcagcctcccgagtagctgggactacaggtgcctgccaccacacctggctaattttttgtatttttagtagagatggggtttaaccatgttagtcagtatggtcttgatctcctgacctcgtgatccacccgcctcggcctcccaaagtgctgggattacaggcgcgagccatcgcgcccggcctcatctccctattttttaaacttatgaaatgtttggtaccataaaagaattaaatatctaaatcatggagcataataattaaacaaatgccatgagcccattacacatatctgcagaccatcaccaagacaaaacacgaaggaaatttgtgtacctcccaccatactctgcctcctgcccaggtcacctcatcctgaatgttatgtttttcatttccttgctttttctttatatttccactgcatgcgtgcgtacacacacacacgcccctaaacaatagattaattttgttggcaattttttactatagtgaaaaacgcataccaaaatttactgtctgtaccatttgtaaatgtacagttcagtagtgttaagtatattcaagttgttgtaaaacattgttttttgagctatataaaaatggtatcacactctacaaatccttctggggtgtttttttgctcaactttatgtttgagatgcatcccttttgtggtggtctatgtgactggtttgttcgtcttcattgcagtaaaacattgtattttaataatgtatcaatttgtccatcctgcccttgagagatactgggatattttccaagttttggctgttgggaacattgctgctgtgaatactctatacatgtgtccttgtgcatttagtcacacggttctcccggtgcctctgcccaggtagaggaatcactgggtcgtggaatgtgcatacctttaattctgatatatgcgtgctctttctatgggcctgcctgtaaagctccccctggtgctaagcagctacctgctgtcattcagagagaggtcagatattgctagcaagtctgatctgcgcatagccaagcacaaggtggtgggtgggaccagagcccggtggcctagtttgaatgtcaggaccacagctctcagctaagctgctgcaccctggcagcctgtgcccagggatgttcctagagctgatgttctgaggaataaggatgattatgtggggtgctctgtgtttctgaaaaattatataaatgaggcaggaaagacactcagtagtttgctctttgggtacacttgtagttagttggtaagctgcccaagggctttggcgattttattcactgatgtctctgaagtgccacaaaccacttgcttggcagaaggtggatgcttaataaatgtttttgcataaatgaacaaatgagtgcacagtgaagagttttctgtgagaccttcccaaaaagtcacagttctgtaggctaaatatacatagttatggtgtatttttaatgttcaacagagctactaaaatttatttttgctctagttcccttcctttacaattaagattttctctttatcacttggcttagcagagcatatattctttgaatattatgttaagtagctaatagttaattttattacccgttaaccataggtaagaagaagcctcgcaatctgattggtttcaggcaccaggcaagttaatagcaaggtctgattggtggtggtagtggtaggagattaatcgtctctctgacaaatttaatttaaattacgcttgcaggcatcacaggacacttaaagatggtagcatcccattattgaagggctgtgaatttcaaaagccagattcattctacttgagccacatttaaaaaataaaattttgcaggaactcatttatttggctaaatgataaacaaatttaaatccaaaactttgaagagtttatagttttaaattccaaaatagaaatgtattttaaaagtaatgtactcataaaaatattctctataatagcacagctccttgggatattcaacatttttttggtatgtagcattgcccaatcctggggatgattgtcatagtcccagttagttttttttcctgataattttaaagtaagttttgtggggaggatgtcatgtaattttttttcccccttaattcatggggctataactatatccaaagaagagttggcaaatatatttattttaccacaacttctagattaattcactttgttgaaatttgacagctttaaggtacaagaaggcattgagaagatgagcttggagaagtgggcatgctcataaggtcatttctgggtggtagtggcttagttttactaaggccacatctaaaactgaagttggcaaggagttagtaaggtgttctatggaaatggaaaagggcaaccaattctgacttactgcaggagttcagttgagtgtctgctttctttttcttttctttctttattttttttgagacagagtctcactctggagtgcagtggcgcaatctcagctcattgcaacctccacctcccaggttcaagtgattctcttgcttcagcctcccaagtagctgggactacagatatgcgccaccacgcccggctaattttttgtgtttttggtagagatagggtttcaccatgttggccaggctggtcttgaactcctggccccaagtgatccacctgccttggcctcccaaagtgttgggattataggcgtgaaccatcacgcccgacccggtttctgctttctgtttccatttaagaaaactttttggccgggcgtagtggctcacacctgtaatcccagcgctttgggaggccgaggtgggcggatcatctaaggttgggagtttgagaccagcctgaccagcatggtgaaaccctgtctctactaaaaatacaaaaattagctgggtgtggtggcgcatgcctgtaatcccaactactcgggaggctgaggcaggagaatcgctagaacccaggaggcggaggttgcagtgagcccagatcgtgccattgcactccagcctgggctggagcaaaactccatctcaaaaaaaaaaaacaaaaaaactttttaacaaatatgtacaacttcattaaaatattggaaaatttattgtgcttccacatattggaaaatgctgttttagacacatgcagaattccagagaggtatggctatagagcacatctagaaagtcagaccatgagcacctgagtttttagttcacccacctcacgtatgctatcaaagaagcagagagccacgaatttgatacaaactttctttaagaaaatttgtaggctgggcacggtgtctcacacctgtaatcccggcattttgggaggctaaggcaggcggaccatttgaggtcaggagtttgagatgagcctggccaacatggtgaaaccgtgtctctaccaaaaatacaaaaaaatgagctgggtgtggtggcgcacaactgtaatcccagctactcgggaggctgaggtatgcgaatcacttgaacccaggaggcagaggttgcagtgaacctagatcacacccctgcattccagcctgggtgacagagtgagaccccgtccccccccccccccaaaaaaaaaaaaagtagcagcagtcagtgcttcagttatattaattgaatgatgaatgaatagtgtatccatctctagatgtattaaaaagaaaaaactttgagtgcctactctgtgtgccagacactgttgtagcagataatgggacaaagatgagtaggatacaaaaatttcacctgaaaattcacttttattttttaaaattgaagaacagtcgtcacagtgaacagactttaagtaattggggagttttacataatttagataataatcttttggaatgtttacatatttccttgtgttgatgggccttcatttaatctaaatcttgcacttttgggctgcttgcgtccctggcaccccaggccccattcaccacccagtcccaggattgctggtagcacagatctcttcttctggcctttttcaggtattttgagttctttttttttttttttttttttcttattaaatatacagatggggtctcactatgttgctcaggttggtcgtaaactcctgcactcaactgatcaccccgcctcagcctcctgagtagctgggactatggcatgtgccaccatgcctggctaactttaaaaattttttgtagagatggggtctcactatgttgcacaggctgcccttgaactcctaggctcaagcgatcctctcgcttcagcctgagtgctggaaatacagacgtgagccactgcacccagccctcttctaatttcttaaaacataaacacatagtccgggtggcttggtggctcatgcctgtaatcccagcactttgggaggccgaggcaggtggatcacaaggtcaggagtttgagaccagcctgatcaacatggtgaagccccatctctactaaaatacaaaaattagccgggcgtggtagtgcgcacctgtaatcctagctacccaggagactgagtcaggagaatcgcttgaacctgggaggcggaggttgcagtgagtgaagatcacgccactgtactccagcctgggcgacagaacgagactccgtctcaaacaaaacaaaacaaaacaaaaaaccaacatatacacatattatagatactccatttttgtctgtggctggtatttcaaatatttaaagtctttgattcttcagtttatgtttcttttacctctcactcatggtgatgtgcatgtttaaattgtgggctcatttccttggatacatactatctggggaatctttgagggctgtgtttgagtgtgatctctggagaggattcgcatctgcctctgtgtacttggtggtatggccagtgcagagccccagtaggcatgagtgtttggcagggtgtggtcacgtctgtaatatgaacgcccaaacctgtgtgaatacaggtctgttgatagaaattctccagggttttatttttagttatttccactctacccatagccaaggatgagacagtcactgcatctccatctgtgtgctggtatttttttcccctaatagatccacccagacctgatctcccaccctgtttggatccccagcctcctctaaatgcctgcttcagtgctggcttatctctgtggttctgagtgttcttggcatttctagctttctcacaggcagcctgcatttaatggattattatttttaaaatgataccaccagttgtagttttttctggatacctactttggaatattgtcagagatggaagtcccagtggtctatttatgaagacattcatctttcatactcagtgatacagatggagaaaaagccgaaagatcccgcagatcacccaattgggcataccctatgataaggctaaggatatttttagacataaacatgcagaaaacttgcctacgaggtcacctttgacaggaagagggggagaatgattttaaaaaaagaatctatttgaaactagatatttttaaaggggttttatgatgataatgttttggaatagtgataataaaaggactcagcacttaacattccattctttttagggtctgtctctcactatgtatttcacttacctttcaagtattgtttctagtttcatttcattgaaggagagtgtgtttgaaaataggtagcataatgaacagatattaactcttttttggtatagaaagtgtgagctggactttatgtcgaggcattttgaatgataattttatttctagcattgaaaaggttgtggttttcatcagattggttttgttcttttaaaacaggccccaggcatggaagagctgatatgggaacagtacactgtgaccctacaaaaggtgagttctgcacatttcatatattctacagtcatgttcttgattttacggatcatggatcttatttattttcacctacacacagttttggctttttttttcccttgaggtacataatgtattatagatactaactggcaataattgctatgttaacaaagatttgcatgctattgtattttttgattaaggactgtttagtatggaacattttagaggttatttagtgtatactcttatctccagctagaacaggttatgaaagagagaaaagaaagggaagaatgaaaatgacctgtactgtttaaggatgtggagggagctttttacaacttctgtaattttaattatgacatattatacataccttataactcttaaaaagtgtagcatccaagagactgtaagtcatttgtgtgaggctgagctggagaactgcactcgtggttctgcatttttttttttttttttttttttttgagacggaattgcactcttgtcgcccaggctggagtacggtggtgcaatttcggctcagcgcaacctccgcctcccgggttcaagcaattttcctgcctcagcctcccaagtagctgggattacaggcgcctatcaccacgcccggctaattttgtatttttaatagagacggggtttctccatgttggtcaggctggtctcgaactcctgacctcaggtgatccacccaccttggcccgcaaagtgctgggttgcaggcgtgagccaccgtgcccagacggttccgcatttttattccgtcaagctgccttccggtcatcatcactgtgattttcctggtttttctgcagggtttcttcttctggctctgaattcctccaaggtctgacatctcctagagggaccataagttcctcataggaagagttttcctttgaccctcagaactgtgagcttcaagctttgtcttctatgaaaattaaagacattcccgaatttaatgtttgttgaattaatccaggtagaaaaaaatgtctctgggccagtgcccaggtacccagacttccagatcagtaatcacaatttcctcatttgaggggttttgtctgcttaggtcttatttttcaactttcctcgtctttctgactctcctctgccctttccctgagcatttcatgcattccttgagttgtggacccaaaattggcagaggtcagagatttttttaggcttggcatagaggatggagctgcctctgtctaaaaccaggtgccggctggtggtgctgccaaattcaaagccatgtgattaatagacaacacccccaacctgttttgagtttgtaattgtgtataatcagtcagcatagtgggcctcacgtgggaaactttccttggaaaggaagattttcttttagtctcggagtaaatttttatataatcgaacccagatttaagaatatacagtcaaatatactcatattatctggatgaaactgggcttagatacatatatatatttttgaaatggagtctcattcagttgcccaggctggagtgtaattgcatgatctcagctcactgcaaccttcacctcctaggttcaagtgattttcctgctccagcctcctaagtagctgggattacaggggtgtgccaccacacctggctaatttttgtatttttagtagagatggggttttgccatgttggccaggctgatctcgaactcctggactcaagcaattcacccgccttggcctcccgaagtgctgggattacaggtgtgagccaccgcacctggcccagacttagctttttaaaacacaaatgaattaggattatgtattatctatgctcaccattgtgcattgctagactgatcatggatgtaataaatcttatttccgatcttccatgcatgaagaaaagggtttagtgctttgcttttcatgagatctcaacacatattttacgttcaaattttatctttaaaatccagttacgggccgggcgcagtagctcacgcctgtaatccccacactttgggaggcagagacaggtggatcacaaggtcaggagatcgagaccatcctggccaacatggtgaaaccctccctgtctctctactaaaaatacaaaaattagctgggtgtggtggcacatgcctgtagtcccagctactcaggaggctgaggcaggagaatcacttgaacctaggaggcaggggttgcagtgagccagcaccactgcactccagcctggcaacagagcaagactccatctcaaaaaaaaaaaaaacaaacaaatccatttacttctttttcactgtatgttgaaatgaaactaccaacacatctactttgaagttaaaggtatactttaaaaatataattttaggcagacataagaaagaacgaaatatgtcctttgcagcaacacgaatgtacctggaggccattatcctaagcaaattaatgctgaaacagaaaaccaaatactgcatgttctcacttagaagtgggagctaaacattgggtacacacagacacaaggacaggaacagtaaacactgggaattccaaaagtacggagggagggagaggagcaaagtttgaaaaactacttcttgggtactgtgttcggtacttgagtgacaggatcattagaagcccaaacctcagcatcagacaatacacatatataacaaacctgcacatgtactcctgaatctaaaataaaaataaaattaaaaaggattggctagcactgggaagagcagtcttttcccgcccagctagaaagttgtggttttttttttttgttttttagagacttctccatttgcccaatttaaagtgcaaaagctgccttggcttgttgaagccttgacctcacaggctcaggtgattctcccacctcagcctcccaagtatctgggactatggatgtgcaccaccatgaccagctatttttttctatttctagtaaagacagggttttgccatgttgtccaggctggtcttgagctgctggactcaagcaatctgcctgcattggcctcccaaagtgctgggattatagacatgagccatgagcctaggcagaaggtttttttttttttaatatgtcaaaacatcacaatatacagaagaattaaaaatatttacagtacaggccaggcacaatggctgtctgttgtaatcccagtgctttgggaggttgagacaggaggctcatttgagcccagaaatttgaggctgtagtgagtagtgatcacaccgctgcactccagcctagcaacagatcaaaactctgtctcttaaaaaacaaatacaataaggaaatctgaaaattaaaaaatacagttttagtacaggttcagtttttactgaagttgttccagctcgggccagcatgatgcaaagaggtacaactggtgcttcaaacagtacgtccctatttggactgaagacattgtttcctatcccggccagcttctagtgataactccagtctgcactatcaatcttttccagcctctacaggctgtttctttcagataaggaatttccctttataaacctgtcagctgacaatgactatgctttgttttgtttctcatttgtttctgtaagcccatctgttcctgaacagtctctggttattgatttgacctttattttattgagtgcttgtaataaatcctgaaagccacttattgaaggatttttaatatttctcctctctgatgtacaggattccaaaagaggatttggaattgcagtgtccggaggcagagacaacccccactttgaaaatggagaaacgtcaattgtcatttctgatgtgctcccgggtgggcctgctgatgggctgctccagtgagtgtcctccctcgctccgcagcccctaccagccctactggttggccctagacggggtattttggttggtgtccactttatttaaaaaaaagaaaaaaataacaaacttttatataatatttgaaaagtcttcaagctggaatggaagccataacacaccatgtttgaataatgcccaaaccttgggaacaccccagctttggagcgaggagggcagttgtttccgtaagaagatagttccaaacatccctcctaggtttaggaatcatttctgaacatggagttttaaattggcatgcttctcaaccccgatgcttaaccaacactgtttatgtttgttttaatttatattctttaagaatttaatgaggagactttggtttattgattatcttatttgtaagagtgatgtggaagttgggacaatttactataggaaaaccacaagttttccaactgccagctttctgacctgaagaagtaacaccattttattttaatttttaataaattttttcttttctttttttttttttttttcagacagagtcttgctctgtcacccagtctggattgcagtggtgcgatctcagctcactgcaaccatcaccttccgagttcaagcaattctcttctgcctcagccacctgagtagctgggattacaggtgcctgccaccactcccagctaatttttgtatttttagtagagacgggttttcgccatgttggctaggctggtgtcaaactcctgacctgaagtgatctgcccacctcggcctcccaaagtgctgggattacaggcatgagccaccatacccagctggtaacaccattttacatgatacatgcctgattcccacaggataacttctcaggacgaagtctaaagttaactgtatggctgcattggataaatagctcaaaagtttaggttttgttggtgtttaaagcctctgtgaactaagcacagtggctcacgcctataatcctgcactttgggaggctgaggtggcaggaacgcttgaggccaggtgttcaagatcagcctgggcaacctagtgagaccctgttgggatggcatgtacctactcgggtcccagctacttgggaggctaaggtgagagaatcctttgagctcgggaagttgaggttgcggtgagctatcatcagtcacactactgcagtccttcctgggtgagagagggaaaccatgcctcttaaaaaataaaattatagttaagaaagtctctatagttttatcaaagttagtagtctttcatatggagaaatgcaaaattttaaagtaatatttgggatgaactggaacaataggattctgtgatctcaaaatttcttaagaatccaaggcaagcccttttcctgcacaaaagcacaaatggatatacacctacttggaaggagtgtttttagacttttctgaagcccaccgtgcacctcaggcaataggggactgatagagaaattccttttgtgtccagacctcaccgtcatcaagtacctcctggtgtgatgctgtggtttggggagatcaggcctctctcttcccagatgatttccatttagacactcagaattgagctgtatggcccccagttcctttctttggaagatctcaggccaagttgactgggccttgggcgccactagacactgagccctttagaaagcctttcaggtctatttgctgcttctatttgttcctaaataaataatttacaatgaatagatgggagtttttcatgacccatttttatttcttgtttacagagaaaatgacagagtggtcatggtcaatggcacccccatggaggatgtgcttcattcgtttgcagttcagcagctcagaaaaagtgggaaggtcgctgctattgtaagtactgggtttgctttcagcttgccttaatagcattttggttttttgcccagaagaaaattaccccttgcttttaagcatttgacagaattacataacctagggaccgctgttcttggatcctcagtacttttggaggggtgtgaagatatgtgtaagttatcttcctacttttccttgtgtcttctcctgaggccagtgattctctgatctgagttagtttgccttaggaaccaagttaggcaattattccctaagagaattagctagattcagaatactggtaaaatagtattaatttagaaaaaaactttcagctcaaaaactcacttgtaaaggcccaagcaaggtatattatatcttcatagactaagagtttcattagaagactgtctataatcttcattcatctattccttcattcattcactggctgagaatcaactgtgagctggatgccattaggccctggggccaatctgtgttgcaagatgtgttcactccagtggggcaggtagacacacacagtgagaatggtaataaagtgtgcttaggggcaatgctagtaggcatatacccacatatatggttgtgtgtgtgtgtgtgtattttttttttttttttgagacagagttttgctcttgttgcccaggctggagtgcaatggcacgatcttggctgaccacaatctccgcctcctgggttcaagcgattctcctgcctcagcctcccgagtagctgggattacaggcatgcaccaccacacctgtctaattttgtatttttagtagagacggggtttcaccatgttggtcaggctggtcccgaactcccaacttcaggtgatccgccagccttggcctcccaaagtgctgggattacaggcgtgagccacctcacccggccacatatatggtatttaatgtttttcaactttatattatgaagattttcaaagaaaaaggaaagttgaaagatcagtgtaataaacatttatcttctaaaatattactattctgccatctttacttggtctctgtatgtatataaacactcatgtctttctgggcaaccatgcgaaggaaagttacagacatgacagttcatttctacttacttcacatgcatttcctatgaatgaggacattcatctatataatactattatccgatctaagaaaagtaataattttacagtattatctaaaatccagtccatatctcaagatgtctttttcatttttagagatgggatcttgttgtgtttcccaggctgatcttgatctcctgggttcaagcgatccttccacctcagcctcccaaggtgctgggattacaggtgtgagccaccatacgcagctctcaaaatgtctttgatatatgttttcttccctatccaggatccaaagttcactcattgcatttaatcattatctctttagttccttttaatctagaagggttcctctttccccttgcccctctaccccaccccccactttaaaaatggcattgggccaggttcagtggttcacgccagcactttgggagatggaggcaggcagatcacctgaggtcaggagttcgagaccagcctggccaacatggtgaaaccccgtctctactaaaaatacaaaaattagccaggcatggtggtgtgcgcctgtaatcccagctatcgggagggtgaggcacgagaatcgcttgaacctgggaggcggaggttgcagtgagctgagtacagtccagcctgggcaacagagcgagactttgtcttaataataaattaaataaataaataaataaggcattgacttttcttccttaaaattttaaaaatttatgcataatgcatagttatagggtatgtgtgattaatttaatacattaatatgatttgtaaaattcagatgagattgggcacgttcaggatggtatggctgtagacatgatttgtaaaattcaaatcagtgtatttggaatatccatcaccttaaataattgtcttttctttatggtagaaacgttcagattattttcttccagctattttggaatgtacagtagattcctgtaagctgtagtcaccctaccgatctaacattaggtcttatttcttctatcagaccatatatttgtacccatcaatcaacttctctttatccgcctttgcccccttggcagctatgtatagaatgtcacactttctggatttttgttttttgagttttataacttagtgatttgggcctctgagacttttcaaacttgagtagaagcagattttggagatactattttattattaccttaattcaaggccctgtactcagagcttcacggtcattgtcctattctaaccctgtgagatttttattgtccgtttccggatgaggaacctgaaccttagtgagtcggcagggatacggttttcctgaaaccagaaccagggctcttaaccactgccttctccacattcagttgtgattgtcctgcgtccacactgagtttgttttgacaacaggtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccgctctcggggaccccgaagccgcagccgcgagcacccgcactcacggagccccagccccgagcctagggggcggccggggcccatcggggtcctcctgatgaaaagcagagcgaacgaaggtaggcatgcttgatgtgggaagaaaagcactgttgtgatatgaataacctttgttttcttaatttttttttttcccccgaaagtgttgctctgtcatccaggctggagggaagtggcgtgatctcggctcactgcaacctccacctcccgggttcaagtgattctcctgcctcagcctcctgagtagctgggtctacaggcacccgccaccacgcccagctaattttatgtttttagtggagacaggtttcaacatgttggccaggctggacttgaactcctgacttgaggtgatccgtccacctgaatctctcacagtgctgggattacaggcatgagccaccacgcctggccaggaatagctactttttttttttttttttttgagacggagtcttgagtcttgttctgttgcccaggctggagtgcagtggcgtaatctgggctcactgcaacctccgcctcccaggttcaagcagttttcctgcctcagcctccctagtagctgggatcacaggcgtgcaccaccatgcctggctgatttttttatttttagtagagacggggtttcaccgtgttggccaggctggtcttgaacttctgacctcaggtgatctgcccactgcagcctcccaaagtgctgggattataggcatgagccactgcacctggccagctaacttttttttttttttgagacagagtctcactgtgtcaccctggctggagagtgcagtggcatgatctcggctcactgcaacctctgcctcctgggttcaagtgattctcctgcctcagtctccgaagtaggtgggattataggtgcctgccaccacgcccggctaatttttgtattttcagtagagacaggttggccaggctggtctcaaactcctgacctcaggtgatctgcccaccttggcctcccaaagtgctgggattacaggtgtgagccaccgcatctggccgagctatctcttaattgcacttaaccagcattgtacccagcattgacctaaatgcctaacaccaattcgttcgtttaatcctcagaactacctcatgagggaggactcttgtttctccattttatagacaaggaaactgaggcacaaaaggttcattgatatacacaaagttgtgtcatcattggaagagccaggcttcagaattttggctttaaactaggagaccagtggttctcaaagcagtgcatcacctgggcaccccttagaaatgcagactctcaggcccaacccagtcccaccagctcagaaaccatggggtggagccgggtgcagtggctcacacctgtaatcccagcactatgggaggccgaggtgggcggatgacttgaggtcaggagttggagaccagcctggccaacatgatgaaaccccatctctactaaaaatgcaaaaattaggtgggcgtggtggtgggtgcctgtaatccccacttctctggaggctgaggcaggagaatagcttgaaccccaaggggcagaggttgcagtagcagagatcatgtcactgcactccagcctgggtgacagagcgagactctgtcttgaaaaaaaaaaaaaaaaaaaaaagaaaccatggggtgggccctcagagtctctatgttaataagctctcctagtggccttgctgcatctcaagtggaaaaccacagtggaggacagtactccgcctaatcattgttgagtttctgctctatgcaagggctatgttgaatattcttttacgtagtcctcacaagaaccttgtgtgttaggaggcttcgtttctgttttgttttgttttgttttgttttgttttgttttgagacggagtctcgctctttcgcccagggtggagtgcagtggcgcgatctcggctcactgcaggctccatctcccgggttcacaccattctcctgcctcagcctcccaagtagctgggactgtaggcgcccgccaccacacccggctaattttttgtgttttaagtagagacggggtttcaccgtgttagccaggatggtctcgatctcctgacctcatgatccgcccacctcagcctcccgaagtgctgggattacaggcgtgagcccccatgcttggccaatgagtgcattttttaagaggattgaggaattgttgaaaaatgccagagagatgttatcactcaagcttgtctcactcagccttctgttctgggctgtgaggctgtttgaccactaggggctcgccatccatgaaagtagctttgcccttcccttattccattcttgactatcagcttcctaaaggactagggcatgggccacaacacttctaatctttgtggtaagatctggctgacaagtttaccgtaaatcatttaaaacttattttaaaattgacttcatacctttcctgaattgtggaaagttactttgttttgtaattataagatttttagtttgaacaataataaaaaattttgtgcctgttttaaaacctgctctgttgtggtagtttcctaaaatgtgaacagttattcttaaaataatgtatttttacaagtttattaagtaaaaccagaagagtcttaagtagcattgaaagtatttaaaaatatgcataacttagtaattacaatgtttttgtttttgatagcaattcagagtccataaactcccaaagctatgctggttttagttgaatgctttattaattactttgcctgacttctttaccccttttcttcacccactgaattcctttcaatgccaagcttcatataatctaaaatgctagattttttgcagtgccttcctgtagacagcctcattgtcagcagaacatgcctattaaggtgtgctgaattgtttttttttctccccaacattttatttgaaaagtgttaatttggccaggcgcagtggctcacacctgtaatcctagcactttgggaggccgaggcgggtggatcacctgaggtcaggagttcgagactagcctggcctacatggtgaaaccctgtctctactaaaatacaacaattagctgggcatggtggtgggcacctgtaatcccagctacttgagaggctgaggcaggagaatcacttgaacctgggaggcagaggttgcagtgagctgagatcatgcccctgcactccagcctgggtgacaaagcaagattctgtctcaaaaaaagaaagaaaaagaaaatgttaattttatagcaaataaacatataaccttcatctagttttaccagttgttaacattttgccacactttctttttcctcctcctttttttttctttccttctactccatcacccttcctgttacctctctcagtgggttttttggtactatttaagtaagttgcaggcaactcaccattacccataaatatttcagaggtatcttccaaagataagaacattctcctacatcagtcaccgtaataccattataacacttaagaagattaacattaatatccctttcatatattatagttcattttcagattgctccaaatgatgtaactcattcttcccccaccctccactggatcagggacctatggtagttcatgcattgcatttggtttttatgtaacttttaatctggaacagtttctctaccttttttgttttttatggcattgacttttttgaagagttcaggccagtcatcttacagaatttcccatatacaaaattaactttttaatacatattttaaaatagtcctataaaccagactaagttttttgaacaaattgataacatacgtgtatgtttatgtgtttgtctcctagagtatggtctccggcttgggagtcagatcttcgtaaaggaaatgacccgaacgggtctggcaactaaagatggcaaccttcacgaaggagacataattctcaaggtgggtagatgggggcagagaacggtagtgtgcatactgccgttcatcgcctgcatgtccacattcagcacccacacagtgagacttagatccagtgagagtcagtggtaagacagaggtggcaagagcagcataatgagacgatttttatcagaaaaaccagacattgagggtcgtaacagtttaatgtcagtttagaaaacaaaaacaaaaaaactccatgaatattttcttctttcctgtttaaagtttagatccctattccctaaactaaggaaagatgagaaggaaagttggtgatatatgaatgctgaatatttaataggtcttgtaaacctctccagtcaggaaacacgttccagtagtaaaccaaaccgttgtcttgagcttggaagttaaataaattagcagagtaacttacacctgtatttgggatccaggcatgcaggattatatttaatttaaacgacaattcatttttattgagtcatcctaaagccaatatctgtttgaatatctgagcaaagcctttacatttttagaaggggaaaatatgaattttctactgtgaataattttattgcatttaacattaccattttttataaacacagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaaggtaaaggaagaggaggctgtgagcttagctggaagtaaggaaggctgttgcttccccattcttctatttagtgtagctatccagctggaagttaaatttctaaggaaagaccccttgaaaccttaatctccaaaggtcactggttggttgttatttgcttattaaagtgcctattgaaattaggtttccaatacaaaattctggtgcatttgcgaactctcagagaactattaattaggcaattgaaagcaaaacttgtcagtaaaaaaatgtgtgtttgagtggttcaaagaactaaccatatcatttatatatttgctaattgcttattgtttttttttgagacagagtttccctctgttgcccaagctggagtgcagtggtacaatcttggctcactgcaacctctgcctcccaggttcaagtgatccttctgcctcagcctcctgagtagctgggattatgggcgcctgccaccacacctggctaatttttgtatttttagtagagacggggtttcaccatgttggccaggctggtcttgaactcctgacctcgtgatctgcccgtcttgtcctcccaaagtgctgggattacaggcgtgagccaccaggcccagccttaattgctcattctttaaaagtggctattaatatctctaatagagaagacaatttggaggatagctaaaacaagtagatgctcaaaaagaatcaaaatggctaatattgtggcattcattaattagcagtctgcatcacctcttcccttttaaagagctatattcattatttgaatatgaattatacataggataacattttaaccttgtaaaaattgccaataaaaatagttaatcacagtatattctactgaaccatctactgttgcttttatgcagagaagtttagaaaatattaagttacgaagttgtaaagcagacttttgttgatttttttttttaaaggaatttctttgtaaaaccttaaaacttaattcactttccagtgtatcagaagttgttgatgactgttacgggtgcagtgcaggaaaacaaaaggagcatgagaaataatgccagcatgttagggggtttgcagtttatttccttgctactcagtatgtggtcctcatcccccaacccctgaccccaatagcatctgcataatcaggtaactggatagaattgcagaatctcagtctcccctcaactgccccacaacaactgcatcctaacaagatttgtatgcaccttaaagtttgagaagcattgggctgcttgggaagaattagtgtatacatctatgatccaataatagaattttgactcttctgtagcagctttgatggaaaatgagacaaaagagaaatacacaattctaaatttgccttcccctttattaattaatgcctttcccttaaaacgagcaagtttttctccaggggaggactattagactaatagcacatttcctgcctacctcgtttccatttcccgtgtttcctacccagagaatagtgcaatttctctgggtaggagaatattttaaatattttatttaaaagtcttttcttatttttgaaactagatatttcagaaatagagtcaaaccgatcattttctccagaggagagacgtcatcagtattctgattatgattatcattcctcaagtgagaagctgaaggaaaggccaaggtaagatgacatgaatattctcttgtacatgtcattgtgaatgtacacacatatgtatttatgaaactgttatctcttgagacatttacgtatgacatgtgattcagttccagagaggacacgccgagcagattgtccaggatgggtgcgacacccactccctttaagtccacaggggatattgcaggcacagttgtcccagagaccaacaaggaacccagataccaagaggaccccccaggtgagccattaagaccactcagtttcaacagttgtgttcagaagtgtgtgctcacacagccataacaaagagtgaaatcatgtcctttgcagccacgtggatgcagctggaggccattatcctaagctaattaacatggtaacagaaaaccacacagcacatgttctgacttttaagtgggagctaaacattgggtacaaatggacatagaggtggcagtaacagaaactggggacaactagaggggaaactactaaaggaggagatggaaagggttgaaaaactattaggtatcatgctcacaccttggtgacaggatcagttgtaccccaaacctcagcatcatgcagtatatgcatgtaacagacttggacgtgcacccactgaacctaaaataaaagttgaaattatacacatatatgtaaatacatagatatgtatacatatatgtatgcatgtgtgtatatatgtatacagatatgtatgtacatgtatatgtgtatgtatagataagtgtgtacttaattccagagggtggctgaaagggaagaaggaaataaaaaattatatatggaagaggccttcctttctctcttttgacgttgacaaaatataaaataatagccttgtctaaatgccattagaattggtcacactttgtcatatttgatgagttgaggtcattgttttctcccatccttgatcctgacctcttcccccaacccttccccaccaccctacaattatcatcataattttatattcataaatatttaaggggaaacagtatcattattgtatgttttttaagttgttaaaaattctatgttcttgtgcatgtgattgtacaccttgcattttagaggttcattttttatctcttgtattttgagaaaccattggcacctgctaatacttcagagttaaacggcactttagagacttctttttgtttgtggtgacatatgtggcatagacttacattttttgtggattttgtgatttttctatttagaaacgcactcttgttagtccagattgataacagtagatgtttcttaacctacagctcctcaaccaaaagcagccccgagaacttttcttcgtcctagtcctgaagatgaagcaatatatgggtatgtatttccgtctctctttgttttcccttcttccttacagctctgtctctgtaactgaaatccagaagagtggtggtttttgcctagatggtgattttgtacactgtcagccacctgtaaccaatccccattggtagtgcttatgagaaagaggaatgatttgtgggaacagcaaaatgcggaagtgggtgaactttgtgatgttaatgttgtctgtttacctacctatctagctacctttccagagtgttactctgaatatttgcgtttgtcagataaattcactcccaaataggtgaagtatttattgctaaactacggtgccctgtggtgactgcactgatgtgatggtcccagtgtcagtccgtgtgggggagggaggaggagtgctgctgcgctctgcacttgataatcagaacccctagttcagcagggttcaagggcagcagcctcctggattaggattctgcttctttgtacccagactgtgtctttatttgacaagaatgcagtgcaagcgggccttcctttggaagaattttagccctaactctgccctttatttgctttctcatcttgaaagagttgctgtaaagattctataattctatgtcttcaccagtaaccagggacctactgatactcatctcatggtcccaagaaagataaaattgtaggatatatgagatagatgagaaaaatgagagggctttgtaaactataaatcactctgtagctagaagaaattaaatctctcatttgctaatgttgttctcccttttaaaaaatatctcccatctttcctttctgaaacggaacctattgcagccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtaagaacagcccagctctgtttctagaagttacttgtaaggagtgcacttttctgggtgttctttctgtaagggaagacaaaatggttcagctggtgaaatagagcagctgcaagtttgttgatgcccagcattgaagtctctgtattcctcaaatgcgtcctgtcttctcagtcttggaacccagaactcatccatgtatctgtgagaactgatagtgtttctgcccttgccaagattttattagtctgattaatgtgaaaatattgagactctaagtaagcacttacaggaaagatttttcaaaaagatttttctgatttttgcttttttcactgtgttccccctgcctgccatctttcttaaggcagtgtcctgaaattgaacaaaggtgagtggttggcatcagactgggtgattggaatttcgtcccagcctctgattagttctgtgaccctggttcaccctgagactcaggtttctgtatctgtttaatggggatgagaatacctgcctcgcagggactgtgggaagattagaccaggtaacacttacaaggcacctagcagagttccctggcacagaataggaaggtgagtgtccattcttttttcttattggaagataacaaatagctgctactcaatgttatttacatctaaaattgtccaagaaagggaattcctggttaatcaaatattgatacttttaaaattactatgtgtttgtataatctgttaaggaattaaaaaataactcaacttgacatttgtgtatgtgtgtgtgtgtgtgtagcattctttgttgacttcggaataaatttcaagaacatcaagtatctccttacaataaaaatatagagtactagggaactgttttttttgtttttttttgtttttgacagtctcgctctgtcacccaggctggagtgcagtggtgctatctcagatcaccgcaacctccgcctcctgggttcaagcaattcttagtcctcagcctccccagtagctgggattacaggtgaactcttaatttttgtctttttagtagagacagggtttcatcatgttgcccaggctggtctcgagctcctgagctcaagcagtccacatgccttggcctcccaaagtgctgggattacaggcgtgagccactgcgcccggctgggaactgtcttcattggaatttcttcctgcttctgcaaacttgcagttcatatatatgaggttttttttttcttgttaatgttagtaaaaaatccatatgtagtaaactaaggggtctggtaggggcttctaggctccaaggagaggggagaaaaaagttctagaattctcaaggaagcaagcagcagcaaagtacaaaagcaggtggcccccttccttcttggccccgttgcagtatttcagatttcatttctggagcagatgaagggcaaaccttgatcatgagctttgcaaaagcttttcagtgaaattctagaccctccttggccctggtcaggatctagaagactatgtacctgcacgaacctcatgttgccttatgatcctaggaaataccactcaccaaatgttactgatgaaaacccatctgagtgccagctcataccagtttactctttgcatatatgctgatgaaggaaaaaggcattttttctaactattgtgaggccataggatgatagctagaaatgtggagcttttgctcattaaggttcaatgataaaatattttcgtatgttcaggggctgggagattttctaaatttccgtgaagaaaagtagtgaattcacctagaggcttggcagtcagacctctctgtaagttgttgttagatggggagagtcgctttggtggataaaaagtcatggtatcagcatttatacttaaggtgttttgtttcttgttatcaccctggcaacacggaaggaactctgggaactggcttcttttgctgtcatcccatatggaggtcaggcaataggtggtcctcatttcttgggtgcgaataaattttctgttgactacaaaagaagctttccgttctagaaaggggtgaaaaagattgagtttgcctacgagggcggagaagctgctgcacaatactaagctgtggctgatacaggatcctcttcaggctcacagcagacacggctagaccctgtagactactaaatagctaatcaaagaggatatttattggaaaggactgttcaatgtaaccttcaagtagaaaagtgctgccctagccttttttcactttaatttgtttcaatgctccttttcatggccaaattgaatatataaagtgagccttatacacatgctaatcactttattctgttgtggggtttttaagtgtggctctttgttttgcaaaggtgacagcctaatgtgtggaatgaagacgtgagccagatatgtatattccttatcaataatggagatatatgtgcttttgctcattcctgcttggctgaactacctctttgcttgttatttatctgatagagttgtcatttctctttcagaaacttttatgggatggaaaagagaaaaaagacttctaagtttggttattaaccatgtagatttttaaaatataactaccatgtgtgctttaattttgaccattatagtttttggctatcgaagactgtgatcgagactgatctaaggttaatctcttgtggccagagagatggactgaaggactcccaaggtcctcccacagccttgtggccctgtcttatttaagtaaacaaatacaagcatgtatagtacatgtgaaaatatacatatggctatatgtagatacagatgtagataaacaaatggcacaagaaaggataccaaaatgggatgattcctaattgggggacagagaggtacaaatgacagtaccttaaatactaaatactgtttcaaaggaaaaattaactcaattgctttagcacatcactttattttaaaagcaccaaattagttttagtctaatgccgactttcacttaatcataaattttggccttaattaaggcccacccaactaaggataagtttcttctttaataaagcattactcttgtgattaaaaggattctgtaattgtcaatgactgaagaaaatatttcataggaattttatatctttatttctacaaaatattattaacatatcaggtactttaatatggtttttgcattttacttatttataattctgttttaaaataggctgaaagatacagaactatgggccaggcgtggtggctcacgcatgtaatcccagcactttgggaggcctaggtgggcggatcacctgaggtcaagagttcgagaccagcctggccaacatggtgaaaccttgtctctactgaaaatacaaaaaaaattagctgggtgtggtggcacatgcctgtagtcgcagctactcagggaggctgaggcaaaagaattgcttgaacccaggaggcggaggttgcagtgagccaagatcgcgccattgcactccagcctgggcgacagagggagactacatctcaaaaaaaaaaaccacatagcactatgatttcaaaatgtcttgttctttgtgctacatttcaattttacttgctttgtaactgtaaggctgatgctctttaatttgatacatacctttcaattttataaacacatgttaaacacttttaggtgatagaagctataggagaagggtagaattggtcagagtctttatttgcacacttttatttgaaccagtttaaaattagtgtaaatgctgggccagcatgctcagttgtcacagaccccaacactccccatgcttcatacttgtgtattaccttcttggccacctctgtgagagactcacagaagggagatggatagaaacaaccacaagaaattctattgtgatctggtgacagatccttgcttcaatggcttaacctctaaggtgcggttggcagtatggggaggcaggaaggtatagtgtgcaggcccatagcaaggtgctgggcgcgaggacttgaatagtgacattaaggactcatttgcatcttggctttgctctggacaggccctgatgaaaacaaacaaaagggtcagtggcatcttactataaacttctctgttttttctttctttctttctttctttctttcttttttttttttttctttttctgtttttccttcctaataggtgaacacacaggatttcagaggattagtgcgggaggatgccgttctctacctgttagaaatccctaaaggtgaaatggtgaccattttagctcagagccgagccgatggtgagcaaatttggtcatttagtttagttggggtgggggtggggagtgggaaggatgagagaggtgtcttggtaccagaataggcaaatctgggtattaaaaaattgagatggatctcaacacctagtccttgggccctaggtgtgtgaagaaaatgtgagtgccgtttaactttccataaaaatgttttctatgcatgcactgaaataattttactagttgtgtcaatttggaataaaactgccttcctgaacagtgatgcagccttatgttctgcctggagttattagtgagtttacatacgacatgtgcaaaggccatggctgctggctggtgcgcctgttacccctgtccagtctgacaagttgtttcacctttccaggccttgttcccatctgttaagtgggtgttgagagtgtcctccttgtctgcttcagagcttgattggcaactgtgttaatgttctccagagaaacagaatgataggagatattggaatcaataggaaagaaagagatttattataaagaattggctcacataattatggagactggcaagtgccaagatctgcagtgaaaatgggcaagatagagactcaggagagccagtgatttagttctagtctcagtctgaaggcctgagaaccaggagagccaatggtgtagttccagtaccaagtcagggaaaagagctgatgtcgccttttgaaggccatcaggcaggaagagtagtttcctcctaattttttatttatttatttatttatttatttatttattattatttttttgagacggagtctggctttgtcgctgaggctggagtgcagtggagcaatcttggctcactgcaagctctgcctcccaggttcaccccattctcctgcctcagcctcccgagtagctgggactacaggcgcccaccaccacgcccggctaattttttgtatttttagtagagacggggtttcactgtgttagccaggatggtctcgatctcctgaccttgtgatccacccaccttggcctcccaaagtgctgggattataggcatgagccaccacgcccagcctagtttcctcttaattgagaaggggtctgattgtcattctcttcaggccctcaactgattggatgaggcccactcgcattggggagggcgatcttctttgctcagtctacccatttatacgtgactgtcattcaaaaacaccctcagagaaaggcatagaataaagtctgaccaaatacctggttatttcatggcccagtcaagttgaaataaaattaaccattgcagcaagccgtgaagctggttatttgtccttgttcctgttggagctgtgactcccataggacttgtgcactgaatggaaggaaggtaaaggggagatcagagataggagaagctgtgttgagtgtctagtactgtaacttgtactaagctgaatgcaacaaacgatgcttttgtctttcagtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcaggtaacagagatcgcattctcacataccccttttaatccttccccctgcagaaaactagagaccgccccccttcccccgtaaaaggaaaccccacatgatgagttcattacttgtcaccatctatttcttgtttatggagagtggcctgaactgtaaatagccaccagccagtttattgtgagtaaatttagcatcatgtggttggttgctgaatgtggctgtttgaacaacttcctaaggagcatccactgccttgtaccgtatacaagagatatactgaatggccgtagcacaccagcacacctcttagagacaaggtacccttgtccggtgcccagtctccatccttggagaggtttatgcaccccagtgaacacttggtgtttggctgacagtgcaggaacctagaaaagaggcctgtatttgagcaggagttccaggtgtgtgtactgtgtacctgcatatcagaatgggccaaatttcacatgtttattgctgagccacttctgggagatttcacagagacccagcctttttctgctcccatttggaagtgaaggtccccacatttcccaccctctgaaacttcttcattgtcaagcggaatcttctctgagctcagaagtaaaattgactggatttgattaatgaaatgcatgttagctgcgttttctggctttagagatttacttcccgtggtttcttctcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaaggtgaggaagtcacatggggcctggaaatgaactgactgggctctgagcctgttcacctttattttcagactgtatggtcaagttctaacttatgtatgtcagttatgccaaaggcagtttatagagttgaaatcaaattctaacaaggagcatgatttataaaaagctgtttcagttcctaaattgaggcttatttctgcaacttaaaaaatgttttaataccactgttcaagagtttcggtatattggctgggcactgtaccttatgcctataatcgtagcactttgggaggccaaggtgggaggatcacttgagctcagaagttcaagactagcctgggcaatatagtaagacctcatctctgcaaaaaataaaaaaagtttccatatattatcaatgggaaagtttgtgtttaaaaatggtgaggagctaggcagtgtagtcccagctactcaggaggcttgagcctaggagtttgagtttagtctgggcaacatagtgagatcttgtctcttaaaaaaaaatctaggttagcatgtggttgaatgaaaagaaaaaaattgttttaaatggtgaggatagtgaaggcatattcttcagaacagagccaagctgaattggggagaaaccacagtttctttcgtttagttatgttatcaaaagcccatacaatacttttactgcttatcataacagctaggcaagtgtgtatgctttaatggcctttcttgtcatttcagctggtttcaagagacctgtggtcttattcggccccatagctgatatagcaatggaaaaattggctaatgagttacctgactggtttcaaactgctagtaagtctgtcagtgtttttttttcccccaaatttttattttgaaaaatttctaacagaggagttggaagaatcatgaacacccacgtacccttcacctggaatcaccagttgctgacattttgtcacgcattttctctcacccactgcctgcaccatagacacacatacacacacacatacacatactctttgaaaaatttctgcagaatcatttataacactttatccctgaatacttgtgtgaatctcctaagaacaaggactttctcccacataactgcaataccattatcacagccaagaaaggtaacattgatgtggtgtgattttgtatatagtccattttccacgttttcttaattgtcctagttatgtgcttcatagcttttttttaaattcagaatacaaccaaggaccattcatgacatttgatttttatgtctttttgtgatttttatgtctttccagtcccctcttttttctaaataactttgttacactgatattttgaagaatccaagctagttgtctcctagaatgcttcctgttggactggcctaaccgtttcttcatgattagatttccactaagcaggttatgtgggtccttcccactgaatcttgttaggagacacttaatgtcaggtgtgccatcattgcttgatgctaggtgggagtatttggttgtcactgttttctaaacaattatttagcttcctgtttttgcttttgcagaaacggaaccaaaagatgcaggatctgagaaatccactggagtggtccggttaaataccgtgaggcaaattattgaacaggtgagaaaattcatccacagaccgtgttttcagaaagaattagattatggtttgctgcagtcacttttaggatagtatctgtacttttaatcattaaatgttaataataaaaaattggccgggcacagtggcttacacctgtaatcccaacactttgagaggctgaggcgggtggatcacctgaggtcaggagttcgagaccagcctggccaacatggtgaaaccctgtctctactaaaaatataaaaaattagccgggcacagtggcaggtacctgtagtcccagccactcaggaggctgaggcaggagaatcgcttgaactcaggaggcggagtttgcagtgagcggagattgcaccattgcactccagcctgggcgacgagtgaaactccatctcaaaaaaatatatatataatgtaaatgcaaaccgtttcactgtgtggaaaccagtcactgttggcagtgagcggagattgcaccattgcactccagcctgggcgacaagagtgaaactccatctcaaaaaaatatatatataatgtaaatgcaaaccatttcactgtgtggaaaccagtcactgttactgttctctggcagtaacatactgtttttttttccagagttcccagcattataccaaataatgtgttaattcattttatcagaagttctaacacattggtaatattgaagtgggcattaggtagaaggaaatgtgttctgcttcttgatttaaatttacaagataggtggctcatgcctgtaatcccagcactttgggaggcagaggcgggcggatcacctgaagtcaggagtttgggaccagcctggccaacatggtgaaaccctgtctctactaaaaatacaaaaattagctggccatggtggtggcgggcacctgtaatcccagctactcaggaggctgagacaggataattgcttgaacccgggaggcggaggtcgcagtgagccaagtttgtgccactgcactccagcctgggcaacagagcaagaatctatcccaaataagtaaacaaacaaacaaacaagatatatctcatacagcctttacttattaaaacaaagtatttgatgctatattactttatatatccatttctctaacttttccccttttgtaaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacaggtaagtgaaatgtaaatgtagtccctttgctaaaaaatgagaaataaagaattgaagagtagaagaaataattaattaatctgaatggagaatttgaaattgtgttcatgactccttgaaaaatagttaatcctataaaatgggatattaggccaatggcatttatatattgaactttgtaattttgtctatttgaaaatgaccataaagatccatgatgtggtaataattagctattttgatgaagttcatattttcctgtgagactataaggctagtgattgagccaggccaaacacctatgtctctctagagattgtgtcattgttctctactcaccatcaatacatgcattaacttacaaagcgaaaggaacttggtttcattatttaaaaatattcctgtccagcatggtggataacacttgtaatcctcccactttgggaggccaaggcaggaggatcacttgagcccaggggttggagaccagcctgagcaacatggtgagatcctgtctctactaaaaggcctagcatggtggtgcatgcctatggctgaggttggaggatcgcttgagccaggaattcaaagctgcagtgagctgtgatggcactgctgcactcctgcctggtgactgagtgagaccctgtctcttcaaagaaaaaaaaaaaaatctagaaacttggacactctgaatattggatgatttaaagatttattatttctctttgttaggtgtgataataatattgtgatttttttaaaaacaaagttctttgaggaatgcatactaaataaaatatttatggttgacctaatataatgttgagaatttgcctaaatagtctgcagtgaggggagtagatgggattatagacaggacaagactggccaagacttggtagttgttagttgttgaactggttgatatgtacatcggagttcattaaactgctatctgtacttttgtacatatttaaagatttacctaatagaatatatttttaagtccatgaaatgaagagccattgctattactcatgaaagtaaaatggtctaagaacatgacatattttagtaacaatatatgcactgtctatataaatgattaattctgtgcatatgagattattaagagttttaaagggttacataaattttgtggtcatgcagggcattattttgttggggcaacacgaggagactgcaaggatatgatatccttaggatgaggatagctcattgagttcattgcccatcatcatccacccatgtcattttagtgtatctctgatactggagaggaaggggtgaatgattgtgttcacattagatgcttgttttagtgtaacttggtttttcttgttaaagagaggtgcactacttgccactgtggccaaatggagagagtttaaccaaatgcagaggaggaagtggtccatcataaactagatttctgtgaatgtagtcttacgtactcatactcttggtatatttatgaatatcctttctgtcctttttactactagtattataattattatgattattactattatagcaacagtaaagagtggtacagccttccatgtgtgctgtcttattaggccataagaaaggccagcacttttgcataatcacaattctgatgtatgactgagcccagactaaactatagcgtccctaactgtccaatattgtacatatgttacagcacagacatattctaatcccaaaaggggtcacgtaatgcagcccttccttttgacagattaaaaaactgaagccaaagtgattataaatgaagttaaaactatccccactttattttcccccctgcttttgtctgagtacactaaatagcgagcgtcttccctcagagagttaaatttgggattcacgtgaggatgtaggaaatcgggaagggaattacagtgcattgtagaggaagaactaggctgaaggcggctggacgaggagagcagggcagaagaaggcagccagtgactgtggggctctcccttgatctaacctgagtccgcatcatttgctcttgggagcacaggccacggtagctggctgagtgtgagtaagaatctagaggggtccatgtgtgtagaaggggttagcaacacctctgttagctccatagatggatttcaagatccttgaaggcagagcctgaacatttcccagcgttgtgtgcctgaggccagcatcaggactagcacatgggcaaggcataaatgtttgtaacttacattagaactgcccctggcacaccaagccatttcttgcctaaactcatcaggaagttgaaagttttagaataactcaagtcagagattggaatggaagcacacactgtaagcattgagtttcatctaaaacattgaagtgatcttatctcaccagaaattgccaatctcttatgtagaattgtacagtcttcaggatagatggtgcagggtgtgcagcaactttgaccagcaagctccaattttctagcaagtggtcttttacagtactcttccagacttcaaagtttgactccctacagctgtgtggatgactgcactaataattgcttttattccccatctcaccctcgtccctcttagcttgaccaggttttgacttgaggctgtgtgccatgtccagaaacactagtctttacatttgagcagtagaatcttcaggcagaattagtattttatagtttttgtttgtttttgagacatagtctccctctgtcgcccaagctagagtgcagtggcacgatctcggttcactgcaacctctgcttcctgggctcaaggcaccttccctcctcagcctccccagtagctgggactacaggcacacaccaccatgcctgggtaatttttgtattttttctggcaacagggtttacccatgttgcccaagctggtctcaaacccctgggctcaagcaatctgcccgtgttggcctcctaaaatgctgggattacaggcatgagccaccgtgcctggcctattttgtaggcttttaaaatgattttaagtgtatggcatttttgtgagttagtagttgagaataatagagtgctttgatgaacacagtaatttgaagtcaagctttatgttgcattagtctctttaggctcaatatccttttgttttcctttttgcaaagtaataagaaagctcctcttcctcacgagtatttaattatgacaatatgaaaatagttctccttacaagtcttacagtacttctcagttaaacaagagaagctttattctgagatttgcccaaaggcaagttgacttgtcataataagtttaagtgttaggtttgcctcccctactaccaatttttaaaaattttctataaaatacatttgcatatcacaaatttttatttttaaaaaacaaactttgaattacatgttttcttggaatcttcaaagtactcagtgcatggttcgaagatcatttaagttgacttatggatttagagacccaagtggggctacccttttatgctaattatagaattttaattcctgatttctcaaaggattatatagactagctagttgaccacagaaaagagaaggaagatgctgggccccctagctggatacctttgctgttgcatgcccatttagagggggtctagcgtgccactgttaaccgagccacgtgaaaagctttattgagttttgacttagataccatataatccacccattgaaagtatatagttcagctgggcatggtggctcacgcctgtaaatcccagcacattgggaggccaaggtgggcaggtcacttgagctcaggagtttgagaccagcctgggcaacatgatgaaaccctgtctctattaaaaataaaaaaattagctgggtgtggtggtgggtgccggtagtcccagctacttgggaggctgaggtgggaggatcacttaagcccgggagctggaggttgcagtgagccgagattgcactacagcactccagcctgggcgacaatgagaccctgtctcaggaaaaaaaaaaaaaaaaaaaaaaagtatgcaattcagtgggctttagtatattcagagttgtacagctgtcatcacaaccaatcaatcttagaacatttttatcatccccaaaagataccccatacccattagcagtcattccccatttctccctttccctaaaccctctagtcttagatgttaccttttgctgtcgctcttggtgcttccaaacctccttggctggggagggggaggtagcactgaccatacatgtcagggctgggcacacgtgccctcagaacctcagtattcccaactaaggcagtggctgagtcagcatcctttcagtatttcactttcttgagctcaaaagatagagtaagtctatccaaggggatataggcataacccagaggttaggagcaacagataattaactactattgctctaaggcaaagaatctgagaagcggaatgagagaatccaataataagctaaaggtacttaattcagcagagtcaagggaaggcagcttcatgtctgtgcacctgcctgttaaaaagaggtcaagtgcatgagttggatgttacttttatatgcagcttaggaagttagctactgtgaagctctcaatttttattcataaacttgactgttaatgtgaattcagtaagagcttttgtgattttctttattttatcaaggggcaagaacatatttcctgcatctcacaaaatgccgttttaactttaggttttctttatgatgaatgcagaccatacttatctcagacagctgcaacataaagctttaaaagactgcttaacattttgtatatatttagtgtaaatcactcattttgtctctggggtacaaaatctcacttctatttttaagtatcatattttagctatgagatgagcacagtaatctttgcagagtaccataataggaatagagaagtccgtggaatcaaagttaattttcttcgggttgtctaatggatcagtttatttcagtgctgtaaataattaataaccaaggaaattgtaagctcattcaggattttctaaggtcactgttagaacttcttaaacagaagaaagctatgttacttggaggaaaacctgaagcatcattgcttacaaaatttgcttaatggttctttttggctttagaagtgatagtacaataagaggccatggcaatgtagtttaaaagaaatcctaatttacctgcagtctgataattttaggggtacaatttgttattttggactaacttgcttgtctaatttatctccattaggtccataatacatattgctgaagaaatgacatatgttgtactttgttggtattttatatctgtgctctaaatttctgtttttagatgggccatgtagtgtggtggctgagaccataggctctgaaagcagttttctgagcttgcatccaagcttcacacttgcttggtgtgtggccttgggctagttaatttcactactttaccttggtttctcatctataagatgggcatcatagcaacacctaccttgcaaagtttgtgtagtcgtgaaatgagctaatccaggtaaggtacttggaaagtaactggttgatgcatagtaagtgctattatgtaagatatactttgttctgagtagaaaatgtatattctttgaatacacactggttgggtttgtttaatctatatgtatattctaaaatgtgtaagtctatcaaagtgatatacagtcagctctccatgtctgtggtttccacattcatgaattcaactagccgtgtataggaaatatttgaggggtaaaatggatggttacatctaaacgtgcagggtttttttcttgtcattattccctaaacaatatagtataacaacgatttgcgtagcatttacattgtattaggaattataagtaatccagagatgatttaaagtatataagaggatgtacataagtcatatgcaaatactgtgtcattttgtatcagatactcggcatctgtggattttggtatccaagtggggggtgtcccggaaccaatcctctacagataccaagggacaactttatgtttaagtgttacttttagtattttattggaggtagccaatacagtatattagtgtatactaattagtgtatacacctcagcctcccagagtgctgagattacaggcatgagccaccacacctggccgaaaacacatgttcttaaaaacatttttaaaagttagcctttctgaaaataaacattctaaaaatctatttttagctttatcacatccacctataatgtgaactcaaacagctacatgattagtagttttaattgcattcattaaaagggttttaatattcaaagatgtgcaaacatcttcttgcgtctgccatagtcttaaatatcacagaaatgagtgtaaattatgtcaaatagcatccttaataaacatgcctctggaaattaatgcagacctttttgtttatatttctatagctacaatcaacctaaattcagccaatgatagctggtttggcagcttaaaggacactattcagcatcagcaaggagaagcggtttgggtctctgaaggaaaggtatgtggcatagatatgctgctatgaggtgagagtccctgttctgaaacttttctcaagagggcagtgaatgtagtcaagccatgcccatttgaagtgatgctcacatgtgtgctaatcaagtttgaaatttcgtaaattctctgaccaagtaataaaaatgaagggacttttaaaagaagagcagaatgtgacatgtgcagccctacattcacttccctttcacttttaatgtagtaactagtgttatattccaagtacactaatcagagcttacaagatctcatgctgagctccacagcttactaaggacgtgggaaacttagagtgcagatgagaggtgaggttgagcaacttggagaatacggctaaacattaataaaaagaaaagctaatggagttagaattacttagaaaataaggttggttgagaatgtgccatcgttctgggagtttgaatgggtgatatgagaacgttagggaatttgtctaggcctctagaattggatcgcttctccctcggggagatagctcacacacagctgtgctgcagggaggagagagggagattctattacctgtggccgcttttattttagaagcttttggtgttagtatcctgttcaccagctgaactgaggtagttttgtgagacttgacagtgactattttgttgcagaattgactaagttttgctctttgagaactagatgtgtagtcaaagtatctggcatctatggagtgcttccagtttggaagggggatgcaagcttccctggggaggacaggttgaacaggacatagcttctgcctttgagggtctgagaatcttgtagaggcatggatgtgagtgtagcacaaggcagcgtgcaatgtgttgatattactaggagagtggtaccaggagaacaggctgcagaggagctggattcagaagaaaagcaagacagactgagaaagtgtggcttagccgcggtatggaggatggatggtagcacagataggctgcagggcccctaatttgagttcctgcacaaaaacgaccataatatcaacattgtaccaaagccaagtgatctcagggagaaaaataaaagatgccttccctggcgagcacatcaaggtttcagtcgcttggctgtgtccttgggaattttcttgagtccccactcccaggagccacatcagaccccactgaccgtccaacacaaattcctctagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggaggtgaggcgaggcaggccacgggcaggaacaggagagcctggtgttttccttgcactctcgtggacagctgtgtgttcagggtgctgtggaaggcattcctaagggttggagcagatgacttccagggagtctctcgctttgagtccacgctggcatggttgcagtctgtgggaaagtggggcaggcaggtggacttcagaagagcttgaggggtcagcactccgcacacccatgccctcaggtgcgatggataaacagaatggctttaggtgccgtctgtccaaattaccagcggaaccttccttcccatgcagtattgttgtatgtacttgtaacctttgattaggtttctctctgtactcttagatgtccttgcttttcttccccatcctgcctttaacctttctaatcttgccaaagctcttgagtgtttccccatcagtttccttctctcttatatttcagttttttaattgagttcatgatcaaaccttcatctgatcacatcacatgtactgtgcatccactgtgattagatagcttatgggatccttgaaatcacattgacaggcactgtaaagtcacagccaagttagcaattattagttgcacctcagagaatgttggaataatgatctttgaagatgggattgttcatatatttggataattattgctgtggatttctctctagcattttagctcattccagtaaatgatttttttctttatgaaatagaactaccaaaaaaaaaaaaaaaaaaaagttcaacaacaacaaactgaagggggagaaaaatacaccattaccacagcaacaaattagtttatgctagacaacttgtaaagaataaattaacttccaaatgcctatagacatggatattagtgacacaagagattttagacttttggagggttcttaaaaaattgtgctttaaaggaagagactctacattggatgcagccagtttttaaaaatgtgtctgaagcatttggtgatggtttctgcctgttcagtaaagaagcaccggctcagaacctcaacttctggacttactcaagtttgcagaactcctccaaagcagtcgagtgctctgttctctctgcttggatgttcttgttgtgaatgaacctttatgtcttgtagagcataaggaaacccagcccagagccacgagctcagatgaggagggctgctagcagcgatcaacttagggacaatagcccgcccccagcattcaagccagagccgcccaaggtacgtggctgggaagcccaggatgggaaggaagaggaagcagatgcctctgaagcctcctggacggccagggaggagcatgcacactgagatggtgtttaattacggttctgactcactgtgttctctattagagcctatcttttggcctgttgggtgaactcccaaattagggaagggcaaaaaggaaggaaaggcaatattaggagagcatatgattttaggactgttagtgtttatttaatttactcttcttgttaa

SEQ ID NO: 428 - DNA, 81154 bp, Homo sapiens
gacgcggttcgccgcaggagcctcgaaggcgcggcgccggcgagcccttccccggcaggcgcgtgggtggtagcggccaatttgacagtttcccgggccgggcggccagcgcggaggcgccacgctcgggtcgggggcgggctgacgccgccgccgccgcgggaggagggacaaaggggtgggtccccgcgggtcggcaccccggcggttgggctgcgggtcagagcactgtccggtggtgcccaggaggagtaggagcaggagcagaagcagaagcggggtccggagctgcgcgcctacgcgggacctgtgtccgaaatgccggtgcgaggagaccgcgggtttccaccccggcgggagctgtcaggttggctccgcgtaagtgcctccttgtgccgcgcggttgggaggagggtcgtgagcgtgagcgtgggagcgctgggggctctgctcgcgtgctgctctgaagttgttccccgatgcgccgtaggaagctgggattctcccatccggacgtgggacgcaggggaggggtaggtttcaccgtccgggctgatgactcgtggcctccggggctcctggaacctttactctgaagtcacttgggctggagattaaggcgcgagtaggggacactgtcttgaacccggtgtcctggatttctgctggcttggaggcatctcgtgtctgttgtgtcgcttgcatgtctttgtgttttccttctctatttcaaaccacactcggtattgatgcaaagttacaggcttgtgtacgtgagagaaactgaaaactcatcacagagcagaatcccttttccctttcaatcagctgcgtctgtaatagaagtaaaagttgtttttttttttttttttttccagtagggaatggggatggaggtttggaaggacccacaaaagaggagtgtgatgaatgctttgtattctagtactagcctacctgtcaccagttctttttatgtcttcatttgtcaagtttctgcttttacacggtagtttaagttataaataatcagggatttctaccacagggttttaacattcttgaaatgtggacaaacttgggagtgagtgctcccgcgcttagtaatggaatacagcctcccacctctatttcagcttcagttcttaggctaggctgcttttctggcagctgtctggcctgagtaatgatggttgtggtttccctgaagttcccagcggagagtcatcccatgatagaaactgccttgcgcttctcactcacgctctcagcccggggaatcccagcggggaggagggagggaggtcgttttcttcagctccccaggtggtctgtgctgggtgtgctgacggtccttttgggaaaacaggtccacctttgccagcgtaattcagaaagagatgtaattttctgagagcacacacctgggcaggagatcgcttgaagtgagaaattcgtagtggtaaatgtatttgtagcaaagtaccactgcatatcctgcttgagaggatgaaatttgattatttagtaagttttcatgaacaactccacttcagtgtggggattacgcagatgagcaagagcgtggctctgtcacacagtcccgttgggaaagcctgcaactcattaagaatccgatgagtgccatttagaaatgtggacagggtactggagcttcctcattgtggggagatggcagaagcggaggtgctttactaaagcaccggtggcttttgaggtgtttcttgtgtttttttcagaactacttctgcagtggggccactttatttcttttcagagctacttatgcagattgatgaaggggaactttcccctctgaaatgctgctgtaactttttcagtaccatccagatattataatactgaatgagcccctactcctgccagtcactgtgggggatacaaagatgaacaagattcaatttctgcatttaggggtctagtggacctgaaactgttagactttactctgcaatctgtgtcgggattcctgagactgagggagggaatgtatgatgccgatgcacactctgcaatacagaaatttagcaaagagtgggattggtcctatatgcattcccttcaggggattcttgctgggaataaagggcatttgaacagttacctcacccgagcaagccactatagaaaatggggccagtaatgcgcccacctcaccgggctgagtgaggtctgaatgaaatgacagagagtacaaggcatgtggtggatgctacgtaaatggtggtagctagtaataggaacaaaacgggtgctgaaaactcttaagtgttgggtcctgggttgataagggaggtgagatctaaagatacaagtaggaggtgccaggtaggtgtccaggaaaaaactgaaagagttgttgttcacactctgttaaaaggccttgaaggccataacgaagctttgggtggggggaagtcagaaatccctcatgtattaaatgacttgactttccctacaaaagaagcgaaccagtttcccagtaaacatcccaccccataactatttttgaggcattcataggcttaagaccaatgaatttttacatcacccccgggggaattgcatttgcaatgacttctgcctacatttaacttttgatctagttctttgtacactgacaaaagttcacagccaaccatttctcttcaggacaagtgtgagaactttctgcatactgctgaaggcaagggagattttgagtttagcaaggttttctctccttaagaaggttatctttttacgagacacaagttattgaaactaggcggggccactttagtcctgtgtacaataatatgtgtagtaatataaatagtaatttaaaaagtcatgcagacttggttggggagaggcatgaagtttgggtgtggtgggggcggggtgaagcggtagaagggttcgcaatcactgctgaaactttcaacatattctaccaacaatatgagccaccagggaattccttgcctcatctctagaacgaatcccattaagcagttgtggctacagatgaatttatctaggttgagagctgattcccaataacatgcctcattgatttgactctaagcagtaatcaggggcccaacagttgttggaccaaccagccttgattttccagagaaggtgatttggtatatggtagtgtctgagggtgagattgccccagatgggagtggagggaagcagaacagttttctctggtgttttactgagtttttgtcttgatcctaaatccaagggttagggtcagaaacacagactcagaggttagatttaacacccatttagtgggttaaacacatcaatggttatgtgaactttgttaaggtttaaaaagctatttagggcctgtttctccctcataggaatttttgcaatcagcctttttagtagatgcccatatagaaagtgaatttgggagggtctaaggtggtattactattaaactttttgaaaaggctgtgtgatagcaatggaaaaaaaaattcaggcatggaaatccaatatgcagtattgcagtagctagttttaattttatttttgtttttttggttttttttttggagatggagtcttgctctgttgcccaggctgaagtgtggtggtgcggtcttggctcactgcaacctctgcctcccgggttcaagcggttctcttgcttcagccttcaaagtagctgggattacagaagtgagccaccgtgcccggccactagttttaattttggatggtacctaggaaagcagttgagctagtatgctgcatacattgtagtgtgagaggcagagttccgagttggagagtgtctgcttccactttttccatttgattaggaaaagcacttcttagaactgggtgactgacagctagagccccagaagacctgcacaagctggggcaatggctacccataacagtgacggctccattctgttttttaaagggattggtgtctctatcatccagctggccattaaacaaccaaagcttcatcatcctagataacctgtgagctctcagaggagacagagtaaggactatcatacccccaaaatacctaatcatttaataaagcattttctctaccttttatgctatcccaaaacagtgctttccaaagtctggtatacagacagacttacaggtggtgcagagagatacatattctatttttcaattatgatgcatgaatattatatgttaggaataaaaacagaaaaccagctaccacatccatttatttcatggctagattgcttagaatgaggcaaaaataaatattaagtaaagcagtgagtttgctttaagaaaaattatcaactctgggaatgagtaatatgaggctaaggcaaaaatggtaaagctagcccttgacatctgaggtgtgcataatactgcttaaaatatgagtgtggtgcttacttatagagagcctggtataccttgaccacgccttcaagaaagtcaaacacagaatggcccagaatagccaggaaagttgaatttgatggactttctgtcttaagcgtgtgcatcctgctcttatccactcagatctcttagatgtggttgcagacagtgtatttgtagagctagctgtttgttttaacgtctggcccaattctcattcctttctctgcttccacaagccattctgcagtttttaaaggtctgttggtatgatatttttgatatgatagagtgataggggaggaagtattttgacactgatgaaggacatcactgtattatcaagtgactcttgctcatgattcattgccgaagaatgtggacagccaaacagcctcacctgtaaatgcatttaatttctcaaagtctttcagaagaatgccaactggatgagtttttttttcttattttttttttaatatgaagcttgtattggtctgtaaaataggctttaacaaggattttcgtaggaacaggaagccttgaggtagaaaacaagtatccctgctttgacctagagagatgcatgctcatggcaggcgaatgaatcaaggagaagagaaaatactgtttcagtagactctctagtgatgtgtgtgttcacaccatttatgagaaatcctaagctttcaattagtaacttgtactttagtcatttaaaatcagcacagatgtttgtttagtgcctctgccagatggttaaagttaaatcaggttttttaacctgaaaaacgtaatgtagctttccttaaccatttacacaccattgtatattgcagaccatagtcagatacattttgttataatgaatgtttattttaccttttagctcaattagaatatcagtggttatggtttctattttgttttcctacagttactgtatgggggtgcagtaacagcggtggtggtgaaagtaagttacttttttctttttctttctttttttttttttttgagacggagtctccctctgtcgcccaggctggaatgcagtggtgcgatctcggctcactgcaagctccacctcccgggttcacgccattcagcctccccagtagctgggactacaggcgcccgccaccacgcccggctaattttttgtatttttagtagagacggggtttcaccatgttagccaggatggtcttgatctcctgacctcgtgatccacccgcctcggcctcccaaagtgctgggattagaggtgtgagccaccgcgcccggctgaaagtgaatctcttaatggatcttccatgaatcaaatatttgtgttttagtaagttaggctgaccaaaagatttcgaatcatacctttaatcatggcaaggatcttatgtcacattcttgagtacacatgttcactaaattttacctatatgtgtatgtgaacatggacttcagaattaattagtgtggtaattattatttctattgtagactttaatcagccatattaaatatatgcattatgttcacagagaaaacatggtatcatctttggaaactttacagtatgctctatattatagataccctatataactatggtactaaacacacgagttagtgacaagtcaggcatttggagggaatgtttgtaacccattgtgggagagagttattagaatagttattcttactggtaggtaacagttatggctgtaatgaatagaatgtgactaaaatccagttatgcctttgccatcgtattaaaagctttggtggagacgtgagaacattgcagatactttggattttgtcacttgagttgaaggtaaacagagaaaacagtactttctagtcatcagtaggaattaactcttccaggacatgtagcttcaaggaccttctaggttcttctgagggggaaataatgttccacttggggccatttttttccatttgttgagagtcatttgttttcagagtattaaaggaagtgttccgagttctaggttgtgtttctttgatgcctactaaagctgagcacacctgagaccctgggtggagctctacaatgggaataggagtaagtaatgtaggcttcgagagacaatcattctgctctcagtccttggaagactgttcctaggtatatatggcaaagcagatgaaattatttgagggaattaattagcaaaactaaacatttctgtttttgaaaggaatgaatcatttggaaggaacttcctggtgagctcagttttagcagcctggtttctgcgttacccttctgcagtctggctgaatcaattgtgttcttgcctgtgattggtgaggatgcacatgctagtatttattctagcccttatcacttcccatcagccctgagcccctccctggtctgagtcatcttggtaaccccagaagctaacagagcaccaacacatccactaaacgttggactgacttgatttggggcaggcttgttgtataagctagtaggaataagagactaattgagaaattaggacagtggattcctgacatttatatagtgagtagatgatcgtttgttagaattgcgaatttcatccagagaattttgtccaaaaaaaattatagaatttcatctagaccatttttgtaatggcatggaagcagcattagctgcaccactgattagctgggtggcttttgctgtcttgtgactctagtttgcaatttcttttttttttttttttttttttttttgaggtggagtctagccctatcgctgaggctggagtgcaatggcccgatctcagctcactgcaacgtctgcctcctaggttcaagcgattctcctgcctcagcctcccaagtagctgggattacaggcacacgccaccacaccctgctaattttttgtatctttggtagagacggggcttcaccatgttggccaggctggtctcgaactcctgagctcgtgatccgcctgccttggcctcccgaagtgctgggattataggcatgagccacctcgcctggcctagttctcagtttctttatcagaaaatgagtagttacagttgatcatctcaaagtcttttgtgcttaagattctgaaggttttgaagtttgagtataaagcctagagaacattctaaattatttccattggttcttctcatcttaaaatgtttttgtgctccttaaactacgtttgtgtttgcttgcttgctttcttttttttttagagatccagtggattatctctgaaaagcattttttaaaaagacagagtccaagagtggctggtagttgttttgctcataaagtgatggaaagatctattattcagttgcagcttaaattatgtaccagcaccacgtgtgctggattctcttccttactttgcagcttaagccagcaactgcaaccatcttgcagagcttcttgagaatccttcttcctcttcctcttcctctccacccccatggacttctccccgggcctcattgcctgtgacatacgcttggaaggaggggcaggcctgcagctgggagccctttctgatttgttcttcacaaatgtgttgaagatgagcctactggtcactgctgcaaaaaaccacattgttcactggtgtaaaatcactgctgtcatctgagtttcagcataacttcaggcatgttggagtttttcaacgtcacctcaggcagagcactttgccttccttgggctggtctgtttagtgtctgggtgagttttaagagaggagagacattgtggcatcttagacactcactgaaattttccagaaatggagctggaaacatttgtgcgtttccttctggtgttattgttaaagcctaaaaacaagggcaagtggcaacacattgaaatgaagaagccccaagtttgcaacacattgaaaggaagaggccccaagttcgttttgagcctaaattgaattttaatcaaaggtctgagagaaatatttagtctacttatactatttaagtgcacagtttggcagatgactttgggcagtgaaggatctggaagaggcaggaaaggtagactcaatctgccagacttagagctaaaaaaatttgcctggtatgtttccatgaagaaaattttcctgtagaagcagtggcacgacctctgttacaagtctgcttattgataatgaagctttttctgtgttatcaatttcgttgaatttatatgtatgtatatacatatacacacacacaaatctcaagtagagagcttgatgaatttctttttttttttttttttgagatggagtttcactcttgttgcccaggctgaagtgcagtggtgccatctcggctcaccacaacctgtgccctccaggttcaagcaattctccggcctcagcctcccgagtagttgggactacaggtgcgcaccaccatgcccggctaattttgtattttttttttttttagtagagacaaggtttcttcatgttggtcaggctgatctcgaactcctgatctcgggtgatccacctgcctcagcctcccaaagtgctggaattacaggcgtgagccattgtgcctggccagggaattttatttattgtggtaaagtacacataacattaagtgtaccattttaaccattttaaagtataaaattcaatggcatttaatacactcacagtattttgtaaacaccatcactctctagttccagaggtaggtgaatttttacatgaatgtattcacctgcatgattaccacctagattaaaaactagaattttccatcactctggaaggttctctcttgccacttttccaatgattaccacacctacctaaaagagaacttctcttctgacttctctcaccgtggaacacttttgcttgaacttgggagaggacccatatataaataaaatcaacattttatgtctgtcatctttcactcaacctaacctctgtgaaattcatccgtatttgttgcgtgagattcagtagttcttttttgccactgagtcgtattccatttatatgcatctgtcacatttggcttatctcttctgttgataggtatttgggttattttcagtgtttttgctattatgaataaagctgccatgaaaagcacctacacattgccttgtggacatgtacacccatttctcttgtgtgaattcctaggaccataggttagggattttttaaaaaacttattttagattaaaaaaaatattttttgagacagtctcactctgtcacccaggctggagtgcagtggcatgatctcagctcattgcgacctgtgcctcccaggttcaagtgattctcctgcttcagcctcccaagtagctgggattacaggcatgcgccactacacctagctaatttttgtatttttagtagagacaggtttctcttcaactcctgagttcaagcagtctgcccaccttggcctcccaaaatgctgggattataaatgcgagccaccacgcccagccaggttacagatgtttaactttgattctttacctctgaagtcaaataaacctgggtgtgaattcttttgtcctgccacttgcttgcttgactttgagcaatttacctttttctcatgttcagttttctcagttgtaaaataggcctaccctatcagtcatggttcagtcaagaagacatgtcattctagctatttcaaggagaaggggattcaatacagagtattagttgccttcaggacaaagaaaaggcgagatgcgcaaaaaatggaagcccaccgctggctttctgatttgccgcaaaaaaagttagaaagctgctgccacccagagaagactcagaaggtcttgcttgaccttccaccttctcagcatctccagccttgaggctggtgaaagggcagggaatctggacatgctgtaaagctcatgtctgaggaatccaacttttgcctgctactgctgctgtctgtaggaagaagaaaaacaaatggcttctgctttccttcatccttccaaatctcaaacacgtgtacctcgctggtagaaccctgttggcaagagagatgggggatctctggtagaaacagaaactcagtgccagcaaagaagaaatggcatagatgccacctggggttgctttgaggtgctcagtaaatggcagtggttataatttattattttcatcattcctcaagaactgctgctgcagttcagactgatttctctctctctctcttcttttttttttttttttttgagacgggcttgctctgtcacccaggctggagtgcagtggtgccgtcacagctcactgcagcctcgacttccctggctcaagtgatcctctcacctcagcctccgattagctgtaaccacgggcatgcgccaccatacctggctaatttttaaatattttgtagagatgaggtctgtctatgttgcccaggtgggccttgaactcctgggctcaggcgatcctcctacctcggcctcccgaagtgctaggattataggcgtgagtcaccacgcttgggcagcagactgatttcttttttttttttttttgagacagagtcttgctgtgttgcccaggctggaatgcagtggtgcaatctcagcttactgcgacctctgcctcccggattcaagcaattctcctgcctcagcctcccgagtagctgggattacaggtgggtgccaccacacccggctaatttttgtatttttagtagaggcagggtttcaccatgttggccaggctggtctcgaactcctgacctcaggtgatctgcctgccttggcctcccaaagtgctgggattataggcgtgagccaccgtgtccgacccagactgatttctgtaacggatgttcattcttttcactttatagtcacatggatgccactgtaagagctccgtgtcacataaggtgttgtttttctggaagggccttccagattctgtatctattgctctgtgattctaggtacttttctaaaggtataagcttgagaaattagttttcaagtctgtaagttaatgtagagctgaaaggtgacttaattctaagagttgctgctttaatgtataattttatggaacctaatgagtgttttctttttaaagtcattccactttattattaataaaataaaaggtaatatataaatctggctgatagatggggttacttttttccctgtctttagcttcctttgtgttctgataaatgagatggaagatttttatcatattttgtacctcaaatctctcgcggagggaacactgtagtctaccaaaacagctggcagaagtgtctgtcctattataagtttattttatgaaacatgagctataatgtagtcctttttttttttttttctttttttggagacggagtctcggttgcgcctggctaattttttgtattttttagtagagatggggtttcaccgtgttagccaggatggcctcgatctcctgacctcatgatccgcctgccttggcctcccaaagtgctgggattacaggtgtgagccgccgcgcccggccaatgtagtggttttaagacatttaaaaatcttgaaccaatgttggcaacagcctgtctgtaatgatgtcacatgtggaaagaaccgagtttttcttaactttagaatgtgaattttttcctccttcaaatactttttcctataacccagacctattttactttccagggaccctactattactgccctaaggtaatttgctagaaatggagtggtcaagatgtattgattaacgttttaggcatacttctgtagtactacttccgaaggctccttgcagagaaatttgaagtgataaggaaggcaaatattcgaaatggaaagataagtataaccagtgactatttcagccactggtttagcagttcaagtgagctggctgtttgtaaagcttgcttagtaaatgaatgtgctagaaatatattgacagaatttggttttatctctttttctccagacttttagtcggccagggctaacaatggatgtccaaacagtttacagtggctgatacacaatgcacaaagggcttcactgtttggagactggaaaatagagccagaggggagcttcttatgggcattgacctaattcactccttttggcaaaaatgcttggttttaaatcaatgtatgtatttctgacccaaatatctataaatatttcagctagtagtgttacagctggaggaagggacccgtggtgttgcttcgtgtattttgatttgacaatattctttagaaataaattgtcaagtgaactaatattacacaaaagttagggaaagttaagagaggcagctgaaattccatcagtttcctccttagtccctggaacctccccacaatcaggaatttgttagtcacctggtttttaaagataaatttctctgtgggcgtttctgctgagaaatgtggggaaacaggactgggctaaaaataaaattagttcaggcattgctaaacttctaagtatcatgtttgtgatgtacttttccaggaaacataaattggcaatatttttgctcctttttactaccacagaaagaatatttgcagtcagcatgcacggcctgaaagaatctctctcgcctattaatagaacagaaggaacatacacatgtctatgtgggggaaaaacatctcatttggcttagtagtaagctccaaataacaattgcattgttgttctgaattgtctttgagtgtgattggatgattaaatataaatgttgacctgattggattatatcacagcaatgaactgtcctgaaaaaacagctgtaacataccactccagactgttaccagacttagtcggctggctttatatttgtgttgtcaaaactgggatgctgtcatttctgtttctctgtctctttcgtctgttccaatttgagatatactgactatgttagtgtagtctgctacatggatagtcctttatctttcagcaacataagcaacataagctttttgactgagacgagcgtaatcaaaaggaatgctgggaaacagtgaactgtaaaaaatgtcctcaattagatacaggcttcagtgcatgggtttatcctttcagaagatcggtgtgttttcagtgagggtctaaacccactggcctggattccacctcttgttggatgggtggtcagttttaacattagggggtgttgattgtgagctcttgagagcagggctggttctttgcattcctaggtaggcatgatgtagagtagttgctcagtaaataggggaaggtgaaaggaagagaagggagaaggtgagtctcaaaagactggaatgtgataagcacacgtttatcacactgggggtgtattctctcccttttcttagagtattccttgcctcctgaaaaaagcactttgcaggaaatatggagatcttctgaacctgtggctttgtgttattggactgagaagtccaaaatgtgcattagcggagcttatagaactgctctgagaatgtgttcttgagttctacaaatattatggggtgcgttgggggctggctcactccagctcagttcccatgtgttaagtggaacttctgatctgttgaatgcctaaccatgacggagcccaggagacaaagtaaggtgtggtttgttttgctgtaagaccacgtttggttagcttttctctagcaaagctggggaaggagatcacagggctgatgtggtggtaggcccttggtgtagatctcactgacttttcccagtcaactaggagtaaatgttaaccctattttataggtgggaaacggaggctcagaaacattaagtaaattgcccagtgtcacacggcttgtgtgacagggaggggatttgagccaaggtccatttgatgaatttgaaacctgtagattctgtcaattccaccagtctctgctttttagaatcacagtggcaagaaaataggagaagctcaaggccctgtgttgattattaggagtttaaacatcatcgctgaaagtgcatagaaatatttgtattcctagagaatcttaagtaaaagtaacatatcaatgttgtcaagagatgtcttcattcatcagagacctctgtgtgttcattactgtatgagaccccaaagactctaagttgcctctaagacacagccttacagggaggtattaagtgattatgtatacagctagctaaaaccacaactttattatagaaatattaagaatatgtcttatcatgtgagagtattctttcttcaagtccatagcctccagttagaaatggctgtgttgtcccatcaaccccttcactcaaaaactatcattaatatcaggaaaaacttatggttacaaactcctgggttatagaattggaaggaaaaacttagatatgctgtgtttgggagcttgccttgaggattggaattccattgcaagttaccttggggtcaaagtacatcccctaaaacatcaaatacctccaagaggttttaggctatcagacagccacactttaatgtggagtagactagtcagctttcttctactatctaactgacaccatacacattgttaaagagataattttgattgggaatgaagatagggaattttgaagccagaacattctggtgatggagcagatactgccgagatgttggcctcgggacagcctggaggaggaggacactgataaacagagcaaccagcccaaggggtggaaagacctaggaagtctccacatacaaattttgcttctttcctgtttctccactgaaccctgggaagggtgcttatttctctcctcactgtctttccccaggacccagaattgataggttagttgagtttctgtgggcagtctaaggtagtgttactatttaaaatgttagtaacattttcagattcactgagattcttgctgagtgtggtggcatatgcctgtggtcccaactacttggagactgaggcaggcaggaggatcgcttgagcccaggagttggaggctacagtgagttctgattgtcctgtgaataggaatagccactgcagtccagcctgagcaccacagtggagactccactttttttttttttttaagtttaaaaaagttaaaaaaaaaaaaagacaaagaaaaaggaaagttgatttttggttctaactcagttgtgacaaacggtggatatatggttctgaccacattctaaattggacttgatggtgggcaagggaaacttccaatgcctatcccctcactttaaaaaaacttctcctgggccaggcacggtggctcatgcctgtaatcccagcactttgggaggccgaggtggacggatcatgaggtcaggagatcgagatcatcctggctaacacggtgaaaccccgtctgtactaaaaatacaaaaagaaattagccgggtatggtggtggacgcctgtagtcccagctacttgggaggctgaggcaggagaatggcatgaacctgggaggtggagtttgcagtgagccaagatggcgccactgcactccagcctgggcaacagagcgagactctgtctcaaaaaacaaacaaacaaacaaacttctcctgtagcagtttgctttgagttgtgggtgccacctccctcactgtctttttctgagggtacataaataaattgcatcctagcttgagatcaggagcaatggtttttagttctctgtgtccaacacaattcttctacacagtgtcttgcccaatacatgtgttggtaatactgacaaacatagttaatcttcttctttgaagattatctgaagcaagattttgaccttaggtcagcttcccctgaagtatgtgattggaaactgaacgagttcagattttagtttaggtaaaaatataaccagagaagttgctaccaagcatagttgactttgagctgacctaacttttggattatgtactcactaagaacttacctcttattaattaaacaaatacaaggaaataaataacccaataaaaacactcaaaacaagtttatccccaaatagtgtacttgatgctaaggacagacctaaagtttgttgaggatagaaatgaaaaatgaggcaaaagaaaccaggaattgagatgtgtgtgtgcctgtaccagcacccgtgtgagccccttgcaggtaacgacccatggtccctgcacatcagtcttctgttactaagttttgcataaattgagtctggtggttggcaagctacatatagccagctgcgtgtttgttgttttttctgcctgctagctaagaactgttcttgcattttaaatggttatgtaagtatctatatgatctccgtgattttgcctcttgtagtggcaagcctaaaatatttattgtcaggccctttgagaaaatgtttcctggctcctgcctcagacctcctggaagcagggtgttggcttgatttgtctcctgttctgcaatctgggaatagtagatcaggatgctgacttgtgggaagatgctggctgcatgagatgcccctgtctgcagtcactcatagcttggaaaagcaaaaaggaaaaagggttggatctgagcactgacagacaggtttgcttctggtttcaatgtagtaaggtgacctgataacaagggccacttgagaagttgcaaatgcagatttcctccgtgttaggtggtgaccaataaaagcatattttgtttttaggatgtagaaaggctataaaactgcaatgtctttgtatcatcaaacatttctgtgtttctgatgtttcagatgttcctatttctctggattgcaggatttcaactttgcaacatgtactgttgtgtttctgagttgttgactatttcagttccaaacagttcgttatttcctgtcagaggaaacttcagagtaacaataaagtgctggtgtggcttcaaaggcttggagaaatgaaaagcagtggagaaattttgtgaggttcctttggcttagaaggttcagaaaggctttgagcgaatgaatgtatgtatcagtcactgttactccaggtccgttagctgtttccagacctttctgtgtcctaaaaacaaacatcattttgagggtggggactgtgtcctatgttgacaggtctttgttttcaaagtctgatgtacaatagagactaaacgttcaatgactgaatgcagttcatttttaaaatttttttttttttgagacagagtctcactctgttgcccaggctggagtgcagtggcatgatctcagctcattgcaacctccacctcccaggttcaagcgattttcctgcctcagtctcctgactacctgggattataggcacgtaccaccacgcctggctaatttttgtatatttagtagagacagggtttttgccttgttagccaggctggtctcgaactcctaacctcaggtgatccacctgcctctgtctcccaaagtgctgggattacaggcgtgagccaccatgcccagccgtatgttttaaatcttatattaagcttataccactgttgattgccgttgctacagtggggcttatattaatattagaaacacccctcatttgagtggtactttacagtttatagcaacctctacataaagctgggcatggtggcacatgcctgtaattccagctgcttgggagactgaggcaggaggattgctccagcccagaagtttaagaccagcatgggcaacatagcaagaacttgtatcaaaaaaagaaaaaaaaaactttcatgttaaattctcacttgatcctcaccaagaaccctgtgaggtgagtgttattcactggatgcttagagaacctagagatcatacagctggctagtgcgtaccaggaacttgaactacttataaactggagcagtcggagaaagcttggtgtgtttgacattgtctgtctcttggtctccaggccccaagaggaagcaaaagcctaattcatcttggcaaatgctgtagaagttcttgcttggattttctttcgctagacagtttttggtggtggtttgttgctctccttcagataaacatttcttgatagtgcagtttcttccttcaatatgttcttattctggtgtgtacatccgtttctcagaatgtttagtaaacatttctgttgcataccctaatgccagtttcttacctactcctcagtagcgtgctgcagcagtggctttgggacctggtgtagacattatgggttgctttattcattcctcacagtgacaaggggatcttgattggtgctaagtccttggatggttcccttggcctcagtgactctgagagagccatcactgcaggtgtgatcagtgccagggtcttcctttcttccttctctctcactttttttttttttttttttgagatgtggtctcactctgtcacccaggctagtgtccagtggcacagtctcagctcacttgagcctcctgggctcaagctgtcctctcacctcaatctcctgagtagctggcactacaggcgtgcgccaccacacctggctaatttttgtatttttagtagagacagggtttcaccatgttgcccaggctggtcttgaactcttgagctcagacgattcacccaccttggcctcccaaagtgctgggattacaggcatgagccaccgtgcctggcttttattgtaatttttaaagtctatttctaatttcatctaaattatgttttgaaattttcaattcgtagggaaccggcagtctctccctttttatttctgcatgactgcaccacctagtggataatacatctgttaccaggcagtggcctttgatgatttcctatagctacaaattctacaaaaaggaaaattgggtgcctttttatgctttgaaatcacatataatttctgccagtaatttttgtttctaggcaagtacggactttttgagaggagcttaataacgtttaattcagaattaaaaaaaaaaacgtcagcccatacctgaagtttcccgtgtcaccaatggactaaggatgcagactgtcagtttcactcagtttatgtgataatggcatacaagatagaataatgaggtctttttctaagtttagaaacaaggctatttcaaacacctgaactttttttttttttttataacttgcttgaatttcatctgctgtgttttattaagtcaaaagaattaggaaggcttgttgatttttgcatggctttggctccacatttgatacaggaaacctcacctttcccctccctgtctcttgtctttgctgccccctgcctggatggagtatgttccagtatgatggagcaattgtttctttttgtctgttgatttccattaggtgcagtgggcattggtcattgtgctaagtataccatgcaagaacacattcagttattacgtttatggtattttaaatatgtaacatacttatgcagttgaaaccataaattgtaagatttttagtcttgtccatagattaacggtttaaaataaaattattgtgtctcttactgacagctggttaaatcagtattttcaaagtatcaatttactaagttttgtcatgtgcctctataaggaattcacagtcttcctctgcgctcccacagcctttttatttttccttcccaggaaaaattttagagacaccaaaaggattcttaaagtataaaaatgaatttcactgtttttgaaaataagtactatttttttcttaatacctggcattctgctcatggttgcagcactgtaaattgctgaaagttataggtcattacacatgaagaggcttaaaaatgccgtttgatctatagttaactacaaaatatggagggggagctatatgcacacagtgtctgccatagcattagttatactagcaaaaaaaaggaaatggcttaaatgactgctagggatatggttaattatatagtaaatattgctatttacaaatttaaattaactaaaattaaacattgcattcttcagttgcagtagccacatttcacatgttcagtagccacatgtggctagtggttactgtgttggacagcacagctatagaacatcgtcaccatggtagaaacttctgttggagagtactgctagacaggtgcttctcaaacattattttccccgtcacctccctgatgggaggtgcttctcaaacgttaatgtgcatattaatcacataggggctctagttagaatgcatatttttatcagtaggtccaagttagggcttgagattctgtatttttaacaggctcccaggggttggctacgtaatacccaaagggtggggttcttgcctttattctccaattctaataggaaaggcatgtgtttgaagctcaggactccgtatgtaggctcactggctttatgggattaaccaggctcattgctaggtggtactaatgtgtccctcttttctgtgggaaccatcatctgatggtgccccaggtctgggagggaacgattgaccttgtgtgtttcctatggggccaaccttgatggtgacatttagctgagcagctctaataattgttttttcaacctgcctttttgacaaagccgtttatgattatctttatcttggtgcctattatgggggtggtggtttgtatgtatgtttgtttttttaaagtgaagctatgttttagtgttatataagtttagtcaggtttaaaattatagggtacacagggctgtgcctgtgttgccaaattagcaccttccttttggcttattaatggcttctttgtaattacaaataagaatgatctgtttatagcttagcttagtgtatcagaactaggaacatagaggtcttaaatgtaactatcagctgatttttttttttttggtctcatatcttatgaaaattggactcatgcaaatttgcattcaaattgtgaccaggcacctgttagctgtggggccttgccatgggcaagttccttgagatctcaggccttctatttttgtatgtgaaaaaagcaggagtagggttagggtatagggtttttggaggattaataggcaatagccataaaatacttagcacggtgtctggcatattgttaatgtccaatcagtgatgatgtgtttcaggcccccccttttccatggtgttcacaaaggcgtaggcattagggagcttgtgcatatataccaaagctgactgttcaaacagccagaaataaaatccgactcgactccctttctgcaccctcttcttaccaactcactgcagaagacttattgggctgtgttgactggacccaggccagtggtgtggaaatagctatcatgcttgtgaagatgttctgagttgtcagagtgattgaatccatgattggtctggtgcccaagcaccaacaatcatgtttttgtttgtgtgtttgttttttaagagacagggcctcactctgtcacccaggctagagtgcagtggtgccatcatagctcactgcagtctcaaactcctgggttcaagcagtgctctctccacagcctcccaatgtgctgggattacaggcatgagacactgagcccagctgggatttcttttggtgtgaaggccagtgatcagtcactagtaggttttggaaggcacaataggtgtatagtggagaggcaaggttcttcagtggaaaggatataagctttctagtcacaccagcctgagttagaatctgtcctctgccactttttacttgtatgacctcaatcaacttactttacttctgacttcagtgtcctttctgtaaaatgagtctattaataatgatattgataatagctaaaattgagcatgtactatgtgccaggcattaccttgatttctctacatgcactgtctgattaaattctcacaacaaccttagagaggtgggtcttgttactgctactgcctctgctttacagatggaggaaactgaggcaaggagaaattaagtaactcgcccaaggtaaagggtggagcatggatttgaatccacactttctgactacagactctacgatgtgatcttttttttaaaaacagctttattgagatataattcatataccatacaataaaagtgtgcaaccagtggcttttagtactgtatattcacagagttgtgtggccatcaccacaattcattttagaacattttcttcaccccaaaaggaaactgcatacccattagcagtcactcctcatttcccccaaactcccatagtcttagggaaccagtaatctttcagcctctgtggatttgcccctccttgacatttcacataaatttgtcattttatgtcacataatttgtcattttatgtctgatttcttttgcttgttttatatatatatgtgtgtgtgtgtgtgtgtacacacacacacacacacacacacacacacatgttttctggaggcagagtctcactctgtcgcccaggttggagtgcagtggcacaatctgggttcactgcaacctccgcctccccagttcaagtgattatcctgcttcaccctccccagcagctgggattacaagtgccaccacacctggctaattttttgtgtttttagtagagatggggttttaccaggctggtcttgaactcctgaactcaagtgatccacctgcctcgacctcccacagtgctgagattacaggcgtgagccatcgtgcttggccctgcttatattatttttaaggatcatccatgttgtagcatgtgtagatactttggtccaccttattgttgagtaacagttcattgtatggatataccacatttcgtttatccagtcatcagttgatggacatttgggctgtttccacttgtttgctattttaaataatactgttatgaacatttgtatacaagttgttgtgtacacatgtattttcaattttcttgagttctgtgatgtacttgttggttttgtttttctttttttctaccatgtgttcgtaatgctcttctgagaggaagaaaacagactttcttacttgggagtggtcagcttatttgctgctacaatattaatgatggaaaacccttatcaagagtgcttatcctgtgatgggtactgagcaatgctctccagaagcattactttattcagttctcagaattctaatagggtagggatcttgacctcattttgcagataggcaaccaagtcttaccaagtgaactgttccagatcacagagcttggagagtgtgtagggggactgagcttagacccaggtgtgtgtgacggcctccagaactcctgccactgtgttatgtggacaccattgtctacctcccactggaaggtttaccagcctggattttacagagtgctttcatggggtttgcctggtttcaccctgtgaaatgggtgatgatgccatcgtttgatgaagcagcagtggaattgagtgagcgcccaagctcatgggtgaattgaggcgcagtcttggatggaggtctgtttttggagtttaaatttattgctgtttgcatttcaacacaactgctttgaaagctacaggttgcctcaggcaccctgtcatcctttcccaattcttttttttttttttttttgagactgagtttcactctgtcacccaggctggagtgcagtgacactatctcagctcagtgcagcctctgcatcccaggttcaagcgattctcttgcctcagcctccagagtagctgggactacaggcatgtgccactacacccagcgaatttttttattttcagtagagatggggtttcaccatgttggccaggctggtcttgatctcctgacctcaggtcatctgcccgccttggcctcccaaggtgctgggattacaggcgtgagccaccatgcccggccacctttctcaattctttattatctatttaaatgcacgctaaaaaatttaccttaggtaaataaaggagaatgtggttaaaaaacacaactcagtaaacctggcactcttcagtagtaggtctgggatctagttgtgttgattctggtgacctatcacaaacccctctctaagcttattgctttttgctgttaaacttggtcataagcaagctgtgtccattgtgaagtgtgtgctgtgagcacatcgcatacactagatttaatcatccactgccggcactcagtgcattgtgaagggagggtaaggagctggtgaaatcacatgtgaaactgaaatacttgtggaataaacgatgaaagggttttgtttgtaaaacaaacgctacagaaagtattgttggatgcggtggcaactagtttattgctaccaagaggggtttaagtttgaatagaccacaggtaagtgccctgaagccaaaaggacttggtttataatgttaaaaattattcgtttttggaagaacaagagttgaactcattttctgccttctctgggaaaaagcatttcctgttttgttattagacagctgtttcaaagttttgtccagtaagcagaattttgactaaattcttcacaatagttaaaaccaatttcctgggggcaggtggggaactataaaagtcctcttttcatctggaggtaggtttacctaccagcctaggccagctagctgtttctttacactatccctttctaaggatttgagttcgtttgtaaaatgacatagcagacacaacataataccagagggggctgaacgtggtggctcacatctgtaatcccagcactttgggaagccaaggcaggaagagtctcaggagttcgagaccagcctgggcaacatagcgagaccttgtctctactaaaattaaaaaaaattagccaggtgtggtggcatgtgcctttaagtcccagctactccggggctgaggcaggaggaccgcttgagcccaggaggttgaggctgcagtgagccctgattgtgccactgcactccagcctgggcgacagaacaagatcctgtctcagacatacacacacacacacgcatgcacgtacgcacgcaccagagggaaacatcatgcagaaaaccattggcccatttattggatggtgtcctcccgaagtttcacatctgctgtttggagctactgagaacctggctgatttcatttagtgctccctctgtcttactttgtctttccttcctttctttcctttctccctcctttccttctttccagctatccagtaacatgtattaaggactcagcatgtggaaagcacgcatgacattgttcatggagacgagggtctggagtcaggcagcagctcggatcccatctctgacagtggtgggctgtgtacactctctggcctcagcttccctatttgtaaaatggggatggtggtgctaactcacagggttgtgggcattcagggaaaaattgtatatttagtactgggtgtggtgccctgccaaatgttaatgacttccttcctctccagttttcacacttaccttgtctcccatttctgaggtgaatatgcattttaaggctcccaagccatagattaagctgttttgacatgtctgtccctgctgagaacgtgaaatcctgtgtgtgttattaaacagtttactgcccggccgcactgagtactcgcaatgtcttgaacacccttgcaggttacccctcctggctctgaacgggctgttccctctatgcagaatgcccacccacctgaccagttagtcatccttcagcatggagctgtgggagagggagcctccctgtggttgggacatacctccctccaccccaggcctctcatcctcagttaacaacccgcctgtgccatcaattacactgttttgtggttttttacacctttttttctagacacaggatctcactgtattgccaaggctggagtgtggtggcatgatcatagctcactgtagcctccaactcctgtgctcaagtgatcctcctgcctcagtgtcctgagcagctaggactataggcacatgccactgcacctggctagattttaacatttttctttttgtagagataggatcttgctttgttgcctagcccagtcttgaactcctgggctcaactgatgctcccacttcagcctcttaaagtgctgggattataggcttgagccaccatgggggctggcctcgcttcacattttatgtagttgctataaccccaccactcaccctgctccagcccatgtcaccttttctctttcctaaatgtactaagcttgtttcccaccccagggcctttgcatttgctgttcccgcagcaatctggagagctgttcagattttcctaggattaattcttcccagtctgccatcccatggcacttattactacctgagatgatgatatatattgactcttgtctgctttctctgctaaaatcctccctgtgaggaaacgagtttggcacatatcccctggcagcatctgacatggcataagtactcagggagtatatgtcgaatgaatgagcctcttggtgggctcttgtacttgcactgaattgtaattgcttgtttacacatcccacctccccactgggctgtgtgacttcctttgcatcataacttggggtgatttgtctttctgtccacagggccaggtgcatggttgcttttgggtctgtaagtatggaagctaggaatctttgagaaggcacatccttaaacccataagctcttctcatggaggtagctgtccaccacaaaatgtccttctgatgccattggtagaacaagtactggttggagcaggctgcagttgttcttacgttctgatggccatcctctactgtcccctcccccttttctttgtcaggtctttgccctgtgctgttctttggaccctgaacaaacccttctccccaccccgctaatcctgtcctttccttcagacctcatctcggtgtccctggctcatggaaaccctccctggccaacctgccttgatcagatgctggctcctgcaaagcttcctgagggcagtgctttatttgttttgctcttcatttgttcctcagagcacattgcacttggtcgacatttgttgaatgaatgagtaaagaattagtgatggcatatttacatacccatgttcatggcagcgtttttcactatagccaagaggtgaaagtaacccaagtgtctgttgacagatgagtggataaacaaaatatgtcatatacatacaatggaatattattcagccttagaaagggaggaacttctgacatacgccgccaccacgtagacgaaccttgaggacattatgctatgtgaagtaagccaatcacaggaagacaaatcttgtgtgagtccacttatatgatgtgtctaatgtagtcaaattcatagaatcacaaaacagaatggtggttgccaggagctgaggggagagggaaatggggagttgtttgataggcatgagtttcagttttgcaagatgaagagttcttgagttcagtatattctgaagtgtgaatatactactgtcttagtcaattcctactcctgtaactgggaagtttataaaaaacagaaatttatttgcccacagttttggctgggaagttgaagatcaaggcaacagcagatttggcatctggtgagggcagctctctccttccaagatggtgtcttgttgctgtatccttacatgacagaagaggtggaaagcaagggggtttagctcagtccctccagcccttttgtaagagcacaaatcccattcatgaggttggagccctcttaatcacctcctaaaagctcctccccttaacacttactgtattgggtcttaggttccagcacatgagttttggtgggacacatacattcaaaccttagcaggtgctacactgtataccctagaaaaatgagaggttaggagtgccgaccctcacacagtcaaaaatccatgtataacttttgactcccccaaaacttaactaatagcttgctgtttaccagaaaacttaccataacataaacagtcaatgaacgcattttatatgctatatgtattatatactgttttgtcacagtaaagtaagctagggaagagaaaatacatttattactcactaagtggaagtggatagtcctaaaggacttcatcctgattgtcttcatgttgagtaggctgaggaagatgacggtttggtcctgctgtgcccaggcggcagaggcggaagaggtggaggaggtgaaggggaggcaggggaggcaggcacactctgtataacttttattgaaaaaaacccatggataagtggaccagggcagttcaaaccttgctgttcaagggccaactgtacttagaaatggttaagataataaattttaggttatatattcttcagcacaattaaaaaaaagaattactgctgctagaaactatgacctctggaaatcactgtagaagaatctggaattcttaaattctaggacacctctgacttctgggtagtatgcatgaacttaagggaaagaagtatttatttcctcatgaggataagctcaggtgttttccttaggactgtcagagtgaaggagtgggctggcctgaaccctccccgagttgcctgggttctcaggctcctctgcacctggagctagtgagccagcccatgggctgaacctggctggtgtgtacagagcctgcacatgtctgcatagcctaggttgaggtttggacacttgcttagattccaaggtcctcctttgtacccatttatttatataataaataatttattattatttttttgagacggagttcactcttgttgcctaggctggagtgcaatggtgggatcttggctcactgcaggagaagtgattctcctgcctcagtctcctgggtagctggggttacaggcacccgccaacatgcccggattttttgtgtgtgtttttagtagagacgaggtttcaacatgttggccaggctggtcttgaactcctggcctcaggtgatcctcccacctcagcctcccaaagtgctgggattataggcatgagccacggtgcccagcctggattttttttttttttttttttttttgagacagggtctcgctctatggcccaggctggaatgcagtggcccgatctcaggtcactgcaacctccgcctcctgggctcaggtgatcctcctacctcagcctcccaagtatctgggactacaggtgtgcacaaccatgcccagctaatttttctatttttagtagagatggggtttcaccatgttggccaggctggtcttgaacttctggctcaagcgatctgcccatctcagcctcccaaagtgctaggattacaggcgtgagtgactgcgcctggcaaagtgtaggatttgaaacataaacttgtattcatttttgatctcatttaactgtcataacatgaagaactcaactcttagggaaggacacacatttcccagtgcctgtccagcaccagcacgagtgctttgtagagattgcctcatttcttgccgacattgcccttctgaagtgtagatggttttatcgccactgtataaagaagggtatagtgtatccaacgccccacagctaagtgacaggacaaggatctcactccagatcttgtgactttaaaaatcactttcttggctctgcttctccttgtttcctagatggtggccatctcatggtccagatttatatacatctcagcctcaaatcaaatggcacactttacatttgcacgctgtttggccaagcccattggcatataacatacactatggtagcaagaattggccagaggctccccaagaccagacttctgaattcctaaccccagctcccaagccccaggcatcccataaaatctttgctagatgttcagaaacctaaaatttgcttctccacccctcccttctccccaagtggtaaagacaaagaacagacggcagggctctttgttattcttttatctgctaagtttacaaaaaggttagacagtggaactttgctgagcaagcattctgtccctgagttgtctctgagcagcaccaaatgagtcttatcttccccttgttatctccaaggacgtaaaacattttcttttcatgctttttaatttctgtgtaacattagccattcagttgacctgaaacattgctagtttatttctagctggcgtgtgtgtgtgtgtatcagagggtctatactgtataaatacttctctaaatattcttttccataatgttgctctaaagtgtctcatttactcaattctgtcaacttagatgctgaatcattttatgtgcttaaaagaaatatctactcggatgctctagttccctggcaagggagagagagggagagaaagaaagctgttgaagtggtgcaaatccaaactgctttcttttttgctcataagtagtgcttttcaaagcgtttggcatccctgccatatggatgtgtcactgtgtgagatgacaacaggatttgctggaaatgtgggccactattgtatccgccttacgtaaccacatggagtgatggaaatgggtgagcagcccggaatgtaggcggtggcctggcccatgcatctccagagaccatgaagactgctcaagccctacataggatgtggatccaggctgttaaaaagttgaggagatggaaaggccgtgtgagtccctctgcaagctctccccttgttttccccaacctttcttcatgggaaggggagggaagcaaaaccattctcacagtgagtcctttatcctcagattgatttgtgcttctggcatctttcagcaacaaattgtgagattgtaggttgtagtcactggtgggtttttaaaaatacttgtattaattttagcagatctatgtgaaactgatagcctcttactggatctgtggatcaaaggctgctgttttccatgtgctaggaatctgtaatggttttgcttcctgggtagagcttaacatactggcttttgtgtttgttcatgtttgagaatttcttgttttgggataaaactttttgctttcttacactgcagaaatctatattcttattatgtctaggcttctaacttagaagaaaaagtgtttttcacatgttcttttttcctcttacagtttgaacatgtgtgagtgtttactttgatggcttgagacttttatgaagcatgtcccttacgtggacagcttgcgattaatctttggttttagctttgacctccatcactgggcagcagcagtctgtggatacagaatctaaaagccgcctgttcagggggactttgggcagtgaacacttcggtatctgttttggggttggcttttaacatgtttctacattctttatgtaaaatatataggatttttacctatctggccaagatttttcaaaggaaaaaagctttataaaaagattaaaaaaaaacacaataagtaactatttgccttagttcctttctcttcttttgtcacacaaaaaccttactgttaatgcattaagttttttgtttatggtagaaaagttagctcacttttaactttccatgaggtcttaagaatgacctgttagatataaagggggttgtcatgaacactacttacgtgaaaagtaaaagtgataaggaaagatgatgaaagcacattgaagatcctcctaatggatagaatgttgacacttggattaaaaaggtgacttggcgttttctgcatacacctccccccacaactccccagacctaacctgcgtccccactctgcccaccgcacctgccttgctttaccctctttgcccctttcaaattactggtaccatccttcaactcgccctccttccagttgaaattattatcccctcttcactttgcaaaattctaactgcattgaaaaatttgctgttaaatatactcgtacctcttgggtattagatccttcaccaggagtcagtattcattttggtgttcacccactcatctccctattttttatttatttatttatttatttaatttttttatttctttttgagacggagtcttgctctgttgcccaggctggagtgcagtggcgcgatttcggctcactgcaagctccacctcccgggttcgagccattctcctgcctcagcctcccgagtagctgggactacaggtgcctgccaccacacctggctaattttttgtatttttagtagagatggggtttaaccatgttagtcagtatggtcttgatctcctgacctcgtgatccacccgcctcggcctcccaaagtgctgggattacaggcgcgagccatcgcgcccggcctcatctccctattttttaaacttatgaaatgtttggtaccataaaagaattaaatatctaaatcatggagcataataattaaacaaatgccatgagcccattacacatatctgcagaccatcaccaagacaaaacacgaaggaaatttgtgtacctcccaccatactctgcctcctgcccaggtcacctcatcctgaatgttatgtttttcatttccttgctttttctttatatttccactgcatgcgtgcgtacacacacacacgcccctaaacaatagattaattttgttggcaattttttactatagtgaaaaacgcataccaaaatttactgtctgtaccatttgtaaatgtacagttcagtagtgttaagtatattcaagttgttgtaaaacattgttttttgagctatataaaaatggtatcacactctacaaatccttctggggtgtttttttgctcaactttatgtttgagatgcatcccttttgtggtggtctatgtgactggtttgttcgtcttcattgcagtaaaacattgtattttaataatgtatcaatttgtccatcctgcccttgagagatactgggatattttccaagttttggctgttgggaacattgctgctgtgaatactctatacatgtgtccttgtgcatttagtcacacggttctcccggtgcctctgcccaggtagaggaatcactgggtcgtggaatgtgcatacctttaattctgatatatgcgtgctctttctatgggcctgcctgtaaagctccccctggtgctaagcagctacctgctgtcattcagagagaggtcagatattgctagcaagtctgatctgcgcatagccaagcacaaggtggtgggtgggaccagagcccggtggcctagtttgaatgtcaggaccacagctctcagctaagctgctgcaccctggcagcctgtgcccagggatgttcctagagctgatgttctgaggaataaggatgattatgtggggtgctctgtgtttctgaaaaattatataaatgaggcaggaaagacactcagtagtttgctctttgggtacacttgtagttagttggtaagctgcccaagggctttggcgattttattcactgatgtctctgaagtgccacaaaccacttgcttggcagaaggtggatgcttaataaatgtttttgcataaatgaacaaatgagtgcacagtgaagagttttctgtgagaccttcccaaaaagtcacagttctgtaggctaaatatacatagttatggtgtatttttaatgttcaacagagctactaaaatttatttttgctctagttcccttcctttacaattaagattttctctttatcacttggcttagcagagcatatattctttgaatattatgttaagtagctaatagttaattttattacccgttaaccataggtaagaagaagcctcgcaatctgattggtttcaggcaccaggcaagttaatagcaaggtctgattggtggtggtagtggtaggagattaatcgtctctctgacaaatttaatttaaattacgcttgcaggcatcacaggacacttaaagatggtagcatcccattattgaagggctgtgaatttcaaaagccagattcattctacttgagccacatttaaaaaataaaattttgcaggaactcatttatttggctaaatgataaacaaatttaaatccaaaactttgaagagtttatagttttaaattccaaaatagaaatgtattttaaaagtaatgtactcataaaaatattctctataatagcacagctccttgggatattcaacatttttttggtatgtagcattgcccaatcctggggatgattgtcatagtcccagttagttttttttcctgataattttaaagtaagttttgtggggaggatgtcatgtaattttttttcccccttaattcatggggctataactatatccaaagaagagttggcaaatatatttattttaccacaacttctagattaattcactttgttgaaatttgacagctttaaggtacaagaaggcattgagaagatgagcttggagaagtgggcatgctcataaggtcatttctgggtggtagtggcttagttttactaaggccacatctaaaactgaagttggcaaggagttagtaaggtgttctatggaaatggaaaagggcaaccaattctgacttactgcaggagttcagttgagtgtctgctttctttttcttttctttctttattttttttgagacagagtctcactctggagtgcagtggcgcaatctcagctcattgcaacctccacctcccaggttcaagtgattctcttgcttcagcctcccaagtagctgggactacagatatgcgccaccacgcccggctaattttttgtgtttttggtagagatagggtttcaccatgttggccaggctggtcttgaactcctggccccaagtgatccacctgccttggcctcccaaagtgttgggattataggcgtgaaccatcacgcccgacccggtttctgctttctgtttccatttaagaaaactttttggccgggcgtagtggctcacacctgtaatcccagcgctttgggaggccgaggtgggcggatcatctaaggttgggagtttgagaccagcctgaccagcatggtgaaaccctgtctctactaaaaatacaaaaattagctgggtgtggtggcgcatgcctgtaatcccaactactcgggaggctgaggcaggagaatcgctagaacccaggaggcggaggttgcagtgagcccagatcgtgccattgcactccagcctgggctggagcaaaactccatctcaaaaaaaaaaaacaaaaaaactttttaacaaatatgtacaacttcattaaaatattggaaaatttattgtgcttccacatattggaaaatgctgttttagacacatgcagaattccagagaggtatggctatagagcacatctagaaagtcagaccatgagcacctgagtttttagttcacccacctcacgtatgctatcaaagaagcagagagccacgaatttgatacaaactttctttaagaaaatttgtaggctgggcacggtgtctcacacctgtaatcccggcattttgggaggctaaggcaggcggaccatttgaggtcaggagtttgagatgagcctggccaacatggtgaaaccgtgtctctaccaaaaatacaaaaaaatgagctgggtgtggtggcgcacaactgtaatcccagctactcgggaggctgaggtatgcgaatcacttgaacccaggaggcagaggttgcagtgaacctagatcacacccctgcattccagcctgggtgacagagtgagaccccgtccccccccccccccaaaaaaaaaaaaagtagcagcagtcagtgcttcagttatattaattgaatgatgaatgaatagtgtatccatctctagatgtattaaaaagaaaaaactttgagtgcctactctgtgtgccagacactgttgtagcagataatgggacaaagatgagtaggatacaaaaatttcacctgaaaattcacttttattttttaaaattgaagaacagtcgtcacagtgaacagactttaagtaattggggagttttacataatttagataataatcttttggaatgtttacatatttccttgtgttgatgggccttcatttaatctaaatcttgcacttttgggctgcttgcgtccctggcaccccaggccccattcaccacccagtcccaggattgctggtagcacagatctcttcttctggcctttttcaggtattttgagttctttttttttttttttttttttcttattaaatatacagatggggtctcactatgttgctcaggttggtcgtaaactcctgcactcaactgatcaccccgcctcagcctcctgagtagctgggactatggcatgtgccaccatgcctggctaactttaaaaattttttgtagagatggggtctcactatgttgcacaggctgcccttgaactcctaggctcaagcgatcctctcgcttcagcctgagtgctggaaatacagacgtgagccactgcacccagccctcttctaatttcttaaaacataaacacatagtccgggtggcttggtggctcatgcctgtaatcccagcactttgggaggccgaggcaggtggatcacaaggtcaggagtttgagaccagcctgatcaacatggtgaagccccatctctactaaaatacaaaaattagccgggcgtggtagtgcgcacctgtaatcctagctacccaggagactgagtcaggagaatcgcttgaacctgggaggcggaggttgcagtgagtgaagatcacgccactgtactccagcctgggcgacagaacgagactccgtctcaaacaaaacaaaacaaaacaaaaaaccaacatatacacatattatagatactccatttttgtctgtggctggtatttcaaatatttaaagtctttgattcttcagtttatgtttcttttacctctcactcatggtgatgtgcatgtttaaattgtgggctcatttccttggatacatactatctggggaatctttgagggctgtgtttgagtgtgatctctggagaggattcgcatctgcctctgtgtacttggtggtatggccagtgcagagccccagtaggcatgagtgtttggcagggtgtggtcacgtctgtaatatgaacgcccaaacctgtgtgaatacaggtctgttgatagaaattctccagggttttatttttagttatttccactctacccatagccaaggatgagacagtcactgcatctccatctgtgtgctggtatttttttcccctaatagatccacccagacctgatctcccaccctgtttggatccccagcctcctctaaatgcctgcttcagtgctggcttatctctgtggttctgagtgttcttggcatttctagctttctcacaggcagcctgcatttaatggattattatttttaaaatgataccaccagttgtagttttttctggatacctactttggaatattgtcagagatggaagtcccagtggtctatttatgaagacattcatctttcatactcagtgatacagatggagaaaaagccgaaagatcccgcagatcacccaattgggcataccctatgataaggctaaggatatttttagacataaacatgcagaaaacttgcctacgaggtcacctttgacaggaagagggggagaatgattttaaaaaaagaatctatttgaaactagatatttttaaaggggttttatgatgataatgttttggaatagtgataataaaaggactcagcacttaacattccattctttttagggtctgtctctcactatgtatttcacttacctttcaagtattgtttctagtttcatttcattgaaggagagtgtgtttgaaaataggtagcataatgaacagatattaactcttttttggtatagaaagtgtgagctggactttatgtcgaggcattttgaatgataattttatttctagcattgaaaaggttgtggttttcatcagattggttttgttcttttaaaacaggccccaggcatggaagagctgatatgggaacagtacactgtgaccctacaaaaggtgagttctgcacatttcatatattctacagtcatgttcttgattttacggatcatggatcttatttattttcacctacacacagttttggctttttttttcccttgaggtacataatgtattatagatactaactggcaataattgctatgttaacaaagatttgcatgctattgtattttttgattaaggactgtttagtatggaacattttagaggttatttagtgtatactcttatctccagctagaacaggttatgaaagagagaaaagaaagggaagaatgaaaatgacctgtactgtttaaggatgtggagggagctttttacaacttctgtaattttaattatgacatattatacataccttataactcttaaaaagtgtagcatccaagagactgtaagtcatttgtgtgaggctgagctggagaactgcactcgtggttctgcatttttttttttttttttttttttttgagacggaattgcactcttgtcgcccaggctggagtacggtggtgcaatttcggctcagcgcaacctccgcctcccgggttcaagcaattttcctgcctcagcctcccaagtagctgggattacaggcgcctatcaccacgcccggctaattttgtatttttaatagagacggggtttctccatgttggtcaggctggtctcgaactcctgacctcaggtgatccacccaccttggcccgcaaagtgctgggttgcaggcgtgagccaccgtgcccagacggttccgcatttttattccgtcaagctgccttccggtcatcatcactgtgattttcctggtttttctgcagggtttcttcttctggctctgaattcctccaaggtctgacatctcctagagggaccataagttcctcataggaagagttttcctttgaccctcagaactgtgagcttcaagctttgtcttctatgaaaattaaagacattcccgaatttaatgtttgttgaattaatccaggtagaaaaaaatgtctctgggccagtgcccaggtacccagacttccagatcagtaatcacaatttcctcatttgaggggttttgtctgcttaggtcttatttttcaactttcctcgtctttctgactctcctctgccctttccctgagcatttcatgcattccttgagttgtggacccaaaattggcagaggtcagagatttttttaggcttggcatagaggatggagctgcctctgtctaaaaccaggtgccggctggtggtgctgccaaattcaaagccatgtgattaatagacaacacccccaacctgttttgagtttgtaattgtgtataatcagtcagcatagtgggcctcacgtgggaaactttccttggaaaggaagattttcttttagtctcggagtaaatttttatataatcgaacccagatttaagaatatacagtcaaatatactcatattatctggatgaaactgggcttagatacatatatatatttttgaaatggagtctcattcagttgcccaggctggagtgtaattgcatgatctcagctcactgcaaccttcacctcctaggttcaagtgattttcctgctccagcctcctaagtagctgggattacaggggtgtgccaccacacctggctaatttttgtatttttagtagagatggggttttgccatgttggccaggctgatctcgaactcctggactcaagcaattcacccgccttggcctcccgaagtgctgggattacaggtgtgagccaccgcacctggcccagacttagctttttaaaacacaaatgaattaggattatgtattatctatgctcaccattgtgcattgctagactgatcatggatgtaataaatcttatttccgatcttccatgcatgaagaaaagggtttagtgctttgcttttcatgagatctcaacacatattttacgttcaaattttatctttaaaatccagttacgggccgggcgcagtagctcacgcctgtaatccccacactttgggaggcagagacaggtggatcacaaggtcaggagatcgagaccatcctggccaacatggtgaaaccctccctgtctctctactaaaaatacaaaaattagctgggtgtggtggcacatgcctgtagtcccagctactcaggaggctgaggcaggagaatcacttgaacctaggaggcaggggttgcagtgagccagcaccactgcactccagcctggcaacagagcaagactccatctcaaaaaaaaaaaaaacaaacaaatccatttacttctttttcactgtatgttgaaatgaaactaccaacacatctactttgaagttaaaggtatactttaaaaatataattttaggcagacataagaaagaacgaaatatgtcctttgcagcaacacgaatgtacctggaggccattatcctaagcaaattaatgctgaaacagaaaaccaaatactgcatgttctcacttagaagtgggagctaaacattgggtacacacagacacaaggacaggaacagtaaacactgggaattccaaaagtacggagggagggagaggagcaaagtttgaaaaactacttcttgggtactgtgttcggtacttgagtgacaggatcattagaagcccaaacctcagcatcagacaatacacatatataacaaacctgcacatgtactcctgaatctaaaataaaaataaaattaaaaaggattggctagcactgggaagagcagtcttttcccgcccagctagaaagttgtggttttttttttttgttttttagagacttctccatttgcccaatttaaagtgcaaaagctgccttggcttgttgaagccttgacctcacaggctcaggtgattctcccacctcagcctcccaagtatctgggactatggatgtgcaccaccatgaccagctatttttttctatttctagtaaagacagggttttgccatgttgtccaggctggtcttgagctgctggactcaagcaatctgcctgcattggcctcccaaagtgctgggattatagacatgagccatgagcctaggcagaaggtttttttttttttaatatgtcaaaacatcacaatatacagaagaattaaaaatatttacagtacaggccaggcacaatggctgtctgttgtaatcccagtgctttgggaggttgagacaggaggctcatttgagcccagaaatttgaggctgtagtgagtagtgatcacaccgctgcactccagcctagcaacagatcaaaactctgtctcttaaaaaacaaatacaataaggaaatctgaaaattaaaaaatacagttttagtacaggttcagtttttactgaagttgttccagctcgggccagcatgatgcaaagaggtacaactggtgcttcaaacagtacgtccctatttggactgaagacattgtttcctatcccggccagcttctagtgataactccagtctgcactatcaatcttttccagcctctacaggctgtttctttcagataaggaatttccctttataaacctgtcagctgacaatgactatgctttgttttgtttctcatttgtttctgtaagcccatctgttcctgaacagtctctggttattgatttgacctttattttattgagtgcttgtaataaatcctgaaagccacttattgaaggatttttaatatttctcctctctgatgtacaggattccaaaagaggatttggaattgcagtgtccggaggcagagacaacccccactttgaaaatggagaaacgtcaattgtcatttctgatgtgctcccgggtgggcctgctgatgggctgctccagtgagtgtcctccctcgctccgcagcccctaccagccctactggttggccctagacggggtattttggttggtgtccactttatttaaaaaaaagaaaaaaataacaaacttttatataatatttgaaaagtcttcaagctggaatggaagccataacacaccatgtttgaataatgcccaaaccttgggaacaccccagctttggagcgaggagggcagttgtttccgtaagaagatagttccaaacatccctcctaggtttaggaatcatttctgaacatggagttttaaattggcatgcttctcaaccccgatgcttaaccaacactgtttatgtttgttttaatttatattctttaagaatttaatgaggagactttggtttattgattatcttatttgtaagagtgatgtggaagttgggacaatttactataggaaaaccacaagttttccaactgccagctttctgacctgaagaagtaacaccattttattttaatttttaataaattttttcttttctttttttttttttttttcagacagagtcttgctctgtcacccagtctggattgcagtggtgcgatctcagctcactgcaaccatcaccttccgagttcaagcaattctcttctgcctcagccacctgagtagctgggattacaggtgcctgccaccactcccagctaatttttgtatttttagtagagacgggttttcgccatgttggctaggctggtgtcaaactcctgacctgaagtgatctgcccacctcggcctcccaaagtgctgggattacaggcatgagccaccatacccagctggtaacaccattttacatgatacatgcctgattcccacaggataacttctcaggacgaagtctaaagttaactgtatggctgcattggataaatagctcaaaagtttaggttttgttggtgtttaaagcctctgtgaactaagcacagtggctcacgcctataatcctgcactttgggaggctgaggtggcaggaacgcttgaggccaggtgttcaagatcagcctgggcaacctagtgagaccctgttgggatggcatgtacctactcgggtcccagctacttgggaggctaaggtgagagaatcctttgagctcgggaagttgaggttgcggtgagctatcatcagtcacactactgcagtccttcctgggtgagagagggaaaccatgcctcttaaaaaataaaattatagttaagaaagtctctatagttttatcaaagttagtagtctttcatatggagaaatgcaaaattttaaagtaatatttgggatgaactggaacaataggattctgtgatctcaaaatttcttaagaatccaaggcaagcccttttcctgcacaaaagcacaaatggatatacacctacttggaaggagtgtttttagacttttctgaagcccaccgtgcacctcaggcaataggggactgatagagaaattccttttgtgtccagacctcaccgtcatcaagtacctcctggtgtgatgctgtggtttggggagatcaggcctctctcttcccagatgatttccatttagacactcagaattgagctgtatggcccccagttcctttctttggaagatctcaggccaagttgactgggccttgggcgccactagacactgagccctttagaaagcctttcaggtctatttgctgcttctatttgttcctaaataaataatttacaatgaatagatgggagtttttcatgacccatttttatttcttgtttacagagaaaatgacagagtggtcatggtcaatggcacccccatggaggatgtgcttcattcgtttgcagttcagcagctcagaaaaagtgggaaggtcgctgctattgtaagtactgggtttgctttcagcttgccttaatagcattttggttttttgcccagaagaaaattaccccttgcttttaagcatttgacagaattacataacctagggaccgctgttcttggatcctcagtacttttggaggggtgtgaagatatgtgtaagttatcttcctacttttccttgtgtcttctcctgaggccagtgattctctgatctgagttagtttgccttaggaaccaagttaggcaattattccctaagagaattagctagattcagaatactggtaaaatagtattaatttagaaaaaaactttcagctcaaaaactcacttgtaaaggcccaagcaaggtatattatatcttcatagactaagagtttcattagaagactgtctataatcttcattcatctattccttcattcattcactggctgagaatcaactgtgagctggatgccattaggccctggggccaatctgtgttgcaagatgtgttcactccagtggggcaggtagacacacacagtgagaatggtaataaagtgtgcttaggggcaatgctagtaggcatatacccacatatatggttgtgtgtgtgtgtgtgtattttttttttttttttgagacagagttttgctcttgttgcccaggctggagtgcaatggcacgatcttggctgaccacaatctccgcctcctgggttcaagcgattctcctgcctcagcctcccgagtagctgggattacaggcatgcaccaccacacctgtctaattttgtatttttagtagagacggggtttcaccatgttggtcaggctggtcccgaactcccaacttcaggtgatccgccagccttggcctcccaaagtgctgggattacaggcgtgagccacctcacccggccacatatatggtatttaatgtttttcaactttatattatgaagattttcaaagaaaaaggaaagttgaaagatcagtgtaataaacatttatcttctaaaatattactattctgccatctttacttggtctctgtatgtatataaacactcatgtctttctgggcaaccatgcgaaggaaagttacagacatgacagttcatttctacttacttcacatgcatttcctatgaatgaggacattcatctatataatactattatccgatctaagaaaagtaataattttacagtattatctaaaatccagtccatatctcaagatgtctttttcatttttagagatgggatcttgttgtgtttcccaggctgatcttgatctcctgggttcaagcgatccttccacctcagcctcccaaggtgctgggattacaggtgtgagccaccatacgcagctctcaaaatgtctttgatatatgttttcttccctatccaggatccaaagttcactcattgcatttaatcattatctctttagttccttttaatctagaagggttcctctttccccttgcccctctaccccaccccccactttaaaaatggcattgggccaggttcagtggttcacgccagcactttgggagatggaggcaggcagatcacctgaggtcaggagttcgagaccagcctggccaacatggtgaaaccccgtctctactaaaaatacaaaaattagccaggcatggtggtgtgcgcctgtaatcccagctatcgggagggtgaggcacgagaatcgcttgaacctgggaggcggaggttgcagtgagctgagtacagtccagcctgggcaacagagcgagactttgtcttaataataaattaaataaataaataaataaggcattgacttttcttccttaaaattttaaaaatttatgcataatgcatagttatagggtatgtgtgattaatttaatacattaatatgatttgtaaaattcagatgagattgggcacgttcaggatggtatggctgtagacatgatttgtaaaattcaaatcagtgtatttggaatatccatcaccttaaataattgtcttttctttatggtagaaacgttcagattattttcttccagctattttggaatgtacagtagattcctgtaagctgtagtcaccctaccgatctaacattaggtcttatttcttctatcagaccatatatttgtacccatcaatcaacttctctttatccgcctttgcccccttggcagctatgtatagaatgtcacactttctggatttttgttttttgagttttataacttagtgatttgggcctctgagacttttcaaacttgagtagaagcagattttggagatactattttattattaccttaattcaaggccctgtactcagagcttcacggtcattgtcctattctaaccctgtgagatttttattgtccgtttccggatgaggaacctgaaccttagtgagtcggcagggatacggttttcctgaaaccagaaccagggctcttaaccactgccttctccacattcagttgtgattgtcctgcgtccacactgagtttgttttgacaacaggtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccgctctcggggaccccgaagccgcagccgcgagcacccgcactcacggagccccagccccgagcctagggggcggccggggcccatcggggtcctcctgatgaaaagcagagcgaacgaaggtaggcatgcttgatgtgggaagaaaagcactgttgtgatatgaataacctttgttttcttaatttttttttttcccccgaaagtgttgctctgtcatccaggctggagggaagtggcgtgatctcggctcactgcaacctccacctcccgggttcaagtgattctcctgcctcagcctcctgagtagctgggtctacaggcacccgccaccacgcccagctaattttatgtttttagtggagacaggtttcaacatgttggccaggctggacttgaactcctgacttgaggtgatccgtccacctgaatctctcacagtgctgggattacaggcatgagccaccacgcctggccaggaatagctactttttttttttttttttttgagacggagtcttgagtcttgttctgttgcccaggctggagtgcagtggcgtaatctgggctcactgcaacctccgcctcccaggttcaagcagttttcctgcctcagcctccctagtagctgggatcacaggcgtgcaccaccatgcctggctgatttttttatttttagtagagacggggtttcaccgtgttggccaggctggtcttgaacttctgacctcaggtgatctgcccactgcagcctcccaaagtgctgggattataggcatgagccactgcacctggccagctaacttttttttttttttgagacagagtctcactgtgtcaccctggctggagagtgcagtggcatgatctcggctcactgcaacctctgcctcctgggttcaagtgattctcctgcctcagtctccgaagtaggtgggattataggtgcctgccaccacgcccggctaatttttgtattttcagtagagacaggttggccaggctggtctcaaactcctgacctcaggtgatctgcccaccttggcctcccaaagtgctgggattacaggtgtgagccaccgcatctggccgagctatctcttaattgcacttaaccagcattgtacccagcattgacctaaatgcctaacaccaattcgttcgtttaatcctcagaactacctcatgagggaggactcttgtttctccattttatagacaaggaaactgaggcacaaaaggttcattgatatacacaaagttgtgtcatcattggaagagccaggcttcagaattttggctttaaactaggagaccagtggttctcaaagcagtgcatcacctgggcaccccttagaaatgcagactctcaggcccaacccagtcccaccagctcagaaaccatggggtggagccgggtgcagtggctcacacctgtaatcccagcactatgggaggccgaggtgggcggatgacttgaggtcaggagttggagaccagcctggccaacatgatgaaaccccatctctactaaaaatgcaaaaattaggtgggcgtggtggtgggtgcctgtaatccccacttctctggaggctgaggcaggagaatagcttgaaccccaaggggcagaggttgcagtagcagagatcatgtcactgcactccagcctgggtgacagagcgagactctgtcttgaaaaaaaaaaaaaaaaaaaaaagaaaccatggggtgggccctcagagtctctatgttaataagctctcctagtggccttgctgcatctcaagtggaaaaccacagtggaggacagtactccgcctaatcattgttgagtttctgctctatgcaagggctatgttgaatattcttttacgtagtcctcacaagaaccttgtgtgttaggaggcttcgtttctgttttgttttgttttgttttgttttgttttgttttgagacggagtctcgctctttcgcccagggtggagtgcagtggcgcgatctcggctcactgcaggctccatctcccgggttcacaccattctcctgcctcagcctcccaagtagctgggactgtaggcgcccgccaccacacccggctaattttttgtgttttaagtagagacggggtttcaccgtgttagccaggatggtctcgatctcctgacctcatgatccgcccacctcagcctcccgaagtgctgggattacaggcgtgagcccccatgcttggccaatgagtgcattttttaagaggattgaggaattgttgaaaaatgccagagagatgttatcactcaagcttgtctcactcagccttctgttctgggctgtgaggctgtttgaccactaggggctcgccatccatgaaagtagctttgcccttcccttattccattcttgactatcagcttcctaaaggactagggcatgggccacaacacttctaatctttgtggtaagatctggctgacaagtttaccgtaaatcatttaaaacttattttaaaattgacttcatacctttcctgaattgtggaaagttactttgttttgtaattataagatttttagtttgaacaataataaaaaattttgtgcctgttttaaaacctgctctgttgtggtagtttcctaaaatgtgaacagttattcttaaaataatgtatttttacaagtttattaagtaaaaccagaagagtcttaagtagcattgaaagtatttaaaaatatgcataacttagtaattacaatgtttttgtttttgatagcaattcagagtccataaactcccaaagctatgctggttttagttgaatgctttattaattactttgcctgacttctttaccccttttcttcacccactgaattcctttcaatgccaagcttcatataatctaaaatgctagattttttgcagtgccttcctgtagacagcctcattgtcagcagaacatgcctattaaggtgtgctgaattgtttttttttctccccaacattttatttgaaaagtgttaatttggccaggcgcagtggctcacacctgtaatcctagcactttgggaggccgaggcgggtggatcacctgaggtcaggagttcgagactagcctggcctacatggtgaaaccctgtctctactaaaatacaacaattagctgggcatggtggtgggcacctgtaatcccagctacttgagaggctgaggcaggagaatcacttgaacctgggaggcagaggttgcagtgagctgagatcatgcccctgcactccagcctgggtgacaaagcaagattctgtctcaaaaaaagaaagaaaaagaaaatgttaattttatagcaaataaacatataaccttcatctagttttaccagttgttaacattttgccacactttctttttcctcctcctttttttttctttccttctactccatcacccttcctgttacctctctcagtgggttttttggtactatttaagtaagttgcaggcaactcaccattacccataaatatttcagaggtatcttccaaagataagaacattctcctacatcagtcaccgtaataccattataacacttaagaagattaacattaatatccctttcatatattatagttcattttcagattgctccaaatgatgtaactcattcttcccccaccctccactggatcagggacctatggtagttcatgcattgcatttggtttttatgtaacttttaatctggaacagtttctctaccttttttgttttttatggcattgacttttttgaagagttcaggccagtcatcttacagaatttcccatatacaaaattaactttttaatacatattttaaaatagtcctataaaccagactaagttttttgaacaaattgataacatacgtgtatgtttatgtgtttgtctcctagagtatggtctccggcttgggagtcagatcttcgtaaaggaaatgacccgaacgggtctggcaactaaagatggcaaccttcacgaaggagacataattctcaaggtgggtagatgggggcagagaacggtagtgtgcatactgccgttcatcgcctgcatgtccacattcagcacccacacagtgagacttagatccagtgagagtcagtggtaagacagaggtggcaagagcagcataatgagacgatttttatcagaaaaaccagacattgagggtcgtaacagtttaatgtcagtttagaaaacaaaaacaaaaaaactccatgaatattttcttctttcctgtttaaagtttagatccctattccctaaactaaggaaagatgagaaggaaagttggtgatatatgaatgctgaatatttaataggtcttgtaaacctctccagtcaggaaacacgttccagtagtaaaccaaaccgttgtcttgagcttggaagttaaataaattagcagagtaacttacacctgtatttgggatccaggcatgcaggattatatttaatttaaacgacaattcatttttattgagtcatcctaaagccaatatctgtttgaatatctgagcaaagcctttacatttttagaaggggaaaatatgaattttctactgtgaataattttattgcatttaacattaccattttttataaacacagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaaggtaaaggaagaggaggctgtgagcttagctggaagtaaggaaggctgttgcttccccattcttctatttagtgtagctatccagctggaagttaaatttctaaggaaagaccccttgaaaccttaatctccaaaggtcactggttggttgttatttgcttattaaagtgcctattgaaattaggtttccaatacaaaattctggtgcatttgcgaactctcagagaactattaattaggcaattgaaagcaaaacttgtcagtaaaaaaatgtgtgtttgagtggttcaaagaactaaccatatcatttatatatttgctaattgcttattgtttttttttgagacagagtttccctctgttgcccaagctggagtgcagtggtacaatcttggctcactgcaacctctgcctcccaggttcaagtgatccttctgcctcagcctcctgagtagctgggattatgggcgcctgccaccacacctggctaatttttgtatttttagtagagacggggtttcaccatgttggccaggctggtcttgaactcctgacctcgtgatctgcccgtcttgtcctcccaaagtgctgggattacaggcgtgagccaccaggcccagccttaattgctcattctttaaaagtggctattaatatctctaatagagaagacaatttggaggatagctaaaacaagtagatgctcaaaaagaatcaaaatggctaatattgtggcattcattaattagcagtctgcatcacctcttcccttttaaagagctatattcattatttgaatatgaattatacataggataacattttaaccttgtaaaaattgccaataaaaatagttaatcacagtatattctactgaaccatctactgttgcttttatgcagagaagtttagaaaatattaagttacgaagttgtaaagcagacttttgttgatttttttttttaaaggaatttctttgtaaaaccttaaaacttaattcactttccagtgtatcagaagttgttgatgactgttacgggtgcagtgcaggaaaacaaaaggagcatgagaaataatgccagcatgttagggggtttgcagtttatttccttgctactcagtatgtggtcctcatcccccaacccctgaccccaatagcatctgcataatcaggtaactggatagaattgcagaatctcagtctcccctcaactgccccacaacaactgcatcctaacaagatttgtatgcaccttaaagtttgagaagcattgggctgcttgggaagaattagtgtatacatctatgatccaataatagaattttgactcttctgtagcagctttgatggaaaatgagacaaaagagaaatacacaattctaaatttgccttcccctttattaattaatgcctttcccttaaaacgagcaagtttttctccaggggaggactattagactaatagcacatttcctgcctacctcgtttccatttcccgtgtttcctacccagagaatagtgcaatttctctgggtaggagaatattttaaatattttatttaaaagtcttttcttatttttgaaactagatatttcagaaatagagtcaaaccgatcattttctccagaggagagacgtcatcagtattctgattatgattatcattcctcaagtgagaagctgaaggaaaggccaaggtaagatgacatgaatattctcttgtacatgtcattgtgaatgtacacacatatgtatttatgaaactgttatctcttgagacatttacgtatgacatgtgattcagttccagagaggacacgccgagcagattgtccaggatgggtgcgacacccactccctttaagtccacaggggatattgcaggcacagttgtcccagagaccaacaaggaacccagataccaagaggaccccccaggtgagccattaagaccactcagtttcaacagttgtgttcagaagtgtgtgctcacacagccataacaaagagtgaaatcatgtcctttgcagccacgtggatgcagctggaggccattatcctaagctaattaacatggtaacagaaaaccacacagcacatgttctgacttttaagtgggagctaaacattgggtacaaatggacatagaggtggcagtaacagaaactggggacaactagaggggaaactactaaaggaggagatggaaagggttgaaaaactattaggtatcatgctcacaccttggtgacaggatcagttgtaccccaaacctcagcatcatgcagtatatgcatgtaacagacttggacgtgcacccactgaacctaaaataaaagttgaaattatacacatatatgtaaatacatagatatgtatacatatatgtatgcatgtgtgtatatatgtatacagatatgtatgtacatgtatatgtgtatgtatagataagtgtgtacttaattccagagggtggctgaaagggaagaaggaaataaaaaattatatatggaagaggccttcctttctctcttttgacgttgacaaaatataaaataatagccttgtctaaatgccattagaattggtcacactttgtcatatttgatgagttgaggtcattgttttctcccatccttgatcctgacctcttcccccaacccttccccaccaccctacaattatcatcataattttatattcataaatatttaaggggaaacagtatcattattgtatgttttttaagttgttaaaaattctatgttcttgtgcatgtgattgtacaccttgcattttagaggttcattttttatctcttgtattttgagaaaccattggcacctgctaatacttcagagttaaacggcactttagagacttctttttgtttgtggtgacatatgtggcatagacttacattttttgtggattttgtgatttttctatttagaaacgcactcttgttagtccagattgataacagtagatgtttcttaacctacagctcctcaaccaaaagcagccccgagaacttttcttcgtcctagtcctgaagatgaagcaatatatgggtatgtatttccgtctctctttgttttcccttcttccttacagctctgtctctgtaactgaaatccagaagagtggtggtttttgcctagatggtgattttgtacactgtcagccacctgtaaccaatccccattggtagtgcttatgagaaagaggaatgatttgtgggaacagcaaaatgcggaagtgggtgaactttgtgatgttaatgttgtctgtttacctacctatctagctacctttccagagtgttactctgaatatttgcgtttgtcagataaattcactcccaaataggtgaagtatttattgctaaactacggtgccctgtggtgactgcactgatgtgatggtcccagtgtcagtccgtgtgggggagggaggaggagtgctgctgcgctctgcacttgataatcagaacccctagttcagcagggttcaagggcagcagcctcctggattaggattctgcttctttgtacccagactgtgtctttatttgacaagaatgcagtgcaagcgggccttcctttggaagaattttagccctaactctgccctttatttgctttctcatcttgaaagagttgctgtaaagattctataattctatgtcttcaccagtaaccagggacctactgatactcatctcatggtcccaagaaagataaaattgtaggatatatgagatagatgagaaaaatgagagggctttgtaaactataaatcactctgtagctagaagaaattaaatctctcatttgctaatgttgttctcccttttaaaaaatatctcccatctttcctttctgaaacggaacctattgcagccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtaagaacagcccagctctgtttctagaagttacttgtaaggagtgcacttttctgggtgttctttctgtaagggaagacaaaatggttcagctggtgaaatagagcagctgcaagtttgttgatgcccagcattgaagtctctgtattcctcaaatgcgtcctgtcttctcagtcttggaacccagaactcatccatgtatctgtgagaactgatagtgtttctgcccttgccaagattttattagtctgattaatgtgaaaatattgagactctaagtaagcacttacaggaaagatttttcaaaaagatttttctgatttttgcttttttcactgtgttccccctgcctgccatctttcttaaggcagtgtcctgaaattgaacaaaggtgagtggttggcatcagactgggtgattggaatttcgtcccagcctctgattagttctgtgaccctggttcaccctgagactcaggtttctgtatctgtttaatggggatgagaatacctgcctcgcagggactgtgggaagattagaccaggtaacacttacaaggcacctagcagagttccctggcacagaataggaaggtgagtgtccattcttttttcttattggaagataacaaatagctgctactcaatgttatttacatctaaaattgtccaagaaagggaattcctggttaatcaaatattgatacttttaaaattactatgtgtttgtataatctgttaaggaattaaaaaataactcaacttgacatttgtgtatgtgtgtgtgtgtgtgtagcattctttgttgacttcggaataaatttcaagaacatcaagtatctccttacaataaaaatatagagtactagggaactgttttttttgtttttttttgtttttgacagtctcgctctgtcacccaggctggagtgcagtggtgctatctcagatcaccgcaacctccgcctcctgggttcaagcaattcttagtcctcagcctccccagtagctgggattacaggtgaactcttaatttttgtctttttagtagagacagggtttcatcatgttgcccaggctggtctcgagctcctgagctcaagcagtccacatgccttggcctcccaaagtgctgggattacaggcgtgagccactgcgcccggctgggaactgtcttcattggaatttcttcctgcttctgcaaacttgcagttcatatatatgaggttttttttttcttgttaatgttagtaaaaaatccatatgtagtaaactaaggggtctggtaggggcttctaggctccaaggagaggggagaaaaaagttctagaattctcaaggaagcaagcagcagcaaagtacaaaagcaggtggcccccttccttcttggccccgttgcagtatttcagatttcatttctggagcagatgaagggcaaaccttgatcatgagctttgcaaaagcttttcagtgaaattctagaccctccttggccctggtcaggatctagaagactatgtacctgcacgaacctcatgttgccttatgatcctaggaaataccactcaccaaatgttactgatgaaaacccatctgagtgccagctcataccagtttactctttgcatatatgctgatgaaggaaaaaggcattttttctaactattgtgaggccataggatgatagctagaaatgtggagcttttgctcattaaggttcaatgataaaatattttcgtatgttcaggggctgggagattttctaaatttccgtgaagaaaagtagtgaattcacctagaggcttggcagtcagacctctctgtaagttgttgttagatggggagagtcgctttggtggataaaaagtcatggtatcagcatttatacttaaggtgttttgtttcttgttatcaccctggcaacacggaaggaactctgggaactggcttcttttgctgtcatcccatatggaggtcaggcaataggtggtcctcatttcttgggtgcgaataaattttctgttgactacaaaagaagctttccgttctagaaaggggtgaaaaagattgagtttgcctacgagggcggagaagctgctgcacaatactaagctgtggctgatacaggatcctcttcaggctcacagcagacacggctagaccctgtagactactaaatagctaatcaaagaggatatttattggaaaggactgttcaatgtaaccttcaagtagaaaagtgctgccctagccttttttcactttaatttgtttcaatgctccttttcatggccaaattgaatatataaagtgagccttatacacatgctaatcactttattctgttgtggggtttttaagtgtggctctttgttttgcaaaggtgacagcctaatgtgtggaatgaagacgtgagccagatatgtatattccttatcaataatggagatatatgtgcttttgctcattcctgcttggctgaactacctctttgcttgttatttatctgatagagttgtcatttctctttcagaaacttttatgggatggaaaagagaaaaaagacttctaagtttggttattaaccatgtagatttttaaaatataactaccatgtgtgctttaattttgaccattatagtttttggctatcgaagactgtgatcgagactgatctaaggttaatctcttgtggccagagagatggactgaaggactcccaaggtcctcccacagccttgtggccctgtcttatttaagtaaacaaatacaagcatgtatagtacatgtgaaaatatacatatggctatatgtagatacagatgtagataaacaaatggcacaagaaaggataccaaaatgggatgattcctaattgggggacagagaggtacaaatgacagtaccttaaatactaaatactgtttcaaaggaaaaattaactcaattgctttagcacatcactttattttaaaagcaccaaattagttttagtctaatgccgactttcacttaatcataaattttggccttaattaaggcccacccaactaaggataagtttcttctttaataaagcattactcttgtgattaaaaggattctgtaattgtcaatgactgaagaaaatatttcataggaattttatatctttatttctacaaaatattattaacatatcaggtactttaatatggtttttgcattttacttatttataattctgttttaaaataggctgaaagatacagaactatgggccaggcgtggtggctcacgcatgtaatcccagcactttgggaggcctaggtgggcggatcacctgaggtcaagagttcgagaccagcctggccaacatggtgaaaccttgtctctactgaaaatacaaaaaaaattagctgggtgtggtggcacatgcctgtagtcgcagctactcagggaggctgaggcaaaagaattgcttgaacccaggaggcggaggttgcagtgagccaagatcgcgccattgcactccagcctgggcgacagagggagactacatctcaaaaaaaaaaaccacatagcactatgatttcaaaatgtcttgttctttgtgctacatttcaattttacttgctttgtaactgtaaggctgatgctctttaatttgatacatacctttcaattttataaacacatgttaaacacttttaggtgatagaagctataggagaagggtagaattggtcagagtctttatttgcacacttttatttgaaccagtttaaaattagtgtaaatgctgggccagcatgctcagttgtcacagaccccaacactccccatgcttcatacttgtgtattaccttcttggccacctctgtgagagactcacagaagggagatggatagaaacaaccacaagaaattctattgtgatctggtgacagatccttgcttcaatggcttaacctctaaggtgcggttggcagtatggggaggcaggaaggtatagtgtgcaggcccatagcaaggtgctgggcgcgaggacttgaatagtgacattaaggactcatttgcatcttggctttgctctggacaggccctgatgaaaacaaacaaaagggtcagtggcatcttactataaacttctctgttttttctttctttctttctttctttctttcttttttttttttttctttttctgtttttccttcctaataggtgaacacacaggatttcagaggattagtgcgggaggatgccgttctctacctgttagaaatccctaaaggtgaaatggtgaccattttagctcagagccgagccgatggtgagcaaatttggtcatttagtttagttggggtgggggtggggagtgggaaggatgagagaggtgtcttggtaccagaataggcaaatctgggtattaaaaaattgagatggatctcaacacctagtccttgggccctaggtgtgtgaagaaaatgtgagtgccgtttaactttccataaaaatgttttctatgcatgcactgaaataattttactagttgtgtcaatttggaataaaactgccttcctgaacagtgatgcagccttatgttctgcctggagttattagtgagtttacatacgacatgtgcaaaggccatggctgctggctggtgcgcctgttacccctgtccagtctgacaagttgtttcacctttccaggccttgttcccatctgttaagtgggtgttgagagtgtcctccttgtctgcttcagagcttgattggcaactgtgttaatgttctccagagaaacagaatgataggagatattggaatcaataggaaagaaagagatttattataaagaattggctcacataattatggagactggcaagtgccaagatctgcagtgaaaatgggcaagatagagactcaggagagccagtgatttagttctagtctcagtctgaaggcctgagaaccaggagagccaatggtgtagttccagtaccaagtcagggaaaagagctgatgtcgccttttgaaggccatcaggcaggaagagtagtttcctcctaattttttatttatttatttatttatttatttatttattattatttttttgagacggagtctggctttgtcgctgaggctggagtgcagtggagcaatcttggctcactgcaagctctgcctcccaggttcaccccattctcctgcctcagcctcccgagtagctgggactacaggcgcccaccaccacgcccggctaattttttgtatttttagtagagacggggtttcactgtgttagccaggatggtctcgatctcctgaccttgtgatccacccaccttggcctcccaaagtgctgggattataggcatgagccaccacgcccagcctagtttcctcttaattgagaaggggtctgattgtcattctcttcaggccctcaactgattggatgaggcccactcgcattggggagggcgatcttctttgctcagtctacccatttatacgtgactgtcattcaaaaacaccctcagagaaaggcatagaataaagtctgaccaaatacctggttatttcatggcccagtcaagttgaaataaaattaaccattgcagcaagccgtgaagctggttatttgtccttgttcctgttggagctgtgactcccataggacttgtgcactgaatggaaggaaggtaaaggggagatcagagataggagaagctgtgttgagtgtctagtactgtaacttgtactaagctgaatgcaacaaacgatgcttttgtctttcagtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcaggtaacagagatcgcattctcacataccccttttaatccttccccctgcagaaaactagagaccgccccccttcccccgtaaaaggaaaccccacatgatgagttcattacttgtcaccatctatttcttgtttatggagagtggcctgaactgtaaatagccaccagccagtttattgtgagtaaatttagcatcatgtggttggttgctgaatgtggctgtttgaacaacttcctaaggagcatccactgccttgtaccgtatacaagagatatactgaatggccgtagcacaccagcacacctcttagagacaaggtacccttgtccggtgcccagtctccatccttggagaggtttatgcaccccagtgaacacttggtgtttggctgacagtgcaggaacctagaaaagaggcctgtatttgagcaggagttccaggtgtgtgtactgtgtacctgcatatcagaatgggccaaatttcacatgtttattgctgagccacttctgggagatttcacagagacccagcctttttctgctcccatttggaagtgaaggtccccacatttcccaccctctgaaacttcttcattgtcaagcggaatcttctctgagctcagaagtaaaattgactggatttgattaatgaaatgcatgttagctgcgttttctggctttagagatttacttcccgtggtttcttctcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaaggtgaggaagtcacatggggcctggaaatgaactgactgggctctgagcctgttcacctttattttcagactgtatggtcaagttctaacttatgtatgtcagttatgccaaaggcagtttatagagttgaaatcaaattctaacaaggagcatgatttataaaaagctgtttcagttcctaaattgaggcttatttctgcaacttaaaaaatgttttaataccactgttcaagagtttcggtatattggctgggcactgtaccttatgcctataatcgtagcactttgggaggccaaggtgggaggatcacttgagctcagaagttcaagactagcctgggcaatatagtaagacctcatctctgcaaaaaataaaaaaagtttccatatattatcaatgggaaagtttgtgtttaaaaatggtgaggagctaggcagtgtagtcccagctactcaggaggcttgagcctaggagtttgagtttagtctgggcaacatagtgagatcttgtctcttaaaaaaaaatctaggttagcatgtggttgaatgaaaagaaaaaaattgttttaaatggtgaggatagtgaaggcatattcttcagaacagagccaagctgaattggggagaaaccacagtttctttcgtttagttatgttatcaaaagcccatacaatacttttactgcttatcataacagctaggcaagtgtgtatgctttaatggcctttcttgtcatttcagctggtttcaagagacctgtggtcttattcggccccatagctgatatagcaatggaaaaattggctaatgagttacctgactggtttcaaactgctagtaagtctgtcagtgtttttttttcccccaaatttttattttgaaaaatttctaacagaggagttggaagaatcatgaacacccacgtacccttcacctggaatcaccagttgctgacattttgtcacgcattttctctcacccactgcctgcaccatagacacacatacacacacacatacacatactctttgaaaaatttctgcagaatcatttataacactttatccctgaatacttgtgtgaatctcctaagaacaaggactttctcccacataactgcaataccattatcacagccaagaaaggtaacattgatgtggtgtgattttgtatatagtccattttccacgttttcttaattgtcctagttatgtgcttcatagcttttttttaaattcagaatacaaccaaggaccattcatgacatttgatttttatgtctttttgtgatttttatgtctttccagtcccctcttttttctaaataactttgttacactgatattttgaagaatccaagctagttgtctcctagaatgcttcctgttggactggcctaaccgtttcttcatgattagatttccactaagcaggttatgtgggtccttcccactgaatcttgttaggagacacttaatgtcaggtgtgccatcattgcttgatgctaggtgggagtatttggttgtcactgttttctaaacaattatttagcttcctgtttttgcttttgcagaaacggaaccaaaagatgcaggatctgagaaatccactggagtggtccggttaaataccgtgaggcaaattattgaacaggtgagaaaattcatccacagaccgtgttttcagaaagaattagattatggtttgctgcagtcacttttaggatagtatctgtacttttaatcattaaatgttaataataaaaaattggccgggcacagtggcttacacctgtaatcccaacactttgagaggctgaggcgggtggatcacctgaggtcaggagttcgagaccagcctggccaacatggtgaaaccctgtctctactaaaaatataaaaaattagccgggcacagtggcaggtacctgtagtcccagccactcaggaggctgaggcaggagaatcgcttgaactcaggaggcggagtttgcagtgagcggagattgcaccattgcactccagcctgggcgacgagtgaaactccatctcaaaaaaatatatatataatgtaaatgcaaaccgtttcactgtgtggaaaccagtcactgttggcagtgagcggagattgcaccattgcactccagcctgggcgacaagagtgaaactccatctcaaaaaaatatatatataatgtaaatgcaaaccatttcactgtgtggaaaccagtcactgttactgttctctggcagtaacatactgtttttttttccagagttcccagcattataccaaataatgtgttaattcattttatcagaagttctaacacattggtaatattgaagtgggcattaggtagaaggaaatgtgttctgcttcttgatttaaatttacaagataggtggctcatgcctgtaatcccagcactttgggaggcagaggcgggcggatcacctgaagtcaggagtttgggaccagcctggccaacatggtgaaaccctgtctctactaaaaatacaaaaattagctggccatggtggtggcgggcacctgtaatcccagctactcaggaggctgagacaggataattgcttgaacccgggaggcggaggtcgcagtgagccaagtttgtgccactgcactccagcctgggcaacagagcaagaatctatcccaaataagtaaacaaacaaacaaacaagatatatctcatacagcctttacttattaaaacaaagtatttgatgctatattactttatatatccatttctctaacttttccccttttgtaaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacaggtaagtgaaatgtaaatgtagtccctttgctaaaaaatgagaaataaagaattgaagagtagaagaaataattaattaatctgaatggagaatttgaaattgtgttcatgactccttgaaaaatagttaatcctataaaatgggatattaggccaatggcatttatatattgaactttgtaattttgtctatttgaaaatgaccataaagatccatgatgtggtaataattagctattttgatgaagttcatattttcctgtgagactataaggctagtgattgagccaggccaaacacctatgtctctctagagattgtgtcattgttctctactcaccatcaatacatgcattaacttacaaagcgaaaggaacttggtttcattatttaaaaatattcctgtccagcatggtggataacacttgtaatcctcccactttgggaggccaaggcaggaggatcacttgagcccaggggttggagaccagcctgagcaacatggtgagatcctgtctctactaaaaggcctagcatggtggtgcatgcctatggctgaggttggaggatcgcttgagccaggaattcaaagctgcagtgagctgtgatggcactgctgcactcctgcctggtgactgagtgagaccctgtctcttcaaagaaaaaaaaaaaaatctagaaacttggacactctgaatattggatgatttaaagatttattatttctctttgttaggtgtgataataatattgtgatttttttaaaaacaaagttctttgaggaatgcatactaaataaaatatttatggttgacctaatataatgttgagaatttgcctaaatagtctgcagtgaggggagtagatgggattatagacaggacaagactggccaagacttggtagttgttagttgttgaactggttgatatgtacatcggagttcattaaactgctatctgtacttttgtacatatttaaagatttacctaatagaatatatttttaagtccatgaaatgaagagccattgctattactcatgaaagtaaaatggtctaagaacatgacatattttagtaacaatatatgcactgtctatataaatgattaattctgtgcatatgagattattaagagttttaaagggttacataaattttgtggtcatgcagggcattattttgttggggcaacacgaggagactgcaaggatatgatatccttaggatgaggatagctcattgagttcattgcccatcatcatccacccatgtcattttagtgtatctctgatactggagaggaaggggtgaatgattgtgttcacattagatgcttgttttagtgtaacttggtttttcttgttaaagagaggtgcactacttgccactgtggccaaatggagagagtttaaccaaatgcagaggaggaagtggtccatcataaactagatttctgtgaatgtagtcttacgtactcatactcttggtatatttatgaatatcctttctgtcctttttactactagtattataattattatgattattactattatagcaacagtaaagagtggtacagccttccatgtgtgctgtcttattaggccataagaaaggccagcacttttgcataatcacaattctgatgtatgactgagcccagactaaactatagcgtccctaactgtccaatattgtacatatgttacagcacagacatattctaatcccaaaaggggtcacgtaatgcagcccttccttttgacagattaaaaaactgaagccaaagtgattataaatgaagttaaaactatccccactttattttcccccctgcttttgtctgagtacactaaatagcgagcgtcttccctcagagagttaaatttgggattcacgtgaggatgtaggaaatcgggaagggaattacagtgcattgtagaggaagaactaggctgaaggcggctggacgaggagagcagggcagaagaaggcagccagtgactgtggggctctcccttgatctaacctgagtccgcatcatttgctcttgggagcacaggccacggtagctggctgagtgtgagtaagaatctagaggggtccatgtgtgtagaaggggttagcaacacctctgttagctccatagatggatttcaagatccttgaaggcagagcctgaacatttcccagcgttgtgtgcctgaggccagcatcaggactagcacatgggcaaggcataaatgtttgtaacttacattagaactgcccctggcacaccaagccatttcttgcctaaactcatcaggaagttgaaagttttagaataactcaagtcagagattggaatggaagcacacactgtaagcattgagtttcatctaaaacattgaagtgatcttatctcaccagaaattgccaatctcttatgtagaattgtacagtcttcaggatagatggtgcagggtgtgcagcaactttgaccagcaagctccaattttctagcaagtggtcttttacagtactcttccagacttcaaagtttgactccctacagctgtgtggatgactgcactaataattgcttttattccccatctcaccctcgtccctcttagcttgaccaggttttgacttgaggctgtgtgccatgtccagaaacactagtctttacatttgagcagtagaatcttcaggcagaattagtattttatagtttttgtttgtttttgagacatagtctccctctgtcgcccaagctagagtgcagtggcacgatctcggttcactgcaacctctgcttcctgggctcaaggcaccttccctcctcagcctccccagtagctgggactacaggcacacaccaccatgcctgggtaatttttgtattttttctggcaacagggtttacccatgttgcccaagctggtctcaaacccctgggctcaagcaatctgcccgtgttggcctcctaaaatgctgggattacaggcatgagccaccgtgcctggcctattttgtaggcttttaaaatgattttaagtgtatggcatttttgtgagttagtagttgagaataatagagtgctttgatgaacacagtaatttgaagtcaagctttatgttgcattagtctctttaggctcaatatccttttgttttcctttttgcaaagtaataagaaagctcctcttcctcacgagtatttaattatgacaatatgaaaatagttctccttacaagtcttacagtacttctcagttaaacaagagaagctttattctgagatttgcccaaaggcaagttgacttgtcataataagtttaagtgttaggtttgcctcccctactaccaatttttaaaaattttctataaaatacatttgcatatcacaaatttttatttttaaaaaacaaactttgaattacatgttttcttggaatcttcaaagtactcagtgcatggttcgaagatcatttaagttgacttatggatttagagacccaagtggggctacccttttatgctaattatagaattttaattcctgatttctcaaaggattatatagactagctagttgaccacagaaaagagaaggaagatgctgggccccctagctggatacctttgctgttgcatgcccatttagagggggtctagcgtgccactgttaaccgagccacgtgaaaagctttattgagttttgacttagataccatataatccacccattgaaagtatatagttcagctgggcatggtggctcacgcctgtaaatcccagcacattgggaggccaaggtgggcaggtcacttgagctcaggagtttgagaccagcctgggcaacatgatgaaaccctgtctctattaaaaataaaaaaattagctgggtgtggtggtgggtgccggtagtcccagctacttgggaggctgaggtgggaggatcacttaagcccgggagctggaggttgcagtgagccgagattgcactacagcactccagcctgggcgacaatgagaccctgtctcaggaaaaaaaaaaaaaaaaaaaaaaagtatgcaattcagtgggctttagtatattcagagttgtacagctgtcatcacaaccaatcaatcttagaacatttttatcatccccaaaagataccccatacccattagcagtcattccccatttctccctttccctaaaccctctagtcttagatgttaccttttgctgtcgctcttggtgcttccaaacctccttggctggggagggggaggtagcactgaccatacatgtcagggctgggcacacgtgccctcagaacctcagtattcccaactaaggcagtggctgagtcagcatcctttcagtatttcactttcttgagctcaaaagatagagtaagtctatccaaggggatataggcataacccagaggttaggagcaacagataattaactactattgctctaaggcaaagaatctgagaagcggaatgagagaatccaataataagctaaaggtacttaattcagcagagtcaagggaaggcagcttcatgtctgtgcacctgcctgttaaaaagaggtcaagtgcatgagttggatgttacttttatatgcagcttaggaagttagctactgtgaagctctcaatttttattcataaacttgactgttaatgtgaattcagtaagagcttttgtgattttctttattttatcaaggggcaagaacatatttcctgcatctcacaaaatgccgttttaactttaggttttctttatgatgaatgcagaccatacttatctcagacagctgcaacataaagctttaaaagactgcttaacattttgtatatatttagtgtaaatcactcattttgtctctggggtacaaaatctcacttctatttttaagtatcatattttagctatgagatgagcacagtaatctttgcagagtaccataataggaatagagaagtccgtggaatcaaagttaattttcttcgggttgtctaatggatcagtttatttcagtgctgtaaataattaataaccaaggaaattgtaagctcattcaggattttctaaggtcactgttagaacttcttaaacagaagaaagctatgttacttggaggaaaacctgaagcatcattgcttacaaaatttgcttaatggttctttttggctttagaagtgatagtacaataagaggccatggcaatgtagtttaaaagaaatcctaatttacctgcagtctgataattttaggggtacaatttgttattttggactaacttgcttgtctaatttatctccattaggtccataatacatattgctgaagaaatgacatatgttgtactttgttggtattttatatctgtgctctaaatttctgtttttagatgggccatgtagtgtggtggctgagaccataggctctgaaagcagttttctgagcttgcatccaagcttcacacttgcttggtgtgtggccttgggctagttaatttcactactttaccttggtttctcatctataagatgggcatcatagcaacacctaccttgcaaagtttgtgtagtcgtgaaatgagctaatccaggtaaggtacttggaaagtaactggttgatgcatagtaagtgctattatgtaagatatactttgttctgagtagaaaatgtatattctttgaatacacactggttgggtttgtttaatctatatgtatattctaaaatgtgtaagtctatcaaagtgatatacagtcagctctccatgtctgtggtttccacattcatgaattcaactagccgtgtataggaaatatttgaggggtaaaatggatggttacatctaaacgtgcagggtttttttcttgtcattattccctaaacaatatagtataacaacgatttgcgtagcatttacattgtattaggaattataagtaatccagagatgatttaaagtatataagaggatgtacataagtcatatgcaaatactgtgtcattttgtatcagatactcggcatctgtggattttggtatccaagtggggggtgtcccggaaccaatcctctacagataccaagggacaactttatgtttaagtgttacttttagtattttattggaggtagccaatacagtatattagtgtatactaattagtgtatacacctcagcctcccagagtgctgagattacaggcatgagccaccacacctggccgaaaacacatgttcttaaaaacatttttaaaagttagcctttctgaaaataaacattctaaaaatctatttttagctttatcacatccacctataatgtgaactcaaacagctacatgattagtagttttaattgcattcattaaaagggttttaatattcaaagatgtgcaaacatcttcttgcgtctgccatagtcttaaatatcacagaaatgagtgtaaattatgtcaaatagcatccttaataaacatgcctctggaaattaatgcagacctttttgtttatatttctatagctacaatcaacctaaattcagccaatgatagctggtttggcagcttaaaggacactattcagcatcagcaaggagaagcggtttgggtctctgaaggaaaggtatgtggcatagatatgctgctatgaggtgagagtccctgttctgaaacttttctcaagagggcagtgaatgtagtcaagccatgcccatttgaagtgatgctcacatgtgtgctaatcaagtttgaaatttcgtaaattctctgaccaagtaataaaaatgaagggacttttaaaagaagagcagaatgtgacatgtgcagccctacattcacttccctttcacttttaatgtagtaactagtgttatattccaagtacactaatcagagcttacaagatctcatgctgagctccacagcttactaaggacgtgggaaacttagagtgcagatgagaggtgaggttgagcaacttggagaatacggctaaacattaataaaaagaaaagctaatggagttagaattacttagaaaataaggttggttgagaatgtgccatcgttctgggagtttgaatgggtgatatgagaacgttagggaatttgtctaggcctctagaattggatcgcttctccctcggggagatagctcacacacagctgtgctgcagggaggagagagggagattctattacctgtggccgcttttattttagaagcttttggtgttagtatcctgttcaccagctgaactgaggtagttttgtgagacttgacagtgactattttgttgcagaattgactaagttttgctctttgagaactagatgtgtagtcaaagtatctggcatctatggagtgcttccagtttggaagggggatgcaagcttccctggggaggacaggttgaacaggacatagcttctgcctttgagggtctgagaatcttgtagaggcatggatgtgagtgtagcacaaggcagcgtgcaatgtgttgatattactaggagagtggtaccaggagaacaggctgcagaggagctggattcagaagaaaagcaagacagactgagaaagtgtggcttagccgcggtatggaggatggatggtagcacagataggctgcagggcccctaatttgagttcctgcacaaaaacgaccataatatcaacattgtaccaaagccaagtgatctcagggagaaaaataaaagatgccttccctggcgagcacatcaaggtttcagtcgcttggctgtgtccttgggaattttcttgagtccccactcccaggagccacatcagaccccactgaccgtccaacacaaattcctctagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggaggtgaggcgaggcaggccacgggcaggaacaggagagcctggtgttttccttgcactctcgtggacagctgtgtgttcagggtgctgtggaaggcattcctaagggttggagcagatgacttccagggagtctctcgctttgagtccacgctggcatggttgcagtctgtgggaaagtggggcaggcaggtggacttcagaagagcttgaggggtcagcactccgcacacccatgccctcaggtgcgatggataaacagaatggctttaggtgccgtctgtccaaattaccagcggaaccttccttcccatgcagtattgttgtatgtacttgtaacctttgattaggtttctctctgtactcttagatgtccttgcttttcttccccatcctgcctttaacctttctaatcttgccaaagctcttgagtgtttccccatcagtttccttctctcttatatttcagttttttaattgagttcatgatcaaaccttcatctgatcacatcacatgtactgtgcatccactgtgattagatagcttatgggatccttgaaatcacattgacaggcactgtaaagtcacagccaagttagcaattattagttgcacctcagagaatgttggaataatgatctttgaagatgggattgttcatatatttggataattattgctgtggatttctctctagcattttagctcattccagtaaatgatttttttctttatgaaatagaactaccaaaaaaaaaaaaaaaaaaaagttcaacaacaacaaactgaagggggagaaaaatacaccattaccacagcaacaaattagtttatgctagacaacttgtaaagaataaattaacttccaaatgcctatagacatggatattagtgacacaagagattttagacttttggagggttcttaaaaaattgtgctttaaaggaagagactctacattggatgcagccagtttttaaaaatgtgtctgaagcatttggtgatggtttctgcctgttcagtaaagaagcaccggctcagaacctcaacttctggacttactcaagtttgcagaactcctccaaagcagtcgagtgctctgttctctctgcttggatgttcttgttgtgaatgaacctttatgtcttgtagagcataaggaaacccagcccagagccacgagctcagatgaggagggctgctagcagcgatcaacttagggacaatagcccgcccccagcattcaagccagagccgcccaaggtacgtggctgggaagcccaggatgggaaggaagaggaagcagatgcctctgaagcctcctggacggccagggaggagcatgcacactgagatggtgtttaattacggttctgactcactgtgttctctattagagcctatcttttggcctgttgggtgaactcccaaattagggaagggcaaaaaggaaggaaaggcaatattaggagagcatatgattttaggactgttagtgtttatttaatttactcttcttgttaaaaaaagattgtaaagaaaaagattgaaaaatactgtactgtatacccagaatcaccaatcgcagaacgtgtttttcttttgctgtccagctaaagttttctgcccagtctgatttagatgcaccagataattcttactggtgatgtgctaaagagaataatcatcaccactgcttacaatgcctctcattaagagagctgcttatttgtttaataaatcattatccagagcagaatcaatataaagacacaagggcttatatcaaaagattatttacctttagtcagaatcagagctgtgactctatgtttttccttataccagaataaaacctatttaactcaataatttattatttattattactattttttgagacagagtctcactctgttgcccaggctggagtgcagtggtgcaatctcggctcactgcaacctccacctcctgggttcaagtgattctcctgcctcagcctcccgagtagctgggacttagaggtgtgcaccactatattcagctaatttttgtatttttagtagagatggggtttcgacatgttggccaggctggtctcgaactcctggcctcaggtgatccacccacttcggcctcccacagtgctgggattacaggcgtgagccactgcgcccagcctaactcaataatttagatgagaagaaagccataattgattgtgtgagccatcagaagtagtaaatgtgataggtactaagtaataataagtgacctcataaaatacatcagcgaaaatttgcaagccgggcaagactggaagtgtgaaggaaaagtggctgttagcgtgaagcagtgctctcctcgctccccaccccagtctcattcctcagctggacatgggtctcacctgggccggctcatgtaccctcagtgcagcagtgacctcagaagcccactcttcgagtcccaaagcctgaattgttctgagatcttctccaagatgctgatctcctctagaacaaaattattccaggtctgatcttacctccagcaatcacagccctcccagcactttccctattcctttttggcttcctgacattcctaatagactagtataggaagggaggtagggctcaggaagcctggccagtggctgtttgccctgctgtattacattccttgtcagaatggtatttgtggaccacctttggaaactgatcaggaaatggagtgtattaaatcactaatatagatttgaaaataaacttaaaagcccagggtgaaaacgtgtcattgctctccgcaggccaaaacccagaacaaagaagaatcctatgacttctccaaatcctatgaatataagtcaaacccctctgccgttgctggtaatgaaactcctggggcatctaccaaaggttatcctcctcctgttgcagcaaaacctacctttgggcggtctatactgaagccctccactcccatccctcctcaagagggtgaggaggtgggagagagcagtgaggagcaagataatgctcccaaatcagtcctgggcaaagtcaaaatatttgagaagatggatcacaaggccaggttacagagaatgcaggagctccaggaagcacagaatgcaagggtaattgtttttaaactacacatcatcaataagagttttaaataagtttgatttcaacataacagcgaacagcccctttgctgctgctgcagatgtggcagggatgcactgcaccaaaggcaggtgctgtgtatgtcacttcagattgccagctcccagcacgtcccttgttcttccaaagaagaaaacttgacaatataggggaagaagattctgctctttatacacagaactttgtatagagttctggaatgaggaagtgtgaggagggaatcagtgcctctcggaagtcgttttaattagaatgtgatttttttttcttaaacgtgtcttcattggctcccagatttgccgtagaaaccaagcaaactgggtgctaaaacagaaaggcccatagattgtactttttgagctgtttgaatttgtataccatatgcacatagaacttttcaaacaaagaagaatttaactaaaggtctgtggagtatatttgcccagtagatgtgggagttttctttcaggtctagcacaacagcagcagtacatctgagcatttttcttttcttgtcgtaaaatatacataacataaaatttaccatttcaaccacttttttcttttatttattttgttttgttttgttttgttttgagacagggtctccctctgtcaccccggctggagtgtagcagtgtgatcacagctcgcagcagcctccacctctcaggctcaggagatactcccacctcagcctcctgaatagctgtaaccacaggcacatgccactgcacccagctaatttttcgtattttttgaagagacaaggttttgtcatgttgctaggctggtctcgaactcctgggctcaagcaatgcaccctcctcagcctcccaaagtgctaggattacaatcatgagtcactgcacccagcctcaaccattttaaaacgttcggttcagcggcattaagtaccttcacattgctgttcagccatcaccaccatccatccccaaaacttttttatccttcccacgtgaaactccgtacccataaaatactaactcaccactctcctctccccgcagtccctggcacccactcctttactttctgttttttgtgaattggacagtgtaggaacctcctataagtagaatcatacactatttgtctttttgtgattggcttatttcccttagcatgatgtcctcaaggttcatccaggttgtagcatgtgtcagagtttcattccttttaaatagttttcctgtctgacgtgtaccgcacataaccatggaaatgaggaggccgcttctgtgtttcctcttcttgaaatgggatgggaaaataagtaggatatggggaaagggtgggaccagcaggaaaccagcaagcagagtgcccagtggttcattctttcactcttattcttttcttttttaattaccacagatcgaaattgcccagaagcatcctgatatctatgcagttccaatcaaaacgcacaagccagaccctggcacgccccagcacacgaggtaagggctgcctagtgggtacaggtctaaggcggggacttctcaaggactgggacttgaagaaagaatttcctttacccaaatttcagagtaacaggaggattttttccccacagattgactgtttgccttactcattccatcaaatttaattgtaaagattacagagtcaaaacttaagcatagtttgcttgtgtgctaaaactctgacaaagtgtaatcattgatgtttccagccagtacatttgacacattggagcctggttatgttacattgcacatggttagcacatgagcagaattcctacggcttagacctgttttgtcttgtttgctgactctcagccaaacttcttaattcctttgcatcatccagcaaagtcagaccgcttgtgctgccctggggtctaaagggaccgtgacaagcaaatgagcagtcttggtaaatgccacacaaacagtaggaatgttcacagtgtcttcctgttgaagttttatactggattgcttcctgcttccgagaatagaaaaaaaaaagtcacattttcttgtggccattcttttgttttttttggagacagagtgactgtcgcccaggctgaagtgcactggtgcaatctcagctcactgcaacctccgtctctcaggttcaagcgattctcgtgcctcagcctcccgggtagctgggattacaggtgtgtgccaccatatccagctagtttttgtatttttaatagagacagggtttcaccatgttggccaggctggtctcaaactcctgacctccgcccgcctcggcctcccaaagtgctaggattacaggtgtgaaccactgtacccagcctcttgtggccattctgactggaagctgaagtctagttttccagtgatagaaaactggaaacaaatttcttctttaccagctgagtggtaacacagtcaaccaggttgcctctggcaacaaagagttcttggttatgatggactgaaactggcagagacctcgctgctgggtgagactagccagggagcttaggggtaaggagggcaccccctgtccaacagggagattcttaggtcagggagcacctggctggcttcctcactcaccgccgaagtgggcattggatttgacctattacgaacctggagcaggaccagggatgccctggttgctctgcagaatgtggctcagaggtaagtgatctgctcgggatacccagtcactgtgctcagagccatgcctccccgggcagccggaggacatggatgtgctctggaatgtctttaacaccctttttttgttagttccagaccccctgagccacagaaagctccttccagaccttatcaggataccagaggaagttatggcagtgatgccgaggaggaggagtaccgccagcagctgtcagaacactccaagcgcggttactatggccagtctgcccgataccgggacacagaattatagatgtctgagcacggactctcccaggcctgcctgcatggcatcagactagccactcctgccaggccgccgggatggttcttctccagttagaatgcaccatggagacgtggtgggactccagctcgtgtgtcctcatggagaacccaggggacagctggtgcaaattcagaactgagggctctgtttgtgggactgggttagaggagtctgtggctttttgttcagaattaagcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaaagcagatacttgaggaaaacactatttccaaaagcacatgtattgacaacagttttataatttaataaaaaggaatacattgcaatccgtaatttt

SEQ ID NO: 429 - DNA, 81154 bp, Homo sapiens; identical to SEQ ID NO: 428

SEQ ID NO: 430 - DNA, 50198 bp, Homo sapiens
atatggatgtgtcactgtgtgagatgacaacaggatttgctggaaatgtgggccactattgtatccgccttacgtaaccacatggagtgatggaaatgggtgagcagcccggaatgtaggcggtggcctggcccatgcatctccagagaccatgaagactgctcaagccctacataggatgtggatccaggctgttaaaaagttgaggagatggaaaggccgtgtgagtccctctgcaagctctccccttgttttccccaacctttcttcatgggaaggggagggaagcaaaaccattctcacagtgagtcctttatcctcagattgatttgtgcttctggcatctttcagcaacaaattgtgagattgtaggttgtagtcactggtgggtttttaaaaatacttgtattaattttagcagatctatgtgaaactgatagcctcttactggatctgtggatcaaaggctgctgttttccatgtgctaggaatctgtaatggttttgcttcctgggtagagcttaacatactggcttttgtgtttgttcatgtttgagaatttcttgttttgggataaaactttttgctttcttacactgcagaaatctatattcttattatgtctaggcttctaacttagaagaaaaagtgtttttcacatgttcttttttcctcttacagtttgaacatgtgtgagtgtttactttgatggcttgagacttttatgaagcatgtcccttacgtggacagcttgcgattaatctttggttttagctttgacctccatcactgggcagcagcagtctgtggatacagaatctaaaagccgcctgttcagggggactttgggcagtgaacacttcggtatctgttttggggttggcttttaacatgtttctacattctttatgtaaaatatataggatttttacctatctggccaagatttttcaaaggaaaaaagctttataaaaagattaaaaaaaaacacaataagtaactatttgccttagttcctttctcttcttttgtcacacaaaaaccttactgttaatgcattaagttttttgtttatggtagaaaagttagctcacttttaactttccatgaggtcttaagaatgacctgttagatataaagggggttgtcatgaacactacttacgtgaaaagtaaaagtgataaggaaagatgatgaaagcacattgaagatcctcctaatggatagaatgttgacacttggattaaaaaggtgacttggcgttttctgcatacacctccccccacaactccccagacctaacctgcgtccccactctgcccaccgcacctgccttgctttaccctctttgcccctttcaaattactggtaccatccttcaactcgccctccttccagttgaaattattatcccctcttcactttgcaaaattctaactgcattgaaaaatttgctgttaaatatactcgtacctcttgggtattagatccttcaccaggagtcagtattcattttggtgttcacccactcatctccctattttttatttatttatttatttatttaatttttttatttctttttgagacggagtcttgctctgttgcccaggctggagtgcagtggcgcgatttcggctcactgcaagctccacctcccgggttcgagccattctcctgcctcagcctcccgagtagctgggactacaggtgcctgccaccacacctggctaattttttgtatttttagtagagatggggtttaaccatgttagtcagtatggtcttgatctcctgacctcgtgatccacccgcctcggcctcccaaagtgctgggattacaggcgcgagccatcgcgcccggcctcatctccctattttttaaacttatgaaatgtttggtaccataaaagaattaaatatctaaatcatggagcataataattaaacaaatgccatgagcccattacacatatctgcagaccatcaccaagacaaaacacgaaggaaatttgtgtacctcccaccatactctgcctcctgcccaggtcacctcatcctgaatgttatgtttttcatttccttgctttttctttatatttccactgcatgcgtgcgtacacacacacacgcccctaaacaatagattaattttgttggcaattttttactatagtgaaaaacgcataccaaaatttactgtctgtaccatttgtaaatgtacagttcagtagtgttaagtatattcaagttgttgtaaaacattgttttttgagctatataaaaatggtatcacactctacaaatccttctggggtgtttttttgctcaactttatgtttgagatgcatcccttttgtggtggtctatgtgactggtttgttcgtcttcattgcagtaaaacattgtattttaataatgtatcaatttgtccatcctgcccttgagagatactgggatattttccaagttttggctgttgggaacattgctgctgtgaatactctatacatgtgtccttgtgcatttagtcacacggttctcccggtgcctctgcccaggtagaggaatcactgggtcgtggaatgtgcatacctttaattctgatatatgcgtgctctttctatgggcctgcctgtaaagctccccctggtgctaagcagctacctgctgtcattcagagagaggtcagatattgctagcaagtctgatctgcgcatagccaagcacaaggtggtgggtgggaccagagcccggtggcctagtttgaatgtcaggaccacagctctcagctaagctgctgcaccctggcagcctgtgcccagggatgttcctagagctgatgttctgaggaataaggatgattatgtggggtgctctgtgtttctgaaaaattatataaatgaggcaggaaagacactcagtagtttgctctttgggtacacttgtagttagttggtaagctgcccaagggctttggcgattttattcactgatgtctctgaagtgccacaaaccacttgcttggcagaaggtggatgcttaataaatgtttttgcataaatgaacaaatgagtgcacagtgaagagttttctgtgagaccttcccaaaaagtcacagttctgtaggctaaatatacatagttatggtgtatttttaatgttcaacagagctactaaaatttatttttgctctagttcccttcctttacaattaagattttctctttatcacttggcttagcagagcatatattctttgaatattatgttaagtagctaatagttaattttattacccgttaaccataggtaagaagaagcctcgcaatctgattggtttcaggcaccaggcaagttaatagcaaggtctgattggtggtggtagtggtaggagattaatcgtctctctgacaaatttaatttaaattacgcttgcaggcatcacaggacacttaaagatggtagcatcccattattgaagggctgtgaatttcaaaagccagattcattctacttgagccacatttaaaaaataaaattttgcaggaactcatttatttggctaaatgataaacaaatttaaatccaaaactttgaagagtttatagttttaaattccaaaatagaaatgtattttaaaagtaatgtactcataaaaatattctctataatagcacagctccttgggatattcaacatttttttggtatgtagcattgcccaatcctggggatgattgtcatagtcccagttagttttttttcctgataattttaaagtaagttttgtggggaggatgtcatgtaattttttttcccccttaattcatggggctataactatatccaaagaagagttggcaaatatatttattttaccacaacttctagattaattcactttgttgaaatttgacagctttaaggtacaagaaggcattgagaagatgagcttggagaagtgggcatgctcataaggtcatttctgggtggtagtggcttagttttactaaggccacatctaaaactgaagttggcaaggagttagtaaggtgttctatggaaatggaaaagggcaaccaattctgacttactgcaggagttcagttgagtgtctgctttctttttcttttctttctttattttttttgagacagagtctcactctggagtgcagtggcgcaatctcagctcattgcaacctccacctcccaggttcaagtgattctcttgcttcagcctcccaagtagctgggactacagatatgcgccaccacgcccggctaattttttgtgtttttggtagagatagggtttcaccatgttggccaggctggtcttgaactcctggccccaagtgatccacctgccttggcctcccaaagtgttgggattataggcgtgaaccatcacgcccgacccggtttctgctttctgtttccatttaagaaaactttttggccgggcgtagtggctcacacctgtaatcccagcgctttgggaggccgaggtgggcggatcatctaaggttgggagtttgagaccagcctgaccagcatggtgaaaccctgtctctactaaaaatacaaaaattagctgggtgtggtggcgcatgcctgtaatcccaactactcgggaggctgaggcaggagaatcgctagaacccaggaggcggaggttgcagtgagcccagatcgtgccattgcactccagcctgggctggagcaaaactccatctcaaaaaaaaaaaacaaaaaaactttttaacaaatatgtacaacttcattaaaatattggaaaatttattgtgcttccacatattggaaaatgctgttttagacacatgcagaattccagagaggtatggctatagagcacatctagaaagtcagaccatgagcacctgagtttttagttcacccacctcacgtatgctatcaaagaagcagagagccacgaatttgatacaaactttctttaagaaaatttgtaggctgggcacggtgtctcacacctgtaatcccggcattttgggaggctaaggcaggcggaccatttgaggtcaggagtttgagatgagcctggccaacatggtgaaaccgtgtctctaccaaaaatacaaaaaaatgagctgggtgtggtggcgcacaactgtaatcccagctactcgggaggctgaggtatgcgaatcacttgaacccaggaggcagaggttgcagtgaacctagatcacacccctgcattccagcctgggtgacagagtgagaccccgtccccccccccccccaaaaaaaaaaaaagtagcagcagtcagtgcttcagttatattaattgaatgatgaatgaatagtgtatccatctctagatgtattaaaaagaaaaaactttgagtgcctactctgtgtgccagacactgttgtagcagataatgggacaaagatgagtaggatacaaaaatttcacctgaaaattcacttttattttttaaaattgaagaacagtcgtcacagtgaacagactttaagtaattggggagttttacataatttagataataatcttttggaatgtttacatatttccttgtgttgatgggccttcatttaatctaaatcttgcacttttgggctgcttgcgtccctggcaccccaggccccattcaccacccagtcccaggattgctggtagcacagatctcttcttctggcctttttcaggtattttgagttctttttttttttttttttttttcttattaaatatacagatggggtctcactatgttgctcaggttggtcgtaaactcctgcactcaactgatcaccccgcctcagcctcctgagtagctgggactatggcatgtgccaccatgcctggctaactttaaaaattttttgtagagatggggtctcactatgttgcacaggctgcccttgaactcctaggctcaagcgatcctctcgcttcagcctgagtgctggaaatacagacgtgagccactgcacccagccctcttctaatttcttaaaacataaacacatagtccgggtggcttggtggctcatgcctgtaatcccagcactttgggaggccgaggcaggtggatcacaaggtcaggagtttgagaccagcctgatcaacatggtgaagccccatctctactaaaatacaaaaattagccgggcgtggtagtgcgcacctgtaatcctagctacccaggagactgagtcaggagaatcgcttgaacctgggaggcggaggttgcagtgagtgaagatcacgccactgtactccagcctgggcgacagaacgagactccgtctcaaacaaaacaaaacaaaacaaaaaaccaacatatacacatattatagatactccatttttgtctgtggctggtatttcaaatatttaaagtctttgattcttcagtttatgtttcttttacctctcactcatggtgatgtgcatgtttaaattgtgggctcatttccttggatacatactatctggggaatctttgagggctgtgtttgagtgtgatctctggagaggattcgcatctgcctctgtgtacttggtggtatggccagtgcagagccccagtaggcatgagtgtttggcagggtgtggtcacgtctgtaatatgaacgcccaaacctgtgtgaatacaggtctgttgatagaaattctccagggttttatttttagttatttccactctacccatagccaaggatgagacagtcactgcatctccatctgtgtgctggtatttttttcccctaatagatccacccagacctgatctcccaccctgtttggatccccagcctcctctaaatgcctgcttcagtgctggcttatctctgtggttctgagtgttcttggcatttctagctttctcacaggcagcctgcatttaatggattattatttttaaaatgataccaccagttgtagttttttctggatacctactttggaatattgtcagagatggaagtcccagtggtctatttatgaagacattcatctttcatactcagtgatacagatggagaaaaagccgaaagatcccgcagatcacccaattgggcataccctatgataaggctaaggatatttttagacataaacatgcagaaaacttgcctacgaggtcacctttgacaggaagagggggagaatgattttaaaaaaagaatctatttgaaactagatatttttaaaggggttttatgatgataatgttttggaatagtgataataaaaggactcagcacttaacattccattctttttagggtctgtctctcactatgtatttcacttacctttcaagtattgtttctagtttcatttcattgaaggagagtgtgtttgaaaataggtagcataatgaacagatattaactcttttttggtatagaaagtgtgagctggactttatgtcgaggcattttgaatgataattttatttctagcattgaaaaggttgtggttttcatcagattggttttgttcttttaaaacaggccccaggcatggaagagctgatatgggaacagtacactgtgaccctacaaaaggtgagttctgcacatttcatatattctacagtcatgttcttgattttacggatcatggatcttatttattttcacctacacacagttttggctttttttttcccttgaggtacataatgtattatagatactaactggcaataattgctatgttaacaaagatttgcatgctattgtattttttgattaaggactgtttagtatggaacattttagaggttatttagtgtatactcttatctccagctagaacaggttatgaaagagagaaaagaaagggaagaatgaaaatgacctgtactgtttaaggatgtggagggagctttttacaacttctgtaattttaattatgacatattatacataccttataactcttaaaaagtgtagcatccaagagactgtaagtcatttgtgtgaggctgagctggagaactgcactcgtggttctgcatttttttttttttttttttttttttgagacggaattgcactcttgtcgcccaggctggagtacggtggtgcaatttcggctcagcgcaacctccgcctcccgggttcaagcaattttcctgcctcagcctcccaagtagctgggattacaggcgcctatcaccacgcccggctaattttgtatttttaatagagacggggtttctccatgttggtcaggctggtctcgaactcctgacctcaggtgatccacccaccttggcccgcaaagtgctgggttgcaggcgtgagccaccgtgcccagacggttccgcatttttattccgtcaagctgccttccggtcatcatcactgtgattttcctggtttttctgcagggtttcttcttctggctctgaattcctccaaggtctgacatctcctagagggaccataagttcctcataggaagagttttcctttgaccctcagaactgtgagcttcaagctttgtcttctatgaaaattaaagacattcccgaatttaatgtttgttgaattaatccaggtagaaaaaaatgtctctgggccagtgcccaggtacccagacttccagatcagtaatcacaatttcctcatttgaggggttttgtctgcttaggtcttatttttcaactttcctcgtctttctgactctcctctgccctttccctgagcatttcatgcattccttgagttgtggacccaaaattggcagaggtcagagatttttttaggcttggcatagaggatggagctgcctctgtctaaaaccaggtgccggctggtggtgctgccaaattcaaagccatgtgattaatagacaacacccccaacctgttttgagtttgtaattgtgtataatcagtcagcatagtgggcctcacgtgggaaactttccttggaaaggaagattttcttttagtctcggagtaaatttttatataatcgaacccagatttaagaatatacagtcaaatatactcatattatctggatgaaactgggcttagatacatatatatatttttgaaatggagtctcattcagttgcccaggctggagtgtaattgcatgatctcagctcactgcaaccttcacctcctaggttcaagtgattttcctgctccagcctcctaagtagctgggattacaggggtgtgccaccacacctggctaatttttgtatttttagtagagatggggttttgccatgttggccaggctgatctcgaactcctggactcaagcaattcacccgccttggcctcccgaagtgctgggattacaggtgtgagccaccgcacctggcccagacttagctttttaaaacacaaatgaattaggattatgtattatctatgctcaccattgtgcattgctagactgatcatggatgtaataaatcttatttccgatcttccatgcatgaagaaaagggtttagtgctttgcttttcatgagatctcaacacatattttacgttcaaattttatctttaaaatccagttacgggccgggcgcagtagctcacgcctgtaatccccacactttgggaggcagagacaggtggatcacaaggtcaggagatcgagaccatcctggccaacatggtgaaaccctccctgtctctctactaaaaatacaaaaattagctgggtgtggtggcacatgcctgtagtcccagctactcaggaggctgaggcaggagaatcacttgaacctaggaggcaggggttgcagtgagccagcaccactgcactccagcctggcaacagagcaagactccatctcaaaaaaaaaaaaaacaaacaaatccatttacttctttttcactgtatgttgaaatgaaactaccaacacatctactttgaagttaaaggtatactttaaaaatataattttaggcagacataagaaagaacgaaatatgtcctttgcagcaacacgaatgtacctggaggccattatcctaagcaaattaatgctgaaacagaaaaccaaatactgcatgttctcacttagaagtgggagctaaacattgggtacacacagacacaaggacaggaacagtaaacactgggaattccaaaagtacggagggagggagaggagcaaagtttgaaaaactacttcttgggtactgtgttcggtacttgagtgacaggatcattagaagcccaaacctcagcatcagacaatacacatatataacaaacctgcacatgtactcctgaatctaaaataaaaataaaattaaaaaggattggctagcactgggaagagcagtcttttcccgcccagctagaaagttgtggttttttttttttgttttttagagacttctccatttgcccaatttaaagtgcaaaagctgccttggcttgttgaagccttgacctcacaggctcaggtgattctcccacctcagcctcccaagtatctgggactatggatgtgcaccaccatgaccagctatttttttctatttctagtaaagacagggttttgccatgttgtccaggctggtcttgagctgctggactcaagcaatctgcctgcattggcctcccaaagtgctgggattatagacatgagccatgagcctaggcagaaggtttttttttttttaatatgtcaaaacatcacaatatacagaagaattaaaaatatttacagtacaggccaggcacaatggctgtctgttgtaatcccagtgctttgggaggttgagacaggaggctcatttgagcccagaaatttgaggctgtagtgagtagtgatcacaccgctgcactccagcctagcaacagatcaaaactctgtctcttaaaaaacaaatacaataaggaaatctgaaaattaaaaaatacagttttagtacaggttcagtttttactgaagttgttccagctcgggccagcatgatgcaaagaggtacaactggtgcttcaaacagtacgtccctatttggactgaagacattgtttcctatcccggccagcttctagtgataactccagtctgcactatcaatcttttccagcctctacaggctgtttctttcagataaggaatttccctttataaacctgtcagctgacaatgactatgctttgttttgtttctcatttgtttctgtaagcccatctgttcctgaacagtctctggttattgatttgacctttattttattgagtgcttgtaataaatcctgaaagccacttattgaaggatttttaatatttctcctctctgatgtacaggattccaaaagaggatttggaattgcagtgtccggaggcagagacaacccccactttgaaaatggagaaacgtcaattgtcatttctgatgtgctcccgggtgggcctgctgatgggctgctccagtgagtgtcctccctcgctccgcagcccctaccagccctactggttggccctagacggggtattttggttggtgtccactttatttaaaaaaaagaaaaaaataacaaacttttatataatatttgaaaagtcttcaagctggaatggaagccataacacaccatgtttgaataatgcccaaaccttgggaacaccccagctttggagcgaggagggcagttgtttccgtaagaagatagttccaaacatccctcctaggtttaggaatcatttctgaacatggagttttaaattggcatgcttctcaaccccgatgcttaaccaacactgtttatgtttgttttaatttatattctttaagaatttaatgaggagactttggtttattgattatcttatttgtaagagtgatgtggaagttgggacaatttactataggaaaaccacaagttttccaactgccagctttctgacctgaagaagtaacaccattttattttaatttttaataaattttttcttttctttttttttttttttttcagacagagtcttgctctgtcacccagtctggattgcagtggtgcgatctcagctcactgcaaccatcaccttccgagttcaagcaattctcttctgcctcagccacctgagtagctgggattacaggtgcctgccaccactcccagctaatttttgtatttttagtagagacgggttttcgccatgttggctaggctggtgtcaaactcctgacctgaagtgatctgcccacctcggcctcccaaagtgctgggattacaggcatgagccaccatacccagctggtaacaccattttacatgatacatgcctgattcccacaggataacttctcaggacgaagtctaaagttaactgtatggctgcattggataaatagctcaaaagtttaggttttgttggtgtttaaagcctctgtgaactaagcacagtggctcacgcctataatcctgcactttgggaggctgaggtggcaggaacgcttgaggccaggtgttcaagatcagcctgggcaacctagtgagaccctgttgggatggcatgtacctactcgggtcccagctacttgggaggctaaggtgagagaatcctttgagctcgggaagttgaggttgcggtgagctatcatcagtcacactactgcagtccttcctgggtgagagagggaaaccatgcctcttaaaaaataaaattatagttaagaaagtctctatagttttatcaaagttagtagtctttcatatggagaaatgcaaaattttaaagtaatatttgggatgaactggaacaataggattctgtgatctcaaaatttcttaagaatccaaggcaagcccttttcctgcacaaaagcacaaatggatatacacctacttggaaggagtgtttttagacttttctgaagcccaccgtgcacctcaggcaataggggactgatagagaaattccttttgtgtccagacctcaccgtcatcaagtacctcctggtgtgatgctgtggtttggggagatcaggcctctctcttcccagatgatttccatttagacactcagaattgagctgtatggcccccagttcctttctttggaagatctcaggccaagttgactgggccttgggcgccactagacactgagccctttagaaagcctttcaggtctatttgctgcttctatttgttcctaaataaataatttacaatgaatagatgggagtttttcatgacccatttttatttcttgtttacagagaaaatgacagagtggtcatggtcaatggcacccccatggaggatgtgcttcattcgtttgcagttcagcagctcagaaaaagtgggaaggtcgctgctattgtaagtactgggtttgctttcagcttgccttaatagcattttggttttttgcccagaagaaaattaccccttgcttttaagcatttgacagaattacataacctagggaccgctgttcttggatcctcagtacttttggaggggtgtgaagatatgtgtaagttatcttcctacttttccttgtgtcttctcctgaggccagtgattctctgatctgagttagtttgccttaggaaccaagttaggcaattattccctaagagaattagctagattcagaatactggtaaaatagtattaatttagaaaaaaactttcagctcaaaaactcacttgtaaaggcccaagcaaggtatattatatcttcatagactaagagtttcattagaagactgtctataatcttcattcatctattccttcattcattcactggctgagaatcaactgtgagctggatgccattaggccctggggccaatctgtgttgcaagatgtgttcactccagtggggcaggtagacacacacagtgagaatggtaataaagtgtgcttaggggcaatgctagtaggcatatacccacatatatggttgtgtgtgtgtgtgtgtattttttttttttttttgagacagagttttgctcttgttgcccaggctggagtgcaatggcacgatcttggctgaccacaatctccgcctcctgggttcaagcgattctcctgcctcagcctcccgagtagctgggattacaggcatgcaccaccacacctgtctaattttgtatttttagtagagacggggtttcaccatgttggtcaggctggtcccgaactcccaacttcaggtgatccgccagccttggcctcccaaagtgctgggattacaggcgtgagccacctcacccggccacatatatggtatttaatgtttttcaactttatattatgaagattttcaaagaaaaaggaaagttgaaagatcagtgtaataaacatttatcttctaaaatattactattctgccatctttacttggtctctgtatgtatataaacactcatgtctttctgggcaaccatgcgaaggaaagttacagacatgacagttcatttctacttacttcacatgcatttcctatgaatgaggacattcatctatataatactattatccgatctaagaaaagtaataattttacagtattatctaaaatccagtccatatctcaagatgtctttttcatttttagagatgggatcttgttgtgtttcccaggctgatcttgatctcctgggttcaagcgatccttccacctcagcctcccaaggtgctgggattacaggtgtgagccaccatacgcagctctcaaaatgtctttgatatatgttttcttccctatccaggatccaaagttcactcattgcatttaatcattatctctttagttccttttaatctagaagggttcctctttccccttgcccctctaccccaccccccactttaaaaatggcattgggccaggttcagtggttcacgccagcactttgggagatggaggcaggcagatcacctgaggtcaggagttcgagaccagcctggccaacatggtgaaaccccgtctctactaaaaatacaaaaattagccaggcatggtggtgtgcgcctgtaatcccagctatcgggagggtgaggcacgagaatcgcttgaacctgggaggcggaggttgcagtgagctgagtacagtccagcctgggcaacagagcgagactttgtcttaataataaattaaataaataaataaataaggcattgacttttcttccttaaaattttaaaaatttatgcataatgcatagttatagggtatgtgtgattaatttaatacattaatatgatttgtaaaattcagatgagattgggcacgttcaggatggtatggctgtagacatgatttgtaaaattcaaatcagtgtatttggaatatccatcaccttaaataattgtcttttctttatggtagaaacgttcagattattttcttccagctattttggaatgtacagtagattcctgtaagctgtagtcaccctaccgatctaacattaggtcttatttcttctatcagaccatatatttgtacccatcaatcaacttctctttatccgcctttgcccccttggcagctatgtatagaatgtcacactttctggatttttgttttttgagttttataacttagtgatttgggcctctgagacttttcaaacttgagtagaagcagattttggagatactattttattattaccttaattcaaggccctgtactcagagcttcacggtcattgtcctattctaaccctgtgagatttttattgtccgtttccggatgaggaacctgaaccttagtgagtcggcagggatacggttttcctgaaaccagaaccagggctcttaaccactgccttctccacattcagttgtgattgtcctgcgtccacactgagtttgttttgacaacaggtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccgctctcggggaccccgaagccgcagccgcgagcacccgcactcacggagccccagccccgagcctagggggcggccggggcccatcggggtcctcctgatgaaaagcagagcgaacgaaggtaggcatgcttgatgtgggaagaaaagcactgttgtgatatgaataacctttgttttcttaatttttttttttcccccgaaagtgttgctctgtcatccaggctggagggaagtggcgtgatctcggctcactgcaacctccacctcccgggttcaagtgattctcctgcctcagcctcctgagtagctgggtctacaggcacccgccaccacgcccagctaattttatgtttttagtggagacaggtttcaacatgttggccaggctggacttgaactcctgacttgaggtgatccgtccacctgaatctctcacagtgctgggattacaggcatgagccaccacgcctggccaggaatagctactttttttttttttttttttgagacggagtcttgagtcttgttctgttgcccaggctggagtgcagtggcgtaatctgggctcactgcaacctccgcctcccaggttcaagcagttttcctgcctcagcctccctagtagctgggatcacaggcgtgcaccaccatgcctggctgatttttttatttttagtagagacggggtttcaccgtgttggccaggctggtcttgaacttctgacctcaggtgatctgcccactgcagcctcccaaagtgctgggattataggcatgagccactgcacctggccagctaacttttttttttttttgagacagagtctcactgtgtcaccctggctggagagtgcagtggcatgatctcggctcactgcaacctctgcctcctgggttcaagtgattctcctgcctcagtctccgaagtaggtgggattataggtgcctgccaccacgcccggctaatttttgtattttcagtagagacaggttggccaggctggtctcaaactcctgacctcaggtgatctgcccaccttggcctcccaaagtgctgggattacaggtgtgagccaccgcatctggccgagctatctcttaattgcacttaaccagcattgtacccagcattgacctaaatgcctaacaccaattcgttcgtttaatcctcagaactacctcatgagggaggactcttgtttctccattttatagacaaggaaactgaggcacaaaaggttcattgatatacacaaagttgtgtcatcattggaagagccaggcttcagaattttggctttaaactaggagaccagtggttctcaaagcagtgcatcacctgggcaccccttagaaatgcagactctcaggcccaacccagtcccaccagctcagaaaccatggggtggagccgggtgcagtggctcacacctgtaatcccagcactatgggaggccgaggtgggcggatgacttgaggtcaggagttggagaccagcctggccaacatgatgaaaccccatctctactaaaaatgcaaaaattaggtgggcgtggtggtgggtgcctgtaatccccacttctctggaggctgaggcaggagaatagcttgaaccccaaggggcagaggttgcagtagcagagatcatgtcactgcactccagcctgggtgacagagcgagactctgtcttgaaaaaaaaaaaaaaaaaaaaaagaaaccatggggtgggccctcagagtctctatgttaataagctctcctagtggccttgctgcatctcaagtggaaaaccacagtggaggacagtactccgcctaatcattgttgagtttctgctctatgcaagggctatgttgaatattcttttacgtagtcctcacaagaaccttgtgtgttaggaggcttcgtttctgttttgttttgttttgttttgttttgttttgttttgagacggagtctcgctctttcgcccagggtggagtgcagtggcgcgatctcggctcactgcaggctccatctcccgggttcacaccattctcctgcctcagcctcccaagtagctgggactgtaggcgcccgccaccacacccggctaattttttgtgttttaagtagagacggggtttcaccgtgttagccaggatggtctcgatctcctgacctcatgatccgcccacctcagcctcccgaagtgctgggattacaggcgtgagcccccatgcttggccaatgagtgcattttttaagaggattgaggaattgttgaaaaatgccagagagatgttatcactcaagcttgtctcactcagccttctgttctgggctgtgaggctgtttgaccactaggggctcgccatccatgaaagtagctttgcccttcccttattccattcttgactatcagcttcctaaaggactagggcatgggccacaacacttctaatctttgtggtaagatctggctgacaagtttaccgtaaatcatttaaaacttattttaaaattgacttcatacctttcctgaattgtggaaagttactttgttttgtaattataagatttttagtttgaacaataataaaaaattttgtgcctgttttaaaacctgctctgttgtggtagtttcctaaaatgtgaacagttattcttaaaataatgtatttttacaagtttattaagtaaaaccagaagagtcttaagtagcattgaaagtatttaaaaatatgcataacttagtaattacaatgtttttgtttttgatagcaattcagagtccataaactcccaaagctatgctggttttagttgaatgctttattaattactttgcctgacttctttaccccttttcttcacccactgaattcctttcaatgccaagcttcatataatctaaaatgctagattttttgcagtgccttcctgtagacagcctcattgtcagcagaacatgcctattaaggtgtgctgaattgtttttttttctccccaacattttatttgaaaagtgttaatttggccaggcgcagtggctcacacctgtaatcctagcactttgggaggccgaggcgggtggatcacctgaggtcaggagttcgagactagcctggcctacatggtgaaaccctgtctctactaaaatacaacaattagctgggcatggtggtgggcacctgtaatcccagctacttgagaggctgaggcaggagaatcacttgaacctgggaggcagaggttgcagtgagctgagatcatgcccctgcactccagcctgggtgacaaagcaagattctgtctcaaaaaaagaaagaaaaagaaaatgttaattttatagcaaataaacatataaccttcatctagttttaccagttgttaacattttgccacactttctttttcctcctcctttttttttctttccttctactccatcacccttcctgttacctctctcagtgggttttttggtactatttaagtaagttgcaggcaactcaccattacccataaatatttcagaggtatcttccaaagataagaacattctcctacatcagtcaccgtaataccattataacacttaagaagattaacattaatatccctttcatatattatagttcattttcagattgctccaaatgatgtaactcattcttcccccaccctccactggatcagggacctatggtagttcatgcattgcatttggtttttatgtaacttttaatctggaacagtttctctaccttttttgttttttatggcattgacttttttgaagagttcaggccagtcatcttacagaatttcccatatacaaaattaactttttaatacatattttaaaatagtcctataaaccagactaagttttttgaacaaattgataacatacgtgtatgtttatgtgtttgtctcctagagtatggtctccggcttgggagtcagatcttcgtaaaggaaatgacccgaacgggtctggcaactaaagatggcaaccttcacgaaggagacataattctcaaggtgggtagatgggggcagagaacggtagtgtgcatactgccgttcatcgcctgcatgtccacattcagcacccacacagtgagacttagatccagtgagagtcagtggtaagacagaggtggcaagagcagcataatgagacgatttttatcagaaaaaccagacattgagggtcgtaacagtttaatgtcagtttagaaaacaaaaacaaaaaaactccatgaatattttcttctttcctgtttaaagtttagatccctattccctaaactaaggaaagatgagaaggaaagttggtgatatatgaatgctgaatatttaataggtcttgtaaacctctccagtcaggaaacacgttccagtagtaaaccaaaccgttgtcttgagcttggaagttaaataaattagcagagtaacttacacctgtatttgggatccaggcatgcaggattatatttaatttaaacgacaattcatttttattgagtcatcctaaagccaatatctgtttgaatatctgagcaaagcctttacatttttagaaggggaaaatatgaattttctactgtgaataattttattgcatttaacattaccattttttataaacacagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaaggtaaaggaagaggaggctgtgagcttagctggaagtaaggaaggctgttgcttccccattcttctatttagtgtagctatccagctggaagttaaatttctaaggaaagaccccttgaaaccttaatctccaaaggtcactggttggttgttatttgcttattaaagtgcctattgaaattaggtttccaatacaaaattctggtgcatttgcgaactctcagagaactattaattaggcaattgaaagcaaaacttgtcagtaaaaaaatgtgtgtttgagtggttcaaagaactaaccatatcatttatatatttgctaattgcttattgtttttttttgagacagagtttccctctgttgcccaagctggagtgcagtggtacaatcttggctcactgcaacctctgcctcccaggttcaagtgatccttctgcctcagcctcctgagtagctgggattatgggcgcctgccaccacacctggctaatttttgtatttttagtagagacggggtttcaccatgttggccaggctggtcttgaactcctgacctcgtgatctgcccgtcttgtcctcccaaagtgctgggattacaggcgtgagccaccaggcccagccttaattgctcattctttaaaagtggctattaatatctctaatagagaagacaatttggaggatagctaaaacaagtagatgctcaaaaagaatcaaaatggctaatattgtggcattcattaattagcagtctgcatcacctcttcccttttaaagagctatattcattatttgaatatgaattatacataggataacattttaaccttgtaaaaattgccaataaaaatagttaatcacagtatattctactgaaccatctactgttgcttttatgcagagaagtttagaaaatattaagttacgaagttgtaaagcagacttttgttgatttttttttttaaaggaatttctttgtaaaaccttaaaacttaattcactttccagtgtatcagaagttgttgatgactgttacgggtgcagtgcaggaaaacaaaaggagcatgagaaataatgccagcatgttagggggtttgcagtttatttccttgctactcagtatgtggtcctcatcccccaacccctgaccccaatagcatctgcataatcaggtaactggatagaattgcagaatctcagtctcccctcaactgccccacaacaactgcatcctaacaagatttgtatgcaccttaaagtttgagaagcattgggctgcttgggaagaattagtgtatacatctatgatccaataatagaattttgactcttctgtagcagctttgatggaaaatgagacaaaagagaaatacacaattctaaatttgccttcccctttattaattaatgcctttcccttaaaacgagcaagtttttctccaggggaggactattagactaatagcacatttcctgcctacctcgtttccatttcccgtgtttcctacccagagaatagtgcaatttctctgggtaggagaatattttaaatattttatttaaaagtcttttcttatttttgaaactagatatttcagaaatagagtcaaaccgatcattttctccagaggagagacgtcatcagtattctgattatgattatcattcctcaagtgagaagctgaaggaaaggccaaggtaagatgacatgaatattctcttgtacatgtcattgtgaatgtacacacatatgtatttatgaaactgttatctcttgagacatttacgtatgacatgtgattcagttccagagaggacacgccgagcagattgtccaggatgggtgcgacacccactccctttaagtccacaggggatattgcaggcacagttgtcccagagaccaacaaggaacccagataccaagaggaccccccaggtgagccattaagaccactcagtttcaacagttgtgttcagaagtgtgtgctcacacagccataacaaagagtgaaatcatgtcctttgcagccacgtggatgcagctggaggccattatcctaagctaattaacatggtaacagaaaaccacacagcacatgttctgacttttaagtgggagctaaacattgggtacaaatggacatagaggtggcagtaacagaaactggggacaactagaggggaaactactaaaggaggagatggaaagggttgaaaaactattaggtatcatgctcacaccttggtgacaggatcagttgtaccccaaacctcagcatcatgcagtatatgcatgtaacagacttggacgtgcacccactgaacctaaaataaaagttgaaattatacacatatatgtaaatacatagatatgtatacatatatgtatgcatgtgtgtatatatgtatacagatatgtatgtacatgtatatgtgtatgtatagataagtgtgtacttaattccagagggtggctgaaagggaagaaggaaataaaaaattatatatggaagaggccttcctttctctcttttgacgttgacaaaatataaaataatagccttgtctaaatgccattagaattggtcacactttgtcatatttgatgagttgaggtcattgttttctcccatccttgatcctgacctcttcccccaacccttccccaccaccctacaattatcatcataattttatattcataaatatttaaggggaaacagtatcattattgtatgttttttaagttgttaaaaattctatgttcttgtgcatgtgattgtacaccttgcattttagaggttcattttttatctcttgtattttgagaaaccattggcacctgctaatacttcagagttaaacggcactttagagacttctttttgtttgtggtgacatatgtggcatagacttacattttttgtggattttgtgatttttctatttagaaacgcactcttgttagtccagattgataacagtagatgtttcttaacctacagctcctcaaccaaaagcagccccgagaacttttcttcgtcctagtcctgaagatgaagcaatatatgggtatgtatttccgtctctctttgttttcccttcttccttacagctctgtctctgtaactgaaatccagaagagtggtggtttttgcctagatggtgattttgtacactgtcagccacctgtaaccaatccccattggtagtgcttatgagaaagaggaatgatttgtgggaacagcaaaatgcggaagtgggtgaactttgtgatgttaatgttgtctgtttacctacctatctagctacctttccagagtgttactctgaatatttgcgtttgtcagataaattcactcccaaataggtgaagtatttattgctaaactacggtgccctgtggtgactgcactgatgtgatggtcccagtgtcagtccgtgtgggggagggaggaggagtgctgctgcgctctgcacttgataatcagaacccctagttcagcagggttcaagggcagcagcctcctggattaggattctgcttctttgtacccagactgtgtctttatttgacaagaatgcagtgcaagcgggccttcctttggaagaattttagccctaactctgccctttatttgctttctcatcttgaaagagttgctgtaaagattctataattctatgtcttcaccagtaaccagggacctactgatactcatctcatggtcccaagaaagataaaattgtaggatatatgagatagatgagaaaaatgagagggctttgtaaactataaatcactctgtagctagaagaaattaaatctctcatttgctaatgttgttctcccttttaaaaaatatctcccatctttcctttctgaaacggaacctattgcagccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtaagaacagcccagctctgtttctagaagttacttgtaaggagtgcacttttctgggtgttctttctgtaagggaagacaaaatggttcagctggtgaaatagagcagctgcaagtttgttgatgcccagcattgaagtctctgtattcctcaaatgcgtcctgtcttctcagtcttggaacccagaactcatccatgtatctgtgagaactgatagtgtttctgcccttgccaagattttattagtctgattaatgtgaaaatattgagactctaagtaagcacttacaggaaagatttttcaaaaagatttttctgatttttgcttttttcactgtgttccccctgcctgccatctttcttaaggcagtgtcctgaaattgaacaaaggtgagtggttggcatcagactgggtgattggaatttcgtcccagcctctgattagttctgtgaccctggttcaccctgagactcaggtttctgtatctgtttaatggggatgagaatacctgcctcgcagggactgtgggaagattagaccaggtaacacttacaaggcacctagcagagttccctggcacagaataggaaggtgagtgtccattcttttttcttattggaagataacaaatagctgctactcaatgttatttacatctaaaattgtccaagaaagggaattcctggttaatcaaatattgatacttttaaaattactatgtgtttgtataatctgttaaggaattaaaaaataactcaacttgacatttgtgtatgtgtgtgtgtgtgtgtagcattctttgttgacttcggaataaatttcaagaacatcaagtatctccttacaataaaaatatagagtactagggaactgttttttttgtttttttttgtttttgacagtctcgctctgtcacccaggctggagtgcagtggtgctatctcagatcaccgcaacctccgcctcctgggttcaagcaattcttagtcctcagcctccccagtagctgggattacaggtgaactcttaatttttgtctttttagtagagacagggtttcatcatgttgcccaggctggtctcgagctcctgagctcaagcagtccacatgccttggcctcccaaagtgctgggattacaggcgtgagccactgcgcccggctgggaactgtcttcattggaatttcttcctgcttctgcaaacttgcagttcatatatatgaggttttttttttcttgttaatgttagtaaaaaatccatatgtagtaaactaaggggtctggtaggggcttctaggctccaaggagaggggagaaaaaagttctagaattctcaaggaagcaagcagcagcaaagtacaaaagcaggtggcccccttccttcttggccccgttgcagtatttcagatttcatttctggagcagatgaagggcaaaccttgatcatgagctttgcaaaagcttttcagtgaaattctagaccctccttggccctggtcaggatctagaagactatgtacctgcacgaacctcatgttgccttatgatcctaggaaataccactcaccaaatgttactgatgaaaacccatctgagtgccagctcataccagtttactctttgcatatatgctgatgaaggaaaaaggcattttttctaactattgtgaggccataggatgatagctagaaatgtggagcttttgctcattaaggttcaatgataaaatattttcgtatgttcaggggctgggagattttctaaatttccgtgaagaaaagtagtgaattcacctagaggcttggcagtcagacctctctgtaagttgttgttagatggggagagtcgctttggtggataaaaagtcatggtatcagcatttatacttaaggtgttttgtttcttgttatcaccctggcaacacggaaggaactctgggaactggcttcttttgctgtcatcccatatggaggtcaggcaataggtggtcctcatttcttgggtgcgaataaattttctgttgactacaaaagaagctttccgttctagaaaggggtgaaaaagattgagtttgcctacgagggcggagaagctgctgcacaatactaagctgtggctgatacaggatcctcttcaggctcacagcagacacggctagaccctgtagactactaaatagctaatcaaagaggatatttattggaaaggactgttcaatgtaaccttcaagtagaaaagtgctgccctagccttttttcactttaatttgtttcaatgctccttttcatggccaaattgaatatataaagtgagccttatacacatgctaatcactttattctgttgtggggtttttaagtgtggctctttgttttgcaaaggtgacagcctaatgtgtggaatgaagacgtgagccagatatgtatattccttatcaataatggagatatatgtgcttttgctcattcctgcttggctgaactacctctttgcttgttatttatctgatagagttgtcatttctctttcagaaacttttatgggatggaaaagagaaaaaagacttctaagtttggttattaaccatgtagatttttaaaatataactaccatgtgtgctttaattttgaccattatagtttttggctatcgaagactgtgatcgagactgatctaaggttaatctcttgtggccagagagatggactgaaggactcccaaggtcctcccacagccttgtggccctgtcttatttaagtaaacaaatacaagcatgtatagtacatgtgaaaatatacatatggctatatgtagatacagatgtagataaacaaatggcacaagaaaggataccaaaatgggatgattcctaattgggggacagagaggtacaaatgacagtaccttaaatactaaatactgtttcaaaggaaaaattaactcaattgctttagcacatcactttattttaaaagcaccaaattagttttagtctaatgccgactttcacttaatcataaattttggccttaattaaggcccacccaactaaggataagtttcttctttaataaagcattactcttgtgattaaaaggattctgtaattgtcaatgactgaagaaaatatttcataggaattttatatctttatttctacaaaatattattaacatatcaggtactttaatatggtttttgcattttacttatttataattctgttttaaaataggctgaaagatacagaactatgggccaggcgtggtggctcacgcatgtaatcccagcactttgggaggcctaggtgggcggatcacctgaggtcaagagttcgagaccagcctggccaacatggtgaaaccttgtctctactgaaaatacaaaaaaaattagctgggtgtggtggcacatgcctgtagtcgcagctactcagggaggctgaggcaaaagaattgcttgaacccaggaggcggaggttgcagtgagccaagatcgcgccattgcactccagcctgggcgacagagggagactacatctcaaaaaaaaaaaccacatagcactatgatttcaaaatgtcttgttctttgtgctacatttcaattttacttgctttgtaactgtaaggctgatgctctttaatttgatacatacctttcaattttataaacacatgttaaacacttttaggtgatagaagctataggagaagggtagaattggtcagagtctttatttgcacacttttatttgaaccagtttaaaattagtgtaaatgctgggccagcatgctcagttgtcacagaccccaacactccccatgcttcatacttgtgtattaccttcttggccacctctgtgagagactcacagaagggagatggatagaaacaaccacaagaaattctattgtgatctggtgacagatccttgcttcaatggcttaacctctaaggtgcggttggcagtatggggaggcaggaaggtatagtgtgcaggcccatagcaaggtgctgggcgcgaggacttgaatagtgacattaaggactcatttgcatcttggctttgctctggacaggccctgatgaaaacaaacaaaagggtcagtggcatcttactataaacttctctgttttttctttctttctttctttctttctttcttttttttttttttctttttctgtttttccttcctaataggtgaacacacaggatttcagaggattagtgcgggaggatgccgttctctacctgttagaaatccctaaaggtgaaatggtgaccattttagctcagagccgagccgatggtgagcaaatttggtcatttagtttagttggggtgggggtggggagtgggaaggatgagagaggtgtcttggtaccagaataggcaaatctgggtattaaaaaattgagatggatctcaacacctagtccttgggccctaggtgtgtgaagaaaatgtgagtgccgtttaactttccataaaaatgttttctatgcatgcactgaaataattttactagttgtgtcaatttggaataaaactgccttcctgaacagtgatgcagccttatgttctgcctggagttattagtgagtttacatacgacatgtgcaaaggccatggctgctggctggtgcgcctgttacccctgtccagtctgacaagttgtttcacctttccaggccttgttcccatctgttaagtgggtgttgagagtgtcctccttgtctgcttcagagcttgattggcaactgtgttaatgttctccagagaaacagaatgataggagatattggaatcaataggaaagaaagagatttattataaagaattggctcacataattatggagactggcaagtgccaagatctgcagtgaaaatgggcaagatagagactcaggagagccagtgatttagttctagtctcagtctgaaggcctgagaaccaggagagccaatggtgtagttccagtaccaagtcagggaaaagagctgatgtcgccttttgaaggccatcaggcaggaagagtagtttcctcctaattttttatttatttatttatttatttatttatttattattatttttttgagacggagtctggctttgtcgctgaggctggagtgcagtggagcaatcttggctcactgcaagctctgcctcccaggttcaccccattctcctgcctcagcctcccgagtagctgggactacaggcgcccaccaccacgcccggctaattttttgtatttttagtagagacggggtttcactgtgttagccaggatggtctcgatctcctgaccttgtgatccacccaccttggcctcccaaagtgctgggattataggcatgagccaccacgcccagcctagtttcctcttaattgagaaggggtctgattgtcattctcttcaggccctcaactgattggatgaggcccactcgcattggggagggcgatcttctttgctcagtctacccatttatacgtgactgtcattcaaaaacaccctcagagaaaggcatagaataaagtctgaccaaatacctggttatttcatggcccagtcaagttgaaataaaattaaccattgcagcaagccgtgaagctggttatttgtccttgttcctgttggagctgtgactcccataggacttgtgcactgaatggaaggaaggtaaaggggagatcagagataggagaagctgtgttgagtgtctagtactgtaacttgtactaagctgaatgcaacaaacgatgcttttgtctttcagtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcaggtaacagagatcgcattctcacataccccttttaatccttccccctgcagaaaactagagaccgccccccttcccccgtaaaaggaaaccccacatgatgagttcattacttgtcaccatctatttcttgtttatggagagtggcctgaactgtaaatagccaccagccagtttattgtgagtaaatttagcatcatgtggttggttgctgaatgtggctgtttgaacaacttcctaaggagcatccactgccttgtaccgtatacaagagatatactgaatggccgtagcacaccagcacacctcttagagacaaggtacccttgtccggtgcccagtctccatccttggagaggtttatgcaccccagtgaacacttggtgtttggctgacagtgcaggaacctagaaaagaggcctgtatttgagcaggagttccaggtgtgtgtactgtgtacctgcatatcagaatgggccaaatttcacatgtttattgctgagccacttctgggagatttcacagagacccagcctttttctgctcccatttggaagtgaaggtccccacatttcccaccctctgaaacttcttcattgtcaagcggaatcttctctgagctcagaagtaaaattgactggatttgattaatgaaatgcatgttagctgcgttttctggctttagagatttacttcccgtggtttcttctcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaaggtgaggaagtcacatggggcctggaaatgaactgactgggctctgagcctgttcacctttattttcagactgtatggtcaagttctaacttatgtatgtcagttatgccaaaggcagtttatagagttgaaatcaaattctaacaaggagcatgatttataaaaagctgtttcagttcctaaattgaggcttatttctgcaacttaaaaaatgttttaataccactgttcaagagtttcggtatattggctgggcactgtaccttatgcctataatcgtagcactttgggaggccaaggtgggaggatcacttgagctcagaagttcaagactagcctgggcaatatagtaagacctcatctctgcaaaaaataaaaaaagtttccatatattatcaatgggaaagtttgtgtttaaaaatggtgaggagctaggcagtgtagtcccagctactcaggaggcttgagcctaggagtttgagtttagtctgggcaacatagtgagatcttgtctcttaaaaaaaaatctaggttagcatgtggttgaatgaaaagaaaaaaattgttttaaatggtgaggatagtgaaggcatattcttcagaacagagccaagctgaattggggagaaaccacagtttctttcgtttagttatgttatcaaaagcccatacaatacttttactgcttatcataacagctaggcaagtgtgtatgctttaatggcctttcttgtcatttcagctggtttcaagagacctgtggtcttattcggccccatagctgatatagcaatggaaaaattggctaatgagttacctgactggtttcaaactgctagtaagtctgtcagtgtttttttttcccccaaatttttattttgaaaaatttctaacagaggagttggaagaatcatgaacacccacgtacccttcacctggaatcaccagttgctgacattttgtcacgcattttctctcacccactgcctgcaccatagacacacatacacacacacatacacatactctttgaaaaatttctgcagaatcatttataacactttatccctgaatacttgtgtgaatctcctaagaacaaggactttctcccacataactgcaataccattatcacagccaagaaaggtaacattgatgtggtgtgattttgtatatagtccattttccacgttttcttaattgtcctagttatgtgcttcatagcttttttttaaattcagaatacaaccaaggaccattcatgacatttgatttttatgtctttttgtgatttttatgtctttccagtcccctcttttttctaaataactttgttacactgatattttgaagaatccaagctagttgtctcctagaatgcttcctgttggactggcctaaccgtttcttcatgattagatttccactaagcaggttatgtgggtccttcccactgaatcttgttaggagacacttaatgtcaggtgtgccatcattgcttgatgctaggtgggagtatttggttgtcactgttttctaaacaattatttagcttcctgtttttgcttttgcagaaacggaaccaaaagatgcaggatctgagaaatccactggagtggtccggttaaataccgtgaggcaaattattgaacaggtgagaaaattcatccacagaccgtgttttcagaaagaattagattatggtttgctgcagtcacttttaggatagtatctgtacttttaatcattaaatgttaataataaaaaattggccgggcacagtggcttacacctgtaatcccaacactttgagaggctgaggcgggtggatcacctgaggtcaggagttcgagaccagcctggccaacatggtgaaaccctgtctctactaaaaatataaaaaattagccgggcacagtggcaggtacctgtagtcccagccactcaggaggctgaggcaggagaatcgcttgaactcaggaggcggagtttgcagtgagcggagattgcaccattgcactccagcctgggcgacgagtgaaactccatctcaaaaaaatatatatataatgtaaatgcaaaccgtttcactgtgtggaaaccagtcactgttggcagtgagcggagattgcaccattgcactccagcctgggcgacaagagtgaaactccatctcaaaaaaatatatatataatgtaaatgcaaaccatttcactgtgtggaaaccagtcactgttactgttctctggcagtaacatactgtttttttttccagagttcccagcattataccaaataatgtgttaattcattttatcagaagttctaacacattggtaatattgaagtgggcattaggtagaaggaaatgtgttctgcttcttgatttaaatttacaagataggtggctcatgcctgtaatcccagcactttgggaggcagaggcgggcggatcacctgaagtcaggagtttgggaccagcctggccaacatggtgaaaccctgtctctactaaaaatacaaaaattagctggccatggtggtggcgggcacctgtaatcccagctactcaggaggctgagacaggataattgcttgaacccgggaggcggaggtcgcagtgagccaagtttgtgccactgcactccagcctgggcaacagagcaagaatctatcccaaataagtaaacaaacaaacaaacaagatatatctcatacagcctttacttattaaaacaaagtatttgatgctatattactttatatatccatttctctaacttttccccttttgtaaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacaggtaagtgaaatgtaaatgtagtccctttgctaaaaaatgagaaataaagaattgaagagtagaagaaataattaattaatctgaatggagaatttgaaattgtgttcatgactccttgaaaaatagttaatcctataaaatgggatattaggccaatggcatttatatattgaactttgtaattttgtctatttgaaaatgaccataaagatccatgatgtggtaataattagctattttgatgaagttcatattttcctgtgagactataaggctagtgattgagccaggccaaacacctatgtctctctagagattgtgtcattgttctctactcaccatcaatacatgcattaacttacaaagcgaaaggaacttggtttcattatttaaaaatattcctgtccagcatggtggataacacttgtaatcctcccactttgggaggccaaggcaggaggatcacttgagcccaggggttggagaccagcctgagcaacatggtgagatcctgtctctactaaaaggcctagcatggtggtgcatgcctatggctgaggttggaggatcgcttgagccaggaattcaaagctgcagtgagctgtgatggcactgctgcactcctgcctggtgactgagtgagaccctgtctcttcaaagaaaaaaaaaaaaatctagaaacttggacactctgaatattggatgatttaaagatttattatttctctttgttaggtgtgataataatattgtgatttttttaaaaacaaagttctttgaggaatgcatactaaataaaatatttatggttgacctaatataatgttgagaatttgcctaaatagtctgcagtgaggggagtagatgggattatagacaggacaagactggccaagacttggtagttgttagttgttgaactggttgatatgtacatcggagttcattaaactgctatctgtacttttgtacatatttaaagatttacctaatagaatatatttttaagtccatgaaatgaagagccattgctattactcatgaaagtaaaatggtctaagaacatgacatattttagtaacaatatatgcactgtctatataaatgattaattctgtgcatatgagattattaagagttttaaagggttacataaattttgtggtcatgcagggcattattttgttggggcaacacgaggagactgcaaggatatgatatccttaggatgaggatagctcattgagttcattgcccatcatcatccacccatgtcattttagtgtatctctgatactggagaggaaggggtgaatgattgtgttcacattagatgcttgttttagtgtaacttggtttttcttgttaaagagaggtgcactacttgccactgtggccaaatggagagagtttaaccaaatgcagaggaggaagtggtccatcataaactagatttctgtgaatgtagtcttacgtactcatactcttggtatatttatgaatatcctttctgtcctttttactactagtattataattattatgattattactattatagcaacagtaaagagtggtacagccttccatgtgtgctgtcttattaggccataagaaaggccagcacttttgcataatcacaattctgatgtatgactgagcccagactaaactatagcgtccctaactgtccaatattgtacatatgttacagcacagacatattctaatcccaaaaggggtcacgtaatgcagcccttccttttgacagattaaaaaactgaagccaaagtgattataaatgaagttaaaactatccccactttattttcccccctgcttttgtctgagtacactaaatagcgagcgtcttccctcagagagttaaatttgggattcacgtgaggatgtaggaaatcgggaagggaattacagtgcattgtagaggaagaactaggctgaaggcggctggacgaggagagcagggcagaagaaggcagccagtgactgtggggctctcccttgatctaacctgagtccgcatcatttgctcttgggagcacaggccacggtagctggctgagtgtgagtaagaatctagaggggtccatgtgtgtagaaggggttagcaacacctctgttagctccatagatggatttcaagatccttgaaggcagagcctgaacatttcccagcgttgtgtgcctgaggccagcatcaggactagcacatgggcaaggcataaatgtttgtaacttacattagaactgcccctggcacaccaagccatttcttgcctaaactcatcaggaagttgaaagttttagaataactcaagtcagagattggaatggaagcacacactgtaagcattgagtttcatctaaaacattgaagtgatcttatctcaccagaaattgccaatctcttatgtagaattgtacagtcttcaggatagatggtgcagggtgtgcagcaactttgaccagcaagctccaattttctagcaagtggtcttttacagtactcttccagacttcaaagtttgactccctacagctgtgtggatgactgcactaataattgcttttattccccatctcaccctcgtccctcttagcttgaccaggttttgacttgaggctgtgtgccatgtccagaaacactagtctttacatttgagcagtagaatcttcaggcagaattagtattttatagtttttgtttgtttttgagacatagtctccctctgtcgcccaagctagagtgcagtggcacgatctcggttcactgcaacctctgcttcctgggctcaaggcaccttccctcctcagcctccccagtagctgggactacaggcacacaccaccatgcctgggtaatttttgtattttttctggcaacagggtttacccatgttgcccaagctggtctcaaacccctgggctcaagcaatctgcccgtgttggcctcctaaaatgctgggattacaggcatgagccaccgtgcctggcctattttgtaggcttttaaaatgattttaagtgtatggcatttttgtgagttagtagttgagaataatagagtgctttgatgaacacagtaatttgaagtcaagctttatgttgcattagtctctttaggctcaatatccttttgttttcctttttgcaaagtaataagaaagctcctcttcctcacgagtatttaattatgacaatatgaaaatagttctccttacaagtcttacagtacttctcagttaaacaagagaagctttattctgagatttgcccaaaggcaagttgacttgtcataataagtttaagtgttaggtttgcctcccctactaccaatttttaaaaattttctataaaatacatttgcatatcacaaatttttatttttaaaaaacaaactttgaattacatgttttcttggaatcttcaaagtactcagtgcatggttcgaagatcatttaagttgacttatggatttagagacccaagtggggctacccttttatgctaattatagaattttaattcctgatttctcaaaggattatatagactagctagttgaccacagaaaagagaaggaagatgctgggccccctagctggatacctttgctgttgcatgcccatttagagggggtctagcgtgccactgttaaccgagccacgtgaaaagctttattgagttttgacttagataccatataatccacccattgaaagtatatagttcagctgggcatggtggctcacgcctgtaaatcccagcacattgggaggccaaggtgggcaggtcacttgagctcaggagtttgagaccagcctgggcaacatgatgaaaccctgtctctattaaaaataaaaaaattagctgggtgtggtggtgggtgccggtagtcccagctacttgggaggctgaggtgggaggatcacttaagcccgggagctggaggttgcagtgagccgagattgcactacagcactccagcctgggcgacaatgagaccctgtctcaggaaaaaaaaaaaaaaaaaaaaaaagtatgcaattcagtgggctttagtatattcagagttgtacagctgtcatcacaaccaatcaatcttagaacatttttatcatccccaaaagataccccatacccattagcagtcattccccatttctccctttccctaaaccctctagtcttagatgttaccttttgctgtcgctcttggtgcttccaaacctccttggctggggagggggaggtagcactgaccatacatgtcagggctgggcacacgtgccctcagaacctcagtattcccaactaaggcagtggctgagtcagcatcctttcagtatttcactttcttgagctcaaaagatagagtaagtctatccaaggggatataggcataacccagaggttaggagcaacagataattaactactattgctctaaggcaaagaatctgagaagcggaatgagagaatccaataataagctaaaggtacttaattcagcagagtcaagggaaggcagcttcatgtctgtgcacctgcctgttaaaaagaggtcaagtgcatgagttggatgttacttttatatgcagcttaggaagttagctactgtgaagctctcaatttttattcataaacttgactgttaatgtgaattcagtaagagcttttgtgattttctttattttatcaaggggcaagaacatatttcctgcatctcacaaaatgccgttttaactttaggttttctttatgatgaatgcagaccatacttatctcagacagctgcaacataaagctttaaaagactgcttaacattttgtatatatttagtgtaaatcactcattttgtctctggggtacaaaatctcacttctatttttaagtatcatattttagctatgagatgagcacagtaatctttgcagagtaccataataggaatagagaagtccgtggaatcaaagttaattttcttcgggttgtctaatggatcagtttatttcagtgctgtaaataattaataaccaaggaaattgtaagctcattcaggattttctaaggtcactgttagaacttcttaaacagaagaaagctatgttacttggaggaaaacctgaagcatcattgcttacaaaatttgcttaatggttctttttggctttagaagtgatagtacaataagaggccatggcaatgtagtttaaaagaaatcctaatttacctgcagtctgataattttaggggtacaatttgttattttggactaacttgcttgtctaatttatctccattaggtccataatacatattgctgaagaaatgacatatgttgtactttgttggtattttatatctgtgctctaaatttctgtttttagatgggccatgtagtgtggtggctgagaccataggctctgaaagcagttttctgagcttgcatccaagcttcacacttgcttggtgtgtggccttgggctagttaatttcactactttaccttggtttctcatctataagatgggcatcatagcaacacctaccttgcaaagtttgtgtagtcgtgaaatgagctaatccaggtaaggtacttggaaagtaactggttgatgcatagtaagtgctattatgtaagatatactttgttctgagtagaaaatgtatattctttgaatacacactggttgggtttgtttaatctatatgtatattctaaaatgtgtaagtctatcaaagtgatatacagtcagctctccatgtctgtggtttccacattcatgaattcaactagccgtgtataggaaatatttgaggggtaaaatggatggttacatctaaacgtgcagggtttttttcttgtcattattccctaaacaatatagtataacaacgatttgcgtagcatttacattgtattaggaattataagtaatccagagatgatttaaagtatataagaggatgtacataagtcatatgcaaatactgtgtcattttgtatcagatactcggcatctgtggattttggtatccaagtggggggtgtcccggaaccaatcctctacagataccaagggacaactttatgtttaagtgttacttttagtattttattggaggtagccaatacagtatattagtgtatactaattagtgtatacacctcagcctcccagagtgctgagattacaggcatgagccaccacacctggccgaaaacacatgttcttaaaaacatttttaaaagttagcctttctgaaaataaacattctaaaaatctatttttagctttatcacatccacctataatgtgaactcaaacagctacatgattagtagttttaattgcattcattaaaagggttttaatattcaaagatgtgcaaacatcttcttgcgtctgccatagtcttaaatatcacagaaatgagtgtaaattatgtcaaatagcatccttaataaacatgcctctggaaattaatgcagacctttttgtttatatttctatagctacaatcaacctaaattcagccaatgatagctggtttggcagcttaaaggacactattcagcatcagcaaggagaagcggtttgggtctctgaaggaaaggtatgtggcatagatatgctgctatgaggtgagagtccctgttctgaaacttttctcaagagggcagtgaatgtagtcaagccatgcccatttgaagtgatgctcacatgtgtgctaatcaagtttgaaatttcgtaaattctctgaccaagtaataaaaatgaagggacttttaaaagaagagcagaatgtgacatgtgcagccctacattcacttccctttcacttttaatgtagtaactagtgttatattccaagtacactaatcagagcttacaagatctcatgctgagctccacagcttactaaggacgtgggaaacttagagtgcagatgagaggtgaggttgagcaacttggagaatacggctaaacattaataaaaagaaaagctaatggagttagaattacttagaaaataaggttggttgagaatgtgccatcgttctgggagtttgaatgggtgatatgagaacgttagggaatttgtctaggcctctagaattggatcgcttctccctcggggagatagctcacacacagctgtgctgcagggaggagagagggagattctattacctgtggccgcttttattttagaagcttttggtgttagtatcctgttcaccagctgaactgaggtagttttgtgagacttgacagtgactattttgttgcagaattgactaagttttgctctttgagaactagatgtgtagtcaaagtatctggcatctatggagtgcttccagtttggaagggggatgcaagcttccctggggaggacaggttgaacaggacatagcttctgcctttgagggtctgagaatcttgtagaggcatggatgtgagtgtagcacaaggcagcgtgcaatgtgttgatattactaggagagtggtaccaggagaacaggctgcagaggagctggattcagaagaaaagcaagacagactgagaaagtgtggcttagccgcggtatggaggatggatggtagcacagataggctgcagggcccctaatttgagttcctgcacaaaaacgaccataatatcaacattgtaccaaagccaagtgatctcagggagaaaaataaaagatgccttccctggcgagcacatcaaggtttcagtcgcttggctgtgtccttgggaattttcttgagtccccactcccaggagccacatcagaccccactgaccgtccaacacaaattcctctagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggaggtgaggcgaggcaggccacgggcaggaacaggagagcctggtgttttccttgcactctcgtggacagctgtgtgttcagggtgctgtggaaggcattcctaagggttggagcagatgacttccagggagtctctcgctttgagtccacgctggcatggttgcagtctgtgggaaagtggggcaggcaggtggacttcagaagagcttgaggggtcagcactccgcacacccatgccctcaggtgcgatggataaacagaatggctttaggtgccgtctgtccaaattaccagcggaaccttccttcccatgcagtattgttgtatgtacttgtaacctttgattaggtttctctctgtactcttagatgtccttgcttttcttccccatcctgcctttaacctttctaatcttgccaaagctcttgagtgtttccccatcagtttccttctctcttatatttcagttttttaattgagttcatgatcaaaccttcatctgatcacatcacatgtactgtgcatccactgtgattagatagcttatgggatccttgaaatcacattgacaggcactgtaaagtcacagccaagttagcaattattagttgcacctcagagaatgttggaataatgatctttgaagatgggattgttcatatatttggataattattgctgtggatttctctctagcattttagctcattccagtaaatgatttttttctttatgaaatagaactaccaaaaaaaaaaaaaaaaaaaagttcaacaacaacaaactgaagggggagaaaaatacaccattaccacagcaacaaattagtttatgctagacaacttgtaaagaataaattaacttccaaatgcctatagacatggatattagtgacacaagagattttagacttttggagggttcttaaaaaattgtgctttaaaggaagagactctacattggatgcagccagtttttaaaaatgtgtctgaagcatttggtgatggtttctgcctgttcagtaaagaagcaccggctcagaacctcaacttctggacttactcaagtttgcagaactcctccaaagcagtcgagtgctctgttctctctgcttggatgttcttgttgtgaatgaacctttatgtcttgtagagcataaggaaacccagcccagagccacgagctcagatgaggagggctgctagcagcgatcaacttagggacaatagcccgcccccagcattcaagccagagccgcccaaggtacgtggctgggaagcccaggatgggaaggaagaggaagcagatgcctctgaagcctcctggacggccagggaggagcatgcacactgagatggtgtttaattacggttctgactcactgtgttctctattagagcctatcttttggcctgttgggtgaactcccaaattagggaagggcaaaaaggaaggaaaggcaatattaggagagcatatgattttaggactgttagtgtttatttaatttactcttcttgttaaaaaaagattgtaaagaaaaagattgaaaaatactgtactgtatacccagaatcaccaatcgcagaacgtgtttttcttttgctgtccagctaaagttttctgcccagtctgatttagatgcaccagataattcttactggtgatgtgctaaagagaataatcatcaccactgcttacaatgcctctcattaagagagctgcttatttgtttaataaatcattatccagagcagaatcaatataaagacacaagggcttatatcaaaagattatttacctttagtcagaatcagagctgtgactctatgtttttccttataccagaataaaacctatttaactcaataatttattatttattattactattttttgagacagagtctcactctgttgcccaggctggagtgcagtggtgcaatctcggctcactgcaacctccacctcctgggttcaagtgattctcctgcctcagcctcccgagtagctgggacttagaggtgtgcaccactatattcagctaatttttgtatttttagtagagatggggtttcgacatgttggccaggctggtctcgaactcctggcctcaggtgatccacccacttcggcctcccacagtgctgggattacaggcgtgagccactgcgcccagcctaactcaataatttagatgagaagaaagccataattgattgtgtgagccatcagaagtagtaaatgtgataggtactaagtaataataagtgacctcataaaatacatcagcgaaaatttgcaagccgggcaagactggaagtgtgaaggaaaagtggctgttagcgtgaagcagtgctctcctcgctccccaccccagtctcattcctcagctggacatgggtctcacctgggccggctcatgtaccctcagtgcagcagtgacctcagaagcccactcttcgagtcccaaagcctgaattgttctgagatcttctccaagatgctgatctcctctagaacaaaattattccaggtctgatcttacctccagcaatcacagccctcccagcactttccctattcctttttggcttcctgacattcctaatagactagtataggaagggaggtagggctcaggaagcctggccagtggctgtttgccctgctgtattacattccttgtcagaatggtatttgtggaccacctttggaaactgatcaggaaatggagtgtattaaatcactaatatagatttgaaaataaacttaaaagcccagggtgaaaacgtgtcattgctctccgcaggccaaaacccagaacaaagaagaatcctatgacttctccaaatcctatgaatataagtcaaacccctctgccgttgctggtaatgaaactcctggggcatctaccaaaggttatcctcctcctgttgcagcaaaacctacctttgggcggtctatactgaagccctccactcccatccctcctcaagagggtgaggaggtgggagagagcagtgaggagcaagataatgctcccaaatcagtcctgggcaaagtcaaaatatttgagaagatggatcacaaggccaggttacagagaatgcaggagctccaggaagcacagaatgcaagggtaattgtttttaaactacacatcatcaataagagttttaaataagtttgatttcaacataacagcgaacagcccctttgctgctgctgcagatgtggcagggatgcactgcaccaaaggcaggtgctgtgtatgtcacttcagattgccagctcccagcacgtcccttgttcttccaaagaagaaaacttgacaatataggggaagaagattctgctctttatacacagaactttgtatagagttctggaatgaggaagtgtgaggagggaatcagtgcctctcggaagtcgttttaattagaatgtgatttttttttcttaaacgtgtcttcattggctcccagatttgccgtagaaaccaagcaaactgggtgctaaaacagaaaggcccatagattgtactttttgagctgtttgaatttgtataccatatgcacatagaacttttcaaacaaagaagaatttaactaaaggtctgtggagtatatttgcccagtagatgtgggagttttctttcaggtctagcacaacagcagcagtacatctgagcatttttcttttcttgtcgtaaaatatacataacataaaatttaccatttcaaccacttttttcttttatttattttgttttgttttgttttgttttgagacagggtctccctctgtcaccccggctggagtgtagcagtgtgatcacagctcgcagcagcctccacctctcaggctcaggagatactcccacctcagcctcctgaatagctgtaaccacaggcacatgccactgcacccagctaatttttcgtattttttgaagagacaaggttttgtcatgttgctaggctggtctcgaactcctgggctcaagcaatgcaccctcctcagcctcccaaagtgctaggattacaatcatgagtcactgcacccagcctcaaccattttaaaacgttcggttcagcggcattaagtaccttcacattgctgttcagccatcaccaccatccatccccaaaacttttttatccttcccacgtgaaactccgtacccataaaatactaactcaccactctcctctccccgcagtccctggcacccactcctttactttctgttttttgtgaattggacagtgtaggaacctcctataagtagaatcatacactatttgtctttttgtgattggcttatttcccttagcatgatgtcctcaaggttcatccaggttgtagcatgtgtcagagtttcattccttttaaatagttttcctgtctgacgtgtaccgcacataaccatggaaatgaggaggccgcttctgtgtttcctcttcttgaaatgggatgggaaaataagtaggatatggggaaagggtgggaccagcaggaaaccagcaagcagagtgcccagtggttcattctttcactcttattcttttcttttttaattaccacagatcgaaattgcccagaagcatcctgatatctatgcagttccaatcaaaacgcacaagccagaccctggcacgccccagcacacgaggtaagggctgcctagtgggtacaggtctaaggcggggacttctcaaggactgggacttgaagaaagaatttcctttacccaaatttcagagtaacaggaggattttttccccacagattgactgtttgccttactcattccatcaaatttaattgtaaagattacagagtcaaaacttaagcatagtttgcttgtgtgctaaaactctgacaaagtgtaatcattgatgtttccagccagtacatttgacacattggagcctggttatgttacattgcacatggttagcacatgagcagaattcctacggcttagacctgttttgtcttgtttgctgactctcagccaaacttcttaattcctttgcatcatccagcaaagtcagaccgcttgtgctgccctggggtctaaagggaccgtgacaagcaaatgagcagtcttggtaaatgccacacaaacagtaggaatgttcacagtgtcttcctgttgaagttttatactggattgcttcctgcttccgagaatagaaaaaaaaaagtcacattttcttgtggccattcttttgttttttttggagacagagtgactgtcgcccaggctgaagtgcactggtgcaatctcagctcactgcaacctccgtctctcaggttcaagcgattctcgtgcctcagcctcccgggtagctgggattacaggtgtgtgccaccatatccagctagtttttgtatttttaatagagacagggtttcaccatgttggccaggctggtctcaaactcctgacctccgcccgcctcggcctcccaaagtgctaggattacaggtgtgaaccactgtacccagcctcttgtggccattctgactggaagctgaagtctagttttccagtgatagaaaactggaaacaaatttcttctttaccagctgagtggtaacacagtcaaccaggttgcctctggcaacaaagagttcttggttatgatggactgaaactggcagagacctcgctgctgggtgagactagccagggagcttaggggtaaggagggcaccccctgtccaacagggagattcttaggtcagggagcacctggctggcttcctcactcaccgccgaagtgggcattggatttgacctattacgaacctggagcaggaccagggatgccctggttgctctgcagaatgtggctcagaggtaagtgatctgctcgggatacccagtcactgtgctcagagccatgcctccccgggcagccggaggacatggatgtgctctggaatgtctttaacaccctttttttgttagttccagaccccctgagccacagaaagctccttccagaccttatcaggataccagaggaagttatggcagtgatgccgaggaggaggagtaccgccagcagctgtcagaacactccaagcgcggttactatggccagtctgcccgataccgggacacagaattatagatgtctgagcacggactctcccaggcctgcctgcatggcatcagactagccactcctgccaggccgccgggatggttcttctccagttagaatgcaccatggagacgtggtgggactccagctcgtgtgtcctcatggagaacccaggggacagctggtgcaaattcagaactgagggctctgtttgtgggactgggttagaggagtctgtggctttttgttcagaattaagcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaaagcagatacttgaggaaaacactatttccaaaagcacatgtattgacaacagttttataatttaataaaaaggaatacattgcaatccgtaatttt

SEQ ID NO: 431 - DNA, 50047 bp, Homo sapiens
atgaagactgctcaagccctacataggatgtggatccaggctgttaaaaagttgaggagatggaaaggccgtgtgagtccctctgcaagctctccccttgttttccccaacctttcttcatgggaaggggagggaagcaaaaccattctcacagtgagtcctttatcctcagattgatttgtgcttctggcatctttcagcaacaaattgtgagattgtaggttgtagtcactggtgggtttttaaaaatacttgtattaattttagcagatctatgtgaaactgatagcctcttactggatctgtggatcaaaggctgctgttttccatgtgctaggaatctgtaatggttttgcttcctgggtagagcttaacatactggcttttgtgtttgttcatgtttgagaatttcttgttttgggataaaactttttgctttcttacactgcagaaatctatattcttattatgtctaggcttctaacttagaagaaaaagtgtttttcacatgttcttttttcctcttacagtttgaacatgtgtgagtgtttactttgatggcttgagacttttatgaagcatgtcccttacgtggacagcttgcgattaatctttggttttagctttgacctccatcactgggcagcagcagtctgtggatacagaatctaaaagccgcctgttcagggggactttgggcagtgaacacttcggtatctgttttggggttggcttttaacatgtttctacattctttatgtaaaatatataggatttttacctatctggccaagatttttcaaaggaaaaaagctttataaaaagattaaaaaaaaacacaataagtaactatttgccttagttcctttctcttcttttgtcacacaaaaaccttactgttaatgcattaagttttttgtttatggtagaaaagttagctcacttttaactttccatgaggtcttaagaatgacctgttagatataaagggggttgtcatgaacactacttacgtgaaaagtaaaagtgataaggaaagatgatgaaagcacattgaagatcctcctaatggatagaatgttgacacttggattaaaaaggtgacttggcgttttctgcatacacctccccccacaactccccagacctaacctgcgtccccactctgcccaccgcacctgccttgctttaccctctttgcccctttcaaattactggtaccatccttcaactcgccctccttccagttgaaattattatcccctcttcactttgcaaaattctaactgcattgaaaaatttgctgttaaatatactcgtacctcttgggtattagatccttcaccaggagtcagtattcattttggtgttcacccactcatctccctattttttatttatttatttatttatttaatttttttatttctttttgagacggagtcttgctctgttgcccaggctggagtgcagtggcgcgatttcggctcactgcaagctccacctcccgggttcgagccattctcctgcctcagcctcccgagtagctgggactacaggtgcctgccaccacacctggctaattttttgtatttttagtagagatggggtttaaccatgttagtcagtatggtcttgatctcctgacctcgtgatccacccgcctcggcctcccaaagtgctgggattacaggcgcgagccatcgcgcccggcctcatctccctattttttaaacttatgaaatgtttggtaccataaaagaattaaatatctaaatcatggagcataataattaaacaaatgccatgagcccattacacatatctgcagaccatcaccaagacaaaacacgaaggaaatttgtgtacctcccaccatactctgcctcctgcccaggtcacctcatcctgaatgttatgtttttcatttccttgctttttctttatatttccactgcatgcgtgcgtacacacacacacgcccctaaacaatagattaattttgttggcaattttttactatagtgaaaaacgcataccaaaatttactgtctgtaccatttgtaaatgtacagttcagtagtgttaagtatattcaagttgttgtaaaacattgttttttgagctatataaaaatggtatcacactctacaaatccttctggggtgtttttttgctcaactttatgtttgagatgcatcccttttgtggtggtctatgtgactggtttgttcgtcttcattgcagtaaaacattgtattttaataatgtatcaatttgtccatcctgcccttgagagatactgggatattttccaagttttggctgttgggaacattgctgctgtgaatactctatacatgtgtccttgtgcatttagtcacacggttctcccggtgcctctgcccaggtagaggaatcactgggtcgtggaatgtgcatacctttaattctgatatatgcgtgctctttctatgggcctgcctgtaaagctccccctggtgctaagcagctacctgctgtcattcagagagaggtcagatattgctagcaagtctgatctgcgcatagccaagcacaaggtggtgggtgggaccagagcccggtggcctagtttgaatgtcaggaccacagctctcagctaagctgctgcaccctggcagcctgtgcccagggatgttcctagagctgatgttctgaggaataaggatgattatgtggggtgctctgtgtttctgaaaaattatataaatgaggcaggaaagacactcagtagtttgctctttgggtacacttgtagttagttggtaagctgcccaagggctttggcgattttattcactgatgtctctgaagtgccacaaaccacttgcttggcagaaggtggatgcttaataaatgtttttgcataaatgaacaaatgagtgcacagtgaagagttttctgtgagaccttcccaaaaagtcacagttctgtaggctaaatatacatagttatggtgtatttttaatgttcaacagagctactaaaatttatttttgctctagttcccttcctttacaattaagattttctctttatcacttggcttagcagagcatatattctttgaatattatgttaagtagctaatagttaattttattacccgttaaccataggtaagaagaagcctcgcaatctgattggtttcaggcaccaggcaagttaatagcaaggtctgattggtggtggtagtggtaggagattaatcgtctctctgacaaatttaatttaaattacgcttgcaggcatcacaggacacttaaagatggtagcatcccattattgaagggctgtgaatttcaaaagccagattcattctacttgagccacatttaaaaaataaaattttgcaggaactcatttatttggctaaatgataaacaaatttaaatccaaaactttgaagagtttatagttttaaattccaaaatagaaatgtattttaaaagtaatgtactcataaaaatattctctataatagcacagctccttgggatattcaacatttttttggtatgtagcattgcccaatcctggggatgattgtcatagtcccagttagttttttttcctgataattttaaagtaagttttgtggggaggatgtcatgtaattttttttcccccttaattcatggggctataactatatccaaagaagagttggcaaatatatttattttaccacaacttctagattaattcactttgttgaaatttgacagctttaaggtacaagaaggcattgagaagatgagcttggagaagtgggcatgctcataaggtcatttctgggtggtagtggcttagttttactaaggccacatctaaaactgaagttggcaaggagttagtaaggtgttctatggaaatggaaaagggcaaccaattctgacttactgcaggagttcagttgagtgtctgctttctttttcttttctttctttattttttttgagacagagtctcactctggagtgcagtggcgcaatctcagctcattgcaacctccacctcccaggttcaagtgattctcttgcttcagcctcccaagtagctgggactacagatatgcgccaccacgcccggctaattttttgtgtttttggtagagatagggtttcaccatgttggccaggctggtcttgaactcctggccccaagtgatccacctgccttggcctcccaaagtgttgggattataggcgtgaaccatcacgcccgacccggtttctgctttctgtttccatttaagaaaactttttggccgggcgtagtggctcacacctgtaatcccagcgctttgggaggccgaggtgggcggatcatctaaggttgggagtttgagaccagcctgaccagcatggtgaaaccctgtctctactaaaaatacaaaaattagctgggtgtggtggcgcatgcctgtaatcccaactactcgggaggctgaggcaggagaatcgctagaacccaggaggcggaggttgcagtgagcccagatcgtgccattgcactccagcctgggctggagcaaaactccatctcaaaaaaaaaaaacaaaaaaactttttaacaaatatgtacaacttcattaaaatattggaaaatttattgtgcttccacatattggaaaatgctgttttagacacatgcagaattccagagaggtatggctatagagcacatctagaaagtcagaccatgagcacctgagtttttagttcacccacctcacgtatgctatcaaagaagcagagagccacgaatttgatacaaactttctttaagaaaatttgtaggctgggcacggtgtctcacacctgtaatcccggcattttgggaggctaaggcaggcggaccatttgaggtcaggagtttgagatgagcctggccaacatggtgaaaccgtgtctctaccaaaaatacaaaaaaatgagctgggtgtggtggcgcacaactgtaatcccagctactcgggaggctgaggtatgcgaatcacttgaacccaggaggcagaggttgcagtgaacctagatcacacccctgcattccagcctgggtgacagagtgagaccccgtccccccccccccccaaaaaaaaaaaaagtagcagcagtcagtgcttcagttatattaattgaatgatgaatgaatagtgtatccatctctagatgtattaaaaagaaaaaactttgagtgcctactctgtgtgccagacactgttgtagcagataatgggacaaagatgagtaggatacaaaaatttcacctgaaaattcacttttattttttaaaattgaagaacagtcgtcacagtgaacagactttaagtaattggggagttttacataatttagataataatcttttggaatgtttacatatttccttgtgttgatgggccttcatttaatctaaatcttgcacttttgggctgcttgcgtccctggcaccccaggccccattcaccacccagtcccaggattgctggtagcacagatctcttcttctggcctttttcaggtattttgagttctttttttttttttttttttttcttattaaatatacagatggggtctcactatgttgctcaggttggtcgtaaactcctgcactcaactgatcaccccgcctcagcctcctgagtagctgggactatggcatgtgccaccatgcctggctaactttaaaaattttttgtagagatggggtctcactatgttgcacaggctgcccttgaactcctaggctcaagcgatcctctcgcttcagcctgagtgctggaaatacagacgtgagccactgcacccagccctcttctaatttcttaaaacataaacacatagtccgggtggcttggtggctcatgcctgtaatcccagcactttgggaggccgaggcaggtggatcacaaggtcaggagtttgagaccagcctgatcaacatggtgaagccccatctctactaaaatacaaaaattagccgggcgtggtagtgcgcacctgtaatcctagctacccaggagactgagtcaggagaatcgcttgaacctgggaggcggaggttgcagtgagtgaagatcacgccactgtactccagcctgggcgacagaacgagactccgtctcaaacaaaacaaaacaaaacaaaaaaccaacatatacacatattatagatactccatttttgtctgtggctggtatttcaaatatttaaagtctttgattcttcagtttatgtttcttttacctctcactcatggtgatgtgcatgtttaaattgtgggctcatttccttggatacatactatctggggaatctttgagggctgtgtttgagtgtgatctctggagaggattcgcatctgcctctgtgtacttggtggtatggccagtgcagagccccagtaggcatgagtgtttggcagggtgtggtcacgtctgtaatatgaacgcccaaacctgtgtgaatacaggtctgttgatagaaattctccagggttttatttttagttatttccactctacccatagccaaggatgagacagtcactgcatctccatctgtgtgctggtatttttttcccctaatagatccacccagacctgatctcccaccctgtttggatccccagcctcctctaaatgcctgcttcagtgctggcttatctctgtggttctgagtgttcttggcatttctagctttctcacaggcagcctgcatttaatggattattatttttaaaatgataccaccagttgtagttttttctggatacctactttggaatattgtcagagatggaagtcccagtggtctatttatgaagacattcatctttcatactcagtgatacagatggagaaaaagccgaaagatcccgcagatcacccaattgggcataccctatgataaggctaaggatatttttagacataaacatgcagaaaacttgcctacgaggtcacctttgacaggaagagggggagaatgattttaaaaaaagaatctatttgaaactagatatttttaaaggggttttatgatgataatgttttggaatagtgataataaaaggactcagcacttaacattccattctttttagggtctgtctctcactatgtatttcacttacctttcaagtattgtttctagtttcatttcattgaaggagagtgtgtttgaaaataggtagcataatgaacagatattaactcttttttggtatagaaagtgtgagctggactttatgtcgaggcattttgaatgataattttatttctagcattgaaaaggttgtggttttcatcagattggttttgttcttttaaaacaggccccaggcatggaagagctgatatgggaacagtacactgtgaccctacaaaaggtgagttctgcacatttcatatattctacagtcatgttcttgattttacggatcatggatcttatttattttcacctacacacagttttggctttttttttcccttgaggtacataatgtattatagatactaactggcaataattgctatgttaacaaagatttgcatgctattgtattttttgattaaggactgtttagtatggaacattttagaggttatttagtgtatactcttatctccagctagaacaggttatgaaagagagaaaagaaagggaagaatgaaaatgacctgtactgtttaaggatgtggagggagctttttacaacttctgtaattttaattatgacatattatacataccttataactcttaaaaagtgtagcatccaagagactgtaagtcatttgtgtgaggctgagctggagaactgcactcgtggttctgcatttttttttttttttttttttttttgagacggaattgcactcttgtcgcccaggctggagtacggtggtgcaatttcggctcagcgcaacctccgcctcccgggttcaagcaattttcctgcctcagcctcccaagtagctgggattacaggcgcctatcaccacgcccggctaattttgtatttttaatagagacggggtttctccatgttggtcaggctggtctcgaactcctgacctcaggtgatccacccaccttggcccgcaaagtgctgggttgcaggcgtgagccaccgtgcccagacggttccgcatttttattccgtcaagctgccttccggtcatcatcactgtgattttcctggtttttctgcagggtttcttcttctggctctgaattcctccaaggtctgacatctcctagagggaccataagttcctcataggaagagttttcctttgaccctcagaactgtgagcttcaagctttgtcttctatgaaaattaaagacattcccgaatttaatgtttgttgaattaatccaggtagaaaaaaatgtctctgggccagtgcccaggtacccagacttccagatcagtaatcacaatttcctcatttgaggggttttgtctgcttaggtcttatttttcaactttcctcgtctttctgactctcctctgccctttccctgagcatttcatgcattccttgagttgtggacccaaaattggcagaggtcagagatttttttaggcttggcatagaggatggagctgcctctgtctaaaaccaggtgccggctggtggtgctgccaaattcaaagccatgtgattaatagacaacacccccaacctgttttgagtttgtaattgtgtataatcagtcagcatagtgggcctcacgtgggaaactttccttggaaaggaagattttcttttagtctcggagtaaatttttatataatcgaacccagatttaagaatatacagtcaaatatactcatattatctggatgaaactgggcttagatacatatatatatttttgaaatggagtctcattcagttgcccaggctggagtgtaattgcatgatctcagctcactgcaaccttcacctcctaggttcaagtgattttcctgctccagcctcctaagtagctgggattacaggggtgtgccaccacacctggctaatttttgtatttttagtagagatggggttttgccatgttggccaggctgatctcgaactcctggactcaagcaattcacccgccttggcctcccgaagtgctgggattacaggtgtgagccaccgcacctggcccagacttagctttttaaaacacaaatgaattaggattatgtattatctatgctcaccattgtgcattgctagactgatcatggatgtaataaatcttatttccgatcttccatgcatgaagaaaagggtttagtgctttgcttttcatgagatctcaacacatattttacgttcaaattttatctttaaaatccagttacgggccgggcgcagtagctcacgcctgtaatccccacactttgggaggcagagacaggtggatcacaaggtcaggagatcgagaccatcctggccaacatggtgaaaccctccctgtctctctactaaaaatacaaaaattagctgggtgtggtggcacatgcctgtagtcccagctactcaggaggctgaggcaggagaatcacttgaacctaggaggcaggggttgcagtgagccagcaccactgcactccagcctggcaacagagcaagactccatctcaaaaaaaaaaaaaacaaacaaatccatttacttctttttcactgtatgttgaaatgaaactaccaacacatctactttgaagttaaaggtatactttaaaaatataattttaggcagacataagaaagaacgaaatatgtcctttgcagcaacacgaatgtacctggaggccattatcctaagcaaattaatgctgaaacagaaaaccaaatactgcatgttctcacttagaagtgggagctaaacattgggtacacacagacacaaggacaggaacagtaaacactgggaattccaaaagtacggagggagggagaggagcaaagtttgaaaaactacttcttgggtactgtgttcggtacttgagtgacaggatcattagaagcccaaacctcagcatcagacaatacacatatataacaaacctgcacatgtactcctgaatctaaaataaaaataaaattaaaaaggattggctagcactgggaagagcagtcttttcccgcccagctagaaagttgtggttttttttttttgttttttagagacttctccatttgcccaatttaaagtgcaaaagctgccttggcttgttgaagccttgacctcacaggctcaggtgattctcccacctcagcctcccaagtatctgggactatggatgtgcaccaccatgaccagctatttttttctatttctagtaaagacagggttttgccatgttgtccaggctggtcttgagctgctggactcaagcaatctgcctgcattggcctcccaaagtgctgggattatagacatgagccatgagcctaggcagaaggtttttttttttttaatatgtcaaaacatcacaatatacagaagaattaaaaatatttacagtacaggccaggcacaatggctgtctgttgtaatcccagtgctttgggaggttgagacaggaggctcatttgagcccagaaatttgaggctgtagtgagtagtgatcacaccgctgcactccagcctagcaacagatcaaaactctgtctcttaaaaaacaaatacaataaggaaatctgaaaattaaaaaatacagttttagtacaggttcagtttttactgaagttgttccagctcgggccagcatgatgcaaagaggtacaactggtgcttcaaacagtacgtccctatttggactgaagacattgtttcctatcccggccagcttctagtgataactccagtctgcactatcaatcttttccagcctctacaggctgtttctttcagataaggaatttccctttataaacctgtcagctgacaatgactatgctttgttttgtttctcatttgtttctgtaagcccatctgttcctgaacagtctctggttattgatttgacctttattttattgagtgcttgtaataaatcctgaaagccacttattgaaggatttttaatatttctcctctctgatgtacaggattccaaaagaggatttggaattgcagtgtccggaggcagagacaacccccactttgaaaatggagaaacgtcaattgtcatttctgatgtgctcccgggtgggcctgctgatgggctgctccagtgagtgtcctccctcgctccgcagcccctaccagccctactggttggccctagacggggtattttggttggtgtccactttatttaaaaaaaagaaaaaaataacaaacttttatataatatttgaaaagtcttcaagctggaatggaagccataacacaccatgtttgaataatgcccaaaccttgggaacaccccagctttggagcgaggagggcagttgtttccgtaagaagatagttccaaacatccctcctaggtttaggaatcatttctgaacatggagttttaaattggcatgcttctcaaccccgatgcttaaccaacactgtttatgtttgttttaatttatattctttaagaatttaatgaggagactttggtttattgattatcttatttgtaagagtgatgtggaagttgggacaatttactataggaaaaccacaagttttccaactgccagctttctgacctgaagaagtaacaccattttattttaatttttaataaattttttcttttctttttttttttttttttcagacagagtcttgctctgtcacccagtctggattgcagtggtgcgatctcagctcactgcaaccatcaccttccgagttcaagcaattctcttctgcctcagccacctgagtagctgggattacaggtgcctgccaccactcccagctaatttttgtatttttagtagagacgggttttcgccatgttggctaggctggtgtcaaactcctgacctgaagtgatctgcccacctcggcctcccaaagtgctgggattacaggcatgagccaccatacccagctggtaacaccattttacatgatacatgcctgattcccacaggataacttctcaggacgaagtctaaagttaactgtatggctgcattggataaatagctcaaaagtttaggttttgttggtgtttaaagcctctgtgaactaagcacagtggctcacgcctataatcctgcactttgggaggctgaggtggcaggaacgcttgaggccaggtgttcaagatcagcctgggcaacctagtgagaccctgttgggatggcatgtacctactcgggtcccagctacttgggaggctaaggtgagagaatcctttgagctcgggaagttgaggttgcggtgagctatcatcagtcacactactgcagtccttcctgggtgagagagggaaaccatgcctcttaaaaaataaaattatagttaagaaagtctctatagttttatcaaagttagtagtctttcatatggagaaatgcaaaattttaaagtaatatttgggatgaactggaacaataggattctgtgatctcaaaatttcttaagaatccaaggcaagcccttttcctgcacaaaagcacaaatggatatacacctacttggaaggagtgtttttagacttttctgaagcccaccgtgcacctcaggcaataggggactgatagagaaattccttttgtgtccagacctcaccgtcatcaagtacctcctggtgtgatgctgtggtttggggagatcaggcctctctcttcccagatgatttccatttagacactcagaattgagctgtatggcccccagttcctttctttggaagatctcaggccaagttgactgggccttgggcgccactagacactgagccctttagaaagcctttcaggtctatttgctgcttctatttgttcctaaataaataatttacaatgaatagatgggagtttttcatgacccatttttatttcttgtttacagagaaaatgacagagtggtcatggtcaatggcacccccatggaggatgtgcttcattcgtttgcagttcagcagctcagaaaaagtgggaaggtcgctgctattgtaagtactgggtttgctttcagcttgccttaatagcattttggttttttgcccagaagaaaattaccccttgcttttaagcatttgacagaattacataacctagggaccgctgttcttggatcctcagtacttttggaggggtgtgaagatatgtgtaagttatcttcctacttttccttgtgtcttctcctgaggccagtgattctctgatctgagttagtttgccttaggaaccaagttaggcaattattccctaagagaattagctagattcagaatactggtaaaatagtattaatttagaaaaaaactttcagctcaaaaactcacttgtaaaggcccaagcaaggtatattatatcttcatagactaagagtttcattagaagactgtctataatcttcattcatctattccttcattcattcactggctgagaatcaactgtgagctggatgccattaggccctggggccaatctgtgttgcaagatgtgttcactccagtggggcaggtagacacacacagtgagaatggtaataaagtgtgcttaggggcaatgctagtaggcatatacccacatatatggttgtgtgtgtgtgtgtgtattttttttttttttttgagacagagttttgctcttgttgcccaggctggagtgcaatggcacgatcttggctgaccacaatctccgcctcctgggttcaagcgattctcctgcctcagcctcccgagtagctgggattacaggcatgcaccaccacacctgtctaattttgtatttttagtagagacggggtttcaccatgttggtcaggctggtcccgaactcccaacttcaggtgatccgccagccttggcctcccaaagtgctgggattacaggcgtgagccacctcacccggccacatatatggtatttaatgtttttcaactttatattatgaagattttcaaagaaaaaggaaagttgaaagatcagtgtaataaacatttatcttctaaaatattactattctgccatctttacttggtctctgtatgtatataaacactcatgtctttctgggcaaccatgcgaaggaaagttacagacatgacagttcatttctacttacttcacatgcatttcctatgaatgaggacattcatctatataatactattatccgatctaagaaaagtaataattttacagtattatctaaaatccagtccatatctcaagatgtctttttcatttttagagatgggatcttgttgtgtttcccaggctgatcttgatctcctgggttcaagcgatccttccacctcagcctcccaaggtgctgggattacaggtgtgagccaccatacgcagctctcaaaatgtctttgatatatgttttcttccctatccaggatccaaagttcactcattgcatttaatcattatctctttagttccttttaatctagaagggttcctctttccccttgcccctctaccccaccccccactttaaaaatggcattgggccaggttcagtggttcacgccagcactttgggagatggaggcaggcagatcacctgaggtcaggagttcgagaccagcctggccaacatggtgaaaccccgtctctactaaaaatacaaaaattagccaggcatggtggtgtgcgcctgtaatcccagctatcgggagggtgaggcacgagaatcgcttgaacctgggaggcggaggttgcagtgagctgagtacagtccagcctgggcaacagagcgagactttgtcttaataataaattaaataaataaataaataaggcattgacttttcttccttaaaattttaaaaatttatgcataatgcatagttatagggtatgtgtgattaatttaatacattaatatgatttgtaaaattcagatgagattgggcacgttcaggatggtatggctgtagacatgatttgtaaaattcaaatcagtgtatttggaatatccatcaccttaaataattgtcttttctttatggtagaaacgttcagattattttcttccagctattttggaatgtacagtagattcctgtaagctgtagtcaccctaccgatctaacattaggtcttatttcttctatcagaccatatatttgtacccatcaatcaacttctctttatccgcctttgcccccttggcagctatgtatagaatgtcacactttctggatttttgttttttgagttttataacttagtgatttgggcctctgagacttttcaaacttgagtagaagcagattttggagatactattttattattaccttaattcaaggccctgtactcagagcttcacggtcattgtcctattctaaccctgtgagatttttattgtccgtttccggatgaggaacctgaaccttagtgagtcggcagggatacggttttcctgaaaccagaaccagggctcttaaccactgccttctccacattcagttgtgattgtcctgcgtccacactgagtttgttttgacaacaggtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccgctctcggggaccccgaagccgcagccgcgagcacccgcactcacggagccccagccccgagcctagggggcggccggggcccatcggggtcctcctgatgaaaagcagagcgaacgaaggtaggcatgcttgatgtgggaagaaaagcactgttgtgatatgaataacctttgttttcttaatttttttttttcccccgaaagtgttgctctgtcatccaggctggagggaagtggcgtgatctcggctcactgcaacctccacctcccgggttcaagtgattctcctgcctcagcctcctgagtagctgggtctacaggcacccgccaccacgcccagctaattttatgtttttagtggagacaggtttcaacatgttggccaggctggacttgaactcctgacttgaggtgatccgtccacctgaatctctcacagtgctgggattacaggcatgagccaccacgcctggccaggaatagctactttttttttttttttttttgagacggagtcttgagtcttgttctgttgcccaggctggagtgcagtggcgtaatctgggctcactgcaacctccgcctcccaggttcaagcagttttcctgcctcagcctccctagtagctgggatcacaggcgtgcaccaccatgcctggctgatttttttatttttagtagagacggggtttcaccgtgttggccaggctggtcttgaacttctgacctcaggtgatctgcccactgcagcctcccaaagtgctgggattataggcatgagccactgcacctggccagctaacttttttttttttttgagacagagtctcactgtgtcaccctggctggagagtgcagtggcatgatctcggctcactgcaacctctgcctcctgggttcaagtgattctcctgcctcagtctccgaagtaggtgggattataggtgcctgccaccacgcccggctaatttttgtattttcagtagagacaggttggccaggctggtctcaaactcctgacctcaggtgatctgcccaccttggcctcccaaagtgctgggattacaggtgtgagccaccgcatctggccgagctatctcttaattgcacttaaccagcattgtacccagcattgacctaaatgcctaacaccaattcgttcgtttaatcctcagaactacctcatgagggaggactcttgtttctccattttatagacaaggaaactgaggcacaaaaggttcattgatatacacaaagttgtgtcatcattggaagagccaggcttcagaattttggctttaaactaggagaccagtggttctcaaagcagtgcatcacctgggcaccccttagaaatgcagactctcaggcccaacccagtcccaccagctcagaaaccatggggtggagccgggtgcagtggctcacacctgtaatcccagcactatgggaggccgaggtgggcggatgacttgaggtcaggagttggagaccagcctggccaacatgatgaaaccccatctctactaaaaatgcaaaaattaggtgggcgtggtggtgggtgcctgtaatccccacttctctggaggctgaggcaggagaatagcttgaaccccaaggggcagaggttgcagtagcagagatcatgtcactgcactccagcctgggtgacagagcgagactctgtcttgaaaaaaaaaaaaaaaaaaaaaagaaaccatggggtgggccctcagagtctctatgttaataagctctcctagtggccttgctgcatctcaagtggaaaaccacagtggaggacagtactccgcctaatcattgttgagtttctgctctatgcaagggctatgttgaatattcttttacgtagtcctcacaagaaccttgtgtgttaggaggcttcgtttctgttttgttttgttttgttttgttttgttttgttttgagacggagtctcgctctttcgcccagggtggagtgcagtggcgcgatctcggctcactgcaggctccatctcccgggttcacaccattctcctgcctcagcctcccaagtagctgggactgtaggcgcccgccaccacacccggctaattttttgtgttttaagtagagacggggtttcaccgtgttagccaggatggtctcgatctcctgacctcatgatccgcccacctcagcctcccgaagtgctgggattacaggcgtgagcccccatgcttggccaatgagtgcattttttaagaggattgaggaattgttgaaaaatgccagagagatgttatcactcaagcttgtctcactcagccttctgttctgggctgtgaggctgtttgaccactaggggctcgccatccatgaaagtagctttgcccttcccttattccattcttgactatcagcttcctaaaggactagggcatgggccacaacacttctaatctttgtggtaagatctggctgacaagtttaccgtaaatcatttaaaacttattttaaaattgacttcatacctttcctgaattgtggaaagttactttgttttgtaattataagatttttagtttgaacaataataaaaaattttgtgcctgttttaaaacctgctctgttgtggtagtttcctaaaatgtgaacagttattcttaaaataatgtatttttacaagtttattaagtaaaaccagaagagtcttaagtagcattgaaagtatttaaaaatatgcataacttagtaattacaatgtttttgtttttgatagcaattcagagtccataaactcccaaagctatgctggttttagttgaatgctttattaattactttgcctgacttctttaccccttttcttcacccactgaattcctttcaatgccaagcttcatataatctaaaatgctagattttttgcagtgccttcctgtagacagcctcattgtcagcagaacatgcctattaaggtgtgctgaattgtttttttttctccccaacattttatttgaaaagtgttaatttggccaggcgcagtggctcacacctgtaatcctagcactttgggaggccgaggcgggtggatcacctgaggtcaggagttcgagactagcctggcctacatggtgaaaccctgtctctactaaaatacaacaattagctgggcatggtggtgggcacctgtaatcccagctacttgagaggctgaggcaggagaatcacttgaacctgggaggcagaggttgcagtgagctgagatcatgcccctgcactccagcctgggtgacaaagcaagattctgtctcaaaaaaagaaagaaaaagaaaatgttaattttatagcaaataaacatataaccttcatctagttttaccagttgttaacattttgccacactttctttttcctcctcctttttttttctttccttctactccatcacccttcctgttacctctctcagtgggttttttggtactatttaagtaagttgcaggcaactcaccattacccataaatatttcagaggtatcttccaaagataagaacattctcctacatcagtcaccgtaataccattataacacttaagaagattaacattaatatccctttcatatattatagttcattttcagattgctccaaatgatgtaactcattcttcccccaccctccactggatcagggacctatggtagttcatgcattgcatttggtttttatgtaacttttaatctggaacagtttctctaccttttttgttttttatggcattgacttttttgaagagttcaggccagtcatcttacagaatttcccatatacaaaattaactttttaatacatattttaaaatagtcctataaaccagactaagttttttgaacaaattgataacatacgtgtatgtttatgtgtttgtctcctagagtatggtctccggcttgggagtcagatcttcgtaaaggaaatgacccgaacgggtctggcaactaaagatggcaaccttcacgaaggagacataattctcaaggtgggtagatgggggcagagaacggtagtgtgcatactgccgttcatcgcctgcatgtccacattcagcacccacacagtgagacttagatccagtgagagtcagtggtaagacagaggtggcaagagcagcataatgagacgatttttatcagaaaaaccagacattgagggtcgtaacagtttaatgtcagtttagaaaacaaaaacaaaaaaactccatgaatattttcttctttcctgtttaaagtttagatccctattccctaaactaaggaaagatgagaaggaaagttggtgatatatgaatgctgaatatttaataggtcttgtaaacctctccagtcaggaaacacgttccagtagtaaaccaaaccgttgtcttgagcttggaagttaaataaattagcagagtaacttacacctgtatttgggatccaggcatgcaggattatatttaatttaaacgacaattcatttttattgagtcatcctaaagccaatatctgtttgaatatctgagcaaagcctttacatttttagaaggggaaaatatgaattttctactgtgaataattttattgcatttaacattaccattttttataaacacagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaaggtaaaggaagaggaggctgtgagcttagctggaagtaaggaaggctgttgcttccccattcttctatttagtgtagctatccagctggaagttaaatttctaaggaaagaccccttgaaaccttaatctccaaaggtcactggttggttgttatttgcttattaaagtgcctattgaaattaggtttccaatacaaaattctggtgcatttgcgaactctcagagaactattaattaggcaattgaaagcaaaacttgtcagtaaaaaaatgtgtgtttgagtggttcaaagaactaaccatatcatttatatatttgctaattgcttattgtttttttttgagacagagtttccctctgttgcccaagctggagtgcagtggtacaatcttggctcactgcaacctctgcctcccaggttcaagtgatccttctgcctcagcctcctgagtagctgggattatgggcgcctgccaccacacctggctaatttttgtatttttagtagagacggggtttcaccatgttggccaggctggtcttgaactcctgacctcgtgatctgcccgtcttgtcctcccaaagtgctgggattacaggcgtgagccaccaggcccagccttaattgctcattctttaaaagtggctattaatatctctaatagagaagacaatttggaggatagctaaaacaagtagatgctcaaaaagaatcaaaatggctaatattgtggcattcattaattagcagtctgcatcacctcttcccttttaaagagctatattcattatttgaatatgaattatacataggataacattttaaccttgtaaaaattgccaataaaaatagttaatcacagtatattctactgaaccatctactgttgcttttatgcagagaagtttagaaaatattaagttacgaagttgtaaagcagacttttgttgatttttttttttaaaggaatttctttgtaaaaccttaaaacttaattcactttccagtgtatcagaagttgttgatgactgttacgggtgcagtgcaggaaaacaaaaggagcatgagaaataatgccagcatgttagggggtttgcagtttatttccttgctactcagtatgtggtcctcatcccccaacccctgaccccaatagcatctgcataatcaggtaactggatagaattgcagaatctcagtctcccctcaactgccccacaacaactgcatcctaacaagatttgtatgcaccttaaagtttgagaagcattgggctgcttgggaagaattagtgtatacatctatgatccaataatagaattttgactcttctgtagcagctttgatggaaaatgagacaaaagagaaatacacaattctaaatttgccttcccctttattaattaatgcctttcccttaaaacgagcaagtttttctccaggggaggactattagactaatagcacatttcctgcctacctcgtttccatttcccgtgtttcctacccagagaatagtgcaatttctctgggtaggagaatattttaaatattttatttaaaagtcttttcttatttttgaaactagatatttcagaaatagagtcaaaccgatcattttctccagaggagagacgtcatcagtattctgattatgattatcattcctcaagtgagaagctgaaggaaaggccaaggtaagatgacatgaatattctcttgtacatgtcattgtgaatgtacacacatatgtatttatgaaactgttatctcttgagacatttacgtatgacatgtgattcagttccagagaggacacgccgagcagattgtccaggatgggtgcgacacccactccctttaagtccacaggggatattgcaggcacagttgtcccagagaccaacaaggaacccagataccaagaggaccccccaggtgagccattaagaccactcagtttcaacagttgtgttcagaagtgtgtgctcacacagccataacaaagagtgaaatcatgtcctttgcagccacgtggatgcagctggaggccattatcctaagctaattaacatggtaacagaaaaccacacagcacatgttctgacttttaagtgggagctaaacattgggtacaaatggacatagaggtggcagtaacagaaactggggacaactagaggggaaactactaaaggaggagatggaaagggttgaaaaactattaggtatcatgctcacaccttggtgacaggatcagttgtaccccaaacctcagcatcatgcagtatatgcatgtaacagacttggacgtgcacccactgaacctaaaataaaagttgaaattatacacatatatgtaaatacatagatatgtatacatatatgtatgcatgtgtgtatatatgtatacagatatgtatgtacatgtatatgtgtatgtatagataagtgtgtacttaattccagagggtggctgaaagggaagaaggaaataaaaaattatatatggaagaggccttcctttctctcttttgacgttgacaaaatataaaataatagccttgtctaaatgccattagaattggtcacactttgtcatatttgatgagttgaggtcattgttttctcccatccttgatcctgacctcttcccccaacccttccccaccaccctacaattatcatcataattttatattcataaatatttaaggggaaacagtatcattattgtatgttttttaagttgttaaaaattctatgttcttgtgcatgtgattgtacaccttgcattttagaggttcattttttatctcttgtattttgagaaaccattggcacctgctaatacttcagagttaaacggcactttagagacttctttttgtttgtggtgacatatgtggcatagacttacattttttgtggattttgtgatttttctatttagaaacgcactcttgttagtccagattgataacagtagatgtttcttaacctacagctcctcaaccaaaagcagccccgagaacttttcttcgtcctagtcctgaagatgaagcaatatatgggtatgtatttccgtctctctttgttttcccttcttccttacagctctgtctctgtaactgaaatccagaagagtggtggtttttgcctagatggtgattttgtacactgtcagccacctgtaaccaatccccattggtagtgcttatgagaaagaggaatgatttgtgggaacagcaaaatgcggaagtgggtgaactttgtgatgttaatgttgtctgtttacctacctatctagctacctttccagagtgttactctgaatatttgcgtttgtcagataaattcactcccaaataggtgaagtatttattgctaaactacggtgccctgtggtgactgcactgatgtgatggtcccagtgtcagtccgtgtgggggagggaggaggagtgctgctgcgctctgcacttgataatcagaacccctagttcagcagggttcaagggcagcagcctcctggattaggattctgcttctttgtacccagactgtgtctttatttgacaagaatgcagtgcaagcgggccttcctttggaagaattttagccctaactctgccctttatttgctttctcatcttgaaagagttgctgtaaagattctataattctatgtcttcaccagtaaccagggacctactgatactcatctcatggtcccaagaaagataaaattgtaggatatatgagatagatgagaaaaatgagagggctttgtaaactataaatcactctgtagctagaagaaattaaatctctcatttgctaatgttgttctcccttttaaaaaatatctcccatctttcctttctgaaacggaacctattgcagccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtaagaacagcccagctctgtttctagaagttacttgtaaggagtgcacttttctgggtgttctttctgtaagggaagacaaaatggttcagctggtgaaatagagcagctgcaagtttgttgatgcccagcattgaagtctctgtattcctcaaatgcgtcctgtcttctcagtcttggaacccagaactcatccatgtatctgtgagaactgatagtgtttctgcccttgccaagattttattagtctgattaatgtgaaaatattgagactctaagtaagcacttacaggaaagatttttcaaaaagatttttctgatttttgcttttttcactgtgttccccctgcctgccatctttcttaaggcagtgtcctgaaattgaacaaaggtgagtggttggcatcagactgggtgattggaatttcgtcccagcctctgattagttctgtgaccctggttcaccctgagactcaggtttctgtatctgtttaatggggatgagaatacctgcctcgcagggactgtgggaagattagaccaggtaacacttacaaggcacctagcagagttccctggcacagaataggaaggtgagtgtccattcttttttcttattggaagataacaaatagctgctactcaatgttatttacatctaaaattgtccaagaaagggaattcctggttaatcaaatattgatacttttaaaattactatgtgtttgtataatctgttaaggaattaaaaaataactcaacttgacatttgtgtatgtgtgtgtgtgtgtgtagcattctttgttgacttcggaataaatttcaagaacatcaagtatctccttacaataaaaatatagagtactagggaactgttttttttgtttttttttgtttttgacagtctcgctctgtcacccaggctggagtgcagtggtgctatctcagatcaccgcaacctccgcctcctgggttcaagcaattcttagtcctcagcctccccagtagctgggattacaggtgaactcttaatttttgtctttttagtagagacagggtttcatcatgttgcccaggctggtctcgagctcctgagctcaagcagtccacatgccttggcctcccaaagtgctgggattacaggcgtgagccactgcgcccggctgggaactgtcttcattggaatttcttcctgcttctgcaaacttgcagttcatatatatgaggttttttttttcttgttaatgttagtaaaaaatccatatgtagtaaactaaggggtctggtaggggcttctaggctccaaggagaggggagaaaaaagttctagaattctcaaggaagcaagcagcagcaaagtacaaaagcaggtggcccccttccttcttggccccgttgcagtatttcagatttcatttctggagcagatgaagggcaaaccttgatcatgagctttgcaaaagcttttcagtgaaattctagaccctccttggccctggtcaggatctagaagactatgtacctgcacgaacctcatgttgccttatgatcctaggaaataccactcaccaaatgttactgatgaaaacccatctgagtgccagctcataccagtttactctttgcatatatgctgatgaaggaaaaaggcattttttctaactattgtgaggccataggatgatagctagaaatgtggagcttttgctcattaaggttcaatgataaaatattttcgtatgttcaggggctgggagattttctaaatttccgtgaagaaaagtagtgaattcacctagaggcttggcagtcagacctctctgtaagttgttgttagatggggagagtcgctttggtggataaaaagtcatggtatcagcatttatacttaaggtgttttgtttcttgttatcaccctggcaacacggaaggaactctgggaactggcttcttttgctgtcatcccatatggaggtcaggcaataggtggtcctcatttcttgggtgcgaataaattttctgttgactacaaaagaagctttccgttctagaaaggggtgaaaaagattgagtttgcctacgagggcggagaagctgctgcacaatactaagctgtggctgatacaggatcctcttcaggctcacagcagacacggctagaccctgtagactactaaatagctaatcaaagaggatatttattggaaaggactgttcaatgtaaccttcaagtagaaaagtgctgccctagccttttttcactttaatttgtttcaatgctccttttcatggccaaattgaatatataaagtgagccttatacacatgctaatcactttattctgttgtggggtttttaagtgtggctctttgttttgcaaaggtgacagcctaatgtgtggaatgaagacgtgagccagatatgtatattccttatcaataatggagatatatgtgcttttgctcattcctgcttggctgaactacctctttgcttgttatttatctgatagagttgtcatttctctttcagaaacttttatgggatggaaaagagaaaaaagacttctaagtttggttattaaccatgtagatttttaaaatataactaccatgtgtgctttaattttgaccattatagtttttggctatcgaagactgtgatcgagactgatctaaggttaatctcttgtggccagagagatggactgaaggactcccaaggtcctcccacagccttgtggccctgtcttatttaagtaaacaaatacaagcatgtatagtacatgtgaaaatatacatatggctatatgtagatacagatgtagataaacaaatggcacaagaaaggataccaaaatgggatgattcctaattgggggacagagaggtacaaatgacagtaccttaaatactaaatactgtttcaaaggaaaaattaactcaattgctttagcacatcactttattttaaaagcaccaaattagttttagtctaatgccgactttcacttaatcataaattttggccttaattaaggcccacccaactaaggataagtttcttctttaataaagcattactcttgtgattaaaaggattctgtaattgtcaatgactgaagaaaatatttcataggaattttatatctttatttctacaaaatattattaacatatcaggtactttaatatggtttttgcattttacttatttataattctgttttaaaataggctgaaagatacagaactatgggccaggcgtggtggctcacgcatgtaatcccagcactttgggaggcctaggtgggcggatcacctgaggtcaagagttcgagaccagcctggccaacatggtgaaaccttgtctctactgaaaatacaaaaaaaattagctgggtgtggtggcacatgcctgtagtcgcagctactcagggaggctgaggcaaaagaattgcttgaacccaggaggcggaggttgcagtgagccaagatcgcgccattgcactccagcctgggcgacagagggagactacatctcaaaaaaaaaaaccacatagcactatgatttcaaaatgtcttgttctttgtgctacatttcaattttacttgctttgtaactgtaaggctgatgctctttaatttgatacatacctttcaattttataaacacatgttaaacacttttaggtgatagaagctataggagaagggtagaattggtcagagtctttatttgcacacttttatttgaaccagtttaaaattagtgtaaatgctgggccagcatgctcagttgtcacagaccccaacactccccatgcttcatacttgtgtattaccttcttggccacctctgtgagagactcacagaagggagatggatagaaacaaccacaagaaattctattgtgatctggtgacagatccttgcttcaatggcttaacctctaaggtgcggttggcagtatggggaggcaggaaggtatagtgtgcaggcccatagcaaggtgctgggcgcgaggacttgaatagtgacattaaggactcatttgcatcttggctttgctctggacaggccctgatgaaaacaaacaaaagggtcagtggcatcttactataaacttctctgttttttctttctttctttctttctttctttcttttttttttttttctttttctgtttttccttcctaataggtgaacacacaggatttcagaggattagtgcgggaggatgccgttctctacctgttagaaatccctaaaggtgaaatggtgaccattttagctcagagccgagccgatggtgagcaaatttggtcatttagtttagttggggtgggggtggggagtgggaaggatgagagaggtgtcttggtaccagaataggcaaatctgggtattaaaaaattgagatggatctcaacacctagtccttgggccctaggtgtgtgaagaaaatgtgagtgccgtttaactttccataaaaatgttttctatgcatgcactgaaataattttactagttgtgtcaatttggaataaaactgccttcctgaacagtgatgcagccttatgttctgcctggagttattagtgagtttacatacgacatgtgcaaaggccatggctgctggctggtgcgcctgttacccctgtccagtctgacaagttgtttcacctttccaggccttgttcccatctgttaagtgggtgttgagagtgtcctccttgtctgcttcagagcttgattggcaactgtgttaatgttctccagagaaacagaatgataggagatattggaatcaataggaaagaaagagatttattataaagaattggctcacataattatggagactggcaagtgccaagatctgcagtgaaaatgggcaagatagagactcaggagagccagtgatttagttctagtctcagtctgaaggcctgagaaccaggagagccaatggtgtagttccagtaccaagtcagggaaaagagctgatgtcgccttttgaaggccatcaggcaggaagagtagtttcctcctaattttttatttatttatttatttatttatttatttattattatttttttgagacggagtctggctttgtcgctgaggctggagtgcagtggagcaatcttggctcactgcaagctctgcctcccaggttcaccccattctcctgcctcagcctcccgagtagctgggactacaggcgcccaccaccacgcccggctaattttttgtatttttagtagagacggggtttcactgtgttagccaggatggtctcgatctcctgaccttgtgatccacccaccttggcctcccaaagtgctgggattataggcatgagccaccacgcccagcctagtttcctcttaattgagaaggggtctgattgtcattctcttcaggccctcaactgattggatgaggcccactcgcattggggagggcgatcttctttgctcagtctacccatttatacgtgactgtcattcaaaaacaccctcagagaaaggcatagaataaagtctgaccaaatacctggttatttcatggcccagtcaagttgaaataaaattaaccattgcagcaagccgtgaagctggttatttgtccttgttcctgttggagctgtgactcccataggacttgtgcactgaatggaaggaaggtaaaggggagatcagagataggagaagctgtgttgagtgtctagtactgtaacttgtactaagctgaatgcaacaaacgatgcttttgtctttcagtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcaggtaacagagatcgcattctcacataccccttttaatccttccccctgcagaaaactagagaccgccccccttcccccgtaaaaggaaaccccacatgatgagttcattacttgtcaccatctatttcttgtttatggagagtggcctgaactgtaaatagccaccagccagtttattgtgagtaaatttagcatcatgtggttggttgctgaatgtggctgtttgaacaacttcctaaggagcatccactgccttgtaccgtatacaagagatatactgaatggccgtagcacaccagcacacctcttagagacaaggtacccttgtccggtgcccagtctccatccttggagaggtttatgcaccccagtgaacacttggtgtttggctgacagtgcaggaacctagaaaagaggcctgtatttgagcaggagttccaggtgtgtgtactgtgtacctgcatatcagaatgggccaaatttcacatgtttattgctgagccacttctgggagatttcacagagacccagcctttttctgctcccatttggaagtgaaggtccccacatttcccaccctctgaaacttcttcattgtcaagcggaatcttctctgagctcagaagtaaaattgactggatttgattaatgaaatgcatgttagctgcgttttctggctttagagatttacttcccgtggtttcttctcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaaggtgaggaagtcacatggggcctggaaatgaactgactgggctctgagcctgttcacctttattttcagactgtatggtcaagttctaacttatgtatgtcagttatgccaaaggcagtttatagagttgaaatcaaattctaacaaggagcatgatttataaaaagctgtttcagttcctaaattgaggcttatttctgcaacttaaaaaatgttttaataccactgttcaagagtttcggtatattggctgggcactgtaccttatgcctataatcgtagcactttgggaggccaaggtgggaggatcacttgagctcagaagttcaagactagcctgggcaatatagtaagacctcatctctgcaaaaaataaaaaaagtttccatatattatcaatgggaaagtttgtgtttaaaaatggtgaggagctaggcagtgtagtcccagctactcaggaggcttgagcctaggagtttgagtttagtctgggcaacatagtgagatcttgtctcttaaaaaaaaatctaggttagcatgtggttgaatgaaaagaaaaaaattgttttaaatggtgaggatagtgaaggcatattcttcagaacagagccaagctgaattggggagaaaccacagtttctttcgtttagttatgttatcaaaagcccatacaatacttttactgcttatcataacagctaggcaagtgtgtatgctttaatggcctttcttgtcatttcagctggtttcaagagacctgtggtcttattcggccccatagctgatatagcaatggaaaaattggctaatgagttacctgactggtttcaaactgctagtaagtctgtcagtgtttttttttcccccaaatttttattttgaaaaatttctaacagaggagttggaagaatcatgaacacccacgtacccttcacctggaatcaccagttgctgacattttgtcacgcattttctctcacccactgcctgcaccatagacacacatacacacacacatacacatactctttgaaaaatttctgcagaatcatttataacactttatccctgaatacttgtgtgaatctcctaagaacaaggactttctcccacataactgcaataccattatcacagccaagaaaggtaacattgatgtggtgtgattttgtatatagtccattttccacgttttcttaattgtcctagttatgtgcttcatagcttttttttaaattcagaatacaaccaaggaccattcatgacatttgatttttatgtctttttgtgatttttatgtctttccagtcccctcttttttctaaataactttgttacactgatattttgaagaatccaagctagttgtctcctagaatgcttcctgttggactggcctaaccgtttcttcatgattagatttccactaagcaggttatgtgggtccttcccactgaatcttgttaggagacacttaatgtcaggtgtgccatcattgcttgatgctaggtgggagtatttggttgtcactgttttctaaacaattatttagcttcctgtttttgcttttgcagaaacggaaccaaaagatgcaggatctgagaaatccactggagtggtccggttaaataccgtgaggcaaattattgaacaggtgagaaaattcatccacagaccgtgttttcagaaagaattagattatggtttgctgcagtcacttttaggatagtatctgtacttttaatcattaaatgttaataataaaaaattggccgggcacagtggcttacacctgtaatcccaacactttgagaggctgaggcgggtggatcacctgaggtcaggagttcgagaccagcctggccaacatggtgaaaccctgtctctactaaaaatataaaaaattagccgggcacagtggcaggtacctgtagtcccagccactcaggaggctgaggcaggagaatcgcttgaactcaggaggcggagtttgcagtgagcggagattgcaccattgcactccagcctgggcgacgagtgaaactccatctcaaaaaaatatatatataatgtaaatgcaaaccgtttcactgtgtggaaaccagtcactgttggcagtgagcggagattgcaccattgcactccagcctgggcgacaagagtgaaactccatctcaaaaaaatatatatataatgtaaatgcaaaccatttcactgtgtggaaaccagtcactgttactgttctctggcagtaacatactgtttttttttccagagttcccagcattataccaaataatgtgttaattcattttatcagaagttctaacacattggtaatattgaagtgggcattaggtagaaggaaatgtgttctgcttcttgatttaaatttacaagataggtggctcatgcctgtaatcccagcactttgggaggcagaggcgggcggatcacctgaagtcaggagtttgggaccagcctggccaacatggtgaaaccctgtctctactaaaaatacaaaaattagctggccatggtggtggcgggcacctgtaatcccagctactcaggaggctgagacaggataattgcttgaacccgggaggcggaggtcgcagtgagccaagtttgtgccactgcactccagcctgggcaacagagcaagaatctatcccaaataagtaaacaaacaaacaaacaagatatatctcatacagcctttacttattaaaacaaagtatttgatgctatattactttatatatccatttctctaacttttccccttttgtaaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacaggtaagtgaaatgtaaatgtagtccctttgctaaaaaatgagaaataaagaattgaagagtagaagaaataattaattaatctgaatggagaatttgaaattgtgttcatgactccttgaaaaatagttaatcctataaaatgggatattaggccaatggcatttatatattgaactttgtaattttgtctatttgaaaatgaccataaagatccatgatgtggtaataattagctattttgatgaagttcatattttcctgtgagactataaggctagtgattgagccaggccaaacacctatgtctctctagagattgtgtcattgttctctactcaccatcaatacatgcattaacttacaaagcgaaaggaacttggtttcattatttaaaaatattcctgtccagcatggtggataacacttgtaatcctcccactttgggaggccaaggcaggaggatcacttgagcccaggggttggagaccagcctgagcaacatggtgagatcctgtctctactaaaaggcctagcatggtggtgcatgcctatggctgaggttggaggatcgcttgagccaggaattcaaagctgcagtgagctgtgatggcactgctgcactcctgcctggtgactgagtgagaccctgtctcttcaaagaaaaaaaaaaaaatctagaaacttggacactctgaatattggatgatttaaagatttattatttctctttgttaggtgtgataataatattgtgatttttttaaaaacaaagttctttgaggaatgcatactaaataaaatatttatggttgacctaatataatgttgagaatttgcctaaatagtctgcagtgaggggagtagatgggattatagacaggacaagactggccaagacttggtagttgttagttgttgaactggttgatatgtacatcggagttcattaaactgctatctgtacttttgtacatatttaaagatttacctaatagaatatatttttaagtccatgaaatgaagagccattgctattactcatgaaagtaaaatggtctaagaacatgacatattttagtaacaatatatgcactgtctatataaatgattaattctgtgcatatgagattattaagagttttaaagggttacataaattttgtggtcatgcagggcattattttgttggggcaacacgaggagactgcaaggatatgatatccttaggatgaggatagctcattgagttcattgcccatcatcatccacccatgtcattttagtgtatctctgatactggagaggaaggggtgaatgattgtgttcacattagatgcttgttttagtgtaacttggtttttcttgttaaagagaggtgcactacttgccactgtggccaaatggagagagtttaaccaaatgcagaggaggaagtggtccatcataaactagatttctgtgaatgtagtcttacgtactcatactcttggtatatttatgaatatcctttctgtcctttttactactagtattataattattatgattattactattatagcaacagtaaagagtggtacagccttccatgtgtgctgtcttattaggccataagaaaggccagcacttttgcataatcacaattctgatgtatgactgagcccagactaaactatagcgtccctaactgtccaatattgtacatatgttacagcacagacatattctaatcccaaaaggggtcacgtaatgcagcccttccttttgacagattaaaaaactgaagccaaagtgattataaatgaagttaaaactatccccactttattttcccccctgcttttgtctgagtacactaaatagcgagcgtcttccctcagagagttaaatttgggattcacgtgaggatgtaggaaatcgggaagggaattacagtgcattgtagaggaagaactaggctgaaggcggctggacgaggagagcagggcagaagaaggcagccagtgactgtggggctctcccttgatctaacctgagtccgcatcatttgctcttgggagcacaggccacggtagctggctgagtgtgagtaagaatctagaggggtccatgtgtgtagaaggggttagcaacacctctgttagctccatagatggatttcaagatccttgaaggcagagcctgaacatttcccagcgttgtgtgcctgaggccagcatcaggactagcacatgggcaaggcataaatgtttgtaacttacattagaactgcccctggcacaccaagccatttcttgcctaaactcatcaggaagttgaaagttttagaataactcaagtcagagattggaatggaagcacacactgtaagcattgagtttcatctaaaacattgaagtgatcttatctcaccagaaattgccaatctcttatgtagaattgtacagtcttcaggatagatggtgcagggtgtgcagcaactttgaccagcaagctccaattttctagcaagtggtcttttacagtactcttccagacttcaaagtttgactccctacagctgtgtggatgactgcactaataattgcttttattccccatctcaccctcgtccctcttagcttgaccaggttttgacttgaggctgtgtgccatgtccagaaacactagtctttacatttgagcagtagaatcttcaggcagaattagtattttatagtttttgtttgtttttgagacatagtctccctctgtcgcccaagctagagtgcagtggcacgatctcggttcactgcaacctctgcttcctgggctcaaggcaccttccctcctcagcctccccagtagctgggactacaggcacacaccaccatgcctgggtaatttttgtattttttctggcaacagggtttacccatgttgcccaagctggtctcaaacccctgggctcaagcaatctgcccgtgttggcctcctaaaatgctgggattacaggcatgagccaccgtgcctggcctattttgtaggcttttaaaatgattttaagtgtatggcatttttgtgagttagtagttgagaataatagagtgctttgatgaacacagtaatttgaagtcaagctttatgttgcattagtctctttaggctcaatatccttttgttttcctttttgcaaagtaataagaaagctcctcttcctcacgagtatttaattatgacaatatgaaaatagttctccttacaagtcttacagtacttctcagttaaacaagagaagctttattctgagatttgcccaaaggcaagttgacttgtcataataagtttaagtgttaggtttgcctcccctactaccaatttttaaaaattttctataaaatacatttgcatatcacaaatttttatttttaaaaaacaaactttgaattacatgttttcttggaatcttcaaagtactcagtgcatggttcgaagatcatttaagttgacttatggatttagagacccaagtggggctacccttttatgctaattatagaattttaattcctgatttctcaaaggattatatagactagctagttgaccacagaaaagagaaggaagatgctgggccccctagctggatacctttgctgttgcatgcccatttagagggggtctagcgtgccactgttaaccgagccacgtgaaaagctttattgagttttgacttagataccatataatccacccattgaaagtatatagttcagctgggcatggtggctcacgcctgtaaatcccagcacattgggaggccaaggtgggcaggtcacttgagctcaggagtttgagaccagcctgggcaacatgatgaaaccctgtctctattaaaaataaaaaaattagctgggtgtggtggtgggtgccggtagtcccagctacttgggaggctgaggtgggaggatcacttaagcccgggagctggaggttgcagtgagccgagattgcactacagcactccagcctgggcgacaatgagaccctgtctcaggaaaaaaaaaaaaaaaaaaaaaaagtatgcaattcagtgggctttagtatattcagagttgtacagctgtcatcacaaccaatcaatcttagaacatttttatcatccccaaaagataccccatacccattagcagtcattccccatttctccctttccctaaaccctctagtcttagatgttaccttttgctgtcgctcttggtgcttccaaacctccttggctggggagggggaggtagcactgaccatacatgtcagggctgggcacacgtgccctcagaacctcagtattcccaactaaggcagtggctgagtcagcatcctttcagtatttcactttcttgagctcaaaagatagagtaagtctatccaaggggatataggcataacccagaggttaggagcaacagataattaactactattgctctaaggcaaagaatctgagaagcggaatgagagaatccaataataagctaaaggtacttaattcagcagagtcaagggaaggcagcttcatgtctgtgcacctgcctgttaaaaagaggtcaagtgcatgagttggatgttacttttatatgcagcttaggaagttagctactgtgaagctctcaatttttattcataaacttgactgttaatgtgaattcagtaagagcttttgtgattttctttattttatcaaggggcaagaacatatttcctgcatctcacaaaatgccgttttaactttaggttttctttatgatgaatgcagaccatacttatctcagacagctgcaacataaagctttaaaagactgcttaacattttgtatatatttagtgtaaatcactcattttgtctctggggtacaaaatctcacttctatttttaagtatcatattttagctatgagatgagcacagtaatctttgcagagtaccataataggaatagagaagtccgtggaatcaaagttaattttcttcgggttgtctaatggatcagtttatttcagtgctgtaaataattaataaccaaggaaattgtaagctcattcaggattttctaaggtcactgttagaacttcttaaacagaagaaagctatgttacttggaggaaaacctgaagcatcattgcttacaaaatttgcttaatggttctttttggctttagaagtgatagtacaataagaggccatggcaatgtagtttaaaagaaatcctaatttacctgcagtctgataattttaggggtacaatttgttattttggactaacttgcttgtctaatttatctccattaggtccataatacatattgctgaagaaatgacatatgttgtactttgttggtattttatatctgtgctctaaatttctgtttttagatgggccatgtagtgtggtggctgagaccataggctctgaaagcagttttctgagcttgcatccaagcttcacacttgcttggtgtgtggccttgggctagttaatttcactactttaccttggtttctcatctataagatgggcatcatagcaacacctaccttgcaaagtttgtgtagtcgtgaaatgagctaatccaggtaaggtacttggaaagtaactggttgatgcatagtaagtgctattatgtaagatatactttgttctgagtagaaaatgtatattctttgaatacacactggttgggtttgtttaatctatatgtatattctaaaatgtgtaagtctatcaaagtgatatacagtcagctctccatgtctgtggtttccacattcatgaattcaactagccgtgtataggaaatatttgaggggtaaaatggatggttacatctaaacgtgcagggtttttttcttgtcattattccctaaacaatatagtataacaacgatttgcgtagcatttacattgtattaggaattataagtaatccagagatgatttaaagtatataagaggatgtacataagtcatatgcaaatactgtgtcattttgtatcagatactcggcatctgtggattttggtatccaagtggggggtgtcccggaaccaatcctctacagataccaagggacaactttatgtttaagtgttacttttagtattttattggaggtagccaatacagtatattagtgtatactaattagtgtatacacctcagcctcccagagtgctgagattacaggcatgagccaccacacctggccgaaaacacatgttcttaaaaacatttttaaaagttagcctttctgaaaataaacattctaaaaatctatttttagctttatcacatccacctataatgtgaactcaaacagctacatgattagtagttttaattgcattcattaaaagggttttaatattcaaagatgtgcaaacatcttcttgcgtctgccatagtcttaaatatcacagaaatgagtgtaaattatgtcaaatagcatccttaataaacatgcctctggaaattaatgcagacctttttgtttatatttctatagctacaatcaacctaaattcagccaatgatagctggtttggcagcttaaaggacactattcagcatcagcaaggagaagcggtttgggtctctgaaggaaaggtatgtggcatagatatgctgctatgaggtgagagtccctgttctgaaacttttctcaagagggcagtgaatgtagtcaagccatgcccatttgaagtgatgctcacatgtgtgctaatcaagtttgaaatttcgtaaattctctgaccaagtaataaaaatgaagggacttttaaaagaagagcagaatgtgacatgtgcagccctacattcacttccctttcacttttaatgtagtaactagtgttatattccaagtacactaatcagagcttacaagatctcatgctgagctccacagcttactaaggacgtgggaaacttagagtgcagatgagaggtgaggttgagcaacttggagaatacggctaaacattaataaaaagaaaagctaatggagttagaattacttagaaaataaggttggttgagaatgtgccatcgttctgggagtttgaatgggtgatatgagaacgttagggaatttgtctaggcctctagaattggatcgcttctccctcggggagatagctcacacacagctgtgctgcagggaggagagagggagattctattacctgtggccgcttttattttagaagcttttggtgttagtatcctgttcaccagctgaactgaggtagttttgtgagacttgacagtgactattttgttgcagaattgactaagttttgctctttgagaactagatgtgtagtcaaagtatctggcatctatggagtgcttccagtttggaagggggatgcaagcttccctggggaggacaggttgaacaggacatagcttctgcctttgagggtctgagaatcttgtagaggcatggatgtgagtgtagcacaaggcagcgtgcaatgtgttgatattactaggagagtggtaccaggagaacaggctgcagaggagctggattcagaagaaaagcaagacagactgagaaagtgtggcttagccgcggtatggaggatggatggtagcacagataggctgcagggcccctaatttgagttcctgcacaaaaacgaccataatatcaacattgtaccaaagccaagtgatctcagggagaaaaataaaagatgccttccctggcgagcacatcaaggtttcagtcgcttggctgtgtccttgggaattttcttgagtccccactcccaggagccacatcagaccccactgaccgtccaacacaaattcctctagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggaggtgaggcgaggcaggccacgggcaggaacaggagagcctggtgttttccttgcactctcgtggacagctgtgtgttcagggtgctgtggaaggcattcctaagggttggagcagatgacttccagggagtctctcgctttgagtccacgctggcatggttgcagtctgtgggaaagtggggcaggcaggtggacttcagaagagcttgaggggtcagcactccgcacacccatgccctcaggtgcgatggataaacagaatggctttaggtgccgtctgtccaaattaccagcggaaccttccttcccatgcagtattgttgtatgtacttgtaacctttgattaggtttctctctgtactcttagatgtccttgcttttcttccccatcctgcctttaacctttctaatcttgccaaagctcttgagtgtttccccatcagtttccttctctcttatatttcagttttttaattgagttcatgatcaaaccttcatctgatcacatcacatgtactgtgcatccactgtgattagatagcttatgggatccttgaaatcacattgacaggcactgtaaagtcacagccaagttagcaattattagttgcacctcagagaatgttggaataatgatctttgaagatgggattgttcatatatttggataattattgctgtggatttctctctagcattttagctcattccagtaaatgatttttttctttatgaaatagaactaccaaaaaaaaaaaaaaaaaaaagttcaacaacaacaaactgaagggggagaaaaatacaccattaccacagcaacaaattagtttatgctagacaacttgtaaagaataaattaacttccaaatgcctatagacatggatattagtgacacaagagattttagacttttggagggttcttaaaaaattgtgctttaaaggaagagactctacattggatgcagccagtttttaaaaatgtgtctgaagcatttggtgatggtttctgcctgttcagtaaagaagcaccggctcagaacctcaacttctggacttactcaagtttgcagaactcctccaaagcagtcgagtgctctgttctctctgcttggatgttcttgttgtgaatgaacctttatgtcttgtagagcataaggaaacccagcccagagccacgagctcagatgaggagggctgctagcagcgatcaacttagggacaatagcccgcccccagcattcaagccagagccgcccaaggtacgtggctgggaagcccaggatgggaaggaagaggaagcagatgcctctgaagcctcctggacggccagggaggagcatgcacactgagatggtgtttaattacggttctgactcactgtgttctctattagagcctatcttttggcctgttgggtgaactcccaaattagggaagggcaaaaaggaaggaaaggcaatattaggagagcatatgattttaggactgttagtgtttatttaatttactcttcttgttaaaaaaagattgtaaagaaaaagattgaaaaatactgtactgtatacccagaatcaccaatcgcagaacgtgtttttcttttgctgtccagctaaagttttctgcccagtctgatttagatgcaccagataattcttactggtgatgtgctaaagagaataatcatcaccactgcttacaatgcctctcattaagagagctgcttatttgtttaataaatcattatccagagcagaatcaatataaagacacaagggcttatatcaaaagattatttacctttagtcagaatcagagctgtgactctatgtttttccttataccagaataaaacctatttaactcaataatttattatttattattactattttttgagacagagtctcactctgttgcccaggctggagtgcagtggtgcaatctcggctcactgcaacctccacctcctgggttcaagtgattctcctgcctcagcctcccgagtagctgggacttagaggtgtgcaccactatattcagctaatttttgtatttttagtagagatggggtttcgacatgttggccaggctggtctcgaactcctggcctcaggtgatccacccacttcggcctcccacagtgctgggattacaggcgtgagccactgcgcccagcctaactcaataatttagatgagaagaaagccataattgattgtgtgagccatcagaagtagtaaatgtgataggtactaagtaataataagtgacctcataaaatacatcagcgaaaatttgcaagccgggcaagactggaagtgtgaaggaaaagtggctgttagcgtgaagcagtgctctcctcgctccccaccccagtctcattcctcagctggacatgggtctcacctgggccggctcatgtaccctcagtgcagcagtgacctcagaagcccactcttcgagtcccaaagcctgaattgttctgagatcttctccaagatgctgatctcctctagaacaaaattattccaggtctgatcttacctccagcaatcacagccctcccagcactttccctattcctttttggcttcctgacattcctaatagactagtataggaagggaggtagggctcaggaagcctggccagtggctgtttgccctgctgtattacattccttgtcagaatggtatttgtggaccacctttggaaactgatcaggaaatggagtgtattaaatcactaatatagatttgaaaataaacttaaaagcccagggtgaaaacgtgtcattgctctccgcaggccaaaacccagaacaaagaagaatcctatgacttctccaaatcctatgaatataagtcaaacccctctgccgttgctggtaatgaaactcctggggcatctaccaaaggttatcctcctcctgttgcagcaaaacctacctttgggcggtctatactgaagccctccactcccatccctcctcaagagggtgaggaggtgggagagagcagtgaggagcaagataatgctcccaaatcagtcctgggcaaagtcaaaatatttgagaagatggatcacaaggccaggttacagagaatgcaggagctccaggaagcacagaatgcaagggtaattgtttttaaactacacatcatcaataagagttttaaataagtttgatttcaacataacagcgaacagcccctttgctgctgctgcagatgtggcagggatgcactgcaccaaaggcaggtgctgtgtatgtcacttcagattgccagctcccagcacgtcccttgttcttccaaagaagaaaacttgacaatataggggaagaagattctgctctttatacacagaactttgtatagagttctggaatgaggaagtgtgaggagggaatcagtgcctctcggaagtcgttttaattagaatgtgatttttttttcttaaacgtgtcttcattggctcccagatttgccgtagaaaccaagcaaactgggtgctaaaacagaaaggcccatagattgtactttttgagctgtttgaatttgtataccatatgcacatagaacttttcaaacaaagaagaatttaactaaaggtctgtggagtatatttgcccagtagatgtgggagttttctttcaggtctagcacaacagcagcagtacatctgagcatttttcttttcttgtcgtaaaatatacataacataaaatttaccatttcaaccacttttttcttttatttattttgttttgttttgttttgttttgagacagggtctccctctgtcaccccggctggagtgtagcagtgtgatcacagctcgcagcagcctccacctctcaggctcaggagatactcccacctcagcctcctgaatagctgtaaccacaggcacatgccactgcacccagctaatttttcgtattttttgaagagacaaggttttgtcatgttgctaggctggtctcgaactcctgggctcaagcaatgcaccctcctcagcctcccaaagtgctaggattacaatcatgagtcactgcacccagcctcaaccattttaaaacgttcggttcagcggcattaagtaccttcacattgctgttcagccatcaccaccatccatccccaaaacttttttatccttcccacgtgaaactccgtacccataaaatactaactcaccactctcctctccccgcagtccctggcacccactcctttactttctgttttttgtgaattggacagtgtaggaacctcctataagtagaatcatacactatttgtctttttgtgattggcttatttcccttagcatgatgtcctcaaggttcatccaggttgtagcatgtgtcagagtttcattccttttaaatagttttcctgtctgacgtgtaccgcacataaccatggaaatgaggaggccgcttctgtgtttcctcttcttgaaatgggatgggaaaataagtaggatatggggaaagggtgggaccagcaggaaaccagcaagcagagtgcccagtggttcattctttcactcttattcttttcttttttaattaccacagatcgaaattgcccagaagcatcctgatatctatgcagttccaatcaaaacgcacaagccagaccctggcacgccccagcacacgaggtaagggctgcctagtgggtacaggtctaaggcggggacttctcaaggactgggacttgaagaaagaatttcctttacccaaatttcagagtaacaggaggattttttccccacagattgactgtttgccttactcattccatcaaatttaattgtaaagattacagagtcaaaacttaagcatagtttgcttgtgtgctaaaactctgacaaagtgtaatcattgatgtttccagccagtacatttgacacattggagcctggttatgttacattgcacatggttagcacatgagcagaattcctacggcttagacctgttttgtcttgtttgctgactctcagccaaacttcttaattcctttgcatcatccagcaaagtcagaccgcttgtgctgccctggggtctaaagggaccgtgacaagcaaatgagcagtcttggtaaatgccacacaaacagtaggaatgttcacagtgtcttcctgttgaagttttatactggattgcttcctgcttccgagaatagaaaaaaaaaagtcacattttcttgtggccattcttttgttttttttggagacagagtgactgtcgcccaggctgaagtgcactggtgcaatctcagctcactgcaacctccgtctctcaggttcaagcgattctcgtgcctcagcctcccgggtagctgggattacaggtgtgtgccaccatatccagctagtttttgtatttttaatagagacagggtttcaccatgttggccaggctggtctcaaactcctgacctccgcccgcctcggcctcccaaagtgctaggattacaggtgtgaaccactgtacccagcctcttgtggccattctgactggaagctgaagtctagttttccagtgatagaaaactggaaacaaatttcttctttaccagctgagtggtaacacagtcaaccaggttgcctctggcaacaaagagttcttggttatgatggactgaaactggcagagacctcgctgctgggtgagactagccagggagcttaggggtaaggagggcaccccctgtccaacagggagattcttaggtcagggagcacctggctggcttcctcactcaccgccgaagtgggcattggatttgacctattacgaacctggagcaggaccagggatgccctggttgctctgcagaatgtggctcagaggtaagtgatctgctcgggatacccagtcactgtgctcagagccatgcctccccgggcagccggaggacatggatgtgctctggaatgtctttaacaccctttttttgttagttccagaccccctgagccacagaaagctccttccagaccttatcaggataccagaggaagttatggcagtgatgccgaggaggaggagtaccgccagcagctgtcagaacactccaagcgcggttactatggccagtctgcccgataccgggacacagaattatagatgtctgagcacggactctcccaggcctgcctgcatggcatcagactagccactcctgccaggccgccgggatggttcttctccagttagaatgcaccatggagacgtggtgggactccagctcgtgtgtcctcatggagaacccaggggacagctggtgcaaattcagaactgagggctctgtttgtgggactgggttagaggagtctgtggctttttgttcagaattaagcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaaagcagatacttgaggaaaacactatttccaaaagcacatgtattgacaacagttttataatttaataaaaaggaatacattgcaatccgtaatttt

SEQ ID NO: 432 - DNA, 22185 bp, Homo sapiens
ttaagtcaaaggtttaatcatgatccaagagcccagagagactttaggacaataataggaataaagcaaggcccacaggctccagctcctgatgcccagatgttcggcaggatccggggacagggcagtgcaggcagtagttttccatcctccactcagaggaggagacgagggggcaggagccttcttcacaaaggagaatgactttctaggctgcctcagaacacccagtcctccctaccctaaccctaatctggaatgcaatagagaatggctaacttattagattctggtgatcctggtagtcaagaggaagggctcagaaaggggcttggtggagctggtcaccaccagatgacatggctaaattgtggccaccaaggaggggcagcatgaatcagaagtggagatggggtggagggaatgaggactggaccagtaaggatctggaggtcataacccttagcttctcctgtgccctcatctgcgcactgcacctccttcctgctgctgtcctttcctcaccccttgtgggctgcaagtccacctgggtgtggtggaggggaagagggccctggggaagtccagctaccataggctcaggagcagaatcaagggaagcgtgcaggagaaaagagagggcacccagggctgtggcctcacagcagggttttcattctgtggaagaaatggaatggagttagctcaggggattttctttagccctttcactacctcagcctcagtcaagaggtattccccttcccctgaggtatccattagaggtctctagtattcagggcaatgaggaggtcagcccctcgcctctatccctttgtctgcctagtttgggttttccccagccggcccagtaaaggtctgaggggtgtaacagaggaggccctacctggtgtgccatcacagcaaaggtagggtgtggccagtcctgggagaagagttggctgtgaaaacgcatcttagctgcaatggcctccgctgaagagaggagagaaggctcattggaagggtatgggggcaggagatttctcaggctcccaaggaaggaaagggaatgccacagggaccctgggctataggggagcaagtgggtgggaggtggaagtgggatactctctcattctgcttgtttcttgagctggagatgtccctgggttccagacaggttgaacaggcagcgtgggaggtttctcagggagtgggagacagaagaaaggcctgggctatggcaatgaaagcctatgctaggaactgctctgtttggtggagatggatggaaccagcctgggccacagagtcgacccttttccttcccttgagtccagctgactcagccccaggggctgggagcaagtacagcacactcactgaggcaggggttgtgggagaagaacccttccagcatttcacactcctcctgcaggttgccactgcctcggcaggtgcagcttaaggcaacactggtgttgacattgctgacaaagttgggggtcatggcagtccctgtgaagagggaaagggtagtcaaggcctaggctaaccctaactttagctcccaccttcttccacccatgtcaggatcacatcctttatctccggagcattcttaccctcaggcctagccaacatagggttccctacacatgcccccagcctcaccaatcagccccaggtatgctcgtagacatctggactgctctgttgcacaagttcctaggatgtccatgggatggcagtgggtctggaaatccaccaggcgtgatctggaagaagggaaatttctgtctttcttttttttttttttttgagatgatgtctcactctctcttgcccaggctggagtgcagtagctcaatcttggctcactgcaacctctgcctcccaggttcaaacaattctcctgcctcagcctcccgagtagctgggactacagtcacgtgccaccacacctggctaattctgtatttttagtagagacggggtttcaccatgtcggccaggctggtctcaaactcctgacctcaggtgatccacctgccttggcctctcaaagtgctgggattacaggtatgagccactgcactcggccagaaaaatttcaagtcactcttgagggtccagcctgcagccttctccctcattcccccttagcttggcatgcccattgtcgtgccaaatcctcctctgccttcagagcctggcccagagcctttcctctgtgaagtgtgcccctgtaacagttaaatgtaccattccttggaacccatagcatttcactctgagtttgggctccacgatccctacttatgagatctcagatagcttctttaacctcagtttcctcaactataaaatagagatgacagcagcactacctcgtggatttttgtgaggatgaagtaagagaatgcataagccaggcatagcggctcacgcctgtaatcccagctacttgggaggctgaggtgggagaatcagttgagctcaggggttggagactaccctgagcaacacagcaagaccctgtctcagaacgaaagaaagaaaaaaaaagaaagagaaagagagacagagagaagagaaggagaaaagagagaagagaagagaaggaaggaaggagagagagaggaaggaaggaaggagaaaaagagaggaaggaagaaaggaaagaagtaaggagagaagaagagaaagagagaggaaggaaagaaggaaggaaggagggagggaaggaaggaaggaaagaaggatcgatttaccttattggggttcttgtgaggtttagatgagttaatatatgttaagtacttaaaacagtatctagccctagtaagtatttagttattcagtaaatgttagtattatgattattaagagccctgactataagatagtttacagatgaggaaagtggtagtctcagaagttaagtaacttgccgaaggttacaaagaactaagtaggagaaccaagttgcaaaccaaggttattgtcaacaaatgtcacttgaatgaatgatagcttcaattttgtaagtgttttgtcctgagaagacacaggaaagccagatcagaatttcaaatttcctgaagagaatatttatcaaatctatcaaataccttaccaatctcccatgtcctttgatctggcaatggtactagtagcagcacatcctaagtaataactacattagtgcacaaagattaaagagtaagagttgggcaagcatggtggttcatgcctataatcccagcactttgggaggctgaagtgggctgatcacttgagctcaggagttcaacactggcctggccaacatggcaaaaccccatctctactaaaaatacaaaaattagctgggcactgtggtgtgcacttatagtcccaacatactcaggaggctgaggctggagaatcgcttgaacccaggagatagaggttgcagtaagccgagatcacaacactgccctccagcctgggtaacagagcaagactctgtctcaaaaaaaaaaaaaaaagaagaagaagaagaagaaaaaaaccaatctggctgggcacggtggctcacacctgtaataccagtactttaggaggccaaggtgggcagatcaactgaggccaggagttcgagactagcctggccaacacagcgaaatcccatctctactgaaaatacaaaaaaaattagctgggcgtggtggcaggcgcctgtaatcccagctacttgggaggctgaggggggagtatcccttgaaaccaggaggcggaggctgcagtgagccgagatcgcaccactgcactccagcctgggtgacaaaacaagactccgtcttaaaaaaaaaaaaaaatcgctgggcacggtggcttatgcctgttatcctagcactttgggaggctgaggcgggcggatcacgaggttaggagatggagatcatcctggctaacacggtgaaaccccgtctctactaaaaatacaaaaatttagccgggcctggtggcacatgcctgtagtcccagctacttgggaggctgaggcaggagaatcacttgaacctgggaggcagaggttgcagtgagccgagactgcgccactgcactccagcctggatgacagagagagactccatctcaaaaaaaacaaacaaaaaaaaacaaacaaaaaaaaaaacaaaacaaaaacctaaatatctagcaatagaggaatggttaaattaagtgtagggcatccatacatggaatataatgcaggcatttaaaaatcaagttcttggctgggtgtggtggctcacacctgtaatcctagcactttgggaggccaaagcaggtggatcacagggtcaggagttcgagaccagcctggccaacatagtgaaaccccatctctaccaaaaataaagaaattagctgggcatggtggcacaagcctgtagtcctagctactcgagagactgaggcagaagaatcgcttgaacctggcagacagtggttgcagtgagccaagatcgtgtcactgcactccagcctgggtgacagaaggggactctgtctcaaaaaaaaaaaaaaaagttcttaaaggacagtaagtaaaaaaataagcactaccatttattgagcacttactcttcaccggtactctacaccactctacataaattatgtaatttaactctcaccagaatcccatgaggtctgcattattatcccagtttttacaggggactaaacggaaccttaggtttagtgatggagtttttaggttaagtgctgtgctcaagatcgcagagacccagggtttaaattcaaacccgtctgacttcagatcctgtcttaccactactccacaccacctccacagaaaaatgctcatgagacatgtgccgtaagagaaaaaaagtaagacacaaatacattctcagaatgtctacttttgttatctggatagaaaatgactggaaggaaatgcttcccaaagtatgatagattatcttcaggtgatagaatttttaatgattttttaaaatacatttttatatttcctgaggttttacagcaaagaaaaaaaagacatatattctttttgagaaaagactttcacaaaatatccaaggtagctacttcgtgaagcagccagtgggtccacggttccctgggagggtcagaccctgctcagcacaggaacgtggccaggaaggagtggcgtgtgcctcatccctgcccaccctgtcctcccaaactacacacctgcaaagcgggtcggagaagcagaggcgccgcagctccaggcagttgggggccacaggcggcagcgcgcagttgggggcgatggtgttgcgccggcgctccccgcagccccggtcgttgggggcacatgggcacagtagcaggccctgcgcgtggggctcggcggccttctcgaagaaagtgagcagctgcctgaggcagacgtggcgctggcagtggggcccggagcacgcctccccgtaggccttgcgcagccggtcacacttgtcattgagagtacacagcatggcaaacttgaggcagaggtctgagtctggggggaaagggcacggagtcagtcggctgggccctctgcacgcctgcaccccaggttccacaggaaccccggaaacccctgatttgacaagaaggtagtggatataggaggaaaagaaggcctgtcatgaataaacccactcctaatccagggcttcccctctccccacaaactctacctgctgttttgaagccttccccaccctactcctctttttttttttttttttttttttttttttttgagacggagttttgctcttgttggccaagccgaagtgcaatggcgtgatctcggctcactgcaacctccgcctcctgggttcaagcaattctcctgcctcagcctcccgagtagctgggattacacgcatgcgccacgacgcccggctaattttttgtatttttagtagaaatggggtttcatcatgttagccaggctggtcttgaactcccgacctcaggtaatccgcccatctcggcctcccaaagtgctgggattacaggcatgaaccgccgcgcccggcacaactcctcatcttgactacgtaaaataataagaataatcactatcatcatctatatgcatcgaacacccatttatctagaattcaagcagccagaaagcttaaataaccatacctctttcctcagtgctatgctgtgagatctgatggtagaaatgataacctagagtacctgcaacattctaaagcactttcagaactgtccaaaacagatgcatccaaattctattttaggtttctggtttggttttggcttcgtctgcacctatcctgttccattttaatgtcacctgcccatctttcattaattgattcatgtatactctgttccccatactctgaatcttgggaaattatggtgatatttctattaacagaatattccagcagccacagcaatcaagtaattgcaacaggttatttgctgatcttgtcacttagagtttttcatgcatgaaactctatgcctttttctcaaaattctaattctaatgataaagctcacatctttctcaaaaagagagtgcatgtgtgtatgtttttcctcaattaactcatagcctcactttcctgaaaaacatgcaacacagtccttgccagactgatggctccccaccctgagtcaccccgtgcagagtcacactctcttttcctgcccaatacctcgcccatcccattagaatggttgaaaacaagcaatttcctagtcttcagggacaaaaaggctactttcccagctgccttgaatgcaagtaaatactgcatttcagcacaatttttcctggggctgctgccactcccaccacgccctttgcaggggctcgccttgtggaaacagggagccctaatgggctctcttcaaatgcctccctaataactgctgtcctttggagacccctgtgagaccagatcatgccccagagctcacacttccagcctgacacagtcttccttagtcacctggtaggctagaaacatttcccttataagctccccaacttctgcccctccccagccacccttcctccagggtccagccccagcctctggttcccgagcctagttgccctccacacctggtttgagcatgttcagtttgctgagattcattttccagggtttgctggtcactgtgtcttcatagggggagacatccagctcatagttacctagagacaaggtggggagcaccagaatgctgaggaccagggtggggtaggctggaggggctgaagctgctggctcagacctcaaaggcctgtggagaaaaggaaaagcacagcctctacctaaccagctgcaagctgtgcaaagatgagaaaaatgcagggccgtaaggtataggctgggctccaccaataagccataagaataataagagctaccatttgttaagcacactgtgtgctgagcaccatgctataagtgaggtaaataaatatgctgagcaccatcgcacttacgcgatggtgctcagcacacagtgtagggaggcaagaggattcagggagaagcctctgaggaagttcggaaagagaagtgattaggatgaggagtagaaaacagggagcaaggagtgtggtaaactgtattattgtttccaattatttgttccccaccccttgggaggattatacgtccccacctgttgccatgtaactttcacaccccctgtgagaggcgtacacttcctcaccccactgatggcaggcttggccaggtgacttgctctggtctgtggattgtgagctgaagtgatgtaaatcacatctgagcagaagctttaagaatcttcacatggttctgctgctactctttctcctctaccagcctggatcttccagtgaagaagacaagtagaacagagacaaggccaactcatagaagcctccagcagatgtgtaacatgagcaagaaatacatttttgttgttgaaagccagagatttgggaattggttgttgcaatagcataacctagcaaattcttactaaaaatgcaatggggtgccgggcacggtggctcacacctgtaatcctagcactttgggaggcctaggcgggtagatcacctgaggtcaggagttcgagaccagcctggccaacatggtgaaaccccatctctactaaaaatacaaaaattagttgggcatggtggcgcatgcctgtaatcccagctacctgggaggctgaggtgggagaatcacttgaacccgggaggcggaggctgcagtgagccaagatcatgccactgcactccagcctgggcgacagtgagtctccatctgaaaaaaaaaaaatgcaactgggaggctgaggcaggaatattccttgaacctaggaacttgagaccagcctggagaacacagcaggacttcatctctacaaaaaatttagctgggtccggtggcacacacatatagtcccagctactcgagaggctgaggtgggaggatcacttgagcccaggaggttgaggctgcagtgagctatgactgtgccactgcactccagcctgggtgacaagtgagactccaactaaaaaaaacagcaaaaataaaatgcaattggtacctagaagtggagcgctacagtaataaaataatataatgtgtgtcattggctttggtactgggcaatgggtggtaaggaagctgttactgggggctggaaagatggcagtcttcattatgcagtggcaaagcatctggtaaaattgttgtgtgtgataactgggaagattatatgctgaatgagtttgtactgttaggggaagctgagaagcagaagtttactagtatgtcttgattgctattggctgcatttggcaaggtactacaagatataagctcagaaaagaattggccagttcccaaatgtggaggaaaagataatctagaaatttcaggacttccaggattaagaaatgcaactgtgctgggcgcagtggctcatgcctgtaatcccggcattttgggaggccgaggcaggcagatcacgaggtcaggagttcaagaccagcctgaccaacatggtgaaaccccctctctactaaaaatacaaaaattagccaggcatggtggcaggggcctgtaatcccagctactcaggaggctgaggcaggagaatcgcttgaacccgggaggcagaggttgcagtgagccaatatcacgccactgcactccagccagggcaacagaggaagactctgtctcaaaaaaaaaaaaaaaaaaaaaaaagaagaagaagaagaaatgccactgtttcttgtattcataaggtaaaagataaaacataaaaaaaaatgctttgagtgataaggttgattacaactcagccttggggaaaagaccaaatgaggtatgtggctatcacactgtttgtggatatctctcagtcgattaagatggtacccaataagtcctgccagttggacaaatgtactcagggaaaaaagactaaagtagtggctcttccacagaagcctgataagggctaggtgcttctaattaggtgtagaaaaagaggcatgtcttgaattgtgggaaaggccacaggcacatgagatgatagaaatcaaagatataagcagcaattatgttttcagagagttgtactacaaagagctaccagtgtagattaaaagagactgtgactatttgagacttaaaatgccccaacatttctcaggcaggaagcaggctgagaatgcggctcagtcctcagggagaatgtagtccctaatacccttttcaaatgtggccaaagagaaaactgaaagaggaaggacctttccagagggctgggccaagagctctggaaaacaatggatagggcaactactcccgtggagtaaaaacagggccttattaaagaacaatccctattcccagggaagaggacccttacaacatttgtctagcaggatttcagaattgctatgaatcaatgtctgctgtgtgtctcccattcattcattcatttatttatttgagacagggtcttgctctgtcacccaggctggagtgcagtggtgtgatcatggctcactgcagcctcaacctcctggactcaagtgatcctcccacctcagcctcccgagtagctgggaccacaggtgtgcaccaccacactcagctaatttatttatttttttgtagtgatgggagctcgctatgttgtccaggctggtcttgaactcctgggctttagggatactcccgccttggcctcccaagttgctgaagttacaggtgtgagccaccacacttagatgcccattcctcccctttctgagaatgtttgttgtggttatcctgaccctgttccgttattatatgctgagtacgtataggaagcagatgacttgtctttttagttcataagtttttagattaagaggagccacatccagacccaatttggaaactatcatgagatcctagacttgaagcctgatgtcatgtttgtttgtttgtttgtttgctttttgcttgtttttttcgagacagagtctcgctctgtcgcccaggctagagtgcagtggcgcaatctcgactcactgcaacctctgcttcccgggttcaagtgattctcctgcctcagcttcccaagtagcctgggattacaggtgcccaccaccatgcccagctaattttttgtatttttagtagagatgaggtttcaccatgttggccaggctggtcttgaactcctgaactcaagtgatccgcctgccttggcctcccaaagtgctaggattacaggtgtgagccaccacacccggcttgatgtcaggtttgaacagagcttttagggcatcttccatggaaaataggtgggtatattttacttgcagaagggagagaaatgaatactttgacaatggtagattgtattattgtttccaatcattctttgccttccctgtaagattgtatatcctcacttattgccatgtgatttttggtatctccctgtggaagaagtataattctcaatccagtgatgtcaggcttagccatgtgacttgctctctcaatgaaatgtaagcagacgtagtgtatataagatttgagcagaaactttaaaaatcatcatgtggttctgccaatgctcatttccttctgccacgagaagggaacatcccagacagaggctgcaccttgagcctggatcccagaatgaagaaggcccatgaaagagccaatacagaacatgagcaagaattaaacctttgttttgcaagtcactgttttgttacagcaacatagtccggtaaaagctgactaataaggggcctatggaaagagtgacaagcagctcctctttggctctttctgtgccttctctctcttacatctcctggctggttaatgagtattctttctgttaaaggctggaccaagatgttacctccccatctctctgaacttggtatttggagcctgtttatgggttaagacttttttctcccatctcctgtccatacccgctgttccaggaactccccaggttgggcctcagcctggttcacagctctgctaagtgggaactgacatgttgccaggtaagaaagggggaagtagggagaagagagggcagtgttatggggccccaaggagatcccagcactatccctccacctttcctgatgtcaaatgcagagcttcattatcctcctcctcagattctaccatgtggcccatatcctgcaggattaaaaaacaacccccaagagccatcttccccagcttagtccactctataatgggagcctcaccaaggctgcgggcacggtgaacggtccaatagatgtccaagcaggcaacctggttcttcatgcgccggtggcacatgcagcctatcagagagctgttcctgagttgctgtgctgcctccaggcagtcagcagggaccgaaggctcctctgagggcagtggggtgcttatgctagaggtgcaggaatccaggtggtggtaggcagcactgcaggtgggatcagcctggcacttcctcctggcctggagacagctgttcatgagtcggctttctgtgggaagggggtctcctgtaaagggagataccaggtgaggctacgtaagattagaatagctgtctgggaataccaagtcatgaggttgggagagggatattcctgatgaaactttgtgaaagtcttagggtagcacaaaaggcctttaagaataagtgtggagagagagagaagcccagcaggactggatagtctgcagctgccacagtcgggacagaacagaccaggcccaacaagaaataggggtttgcagagaggctgctcagccttcagggaggtgaagggaatagttgtttgaaggcgagcctgatgaccctgacaggcacagaggaaggggtccccaggcagagccatgccatgggcagggctagtatcagaaccagagagttgagaatggacaagggagtgctaaatgggagtcagcaataactttgagtctcccattaaaaatcatttaaaaatacctgaaggtggaaactggctggggttggggtagagagctaattccaaaaggaaagaaagggtaacctgaccctgtctcttactcagaaataccaagattcctccacagcccggaaggaagcccctgcatcctaggatttagggtgctcaacatggggtaatagaacatcatcatctcactagctgttcaaagataaaaatctaggagaactttttttttttttttttttttttttttgagacagagtttcgctcttgttacccaggttggagtgcaatggcgtgatcttggctcaacgcaacctccgcctcccgggttcaagcgattctcctgcctcagcctcccgtgtagctgggattacaggcgtgcgccatcacacgcccagctaattttatatttttagtagagacggggtttctccatattggtcaggctggtctcaaactcctgacctcgggtaatccgcccaccttagcctcccaaagtgctgggattacaggcgtgagccaccgcgccttaattcatctctttctttcacagcctgtgttcaattcagcaagtcctgtcaactccataacacatctggaatctgcccacttttctccatgtgtgtcactacctccttagatcaagccaccatcaactcttctccttcttccctcttctttcttccttctccttctcttctccttctccttcttctcctttttcttttttagatagggtcttgctctatctcccaggctggagtgcagtggcacgatcacagctcactgcagccttgacctcctgggttcaagctatcctacctacctcagcctcctgagtagttgggactacaggcacatgccaccacatctggttaatttttgtatttttagtagagatgggttttcatcacgttggccagactagtcttgaacttctgacctcagatgatctgcctgccttggcctcccgaagtgctgggattacaggcatgagccaccacacccagccagtacctcattgttctttatggatgactaatatttcattatatcgatatgctacattttgtttatgcattcttcagttaatggacacttgggttgcttccaccttttggttattgtgaatagcgctttgatgaacatttcatgtacaagtatttgtttgaacacctgttttttgttctttgggatacatacctagggatggaattgctgggtcatacggtaattctatgtttaactttttgaggaaccgccaaattgtttttcacagcagctgtaccattttacattcccatcagcaatgtacaaggagtctagtttctatacatactgccaactcctgttattttccattaaaaaaaattataaccatccttgtgagcatgaagtggtatctcattgaggctttcatttgcatttccctaatgactaaggatgttgagcatatttttatgtgcttgttagccatttgtacatcttccttggaaataaagtttttgttgaggtgtaacacagaaaagtacatgaatcaaaaatgtatagctcaatgaatttcacaaattgaatacacttgtgtagccagaatccagataaaggaatagaacattatcagtaaccctgaagccctcttccagtcactgtgctcccaagtaaaccagtatcttcatttctttttctttctttcttttcttttcttttcttttctttttttttgagtcagagtcaggctggagtgcagtgatacaatctcagctcactgcaaccttgcaacctctgcctcctgggctcaagcgattctcctgcctcagcctcccgagtagctgggactacaggcacccgccacaatgctcagctaatttttgtacttttagtagagaaagggtttcaccatgttgcccaggctggtcttgaactcctaacctcaagtgatccacccaccttggccttccaaagtgctaggattacaagtgtgagccactgcgcccagcctgtcttcatttcttttacttgtcttctggtttgttgaagcaataggtcagacgtttgccaaaataatgtctgtcagagtggctggccataaacacttcagcaccacattcatctgaagggtactcctgacgaaggtgactatttttgctattctcatccaccttatggtattttaggacagccagcttcaccttttttcttttatgctttttttttttttttttttttgagaccaggtcttgctctgttgcccaggttggagtgcagtggcatgacctcagctctctgcaatctccgcctcctgggttcaagtgattgacctgcctcagccacccaagtagctgggattacaggcatgcgccaccacaccgagctgggttttgtaattttagtagagaggtagtttcaccatgttggccaggctggtctcgaactcctggcctcatgcgatccatctgccttggcctcccaaagtgctgggattacaggcatgagctacagtgcctggcctattctttttgggagtagtttaagacttcttccttttcttagggccaccacgaagtctcaacacaagaagggtggactccttttgaatgttgtagtcagacaaagcacatccgtcttccagttgcttgccagcaaagatcagtctttactcgtcagaaggaattccttccttatcttggatgttggcttttacatttccttgtatccaagggttcaacctcaagactgatggctttctccataaaggttgttatgaaaatctgcattttggtggtggctccactgcagatggtggatcgaaaaggcagtatctttgtctctaacatcagggattagttttgccccagtacagccaactgatcttggcaacaaagcaaacgaaaacataaagtggggaaagaacagccttttcaacaaacggtgctgggataattggctacccacatgtaggagaatgaaactgggtcctcatctctcaccttatacaaaaatcaactcaagatggattaagaacttaaatctggccaccacgcctgtaatctcagcactttgggaggccaaggcgggtggattacctgaggtcaggagttcgagactagcctgatcagcatggtgaaaccctgtctctactgaaaatacaaaaattagctgggtgtgatggcgggcgcctgtaatcccagctactcaggaggctgaggcaggagaatcgcttgaacccaggaggcagagtatgcagtgagcagagactgtgccactgcactccagcctgggcagcagggtgagactccatctgaaaaaaaaaaaaaaaaagaaatctaagaactgaaactataaaaattatagaagataacattggaaaaatccttctagaccttgacttacgcaaagatttcatgaccaaaacccaaaagcaaatgcaaaaaaaaaaaaaaaaagataaatagctggtacttaattaaactaaagagcttttgcacagcaaaaggaacagtcagcagagtaaacagacaacccacagagtgggagaaaattttcactatctatacatctgacaaaggactaatattcagaatctacaacaaattcaaacaaatcagcaagaaaaaaacaaacagttggctgggcgcagtggctcatgcccgtaattgcagcactttgggaggccgaggtgggcagatcacaaggtcaggagattgagaccatcctgactaacacgatgaaaccccatctctattaaaaatacagaaaattagccaggtgtggaggcgagcgcctgtagtcccagctactcaggatggtggtgagctcctgtagtcccagctactcgggaggctgaggcaggagaatggtgtgaacctgggaggcggagcttgcagtgagccaagatcatgccactgcactccagcctgggtgacagagcaagactccatctcaaaaaaaaaaaaaaagaaaaagaaaaaaacaaacaatcccatcaaaaagtgggctaaggacatgaatagacaattctcaaaagaagatacacaaatagccaacatatgaaaaattgctcaacatcactcatgatcagtaaaatgcaaatcaaaaccacaatgtgataccaacttactacttcaagaatggccataatcaaaaaatcaaaaaacagtagatgttggcatggatgcggtgatcagggaacacttctacactgctggtgggaatgtaaactagtacagccactgaggaaaacagtctggagattccttaaagagctaaaagtagtctgggcgtggtggctcaccccgtaatcccagcactttgggaggctgaggtgggcagatcacctgaggtcaggagttcaagaccagcctggccaacactgcaaaagcccgtctctactaaaaatacaaaaattagccaggtgtggaggcgggcacctgttatcccagctactcgagaggctgaggctggagaatcacttgaacccaggaggcggaggtttcagtgagccgagatcaagccattgcactgaagcctggggcacaagagcgaaactctgtctgaaaaaaaaaaaaacaaaaaacaacaagccagacgcagtggctcaaacctgtaatcccagcactttgggaagccgaggtaggcagatcatgaggtcaagagattgagaccatcctggccaacatggtgaaaccccatctccactacaaatacaaaaaattagctgggcgtggtggcgtgtgcctatagtcccagctactgaggaggctgaggcaggagaatcgcttgaacctgggaggcggaggttgcagtgagccgagatcatgccattgcactccagcctggtggtgacacagcaagactccatctcaaaaaaaaaaaaaaaaaaaagtagaactaccatttgatccagcagtcccactactgagtgtctacccagaggaaaagaagtcattataccaaaaagatacttgcacactcatgtttatagcagcacaatttgcaattgcagaatcatggaaccaacccaaatgcccatcaatcaacgaatggaacagaaattgtgatagaatagaatactactcagccataaaaaggaatgaattggccaggcatggtggctcacgccggtaatcccagcactttgagaggctgagacagtcggatcacaaggtcaggagatcaagaccatcctggctaaaacagtgaaaccccgtctccactaaaaatacaaaaaaaaaaaaaaaaaaaaagttagccaggtgtgctggcaggcacctgtacagctactcggaggctgaggcaggagaatggcgcgaacccgggaggcggagcttgcagtgagccgagatcacgccactgcactccagcccgggcgacagagccagactccgtctcaaaaaaaaaaaaaaaaggaatgaattaacagcatttgcagcaacctagatgagattggagactattattctaagtgaagtaactcaggaatggaaaaccaaacatcgtatattctcactgatatgtgggagctaagctatgaggatacaaaggcataagaatgatacaatggacttggggacttggggggaagcgtgggggaggggaagggataaaagactacaaatagggtgcagtatatacttcttgggtgatgggtacaccaaaatctcataaatcagcactaaagaacttacttatgtaaccaaacaccacctgtatgtaccccaataacctatggaaaagaaaaagtatatcagaatttctctaggaaatatgtatttccaaaaagcatatttgataattttacatgtacaagatgaaaaaaaaagcttttgagatttcaaaaagtatttaaggaaggtatgagattttatatatttaccaaaaggggaacatggatttaaaaagattgaggaatttctacaagtttacgatgttacttccggtaggtactgaataagtggtaagtacacaaagaaaagtggcagattcaagttctattgttgtaactggactaaaaataattttttttttttgaggtggagttttgctcttgttacccaggctggagtgcagtggcgcgatctcggctcactgcaacctctgcctcccgggttcaagcgattctcctgcctcagcctcccaactagctgggattacaggtatgccccaccatgcctggctaattttgtatttttagtagagatgcgatttctcgatgttggtcaggctgatcttgaactcccgacctcaggtgatctgcccgcctcggcctcaacaaagtgctgggattacaggcatgagccactgtgcccggccataaatatttaactgtactaactattgagttgtaaacattttcaaaagaaaacaatttcttagttgacactttaccaagtttgagcagtgatggatttaggggcattcatctcaacaaagaacttgggggccacgttaaatttcatctcaacaaggtggaacctgtgtttcctggattgtgaaacacaggacttgatccagggcaaaggtcataatttgatccagtgtgcaaatgtgtcttttttagtcagcatagttccgttcctttctttttctttctcctttctccttttcttttctttcttttaatctctgtcacccagactggagtgcagtggtacaatcgccactcactgcagcctacagtctcgacctcccaggctcaggtgaattctcccacctcagcctcccaagtagctgggactgcatgcatgcactaccacgcccagctaattttgtattttttgtagagatgggttttcaccatgttgcccgggctggtctcgaactcttgagctcaagcaatccacccaccttggcctcccaaaatgctgggattataggcgtgagccaccattcccggcagtattttcttttctgttttttttttttttttttttttgtgtgtgtgtgtgtgtgtgtgtgtgtgtgtggtttggttgttttatttgtttgtttggttggttttttttgcacgttcacagtattttctttttcttttttttttttttgagacggagtctcgctctgtcacccaggctggagtgcagtggcgcgatctcagctcactgcaagctccacctcccaggttcacgccattctcctgcctcagcctcccgggtagttgggactacaggcgcccaccagcatgcctggctaattttttctattttttagtagcgacggggattcactgtgttagccaggatggtctcaatctcctgacctcgtgatctacccgtctcagcctcccaaagtgctgggattacaggtgtgagccactgcacccagccagtattttcttaaagttgtaattagtggccaacatttaaaaatcagattttaggccgggtgcggtggcgcacacctttaattgcagcactttgggaggccaaggtgggcagactgtttgagcccaggattcaagatcagcctgggcatccgagatggcaaaaacccgtctctacaaaaaatacaaaaattaaccaggtgtggtggcacactactacagtcccagctactggggaggctgaggcagaaggattacttgagtatgggaggttgaggctgcagtgaactggaatcacaccactgaactccagcctgggtgacagattgataccctgtctcaaaaaaaaaatcagatttcaaataaaactattaatttccaatttgtcttgaaaaatggaaacactcgggcccacatgtaacgggtggagtaatgactgcccccttttgacaagtcatgccttttccagcttgttatagtccataccactttctattacttgccccacctcctcatttatacagccactgccacgtctatttcatattgatttgttagcaacctggttttgtaactttgttttctgcttcttggctcatcagagaatgagtagctacagaatgggtcagatcaggctatgcctcagggcacaagatcctcatttgtttctcatcagtgaggcccacaacccaggtatccattttatagttggatgaacaaagaaaagtaatgtgcaccaggggatgtagcaagtcaagaccgagtcaaggctagaacccaggactccagcctcctatccacttcagaatgattttcagtacatgacaccacttccccatgaatcggaggtctcctatatgcttggctttagcaggccctgagcaatgatattttccacccccaaagccctctgttggtctgtgctcttgaagagcacttggctctacatggtacctcctagatgactgttttatggattttcaatgaggctacttaaccagatgtcattgctgtcaagtattactgtggaaaatagatctgtcaccaacactgcttcattaaaccatttaatgagaaaggtgtttaatgttttcccctgatcctgacatgcagccataacctttaggattagtgaaatttcctgggcagtcaaatcagactggtgatgtcttgctgccctgacttactgatgttggcaggtggacagaccagggtttttcctccttccttccatatctgtctcaaggcagcatttctacagcactgcgttgtggactgaggtctcagggcagtgtggtggtctctctgtctcaggagtccctccattcagtctctgggcaggagccgcataataagattccacacacccataccactcacgaaggccatgggccttccagggatctcggatcccaggctgttcttccttgggggagtggcctggttctaaaaccaggccttgaactacatctacaaaacatctattgtggattatttattatccaaggggcaagccactgtgctagacggcttgcaaggcctgctattgtagaaggttatgaaacaagtcagttttaacgaacttctttttcttcacctgtacctagtttcttcctcagtccttaaagcagatggaagagttaaagcccacgtggagcaaatgacactctgtttctgatctgattctccccgcctcttagagacgctgtcttggtagtgacctggctgtgggttgttctgtgactgtgtagacctacctcaaaagagggaagaggggggaaaaaggggcgaggaggagatgcttgggtggccaggccattgctggcactcagtctatctcagttcgtacactgtgttaggtgtgaccccagccccttgcaggcaccctgggcttcctgctccagttccccttgttcggctcggatgcaccgggaggctgctgcgccctctccggacaggtgccccgggcctcgcctacacctcacctccccctcccactgtacccccggccggtgcgcgctctgacactcaccggctgcgagaggcagcggcgacggcggcagcagcagcagcaacatcaggactacgggcggcagcggtcgcgggttcagggggcgcaccatggcgagctgtaggcgccgggctccgcgctcccctcgctcctcccctggagctctgagagcggggctccctcgaccggcacctcccgcccccgcctcccgccctccagcgcgacgcacacactctcccaccagggtcctgg

SEQ ID NO: 433 - DNA, 46558 bp, Homo sapiens
ctcattctgtagtgtttatttttccatttttaaaaaagaaagagggggaaacaaagaaggaaaatacaaagaaagaaggtagacaacgctcttgcatagcccgaagcccagagagaaagagttggctggcttgtgagaagacatgaggagttgggaaaaggaatgccagagttccctgaaccaatacaaatctctatgcaactcaaggctgccttatagagccagctccaggactctgccaccagctttcagctctgctgaaacctaatccattcccaggcctggatacaagttggtagcctgttggtttgcagagacatcttttaataatcttgggtttggccatccagaaggcctctttctgctcagggtttctgcagtgtcttttggtgacttgttagcagccagtggctggaatgttatcatgggctcatgtccttcaccagaagggcaatctgctcccgcagctgccgctccccttcctgcactttgctctggcttcgacacctcagcaactcagtcttgtggtcctgatgatgcatagggcagtagctctgtggttcacacagttcctgaaaggtaaggaacagagtaagggattctctagactcctgaactctacctatgaaggataatagagatgctgctgctggcagtggctaaggaggagcagcagtttcttctctgaaggctttgcaggccctgggagttgagttgttaaagtttggctccccgcatgccccaccctttaccatatattctggaaagaagtctctgtagccgcctttaaggatatatagctctgggtagtacaatgcaggatactggttcagagacctgtcctcttcacgcagacagcggcacctttagagagaacccagagatgggtggggtggaaagaaacaaggtcaggatcccaggggccattcactggggaggggggagaggagtagactattgccaacctcaaaaaggactttccaatctccctgtgtttgcaaaaaaaggtccaagtagtaccacccttcctcctttcctccactgcagcctcattctcaatcccttttcctttattgtttcaaacttttcaattttagaaacgtcttccttcaacctccctaacattcttcaaactgtagaatccagtcagtctctgtctgaactggtgtgggaagtccaactcaaaatccatttccatcacccgccagaccccatttagacactcacattcgggggcccctctctgaggagaattcacagtggaacacgatgattattctcttctgggtgtccaaagggacgatgggcttcttcagaaagaagttaaacagttcttcctgactatataagtttaaggctccctgtagaagaagaattttagtaagtatttcctcaggggcttatagacagtgccaatacttagaaatgactgagacgccaacctgggataatgtggaccagaaaagctggactataagcacctttagggcaggggtctaagtatatctctgtatataccctgaacgcctggcatagagcttgtagatggtcaataaatgtttatagacctgaaccactggaagtatagagatcactgcgaggaatgttcatgaatagtaagtgtttgcaaagtgcttcagtccttggattaatgtttttatttctaggtaggaccccttggctcctacagaaaagagggagatagatctaggagggaaagggaaagtaacctgcttaaggtatacagaattaaaacaatgaggacctcagccttgaggtgcttcaaatatgtaatctttgtcctgactctagagttcatagacccctttgtccacagactcttctcaataaagagttatctccagccctcccctactaatggccacaatgtcgtctcacctggatgtgtcctcccagatactcatatggatagcgacaatcaatgacataaaacttctcaatcagaccctggaacttccccgacagtaaggcagccacctggacagaaacaatgactgaatattctgctcactgccactctgagggagagaagggtcaatgacacagttccttacaagcatactcctgttctgtccactgtatgtccagcctccaaagtcaccccatatttgatatgtggcaatgattcagccccactccacaaaagagaatgaaacaggaagtggcccttttagagaaccaaaatagctggcactgacaagataccaaggaaaaccatattcaggctacccatctggggataggcatggctggactcaggagatgcccaaggacttctgcagtggcagaggcagcagctagagagcttgaaattgcaggaagaaatgcaaaatggttccctacccaccatcaaaaaggaagaaagtaagtctttcaggaaaggatatggaagggaaaggttgatacctaaaggaaggaagaaactgaagctacttgtaggagtgcaaattggttcagcctttctgaagggaactttgtaaatacatatacaaataaatgtaatcacactttgactcagcaatttctaacatcttaagtaaacaggaaaagtacacaaagatgtaggcacaattatattcatctcagcattgttttatattatcaatatattagaaataacttcaatattcaataataggggtttggtaaaataaattgtacatgtcagtagaatagagcggcattatatagccattaaaatgataatatagataccttattgatatagaaagatgtctataatgtctcactaagcaaattgcaatactatacgttcatcatgatcctttttttttgttttttgagatggaatttcgcccttgttgcccaggctggagtacaatggtgccatcttggctcaccgcaacctctgcctcccgggttcaagcaattctcctgcctcagcctcccgagtagctgggattacaggcatgcgctaccacacccagctaattttatatttttagtagagacggggtttctccatgttggtcagactcgtctcgaactcccaacctcaggtgattcgcctgccttggcctctcaaagtgctgggattacaggtgtgagctgtgctaggcccatgatcccatttctataaaacatatgctagaataaaatctggggctgggcgcagtggctcacacctgtaatcccagcactttgggaggctgaggagggtggatcaccagaggacaggagtttgaaaccagcctgaccaacatagtaaaaccccgtctctactaaaaatacaaaaattagtcggtgtgatggctggcacctgtaatcccagctacttgggaggctgaggcaggagaatgacctccgggaggcagaggttgcagcaagccgagattgtgccattgcactccagcctgggcaacaagagcgaaactccatgtctaaaaataaaataaaatctggaaggccataggaaaatatgactagtggttatctctggtgatgagattgtgggtatggtgaccaaataatttttgtacaaactgggagacttttgagaatgaaagcaaacactattaataattaccctcactaatagatgaaaatgggattgtaaaatgtaaacgagggtgcatggtcaccctaattgagaccttaattgagaccatttcttgtgtgtgattttttattttcctttctttctcccttttttcttaagtaattattattttttgagacagtctcgctgtgtcgcccaggctggagtacagtggcacgatctctgctcactgcaacctccccaactggggttcaagcaattcttgtgcttcagcctcccaagtagctgggattataggcacacattaccacgcctggttaatttttttgtatttttattagagatggggtttcgccatgttggccagggtggtctcgaattccctgcctcaagtgcctgagatctgcctgcctcagcctcccaaaatgctaggatttcaggcgtgagccaccatgcctgacccctccctttttcccttttacaaaaactatgtatcatttgtttaactaaaaacgaaggagagagaagaatggggaaaaaaatgagtccttcaatataacttcagttgaataaggagcctgtgtgagtgaacacagtgaaagaaatacaaatggaaatgggcattttagggacagaagagaccagatggtagcttatgtaaccagttaccatctccagaaatctgcttactgtttctgggttgacatacttcagatcttggtgtttccctgacacggttggcagcgcacatacctagaaatacacaagagctgaaataacagcaagtattccacacccaagtttgagatcaaagacccttattttgtccttctttccaagtgacccttaaaaccccagaggccttcaaaaaaatcagtgtctctataaagtgcatatacatcaagtccatttctaagaactgatcctaaagaacaaatcaaggatgtgtacgaagttttagatttctctacaaatatattcatcttggtatcattcataagaaaaaattgtaaaaccaaatatcttacaagaagggatttatgaagaaattatgagcagccaaaaaaaaaaaaaaaagaaataatatggagctattaaaatgaaatgggctgggcatggtggctcatgcctgtaacctcagtgctttgggaagccaaggagagagaggatttcttgaggccaggagctcgaggctgaagtgagctatgatcatgccaatgtactccagcctgggcaacagatcaagaccttgaatcttaaaaaaagaaagaatgaagcataactgcttattaatatgaaaaaagatgcccctgatataattattaaatgagaggaaaaacaacagataacaaaacaatataaactgtttttgtagaaaagcaaaaactgtatttgtatatgtgtttgtgaaaacacagaaaaaaatctgtaagaatatgtaccttctgcaattacacagacagtaggggggaaaaaaagagtatatactaagcaatattaccctggttaataaagtttgggataaatttcttcattttctactttttctgtaacaaccaagtattatttacataattttaaaatatgtttttaaacagaaaaaaggtaaaaagtctcatactttcccctgttctggatcttcccagaagaataagaaatactttctctctggaaaggcttagggcctggatctaccactagagcactgtcaggttaccaaagagtacttggtgaggatgcatatttacaccaggcattctcggcaaacagagaagattcagatccaaaatgactcactgaaatacaggatgggtgtagccaaactcaccttggaaaaatcaccaatcaggtgcccctggttagaatcttcctccagcatctgagtgatagtaatgtcacacagagagactgtcttctttaaacataagccctgaagatgacaagattcccaccccacacccaatcctcatgttaaaggtttaaaaaccagtggatggagtgggccatggtggcgcacatctgtaatcctagctacatgggaggctgaggtagggagatcacttgagcccaggaggccaaggctatagtgagctacgattgcaccactgcactccagtctgggagacagagtgagactccatttgtttatttattatttttaataataaataaatattgaggctgcagtgagtcaagaccatgccactgcaatccagcctgggtgacagagtgagaccccatctcaggggaaaataaataaataaataaataagttgattttataaaatatccaaagattttagaattttaattttttattttatttttttttattagagatggggtcatgctatattgaccaggctggtcttgaacttctgaccttaagtgatcctcccatctatttaatttttttaaagttggggagggtaaaggacaaaggctaagtttttcagaagttgctttccacaaaaccaacctgctatatgatgttgtttctgtcagactgcatgtaaaacagcagtaaaatatccataccaaagttcccttgtattctttcagatcttaagaaaaagggttgggaagacggtatgatgacaacatttctctttttttttttttttttgagacggagtcttgctctgttgcccaggctggagtgcagtggcacaatcttggctcactgcaacctccacctcccgggttcaagcgattctcctgcctcagcctcctgagtagccgggactacaggcacatgctgccacgcccagctgatttcttgtattttagtagagacggggtttcaccgtgttgcccagtctggtcttgaactcctgagctcaggcaatccgcccgcctcggcctcccaaagtgctaggattataggcgtgagccactgcacccggcctatgacaacatttctaaaagtacaatatagatatactttatgtatctatgttatataaatattttatatatatatatatatttcacgtggatacagatgtagaaaagacagaaagatggaaagaacaaagaggaaaaagtaaaagtaaagaggaagaagacaaaaaaggcataataaaacaatcctcataccagaaaagcaaagacatgagatagaagatgaacaagattttcatcttaaaaagttcttaccttcctgagctttccttggccagaaaaatacttttttttaactttatctggtattgtgttgtccttgaatttttccacctgcttcagtcttggcctgttcaagttctctggcatcgacggggagcgatataggccacttctgctcacctgtttgggaatattaaaccccctagttcttactcctccaagtgtgtctgcagacctgcagcaacaacatctcctgggagcttctttgaaatgcaggtttccagatgttaggccacaccccaaacctactgaattaaaatctgcattttaacaagatgcccaggtgatttctcaagtttgagaagccttgggtaggcaacctgtcttcataggcccgttaatatctttctacctggactgcatgatattccatctccatggacgtcttaactagccaaaccaaattctgcagctgactgtcttagatgcaccagttcttctaacagaaagcaaacacaagctcagtccctccagttatgtgaccaaaaaaaaaaaaaaaaaaaaaaacataagtccattttgtctctgggatcctaggacattgacaatcaggatttaaggacctcaacaaacctaaagatgaaaagccaagaagaaaaatagcaaaagaagcatcatgcaagaaaaaaggacacactaaaatcaaatagcatgctgaccattataggatggatactatgaaacccatcagggaaaaaaaagtggctcaaacgtcatgaagaactagccttgagaattgcttacacaggaacagattaaagtataagaggatagactgttgtttatttgaaaggcatggtttgggtgctatattcagagttgagggtctatcaaatgacctctgataacaccttccaactaatccacaattctatcctctgttgccacatactttgagatctctacctctcacctagagaacaggcaaaagctccttctctaaacacttatcgcactacctgttatggactgatttaggaggggggctatacaataagagagccataactggaaggcagcttgatgatcaatggtttctggaagaacgaaataagaataacaacattttgctttatgacagctatggatattatgttgtttatcacacacatggtcctacctcttgttcgtgataccagctgatggtaccgtccacattatacgtacccttagactccttccaaacatcgccctatgtccccatccaccctaccccccagacactgatgactggaccatattgctggttgaacacatctatttagtggtctagaataagcaaaaataatctaggccaatcaggttccctctcttggttgcctaacttggaagatggagaaataattaggcagtagcagaagccaaagcccaaaaggaagaagccaagagatacagtcaaggccacgaagccagtgatgcatgaatggatcaaccaaaggtagggtaggaaaggagatatggtgaggcactgaggagtagggtgcctggtctccatgacagacaggacttcatataacttcaattttcccctgagaaggcaggggaaagctagatgaggatttcaaaaggggcttctctagaacacaccataataattatgctaagagccatattactaagagtttggaattaattagctaattgaaacttatctttttttttttttttttgagatagggtctcgctgtcactctggttggagtgcagtggcacaatcttagctcactgcaacctctgcctctcaggctcaagcgatcctcccaactcagcctcctgagtaactgggactacagatgcgcatcaccatgcccagccaatttctgtattttttatagagagagggttttaccatgttgtccaggctggtctcgaactcccgggcttaagtgatccatccgccttggcctaccaaagtgctgggtttacaggcatgagccaccacgcccagtctgtatccatttttaagcattgtatctaataaatttttgccaactcaaggtcacaaaaattgtctccgttttctttggatttttttttttttttttttgagacagagtctcactctgtcgcccaggctggggtgcaatggcatgatctcggctcattgcaacctccgcctcccaggttcaagtgattctccttgcctcagcctctggagtagctggcattacaggtgctgactaccatgcttggctaattttttttttttttttgagatggagtctagctctgtcacccaggctagagtgcagtggcacgatctcggctcattgcaacctctacctcccaggtttcagcaattctcctgcctcggcctcccgagtagctgggattacaggtgcctgccaccatgcccagctaacttttgtatttttagtagagacggggtttcaccgtgttggtcaggctggtgtcgaactcctgacctcgtgatccatccacctcagcctcccaaagttctgggattacaagtgtgagccaccgtgcccaaccactcagctaatttttttttttttttttttttttgagacagagtcttgctctgtcacccaggctggagtgcagtggcgcgacctcagcgcactgcaagctctgcctcccgggttcatgccattctcctccctcagcctcctgagtagctgggactacaggcgcccgccaccatgcccagctaattttttgtatttttagtagagatggggtttcaccatcttagccaggatggtctcgatcttctgacctcatgatctgcccgcctcggccctccaaagtgctgggattacaggcatgagccaccgcgcctggccccgctcagctaattttcctatttttagtagagatggggtttcaccatgttggtcaggctgatctcgaactcctgacctcaggtgatccaccagcctcggcctcccaaagtgctgggattacaggcatgagccactgtgccaggcctttcttcagatgctttatggtttaaggttttagatttggagctatgatccattttgtgttaattttaatatatgatgtacggtatgggttaaagtacttttatcttttaacgtatggatttccaattgctccagcacaatttgttaaaaagactgtactttctccatttgattattttgtatcttggctgaattaccagttacatatatgcataggtctatttctcaaatctctattcccttgtttcaatgttttaggtttctggtagctaatatagtgataattaaggtgattaacatctgcatatagtccaaggacaagatgtcaaaaataaatgatagcagaaaactactttcgcaaacagaaacagctacttcagcggccaggcatggtagctcacacctgtaatcccaacactttgagaggccaaggtgagtccaaatcgcttgagtccagtagttcaaaaccagcttgggcaacatggtgaaaccttgtctctacaaaaaatacaataattagccagatatggtagcgtgcacctgtagtcccagctacttgggaggctgaagtggaaggatcgattgagcccaggatgttgaggctgcagtgagctgtgatcatgccactgcattccagcctgggtgatagtgcaagatcctgtcttctcttaagaaaaaaaaaaaaaaggaaagagcaagctacttctttcctatacacttacatgaaaataaatgtcaactgattgcaaaggatataagtgctaggccatggagagataatgaagatggtactttagttctgtctagctagttagaagtttcccagttcccagaagctggtgtgggaagatcccaggatcatctggcttagatagcattcaacatctacccattttcaatctttaaggaatcaccagagagtttccaaatatgggagtttttaaacactgagaaagccaaaaagaagggaggaaaacttactagattcaacctgcagattctattaaaaggcttaattaaataattattattttataaactgaattgaataattattattttataaactggcctacacactcttgagtacacataagccagcccggcttctgtctgcaccactcttctgctcttgtcaaggctatcaacagccttcatgttgcagcatctgacagtcacttctctagccacattatctttctgaacctcatgtcggcttccgttaagttagctactccatttttgatggctttaatggcacctcctactcttttagttatttttatttatttatttatttatttttgagatggagtctccctctggaacccaggctggagtgcagtggcacgatctcagctcactgcaacctctacctcctgagttcaagcgattcccctgcctcagcctctcaagtagttgggattacaggcgtgcaccaccacccctggctaatttttgtatttgtattttatttttttgagacagagtctagctgtgttgcccagtttagagcgaaatggcgtgatctcagctcactgcaacctctgcctgctaggttcaaatgattctcctgtctcagcctcctgagtagctgggatcacaaacatgcgccatcatgcctggctaattttgtatttttattttattattattaattatttttttttttttttgagacagagtctcgctctttcacccaggccggaatgcagtggcgcgatctcggctccctgcaagctccgcctcccaggttcacgccattctcctgcctcggcccccagagtagctgggactacaggcgcccgccaccgcacacagctaattttttgtatttttagtagagacggggtttcaccgtgttagccaggatggtctcaaactcctgacctcgtgatctgcccgcctcggcctcccaaagtgctgggattacaggcgtgagccaccacgcccggccactttttttttttttttttttttttagacacagtctcgctctgtcacacagggtggagtgcagtggcacgatctcggctcactgcaagctctgcctcgcgggttcacgccattcttctgcctcagcctcccaagtagctgggactacaggcatccgccaccacgccaggctaatttttttgtatttttagtagagacggggtttcaccatgttagccaggatggtcttgatctcccgacctcgtgattcgcctgcctcggcctgccaaagtgctgggattacaggcgtgagccaccgcgcctggccattattattattttttaattttgtatttttagtagagacagggttcaactgtgttggccacactggtctcgaactcctgacctcaagtgatcggcccacctcggcctcccaaagtgctaggattataggcatgagccactgtgcccggcctagttctttatttctagtacaggcagcccctacactagaagaactatgatgcttctacctctgtgccctctcctctgctccttctcaattttctttgttaggcctccttacctatcaaacctctaatagatgctggattcatcagggccaggccctggcccttttctcttttatctcctccctctagccataggtaatttcttctacctgtgaatttaaattttcactctaagctaatgatttccaaatttctatctttagtcaagtcctctgctctgacttcagaacttccaaattcacatttggaagcttgatacgttttgagtacctactaggtgacatagcaatgaacaaaagagtaaaagaaacaaagaagtagactaataaatatactctgtactttttcacatagtgataaatggcataaatcaaaacaaagaaggatgaaaagaaaaacacaggggttgggaagtctgtcaggaaaggtccttataagacatatgcacagagactgaaatgaggaagaaaatcatgcattgccttggggaagaaagttctaggatgaaggaacaacaaatgcaatggccctgggtgagaataacaaggcagccagtgagacagccacatttagtatggtacctttttttttttttcttgagacagggtctcactctctcatccaggctggagtgcagtggcatgatcacagctcactgcaatctcgacatcccaggctcaagtgatccttccacctcagcctcccaagtagctggaactacaggcttgagccaccacaccttgcatttttttttttttttttcgtagagacaaggtctctctttgttgcccaggctggttgtgaactcctggggctcaaatgtcctcttgccttagcctcccaaagtgctgggattacagatgtgagccaccacacccagtgataccatttttagaaacctcaaaaactaatttaaacaatactataaaccaaccagacctaacagacacctagagaacactctacccaacaaccgtagaatacacattcttctccagtacacatggcacattctcacaatagacaatatgcctgaacataaaataagcctcgccaggcgcagtggctcaaacctgtaatcctagcactttgggaggctgaggcgggcagatcacaaggtcaagagatcgagaccatcctggccaacatggtgaaatcctgtctctactaaaaatacaaaaattagctgggggtggtggcacatgcctgtagtcccagctattcaggaggctgaggcaggagaatcgcttgaacctgggaggcggaagttgcagtgagcttaggtcgtgccactgcactccagcctggtgacagagtgagactccatctcaaaaataaaataaaataaaaataaaataaaataaaataagcctcaataaatttaaaaggattgaaatcacacaaaatatgttctctgaccacaatggaataaaattagaaatcagttaacagaaaaaatctggaaaattagcaaatttatgaaaattaaataggccaggtgtggtggctcacacctgtaatcccagcactttgggaggctgaggcgggcggatcacctggggttaggagttccagaccagcctggccatcatggtgaaaccccatctctactaaaaatacaaaaattagctgggtgtggtggcgggtgcctgtagtcccagctactcgggaggctgaggcaggagaattgcctgaacctgggaggcacaggttgcagtgagccaagatcgcaccactgcactccagcctaggttacagagggagactctgtctggaaaaaaaaaaaaaaaaaaaaggccaggcacagtggctcatgcctgtaattccagcactctgggaggctgaggcgggaggaccacttaaggtcaggagttcgagaccagcctggccaacagagtgaagccccatctctactaaaaatacaaaaattagccaggcgtggtagggtacgcctgtaatctcaactacttgggaggctgaggcaggagaattgcttgaacccagggggcagaggttgcagtgagccaagatcacaccactgccctccagcctgggggacagagcaagactccgtctcaaaaaaaaaaaaaaaaagaaagaaaagaaaaagaaaattaaataacacacttgttaataaccaatgggtcaatgaagaaatcataggaaaatcagaaaatactttgagatgaatgaaaactaagatacaacataccaaagcttatgggatacagctaaagtaatgcttagaaaaaaatttaaagctataaatgcctaaaataaaaaagaagatctcaaatcaattacctaaactcccacctaagaggaaactaaatccaaagcaagcagaaggaaggaaataaaaaagattagagcagaacttaagagaatagaaaaacaacagaaccaaaagttggttctttgaaaagatcagcaaaaatcgacaaacttttagcctgaacaattaaaaaaaagtctcaagttatcaaaatcaggaatggaaagtgggacattactaccaaccttacagaaataaaaaggatcatgaagaaatattagtgaataactgtgtgccaacaaatgagaccacttagatgaaatggactaattcctaacaagacaaaaactactgaaactagccaggtgtagtggtgtgcaccggtagtcttagcttctcaggaggcggaggtggaaggattgctggagcacacaggagttcaaggcgacatagtgaggcaccgccccaactccaattaacaaaacaaaacaaaagactgaaaccatgaccaggtaggatgtatcccagaaatgcaaggttgatataacatctgaaaatcagccaccgtatcccaccagatcaataaaataaatgacaaaaaccatatgattactcatctctgcacgttgtgaggctaagacgggtgggttgcttgagctcaggagtctaagaccagcctgggcaacatggtaaaacgctgtctctacaaaaatacaaaaattagctgggtacagtggtgcatgcctgtagtcccagctacttgggaggctgaggcaggaggattgtttgtgttcaggaggttgaggctgcagtgagccgtgattgtgctactgcagtccattctgggcaacagagtgagactctgtctcaaaaaaaaaaaattgatagattaatagacagaaaactaataagcatatagatgtgttcaacaatataaataaactggacctacttgacatacatagaatattctactcaagaatagagactatacattttctaagttgcactaaacatttaccaagatgttctgagtcatactctggaccataaaaaccaatcttaatgcacctaaaaggatttaagtcatataaaatatattcttgacaatcgaattaaattagaattcaataacagaaaggtcctcaaatatgaggtcctcaaaaagtcctcaaatatttgcaaataattaaataacaagcttctaagtaacccctacatcaaaaaagaaaccaaaaaaggaaattggaaagtattttgaactgaataaaactgaaaatgcaacatatcaaaatttgtgagatgcagctaaagtactaaatacccttatttaaaaaggtctcaaatcaatgaccttagcttcaaccttaactaaacatgaagatcaaattgaactcaaagtatccaaagattagagtgcaaaatcaatggaatagaaaacagaaaaacaatggagaaagtcaataaaaccaaaagatgattttttaaaaagatcaatattgataaatctctacccagacttatcaggaataagacagaggacacatataaccaatatcaggaatgagagacatcactatggattctacagacactaaaacgctaataaggaagtatttttaacaactttatgccactatatttgacaacctaattaaaatggacaaattccttcaaagacacaaactaccaaactcactcaaaaagaaacagttaaactgagtagttcctatctgtaaagtaagttgaatttgttaaaaacattcccacaaagaaaactctaggcccaggtggcttcaccggtgaatcgtgccaaacatctaaaagagaaataaaaccaattctatataaactcttccagaaaattgaaaaaaaaagagggaattatttgcaaatcatttcatgatgctagcattacactgataccaataccaaaacattaacatgaaaagctaaaacactgaagatcaatatctctcatgaacatagaggtacacaaaaaaaaaaaaaaattttttttttttttttcagatggagtctcgctctgtcacccaggctggagtgcagtggtgctatctcagctcactgcaacctctgcctcctgggttcaagcgtttctcctgcctcagtatcccaagtagctggaattacaggtgtgtgccactgcacctggctaatttttgtatttttagtacagatggggtctcaccatgtaggccaagctggcctcgagctcctgacctcaggtgatccacctgccttggcctcccaaagtgctgggaattacaggtgtgagtcactgtgcccggcctttttattgagacagagtctcgctctgtctcccaggatggactgcagtggcacgatctcagctcactgcaacctctgcctccctgattcaagcgattctcctgcctcagcctctcgagtagctggtactacaggtgtgtgccaccatgcccggctagtttttgtatttttttgtagagacgggggttccaccatgttggccaggctggtctcgatctcctgacctcgagtgatccacctgcctcagcctcccaaagtgctgggattacaggcatgagccaccgtgctcggccgatgtaaaaattatcaacaaaatgttagcaatgaaatccaacaacatataagaaggatcatatgtcacaaccaagtgaggttatcacaggattgcaaggttgtttaacattcaaaaacgtaggccaggcacagtggctcatacctgtaatcccagcactttgggaggccaaggcaggtggatcacctaaggtcgggagtttgagaccagactaaccaacatagagaaaccccgtctctactaaaaatacaaaattagcaaggcgtggtggcacatgcctgtaatcccagctactcgggaggctgaggcaggagaatcgcttgaacccaggaggcggaggttgtggtgagctgagattgcaccattgcactccagcctgagcaacaagagcgaaactccatctcaaaaaaaaaaagtaattcatcatattaacagattaaaaaaaaaactcacttgattatctcaatagatacagagaaaagggctgggtagggtaacttatgcctgtaatcccagcactttgggaggctgaggcagaggggttgcctgagcccaggagttcaagaccagcctggacaaaatggtgagatccccatctctataggggaaaaaaaaaaaaaagaactagccaggggtgactgtgtttgcctgtagtcccagctacttggggaggcataggcaagaggatctcttgagcccaggagtttgaggatgcagtgagctgtgattgtgccacgcactccagcctgggcaagagagtgagaccatgtctctttaaaaacaaaaacaaaaacaaaaaacctgttcctgctaaaatctcctggcaaactaggaaatagaagggaacttcctcaacctgatgatgggcttctcaagaaatgtatagctaacatcatactcaatgtataaaaagctgaatgcttttctctaagctcaggtgtaaggcaaggggttgtaagtaatttttaagattacaaaggagttctaagaccaaaaaatttgagaactcttattctagtagaagggaaaattggtaatataggagtggggaaatactgcagtagtacacatgaggagatgcttccatctgactcggtttttgcagtctttacaaatgcctacaaggccctacacgatctgtccttctgctaactcctctctgccctcattttctacccttctccacttgctccctccgcttcagccacactggccttcttgctgtcccataaacacgccaagcatactcacctcaggggcattgcacttgctttgccttctgctgggaatgactcattcctcctgacatctgcttgttggcttcctcgctctttcagatgtctgctcaaacgtcactctcaaataagtctcctctgacctatgcaacctatcaaaaataacaactctcaccctgccctactccaatccagggactccctataatctccctttgctttttcaccatagtatttttaccatctgccatattacaaatgtatttgtctgtctgtttcctcataactagaatgtaagctcagatactactgtatctctggcattagtgaataaatgaatgaatgaatgaataggacacagtgtgaaggaagggctttagataggagcagggacacttcgtgctctgtggcaagagcgactgcagattatatgggtataaaaggagattgattgctgtatctggtgagaaaagaaggcagttttcttctgatagcatctgttttctcttcacaacaaaacacttcaaactgcatatgactaaagtcatccttgatctcatccttccttcacagcctgcacccaacccttcaagtcctgttgattctctatccaaaatatatatatctatgtatctttttacttttttaatttttttgagacagggtcttgctctgttgcccaggctggagagcagtggtgtgatcgtggttcactgcagcctcaaacccctgggctcaagccatcctcccacctcagcctcctgagtagctgggactacaggcatacacaccatgcctggctttttttttttttttttttttttgtagagacatgttgctgaggcaggcagacaaaatatattttgaatgcatccatttctctgtctccatagtcaacaccttagttcaggctaccaccaactgtagctaggactaacacaatggctcctactcttacctgcttccaactctttttttttttttctcctttttgaggcagggtctccctttgttgcccaggctggaatgcagtggcacgatcatggctcactgcagccttgacctcctgggctcaagcaatcctactgtctctgcctcccaagtggctgggactacaggcatgcactaccacatgcaactaacatttttttatttttagtagtgatgaggttttgctatgttgcctagactggtctcaaactactgagctcaagcaactctcctgcctcagcctctcaaattgacaggattacaggtgaaagccaaaccacccgttgacttccaactcttaatcctttctaatctgttccccatccatcaacaagagtggtcttcacaaaacaaatcagaccatattattcccctgcctaaagccctcccttcagtagcaactcattgtacttagaatagaatccaaacactcaccatagcctaaagaccctgcgtgatctacctcctgactacttattctttcccagctcacataacactcctctcattcactgacttctcagtccctccaacatgtgaagaccttttccacctggggcctctgtacctgcaacattccttcttcatgaaatgctcctgcctctactcttgtcatatatgattccttcacaattagagtggccctaacttaataccagcttgtccgggactttcccagctttagcaatggaagccccatatcctagaacattctagtcccaggcaaacagagagttcatcacccgattcttaaccaaatatctcccacttgtggagatcttcccttattattctccatttaaagatttccttttgttagcctctatttcagacctcattttgtttccatcattacacttggactatttgcaattactaaattattattattattattagaaatggggtcttgctctgtcacccaggctggattgcccaggcatgatcatggctcactgtagccttgaactgctagactcaaacagtcctcccacctcagcctctggagtagctaggactacaggggcacaccaccatgcctggctaatttttatttttttgtagcgatgggggcttactgtgttgcctaggctggtctcaaacttgtcgactcaaactatccttctgcctcagactcccaaaatgttgggattacaagtgtgagccaccacacccagcccaaaatctaaattattttgtctgttatggcagacatttacaatttggctgcctaacatactgtttcagtaaaatctaaagttagagaggcagtcctgcctcctcatgaggtggccaatgggagacagatattcccttttccatgcccttgtgaccaactagatattcctgcctgggattttcaaccttaaagaagctcaaaaagcaaagggttggtccagactttttatggtggctgcatcacagtagagaatatactaggtggtagcaaatatccatgagcagcacagtctatctagcagcaagcctgatcatgttccatggcagggtgccagtaacggtggcattgagtgtctagccagcaagtggtggcatcctgagctcaatgttcctggaatagtattttggctgggccttactttgttttccagccttccttgtaattctgagttcctcagtaccctccagaaaaatcccttttctgcttgaggaaactagaatcagtttctattatttgcaaccaagaactctaactagaatatctattaacttgaaaaaaatttttgttgttttgatgcatccctgacaagaatataaattctagtctgttttgttcaccatcgtatcaccagtgcctagcacacttcccaacatgtagcaagtactcaataaatattttttaagtaaagaaatgaatgaaaaatcactaaggttacgacaatctccaaggaggtcactgctttatacaagtatctatttatttccgtttattattattattattattatattttgagacagggtctcactctgtcacccaggcaggagtgcagtggcgcaatctcggctccctgcaacctccacctcccgggttcaagcaattctcctgcctcagcctcccaagtagctgagattacaggtgcataccaccatgcccagctaatttgtgtatttttagtaaagacggggtttcatcatgttggccaggctggtctcaaattcctgacctcaggtgatctgcccacctcagcctcccaaagtgctgggattacaggcgtgagccaatgtgcctggcctattttttttttttccatttaacatcaaagaggtaaaacagtaacaaaaaaaaatccctattccttttcttttttttttcctttttgagacagagtctcgctctgttgcccatgctggagtgcagcggcacgatctcagctcactgcaatctctgcctcccaggttcaagtgattttccttcctcgggctctttagtagctgggattacaggtgcatgccaccatgcctggctaatttttgtatttttagtagagacggggttttgccatgttggccaggctggtctcgaactcctgacctcaagggatctgcctgcctcggcctcccaaagtgctgggattacaggcatgagccaccgtgcccagccccctatcccttttgtaacctaaaacctactgctatgcatattcttataggatgggccatcaatcaaaaatgactttatggccatgcatggtagctcacacctgtaaccctagcactttgggagggtgaggcaggcagatcacttgagcccaggagttaagaccagcctgggcaacatggtgaaattgtctctacaaaaattagcttggcatggttgcatgtgcctgtagtcccagctactcgggaggctgagatggaagaatcgcctgagcccaggaggttgtgacctgcagtgagccctgatcacgccactacactccagcctggaagacagactgagactgccacaaaaaaaaaaaaaaaaaaaaagaaaaagagaaagaaggaaaaaaagaaagagaaaatgactgcataagagttacaatctaagaaaatgagcccataaaaggacaattttaaaacattttttatttaattatttaaattttctgtcaaggctctattgtccaaatatttttcaaagaccatcaaaatgcactttgggaggccaagacagggggaacacttgagctcaagagtttgagatcagcctggacaatatagaagaccctgtctcttaaaacaaaaatcaaataaatactcatagccctatgccactcttccacctaaacaaaactttcagagcagtggtccccagcctttttgatactggggaccagttttgtggaagacatttttttccatggatctgggtggggatatggtttcaggatgaaactgtttcacctcagatcatcaggcattagttagattctcagattctcacaaggaaccggcaacctagatccctcgcatgcgcagttcacaaaagagtttgcctcctatgagaatctaatgctgccactgatctgacaggaggcagagcttaggtgttaatgctcgctggcctggcccacctcttacttcctactgtgcggcccggttcctaacaggccatggacctgtgttgatccatggcccacgggttgggaaaacctgttccagaatatttcctggggtcaatctattttaagtccatgcttctatactgtctatattatgcaattcagaatgatatttctgagactatgaaagatcttcaatcaccagagaaagattcaattatgttcactgtactgtacttaatttcataaaagcagatcaacataacttagacaagttttcaacaatgaaatagaaaataaaaggattttttaaattaacattaaattcaatttgctaagttaataccagctgagacttaactatattaattacaacattctgcaaatgtgaagactaacatatttgtaaaagtgatcctaaatcttcattttacattgctctttttttcggaagccctagaaaccttttccccatgccgactattcccaactcactgtttttctatagatctactgcccattatcagcaagtcctcaaaactgttttatgttttaggaaggtcactgtcaattctcccaacacccatcctgccttcttcagattgtatcttggttttgttttcccacaaaccaatgaaattaaaaataaaataggacttaatactatgttatagaacataacgctcaaaatttagtgtatatcagaattacctgggaaaattgctaaaaacaggctctggggtcaggtagatcttagtttaaaccctggctctgctgcttctaactatgtaaccatgggtatcacaccttacctcatgacccaatgggctcccctcaaagggagacaacagtcatatttcagggtggatatgagaatgaaatgtgattatggatgtatactgcttagcacatggtgcctactatactctaagtagtcaataaatgggagctcttgttattgcgtggccctcatttttcctttccattctagtctctgtactgtcttcaatactaaaacccattgtattttccacattcttacaatgtccactgacaacactttggagagcatgacttcacaatacttccactaagcttctctagaactccacatcaggctctcaacaaactggtattaaaaaaaaaaaaaaaacataaaaatacttcattcttaaaacaggaaatttgactgggcacagtggctcacgcctgtaatcccagcactttgggaggccaaagcaggtggatcacctgagatcaggagttcaagaccagcctggccaacatggtgaaaccctatctctactaaaaatacaaaaaattagctgggggtggtggtgggcacctgtaatcctacccacctgggaggttgaggcaggagaatctcttgaaccctggaggcggaagttgcagtgagccgagatcacaccatcacactccagcctgggcaacaagagcaaaactccgtctcaaaataaaagggcgatggggggaggtgaggggaatttaagaaaacaaaataaaaaaataaaaataaaaacaactgcaatcatcatctattattatactatcaagagctcaaacatggcatgccctcaaactaactaaaacctcccctggctctcaaaattttttttttttttttttgagatggagtctcgctctgtcacccaggctggagtgcagtggtgtgatctgcaacctccacctctcaggttcaagcgattcccctgcctcagcctcccaagtagctgggattacaggcacctgccaccaaacccggctaatttttgtatttttagtagagatgaggtttcaccatgttggccaggctggtctcgaactcctgatctccagtgatccacctgtctcggcctcccaaagtgttaggattacaggcatgagccactgctcccagcctagctctcaaaactttctaaaccagccactttctaccttctcagcaactttcaatcacattactgctcttactttactgagtccacctaatgatatctggctttttagccaggctttgaatcatcgtcgacttttctgctgccttcaccatacctattcttcctcaaccccttgttcatccaccattggcaatcttcaacccttactatcatccctggagttccaaagtctccaatctcgcttccaggccagaacattcttgtaggaagacacttcgaacaagtgccatgcatgtctacctgataatgccctcataggaccttacaaatatcatcttactaggcttttagtaattccacagtctccaaaagtcaattataaccttcttcacacacttttaagactctcgcctcgcactctcctctgaatcatcagattacttcaatgtttactttgcggaggacatcaaggccattgagcatcccctcacctatcagccttcttcataactccacatagtttagtcgtatactacaataattaagcacttacactacacaataatagttaagtactattaattgataagtattgctctacatgttttatgtgtaattaactcattcgatcctgacaacaacccaagaaattgaacacaaggagatcatatgactcacctacagtcatatatctaaaagtggcagagtcaagctatgaatccaggcagtctggccccagaggctacttctcagaccactgcgctccactgactcacatgctcttaacttttcccactgagccctttccttcaatagggacttcgaatggtggtcagatagggttagttatccttagctgttatgttttaacttttccataaaggagaatatattcaaggatgatttgtgaaattaaagatttataaaatgacttactacaaagctgcagtaaacagtgtggcactggcataaagacagacatatagaccaatggaatggaacacagccaagaaataacctcttgcatatatagttaaatgatttttgaaaagggtgccaagaccattcaatgaagaaaggagagttttttcaacaattagtggtgggacaactggattttacattcccaccagcaatgcacaagggtcccaatttctccatattgtagccaacactgctttgttctttgtcccaaagagcaaagttaaagccttctcttataccatatacacacattaactcgaaatgaatcaaagacctaaacttaagagctataactataaaactctttaaagaaaacatagggagctgagcccaatggctcacacctgtaatcgcagcaccttgggaggctgaagcaagaggatcgcttgaggccagaattttgagaccagaagagtaacacagcaagacctcatctctatctctacaaaaaataaattagccaggtgtggtggtgcatgcctgtagtactagctactatggacactgaggtgggaggatcccttgagggcaggagtttgaagttacagtgagctatgtgatcgcatcactatactccagcctgggtgagaccctgtccctactattttcttttaaaaaggggagggggttgggggaggcacatgacattgaatctggcaatgatttctcagatatgacaccaaaagcacaagcaacaaaaaaagtggataaattagacttcatcaaaattaaaaacttttttgcaacaaagggcacaatcaacatagtgaataggcaaccaacggaataggaaaaaagatttgcaaattatttatctgataagggattgatatccagaatatataaagaactacaactcaacaacaacaaaagaaacaactcaattaaaaaatgggcaaaggacttgaatagacacttctccaaagaagatatacaaatggccaggaagcatatgaaaaggtgctcaacatccctaatcattagggaaatgcaaattaaaattacgatgagataccatttcgtagtcatcagatggatagtatcaaaatcaggaaataacaagtgttggctatgatatggagaaactgagacccttgtgcattgctggtgggaatgtaaaatgaacagttgctatgaaaacagtatgagagttccttaaaaaattaaacacagaataaccatatgacccagcaattttacttctgggtatataccctaaagaactgaaagcagggccaggtgtggtggctcacacctgtaatcccagtcacttgggaggctgagaagggaggactgctggagccaaagagttcaaggctgcagtgagccatgatcacatcactgcactgcagcctgggcaactgagtgagacctgtctccaaaaaagtaaaagaactgaaagcaaggacacaaacagatatttgtaaaccaatttttatagcaacaatattcacaattgccaaaagatggaaacccaaatgtcacaaaatgtgatatatacatacaatggaatattattctgccataaaaaggaatgaaattatgatacatgctacaacatagataaagcttgaggacattatgctagttgaaataagccagttacaaaacaaaaaaaccctgtatcattccacttatcagagatatctagaataatcaaatttatagaaagtagaatggtggttgccagaggctgggagaaggggaaaatgggaagttgttttatgggcacagagtgccagttttccaagattaaaagagttctggagattggttacacaacaatgggaatgtatgtaatactactaaactatacacttgaaaatggttatgatgataaaggttatgtgcattttacaatttaacataaaactgattttttttaaagagaatgaaattctgatacatgctacaacactgattaccaatgaaaacattacactatgagatatatgccagagataaaaggatgataaaattccatttatatgaggtacctagagcaaactcatagagggcagaaaatagaatagtggttactaggggctggggaagggggagaagatggggagttattgtttatggggtacagcatttctgcttgggggccaggtgcagtggctcacctgtaatctcagcactttgggaggctgaggagggcagatcacctgaggtcagatattcaagaccagcctggccaacatggtgaaaccttgtctctactaaaaatacaaaaaaaattagccggccacggtggggcatgcctggaatcccagctacgcgggaggctgaggcaggagaatcacttgaacccaggaggtggaggtgcagtgagacaaaattgcgccactgcactccagcttgggcgacagagcaagactatatctcacaaaaaaaaaaaaaaaaaaaaaaagagagaatttctgcttggggtaataaaaaaatcctagagatgggtaagtacactcacaataaaatgaaggcacttaataccactaaactgtatgcttaaaaatgattaaaattgtaaattttgttttaccataacaaaaaatgtataaaaagaattaatatataaatgtgccacctgtatttgtgtcctagatctctcctttctgattcctggctaatattattcctatatgtgtctacttcattatcagtcccacagtggctactgctctttcttcccagcctttctcttcactttaaacttagagtcattagcttccattttctcctctatacagctgccccagaaatgtacatttctcatcctgatagcttcaactcctcatttagtatttccatctaaatttcctccttagcatctataactcaatgtccaaaacagaacacatctattcccgctgaatccacccttcttttcaaattcattatactgttgtcaccatttctccagttactcagggtaaagtcaaaaataatatcctcccaaacacctatgtccctttttctttctttctttctttctttctttctttcttttttttttttttttgagatggagtcttgctctgtcgcacccaggctggagtgcagcggcacaatctcagcttactgcaacctctgcctcctgggttcaggcaattctcctgtgtcagcctcctgagtagctgggattacaggtgcccaacaccatgcccagctaaatttttgtatttttaatagagacgaggcttcaacatgttggtcaggctggtctcaaactcctgacctcaggtgatccacctgccttggcctctcaaagtgctgtcctttattcaaatcgtcctgtcattcatagcacctttttttttttttgagatggagtctcattctgttgcccaggctagagtgcaacggtgtgatcttggctcaatgcaacctccacctcctgggttcaagtgattctcctgcctaagcctcccaagtagctggcattacaggcacctgccaccacacccagctaatttttgtatttttagtagagccaaggtttcatactgttggccaggctggtctagaaatcctgacctcaggtgatccacccaccttgacctcccaaagttctgggattacaggtgtgagtcaccgctcccagcctatagcacttttttttttttttttttttttgagacagagtttcactcttgttgcccaggctggagtgcaatggagcgatcttggctcactgcaacctctgcctcctaggttcaagcgattctcctgcctcagcctcctgggtagctgggattacaggtgcccgccaccacacctggctaattttttttttttttttggtatttttaatagagacagggtttcaccatgttggccaagctggtctcaaactcctggcttcaggtgatctgcccatctcaacctcctaaagtgctgggattacaggcctgactcaccatgcccagccagcacttttttttttttttttttttgagttagagtctcactctgttgcccaggctggagtacagcggtgcgatctcggctcactgcagcctctgccacctgggtttaagttcaagcgattctactgcctcagccagcccagtagctggggttacagatgctcaccaccacgcccagctaatttttgtatttttagtagagatggagtttcaccatgttggccaggcagctctcaaactcctgaccacccgcttcggcctcccagtgtgctgggattacaggcataaaccaccacgcccagcctcctataatttttattatagtatgttgttgtaattgttctattttattattagttattattgttaatctcttactatgcctaagtaaaaaactccatcacaggtacatatgcatagggaaaagcatggtatatatagggttcagtactgtctgcaattttaggcatccactggggggtctcagaatgtattctctgtggataacagaggactactgtattacaaactgctctttaaatttttttttctattttatggaggtataaatgataaaatttgtatatacttaaggagtacaatataatgatttacgtatatattacatgaggattaccacaatgaaattcattaacacatccttcatcacacagttaccatttgtgtgtatgtgatgaggacataaactgcttttaatattttatttacaacaagcctattaaggaggtagttgttttatcatgctctccattttataaattaaaaactgaggtcaagtggttgtcttgtgaacagtcataccaccaagtaaataaaagaatgaggctggatacggtggctcacacttgtaattccagcactttgagaggccaaggtgttggcagctgcaactccagagggcttgctgctgtcatcaaactggctgcagcagagaggtatggatagggctgcatgatccatggagctagcgggagcccttccccttctgagttggggcaggagctcccctggtgctgctggagctacacaaactgcagctgttaacctgggcctcctgttccacggagcaggcagaagccctgccctcctgggtgggcttgcagccgcccaagttgtggctgcagatccgagcctccctgtggtcttgtgggggccgggagcaggcaggatccctgccttcccgggtgcagctgcagctgccctcccaggtgcaggacctaatagtctctgcagcctgcacccttgggggcccaggaaggcctccccaccacccccatatccccacttctctctgctcttggcacccactccaatctcagagtggggttggggcaagtccaggtgctgttacagtccgggggcggatctgtgtgtgcaccctcagggcagcaccctgccaccttgaccccctctagaatttgggcacggagaagcaaaagaggggaagccaagtagggactgagggtggtcagtgctggcctttaggtgcaccttggtgtgagcagcctggtgccatggactgctgagagagacagacaggctcctgggtagaagggaggttcctgtaagtccccaccttcaggacggggagggcttaaaggctggggaccgggctgctagtcccacccactggatggggatttgtgctgccttttctcacagtccatgaaccaatcaggaagcactttctcccctctgaggtccataaaaggcccaggctcagccagagcagggtagaggatggagaaaagatcagacaaccaaagaggagagaggagctatgctgtctgctgaaagctgggaaatcaacagggaggacctgcctgcagagaggagccacccactccagggcctcctctctgctgagagctgaatacgggataagacaaactgcctacagagaggagctgccccctgtgggtctcctctgagctgttctaacactcaataaagcttctcttcgtcttgctaaccctctacttgtctgcttacctcgacgcaggacaacaactcaggcaaaggcaccactgggcagaaaggtttctggccagaaaagcaacaccctaaagatcccgcaacaaaggcaagaggattgctggagcgcaggagttccaaaccagcttgggcaacacatcaagaccccatctctacaaaaaattttaaaaattagctgggcatggtggtatgcacctatagtcctagctactcaggaggctgaggtgggaggattacttgagcccaggagttcaacactgcactccagtctgggtgacagagcagagcaagaccctatctaattaattaaataattaaaaaaaataaaagcatgaggactagaatgcaactgttctaactccactataccatactggccttgtgaaatgaataaattttaaagacaaacccatagccctacttgtttcaaagcaacaaagctgatttagaaatgctaaatgtaggccaggcatggtagctcatgcctgtaatcccagcactttgggaggccaaggtgtgtgaatcacttgagtccaggagtttgagactagcctgggcaatattgtgaaaccacatcgctacaaaaaatacaaaaaattagccaggtatgatggcatgtgcctatagtcccagctacttggaggctgaggtgggaggactgccagagcctggggagattgaggctgcagtgaactttaattgtgccacgtaccccagcctgggctacagagaaagaccctgtctatctaaaaaaaaaaaaaaaaaaaaaaaaaccaaaaaccaaaaaccaaaaaaagctaaatgcctcagaaactatctttggcatatcagcatataggctataacccacatgcttcaggtatatctatcagtgatatgggaaagaaaaaaggaaacaaaagactgtattataaaatacctgaaaagtaatgttaggtatattctatacatttatacattaccattatcctggagacattacttatcctagattactttgatggtgatccactcaaactattgactggaacctgttcaccagcagtaagaagatttctgtagtgacctgataacctatcagtcaggtaaccctacagtctaaagataggttacgccaggcgtggtggctcatgcctgtaatcccagctctttgggaggccaaggcgggcagatcacttgaggtcaggagttcgagaccagtctggccaacatggcaaaaccccgtctctactaaaattacaaaaaattagccaggcatgatggcgtgctttgggaggctgaggcaagagaatcacttaaacccaggagacggaggttgcagtgagctgagataccaccactgcactccagcctaggtgacacagcaagactccatctcaaaaataaataaataaataaagataggttatcacatcttgttgatctctgtagctctagcatttagtagagtgactcatacatatcaggcataaaatgtttattcaagaatgaattgttggctgggcatggtggctcacgcttgcaatcccagcactttggaagcctgaggtgggtagatcacctgaggccaggagtttaagaccagcctggccaacatggtgaaaccctgtctctactaaaaatactaaaaattacccgggtgtggtggtgcacacctgtaatcccagctactcgagaggctgaggcaggagaatcgcttgaacctgggaagaggaggtcgcagtgagccaagatggcgccactgcactccagcctaggcgacagagcgagaatctgtcttaaaaaaaacaaacaacaaaaaaaagaagaatgaattcttaattaaactaaatttggcctggggatgcctctgtacttgagtctttatataccaagttgcaacctaacttagtacttaaactaactgaaagcctaatttagaagtatacttttgtatcaaaaagctgagtctcaggaaagcacagcagctgagcttcagtcaaccacaagcaatcaactgtttaaaccatgttcaaataaggcaaactcaaggctgcaaccaactgggctgtctctgtacctcacttctattttctgtacttcatttccattttctgtccataatactgcctgaccacatggcaaactggagttttactgaacatgttctggctatgagggttgctggattcactagttatttttttgctcaaataaactctcctaagtttaatttgtctagttcttcttttaacagaatgaaggaatatgaagaatacaaagatactaccacagaacactttacctttgcttcttgatctttcagggaaaactccattaattcatctgaaatctcttctgcctggtcttctcctaggtttggatttttatccaattttggaacagtagtaatgggactgcccaaatatttcatttcactgtccaccaagtttccattgtcctgtcaagtatattgacaacattaaaaactattcaaaatatatcaaagttctaaatgtaagagctaaaactataaaactcttagaagaaaagataagggaaaaaattcatgacactggatttggataatgccaccaaaagcacaggtaacgaaagaaaaaaacagataaattggtcttcatcaaaatggaaaacttttgtgcatcaaagaacaccattaagggaatgaaaaggcaacccacaaaatgggagaaaacatttgcaagtcttatatttgatgagagattaatatcagaatatataaggaactcctacaactcagtaacaacaacaataacaatcaaaagggacatgaatagacatttctccaaagaagatatacaaatggcccataagcacatcaaaagatgctcaacaaagtaatcattatggaaatgcatatgaaaattgcaagagatacttctttatacccattaggatagccattataagaaataacaagtgtttgtgcattgctggtgggaatgtaaaagggtgcagaggcattctatggataatagcatggcagttcctcaaaaaattaaatgtagaattatcatgtaatcaagcaattctacttctgaatatatacccaaaagaattaaaagcaggggccgggcgcagtagctcacgcctgtaatcccagtacttcgggaggccgaggccagcagatcacgaggtcaggagttcgagagcagcctggccaacatgttgaaaccccatctctactaaaaatacaaaaattagccgggcatggtagcatgtgcctgtaatcccagctacttgggaggctgaggcaggagaactgcttgaaccagggaggtggaagttgcagtgagctgtgatcgttccactgcactccagcctgggtgacagggcaaagactccatcttggaaaaaaaaaatacacaaaataaaataaaagcaaggactcaagcagattttgtacacctatgttcataacggcattactcacaatggccaaaaggttggaaacaactcaaaatgtccatcaacagatgaatggataaacaaaatatgatatatacatacaaaagaaatgaaattctaatacatgctatgacatagatgaactttgaagacattacgctaaatgaaaatataggctggacgcagtggctcacacctgtaaccccagcactatgggaggctgaagcagatggatctcttgaacccaggagtttgagaccagcctgggcaacatggcaaaaccctgattctacaaaatatacaaaaaaattaggttgaggtgggcagatcacatgaggccaggagtttaagaccagcctggccaacatggtgaaactccgtctctactaaaaatacaaaaaaattcaccaggcatggtagcacacgtctgtaatcccagctactagggaggttaaggcataagaatcacctgaacctgggagataaaggttgcagtgagtcaagattgcaccactgcactccagcctgggtgacagagtgagactctgtctcaaaaaaaaaaaaaaaaaaaaaaaaaaaaaagtagccaggcatagtggcacacacttgcagtcccacctacttggtaggctgaggtgggagaataatcagagcccgggagtttgaggctgcagtgagttatgattgtgccactgtactccagcagaggtgacagagtgagacctcacacacacacatgaaaggacaaaatataatattattctactcatatgaggtatctagaatagtcaaattcactgacacagaaaatagaggttatcattggctgggcagaaacagggatggggagttatcacttaagggtatacagcttctgttttgaataatgaaaaaattctggaaatgagttctggtgatagtctcacattattaatatacttactgtcactagactgcacactcacaaatagttaaaattgtaaatattatgtacattttactgcaattaaaaaaaatcacatataagactatccaataattgaacatactccaggtcttccctccatcctagaaaccaaaaacctaaataaaacatgatcaacttagtggccaggcgcggtggctcatgcctgtaatcccagcactttgggaggccgaggcaggtggatcacgaggtcaggagatcgagagcatcctggccaacatggtgaaaccccgtctctactaaaatacaaaaaattagctgggtgtggtggtgcacgcctatagtcccagctactggggaggctgaggcagtggaattgcttgaacccaggaggcagaggttgcagtgagctgagatcgcaccactgcactccagcctggtgacagagcaagactctgtctcaaaaaaaaaaaaaaaaaaaaaaaaaaaaaaaaccatgatcaactttatcttcataggatagaatatgttaaaatagctttccctcagggttgagattagaaataataatccaaatctctggagtccatggtctatgaaaggcaagtcaatgcctgggtaagttaagaccccagtattataagggcacaaaagacactagagaaattacgcatggataataatcacatgaaatcactactaattattattattattttattttattttttgatacagagacatgctttgtcgcccaggctggagtgcagtggcgcgatcttggctcactgcaagctccgcctcccgggttcacgccattctcctacttcagcctccggagtagctgggactacaggcgcccgccaccacgactggctaattttttgtacttttagtagagacagggtttcaccatgttagccaggatggtctcgatctcctgaccttgtgatccgcctgcctcggcctcccaaagtgatgggattacaggcgtgagccacagcacccggcctataattattattatttgagacagagtctcgctctgtcgcccaggctggagtgcagtggtgcagtctcggcttactgaaacctctgcctcctgggttcaactgattctcctgcctcagcgtcttgggtagctgggattacagatgcctgccaccacgcccggctaatttttttttttttttttttttttttttgagatggagtctcgctctgtcgcccagactggagtacagtggcacgatctcggctcactgcaagctccgcctcccgggttcacgccattctcctgcctcagcctccagagtagctgggactacaggcacccgccaccatgcccggctaattttttctatttttagtagagacggggtttcaccatgttagccagaatggtctcgatctcctgacctcgtgatccgcccacctcggcctcccaaagtgctggaattacaggcgtgagccaccgcgcccggccctggctaattttcatatttttttttcagtagagatggggtttcaccatgttgcccaggctagtctggaactcctgacctcaagtgatcagcctgcctcagcctcccaaagtgctgggattacaggtgtgagccactgcacccagccactactaattatttttatttttatttttttttccttttttttttgagacagtctcactttgtcacctgtccattcactgcactggagtgcagtggtgtaatctcagctcattgcaacctctgcctcccaggttcaagccattcttgtttctcagccaggtgccaccacgcctggctaatttttgtatttttagtagagacagggttttgccatgttggccaagctggtctcaaatcctggcctcaggtgatccacctgcctcagcctcccaaagcggtgggattacaggcatgagccaccatgcctggcctgctaattatttttaacataaaataaactattttaccatgtatgtatgtgtgtgtgtattatttatttgagactgagtctccatctcagctgactgcagccccagactcctgtgctcaagcaatcctcccaattataactcactggagcctcaggctcttgggccgaggcgatcctcttgccttggcctccagagtacctgagactacaggcatgcaccaccaagtcccagccatttcttttttttggttggggggtggggtagagatgtggtcttgctgtgttccccagctagggaactcaaagtcctggactcaagcaatcctctcacctcagcctcccagagtgctgggattacagggatgagccacaacatctggcctaattagcattttccctcaaactagactgctcagcagaaagtaattttttaaaaaattccatgagaagtccaggtatggtggctcatgcctgtaatcccagcactttgggaggccgaggtgggtggatcacaaggtcaggagttcaaatcagcctggccaatatggtgaaaccccgtctctactaaaaatacaaaaattagctgggcgtggtgccacacgcctgtagtcccagctgctcaggaggctgaggcaagagaatctcttgaacccgggaggcagaggttgcagtgagctgagattgtcccactgcactccagcctggacaacagagcaagattccatctcaaaaaaaaaaaaaaaacaaattccatgagaagactgggcagggtggctcacacctgtaatcctagcattttgggaggctgaggcaagtggattgcctgagctcagaagttcaagaccagcctgggcaagatggtgaaaccccatctctactaaaatacaaaaaattagctgggcgtggcagcatgcgcctgtagttccagctactcaggaggctgagacaggagaattgcttgaaccagggaggcagcggttgcagtgagctgagactgcgccactgcactccagcctgggtgacagagtgagactctgtctcaaaataaataaataaataaataagtaaattctatgagatttggattgctaatgaaaatgtaaattcttgtaacttttttagaaatgaatcggagaaagtatcaaaaccttaaggcttgagcccaggagttcaagatttgcctaggcaacatagtgagacccttatttctagggagaggaaaaaaaaaaactttaaaaatattgatgctgtcgggcatggtggctcacggctgtaatcccagcactttggggggcagaggagggcagactacgaggtcaggagatcaagaccatcctggtcaacatggtgaaaccctgtctctactaaaaatacaaaaattagctgggtgtggtggcacgcacctgtaatcccagctacgtgggaggctgaggcaggaaaatcgcttgaacccaggaggtagaggttgcagtgagccgagattgcaccactgcactccaccctggggaacaagagcaaaactctgtctcaccaaaaaaaaagaaaaaaaagtgattataggccaggcagtggctcacacctgtaatctcagccctttgagaggccgaggcaggtggatcacttgaggtcaggagtttgagaccagcttggccaataagacaaaaccccgtctctactaaaaacacaaaaattagctgggccgtggtggcacgtgcctacagtctcagctatttggcaggctgaggaacaagaatcacttgaacccgggaggcagaggttgtagtgagctgagattgcaccactgcactccagcctgggcgatggagcgagactcagtttcaaaaataaatgaataaaaagtgattataaatggagattagaaggacagtattaaatcaagaaaaaactgataagaacagccgaaaacatgagtttatcttaagtcaatgtaagaaaagaagagcagctatcttttatggtaatgatttggggaaagggatgggaggcagggaagaaaaaacgatgtctagaaaaggggcttagatgagggattagatacagaactatcttagtgatgaggtggctccggagaggctagatttaacttggaacgacggatggcctaaggtttagataaaaagtaccatggcctcctcggaataagggcttaaaagctagactaagggggaaataagaaattaatctacacttgcatgtaaagtggtaaaaaaaaatccatgaacaagttatgcaagttatccctacctgttaaaacaaacaaacaaacaaacaaaaaactcctaaatcccttacactacagtaagggtaatttttgtcctcaaaatgatcaactgaacatgagaaataatgatgacctactgtggaagatttggagctgggtgtctgtcctagggccaaactttaataagaaaaaacaaaaacaaagaaattttctcccctatagtaatacagtttccttgtctagcatacgaggtataaacagttctatgtctcattatgataccaagtttcttcactcaaaaaataaaactgccaatatatctaggtttccattaaacactcacattttctttatttgcagatgaactacacattgcatctctctttctatggccacggtccaaaccattcggagtgctacaaagaagctgtgcctaaaaaagagagtttgctgagaacgtccagcatcctcaagccacaggtgcaatggaaaccctctgcctcccacctgaaaagcaaaacaaaacccaaaaaaagagaggctactcactgggctacatttcattaggtgctggtcatgattcctgcagattaaaacaaactgcctgtcaggttagtcccaaatactgtttgattattcttcagtggattggtgcatcccaacatttttctatttcattctaggagccctattcctagttgatatgtctcttccaacaacaatacatagggtattctctgtggtaaatatcaagactcaagtgacatcctggggataagaccctcattttgcctgcataaccatataacatgttccaaagatgaacgagttttatacaatttacaatttactaattttccagcacagtgtattggggctaattttttttttttgagacggaatctggctctgtcactcaggctggagtggcacgacctcggctcacagcaagctctgcctcccggtttcacgccattctcctgcctcagcctcctgagtagctgggactacaggcgcctgcaaccacattcagctaattttttgtatttttagtagagatggggtttcaccgtgttagccaggacggtcttgatctcctgacctcgtgatccgcccgcctcagcctcccaaacttctgggattacagatgtgagccaccgcacccggccggggctaactttttaaaaaaatttaatttctggcggggcgctgtggcccacgcctgtaatcccagcactttgggagttcgaggcaggcggatcacctgaggttgggagttcgcaaccagcctgaccaacacagagaaacccgtctctactaaaaatacaaaattagccaggcatggtggcgcatgcctgtaatcccagctacttgggagcctgaggcaggagaatcgcttgaacccgggagggagaggttgtggtgagccgagatcgcgccattgcacttaagcctaggcaacaagagcaaaactccgtctcaaaaaaaaaaaaaaaaaaaaaaggctgggcgcgggggctcacgcttgtaattccagcactttgggaggccaaggcgggcggatcacgaggtcaagagatagagaccgtcctggccaacatggtgaaaccctgtctctactaaaaatacaaaaattagctgggcgtcgtggcatgtgcctgtagtcccagcctctcaggagtccgaggcaggagaatcacttgaacccgggaggcggaggttgtagtgagccaaaatcgcaccactgcactccatcctggcaacagagcgagactccatctcaaaaaaaaaaaaaaattaatttctatcctccctccatggatttcattatctatctgggttagagcatttaaagcaattcaagctgggcccagtgactcacatctgtaatcccaggactttgggaggccaaggggtgggtgggggtggggcgctgatcacttgaggtcaggagttcaagaccagcctggccaacatggtgaagcctccatttttgtattactaaaatacaaaaattagccgggcgtggtggtggacgcctgtaatcccagctactcgggaggctgaggcaggagaatcgcttgaacccagggaggcagaggttgcagtaagtcaagatggcaccactgcactccatccttggcaacagagccagactccatctcaaaaataaaaataaatacataagtaaaatgcttggtatgtgctagatacacagtttatttactccttacaatagctactttatgagaaatgctattattgtctccacgttacaaataaaaaaaattaaggtccaatgaagttaaaaaaaacttgtcagagtcacaactggtgaatgaagtagtaagccaggaatccacacactgattccagagcttatactctgtactttctttttttttttttttctgagacggagtctcgctctgtcgcccaggctggagggcagtggcgcagtcttggctcactgcaacctccgcctcctgggctcaagtaattctcctacctcaacctccgaagtagctgcgattacaggcatgtgccaccacatccagctaatttttgtatttttagtagagacggggtttcaccatgttgggcaggctggtcttgaactgctgacctcaactgatccgcctgccttggcctcccaaagtgctgggattacagatgtaagccaccgtgtccggccactctgtactttcaattactaagatacagcacctttcacatacaaataaaagcctatacataagtgtagtataccattttccttcatttccttatagatacttctgattatgatggttaaaatgaatagccttcattttcacaacactatttagatgtggaaaacttagaaactgttcaaggtaaggaactaggcctcaaagcccacttatacccagtatgaaaggttttgtactctgcagagtctgcacaggataaaatctctatgaccagtgctaaaaggcttttgtgtggggttcatttaacaacagaacttacatcccagctaaatgcacttcctgaagtcctgaagaatccaggtgacctgcaatcaaatataaagaatcagtaaaaggagttattcttgtccatgcatcctgtttttccttcagattttcttcattaccagtaagccgtattaatttcaaggactgagcttttgaatacaaagcctctcgattggtacccatttcatggtacaaggtacaatttcacagaaacgtaagaatttatatgtgtcactaaaagaaatcaagtgttgggaaacactacactatgctacctatggagtttttttttttcttatgggtagaaaagaaaggttatcactcagaaaatctgaaattagaattctggaaggttaacttatgaaacattccttttggaatatttcatataaaacatataaaaattagttgacaacatatttctttttttttgagatgcagtctcgctctgtcgccaggcgggagtgcattggtgctatcttggctcactgcaacctccacctcccgggttcaagagattctcctgcctcagcctccccagtagctgggcctacaggcacgtgccaccatgccaaactaacttttgtatttttagtagagatggggtttcaccatgttggccaggatggtctcgatctcttgacctcgtgacccgcccgccttgccctcccaaagtgctgggattacaggcatgagccactgcacctggccaacaacatatttctttatgctggtttctttgcctctgctgagattagactgaggcacaaaacttctcatatcctaatgactatactttcattcccaccattaatcagtcaacaaaatatattcctacttgtctaacattttcatatgcaaagtagctcctattagtgttattatctttctcttcccattggcttaatcattctcaaaaatcctctagttacccacaaaattccatctctctaggcagattctttttatactttcaccaccttccgtctctatcctccttccctgttttctcccttaaaagttattcttccctttgaggcctttatctcccttctccctaccagtttcatcaaggtctgcagaagtggtaagctgagtggcagttatctccccactgctaagattcgaaagatcgaggcaacgttttggggttcctctgttgagacataatagtacatcgaaattcccattagattattatatccttaaaagtcaaagatcatgtcatcctcttcttttttttttttttttttttttgcagtggagtcttgctctgtccccccagctcaagtgcagtggcacgatcttggctcactgcaacctccgcctcccgggttcaagcgattctcctgcctcagcctcccaaatagctgggatcacaggcgcctgccaccacgcccagctaatttttgtatttgtagtagagatggggcttcaccatgtcagccaggctggtcttaaactcctaacctcaggtgatccacccacctcggccttccaaagtgctgggattacaggtgtgagccacaacgcctggccaagcctgttcatttgaaacaccccttaatgactatcagatcatctgaacagtgtccaaataaatctaattgcttttgggaaatatatcagactgggctgagaaaaatctcccactaccataatctgtactttattttctccttaccaacatactgaaacagataatttttttttttttaaatgaggcccagagtttattggccgagggggatcttgactccacattcccggtcctgagcactatgaacacaggcttgatttctccctggggtccctagtttttctcaggtactacttctctttgctagttgagacatggtatgatcagaattcaaagtacaactgcaataacactaatattaatactaataaagtgaccgactcgtaatgcagcggttttcaaagacttttcccagttatcacatcatttgattctcacaagatcctagtaagataggaagcgattattatttctttgtcttttcttttctttttgagatagagtctcactctgtttcccaggctgaagtgcagtgaggcgatcttggctaactgcagcctccacctcccgggctcaagcaatcctcccacctcagcctcccgagttgctgggactataggtgcacaccaccacactcagctaacttttaatattttttgtagagacggcgtcttgccatgttgcccaggctggtcttgaactcctagactcaggcgatccgccctccttggcctcccaaagtgcggagattacaggcatgagccacctcgcctggctgagattatttcttgtcacagaaaagaaggtgagactcaaaagggttacacagtcaagggcagagttgagacttaaagcctgacctttgagccgggataattgaaaacaaaccaacaaacaaacccaactgtttggaaatagcaaaggcaatacagtgtaaaaataaaagtatatttacccagacaaaatgcttaggtttgcagaatcaccaagaaatttgcccactggagttctagggacatctggacagacggtaaaggaagtgtctctctccaggagcaggtttaacattttcctttgattagacctaaaactgggtcctgagccagagcttccttcctctcttgtggatgagaagagttccgtagacatggtcttcgaattctcaccaggagaaaaacaaaacctagctaggaggaaaacgtcatctaaatcggtacatcacagttccctcagctttcctaaactcctccaccctttccagccaggcgaatcaacactggaagaggggcaaccccgaagggtgattcacagcctggcttaaggttagaacctgaattcaccgacgagaggcaaccttaggaccttaaagatggaatgaagagaggattttgacttgttccacgccacacagctcgagactcctgactagaaagaacccgggtctcgtaactcgcgatagtccccattcggccctcccaacctctgtctgtgggggcccgactggaccctaagggggacaatggggtctccgtgattccgtggcggagacggctgcggacttacctcaagcctggagtctgaggcttgcctacaagaggagagaaagtagatagggatcggacacaggcgaagacttgagcagaatgaaaggaaatctaggggaaaggaggtagttaactagattgcagctctgccttccgactgggtaggccaacgtcggactcagagtcttccctgagcagaaggccaaagttacggcctctgagcaagaatatcaacagccgcaggcgttgacc

SEQ ID NO: 434 - DNA, 46558 bp, Homo sapiens; identical to SEQ ID NO: 433

SEQ ID NO: 435 - DNA, 306671 bp, Homo sapiens
agagatcctgggagcgagagggagagagagggagcaagaaaggaagagagagcgagcgagagagagcgagcgaataagagagagagtaagagggagagagaagaagaggaagaagaggaggcggcggcagcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtacatggccaggcagaagaaaatggggcaaagcgtgctccgggcggtcttctttttagtcctggggcttttgggtcattctcacggaggattccccaacaccatcagcataggtaagcgcaagcgagccagccgtcggtccaggctctccctcacccgagaccactgccccggcaaggctttccctgcggtgggtccctgtcctgcgtggcctgggaactgggactggggccgggaccgggcagagatggtgcggggcggggggcggggcggggggaatctgagcctcaacgaggtggctggtctgaagagcctctgggacaagagaggggtctcctggggctagtgggggtgaactgctaggttttccgagccgagaggagcaccggaggcgagcaggaggctgggatgctgcaagggggtgaagagtcgaggcttttcggctcgctgctctggactttgccatggcgtgcgtgcagctcctggaagttgtcccagggtgatgccgactgtctggccgcgccagggcgcataacccgggcccggggtgctcagtccgtggtctccggctgtcgggagacaggctggtgctgggggaggtggagcccactttggatctcccagacccgggcagcagcaggcgttggtggtggatggggtaggaggcgggggtgagactaggagctgagcgggcaagcggcgaagtcacgcagaccacgaattcatgaattgccgctgtgtctgtctggagcccggctcctgggcgcctggagggagttatcttggcttctgtcgtatttacaagtctagaagttagaatttttgccattactgaaccaaccccctgtattgtcacgggggagggtggctatggggaacgggttggggtagcagggggaacaatattgtttttcttcccaacctttcccttcacacaatgaaaagatgaccagctgtgcggatgggcggggggcggagggggggggcgactaaaaaaaaagaaggctgccgactaagaaagaaccaagtctcactcttggttccatcgtcctaacccaaaacggctccctcgtctcttctcccttctctctagcctcttcttttcagtctagaaaagccaggtttctcttggccaaaatctgagttcacaagtcttgaaagacacacaggttgaatatcaatcctcaatcccacaccccagtatcattgagaggtatccggtatctatattgttccccaattcctaactggccctagtgtgggggaacacaagccaaatctccgttccctttgcttataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgcttgtaagtagatctgcttttcctccctttgggacgttggggacctcatttgcatctttcttgtggcacttagggtctgtgtatgtgctgggagatgattgcttcagtagatattttaggggctctaatccatccggtttcatgttgcataaatcaactccaaatgatactgctgaggggcttaagacagtgggaaaaactcaagacagtgggcaaaagtctgctccaaatagtgtttgatgcaaaagtttcattttcctccatgctaacctagtgtgttccttctccaacactctctctcttttttttttaactggggaaaaaaaaagaaagaaagaaaaaaatagcacggttgttcagagaaatttcttcagatgagatttaaaaaagcagcagcagcttcttgattgagtcaattcaggatgtacatcacttgactgttaaagctagtgcctggctctaggaacgagctgaatttgacaattgcctaatgtgtaggaagcaaatatgagaaattctgcaaacaagtgaccttgaggggcagaacaggctgggttccctggcctctttctgtcctcaaatattaccttacttactgagagagctctgataggaactcataagactacaaactgattgcaagtgatgaatgcctagcaaactgaggggaggggagaaaatggtgatcaggtgatgatttagaaagctagttctgcctcccctagtgttgttcacccccatgatcattaaagacaacacagttcttaatttagagcaaagagggggcaggaggagaggaggcttggagcaggaaaactgaatatggaaagagaagaaattcatcaggcccaaagccggttctgaaatccttagttgtaccgggtgattattcctctgaaaaggggacattttgtaaaatacaaccaaaggaacctaaatggctaatagcctgttggacatatggttttacttgaatggaatgtttcgtgagaaagactgagaatacttcatgtaagcttatttcactaaaagttttcacaacaatgaggctgaatatggtataaaatatgctttgcttttatggctgatgtagtttggaatttggggtttttcttcctttctcttccaagggagaaatgatatttatgtttggatgggtgaaactttgtatatgactttctttaaatccttctgcctcaaaggatgcatggtttccagaaaccactgaaagggtctctccaagggcacaggtttcttggctttgaagacttgggccaagaggatgggggtaacatactctgcaagaaatatgacagttgtcagctttaagaaaattttagctgaagatacagatccttatatgaacgtgttctgagatactccatatttgactttctttggctttctgacattgacaaaaataggaatttattaattccagctagtgtgaaagttacgaaatgtctgtctatactttgcatcttattttggtaatcccagcctgtctccacagcatttacaacacgcatctgactcttaatcctgcagcactgtgatcttgtcaagaggctgaatctcaaatgcagcttcctaaatatcaattagaacagatttaaaactaaatacattaaactaccagggtttattaccattagtaacaaataatatttatttcaactcccttcagtgtcttttcactgatgagaactgggataagagaaccatttggtttctcagaaatgattgatttccaaggtttttggtcctgttcttatggtcaaaccagattgacacccaccagccctggactgtcagaaccccactcaagaagcaatcagaaatgattcttgccatgtgaaaatctcaggtttaggaaaaggcaataagtcatccatattggtattgagttgccttattgccttacctctcagggcaataagagaacaaccaggggaaaggaaaagaaattgatcaaaatccctcaccgtaaattcatagcatttccacttacaaggctgggttgtggctaggggcttgagagttcgggagaaggagtgtggctcactgggcaacaagaaaaagaaaatgaaaacgtgaccttgcccttagttatgtcaaatacacatgtatgcatgcacagacatacgcaggaaaaatagctagaaaccagtgttgtgtatccagctgcctgttgctttctctgaagacagaggaggaaagctgtcatcttctctggtccctgaaacagtcatctctgaatgtcacaatcattgaatgggggccagatctcaaagctgtctctaggcagctgctgcttggtagcttagtatgagaaagatgactcgtctaaccatagtcttggaatgcagaaaccaagtatttcaagggaccaaagaagccctggaggtgtttctcatttctacccctggctttaattgttctttttcttgtggaagcggagatcaaatatttccaactgggttgaaattctagttcagtgctggagcctgacaggtgacccccaggttccactcctccaaatgattgccctgattgtgcaaagagaaacctctgtatcctccggcctgtccttctctggagacctagggagaattccagaaaacaacagatgagtctcaatctggccaaccacctctcctatctggttcaatatggaatgggctggcaaaaattaaagaaactttcccttattcctatgcaaaattcctagtttcaacttcccttagcactagaattgatctcttctcatgatctttcctgcaccctcaatcctgaggcaggcacacactttctagggtgtaggtgtgcaggtaaacgaatacacaaagaataaacaaagggtaattctttcatatatgtgtccctgttctctgttctccctccacatcacccacccctacaacctctgacaatgtgtttgaaaggtttccttgcgatgaatcccaggcatcagttatttaaagactcttcttcatcagaaaccaatttttttgcacaacccccaagaggtttgcttaagacagactccaactttattccatgtcctacgaggccaataagagccacactggctttgaaaggtgtttaatttgggatctcaactcagagatggattgaagtttatctaagagacttacctgatttgaagcacatgttcccatttcatgaggattaatagagtttgctgccttacttttcaacttagctagataaccccagaaccaagagtggtgtgaattctttggcttcaggatatatacattcatagacacacaatcaatatatatgaagagagatgtatacacatgtaagttacatgtgtgttttttaaaaaacagattcaatagtcctaaggctttcagggcaggggtgtggaaacaccaagggactgatgtgtcccatcgtgtggctttgctgtcctggttcctcaggaaacatcgccgattcccttgaagtcccctcctgtgtctttctgctgtgcacttgtagtgcactccacactacaccgccccagcctctgcagtgtcagctcattagcacacagatctcatattccctctccgcactgtcattgcaaaaattgctgttgtacacctttacagccaacaaatgtgcttgtggattacgcactgtttgcaagaagcagggaaaaggcaaatgtaaccttaaaggttattcaccacggaattgtactctaaacgcattggcttaaataaaaatctgttgatggaggcacaatggtgatggtgggattgagaataggacttaggagtgcaggctttaatggagccccaggtaaaatcccttttgctggctaaacgtaacccatcagatgcaaaattttattccattaatttttttcaagccatttgaaatataactgctgagaacacactccctttacaactaagcgcatttcactaccaaatatacttagctgagacaggtttctgtctcttgcctacagagtcacaatctaattatctaattattataattgccaaaatcaatttaactatttatgtccatttgggaaggaaatgtctcctttgatcccattctttgcaatttggtgggttttgttttgtcttggtttggctttggtgtctgtcctttccatgtaagatttggaaaccaggtgaagactcctgggatcaagatcaagcctccttcccttaacagattttgccatactacccaacattgactgctctggttccactccctccctcactccccctcttccctgcctttgtgcctttgctgctctccctctctcctctgtctgctggccagccttcagtaagcacgccggcttagctcacttctcggcccctctggcttagtcccctgaagcatgaagaggttgccttagtggtgccagtcaaaaaattaagtcacgttttcacaaggtttattacggtttttaaaatttatttttcatagggcgggggagggaagaagctgatgctgttcatttgggccataaaaatagatggcaatcagcaggctgtaaaggtgagcttcctgcaaagtgtattacctcccctagaaggcagcttcctattgatctactaaatcaggggggacagcagcaagaagggtttgaaggaaaggaataaagggaattattttgttctccatctacatttactgcaaaatgggccatggtttttctccctctctgcaattttaactttttttccctaaaatgaaactagttttccacattttcctacttctgcccctacagaggtaatttccttaattctgcatttccctccctagtccctaagactgagtgataatagtggaggatcgatgagctttttgttatgtttttggctcctgatgtatttttaaatttcattgttatgggtagtcagaggtgattggctggtttcattttaacagattgaaaaataaatgaagctcctgaggcatcgttatttgtcttcctttttacagttaaagagatttgtcatttttatacagttggtttaaggattaaatgatggcatagattttaagacagggccagaattttagacgatagaattccataactttgggggagactaataaacatgcttatccagatgatttccctgtcaacttcttagattgagactgcaaaataaatttgaaggacctttcataaaaccatctatcttcaatgaaggtcaagcaaataatctgtatactttacctgctccattaaaaaatcaagttttgactttattcctttggctttgttactttgggtcttattagataaaatatccacaggagggtgcaattaaaaccccaggtgggggtgataggtattcttcagcagcactgtgggagttgtgcagacacaaaaggaattccctccatcttgggagctgctcagaaactgtctgggctccagatacagagctatagatagcctcagcccgtgtgtgggatgagccttgagctaaggcagcagcccccaaaaagggtcagtccttgacaaaggttaacatggatagaaattgtcttcctcatatttctacctcttctattgccattattttcttctcttgctctatccgtccagctcgtctaactcccttttgctggtctctgcctactcactgaccagcccctgattctagcatcccatccacactaaacttacctagggactattttctaccccggacttttccagacctaattcccagaacttctccttctccaccagaatacctttactcttggtccatgctccaaggatgtagagtgcagtacggcctgcactctactttgggggtgacagctttatatctaatataggtatatatttcatatatatgaaaatgtcagataaatggtaaagggttaatatatgtaacggggagtatctgcttcaaaactagggactatgggaaacatactgcctcaatttcaaggaaagatacttaaataggagtgtttctggatattactctcagagtggctgttcactctacccaaactaaaggtcagctggctttggtcatagaagacttttacaggccaaagtacaagtctaactgcccatagtaggttgggtgtaagtacacccgaggcataggcaggttcaacttcatgttgaatctaaaagcctttgcgggtaatttgggaagctgcaggttcaacttcttcatattgaatctaaatgcctttgggggtgatttgagaagctgctaaagttcataggtatttattttattaaagaggctggtgtggagactgaacctgcctatgtgggcactgtcaggagatgtactggcacaaaaggaaggttataggagaggataagggtgggagagaagctatctctccagctgtaagtttcctttccctgggatggtatgtggaatgccacgtttaagaggtaacatccctctcaccgtcactaaatagtatctctggaggtatttggaagtgtagttaagcagtatctcctcctccctccatccttcccttaccttgtctcaaacatacactctggcctccctcccagtggaaataaccagcatattctcttctggatttccaattgctcattggtcacagaagtgtttacatcccatgctctatctggacctccctgttcctcaattcccaaccgtcactggcttcttaagcaattatcctcaacacaaccatcatttgtccttatttggagggtgcaggggagcaaggataagaataaggagaggaaacacagctgataatgatccctcaaccctatgaggcgcaattcagggtagaacagcacttgttaatttttcatgtgcacaccaatcacctaggaatcttgttaaaacaaagattctgattcactaggtctgtgatggtgcccaagaatttgcatttttagcaagctgccaggtgatgccaatgcttctggtcctggaaccacactttgagtaagaagagcccagagcaaggagactgtgatcattaaaggaaaaggctctcgcagaccagctcttatccatctttgtatcttcttgccctccaaagaaggttctgtaagagacacatttggctcgttcttactcaagtatgtatctgtcacattcccaacaagtccgtgtccatttcagccaggtctgtaggtggcattactagatatctgatgatagcatttagagttgttttattgtagggatgtggagtggggactgaaaggcaggttcagcgaggaagtagctcatgagcccgggtgacactgtcttggcttcttgccataccccaaagtgccccttttagaaacaacctgcccaagagagcgaaggttggcatgcagttccaactgcctttccactttgcttctctgggtcaaggcatgccagaaggaggaatgtaacatctgctcctcagctgtctgacttcccttaaacagggttagaaacaagaagtacaacacaacctgaattctatctggttccctaagagactgaaaaattgactccattttcaaggcctgtgccaggcactcactgatgggagggatgggagggaagggaagtaatgtcactttctagcagacctgagccgagaactgctccagggaagccattaaaagcttacccagtgtcatttgaggatcgcaaaatagcaaaattccccagaaaaattgccccccaacagtgtgccattagtctgaaattccacaaatttgtttatttgtattactgcactgaaagcctgtgccaaaatgcaagcgtgctatctggaagggaataaattaaatccttatcagtcattaatatttcaaccagaattctctgttcagattaccacctgttaccttgcaggatcctcagagggggctttccaagacaggtaaatgacccagaacaagatacctgcccaaggaagtgaggcaccaaatggattgcgggcattcagaggggcgctggtagactcttgaggataaggaagattccctcaaatacacttcacctatttttcaacatttgaccttctccatggataaattctggtactttattcactaagattttagttatctttaactattttagctgcctttgaccgaagtcatacccttctgatggtagtgggcctgctgcctgttctgtgtgtggtgtttgctgcaataggtgatttcagcttcaggattttccacagttactgtggaaaattttcagaggtaaaatcagtttgtgatgaggtatggtgagaatttaagcttttaaaaattgttgtgatcaaaaataattccctctcaattatccatgattggctaatctaccttgccaattactcattgcaaccagggccttcatctttgtagctccccagaaaggggtcaagccacaggcaataaatgagatgggaagggatcaggatgcagctcacagaggggtaagtgtatgggtgtgggtacaggtctttgtgtaggtgaacacctttgcacaattaagattagtaaagccattaatgtccaaagtcagtcagaacctgttaaacattctcaaatatcctagtacctcactgcagtttccaaagctccttgttcattaaacagtgtttcttgaattgggccacttgctttagaatcaccagagatgcttgttaaatattaattcctgggtcataccctagatgtattgaatcagaaactatcaagataagcattttaccaaggtctatgggcgatactaacgcatactcagtttaggaatcacaggtttaaaaagccccagtactacagagatatacagattcagattgaatatttattgaatacccactgagcaccaggtattatgccaggcactttcacatatgttacttctctatgtaactgaggtgctattggcctatgcaagcattagagagtttggctttcaggctggaaatctaagacttggaagaactaagagactagcctcaagtcacagtctctgagggaaataaaacagaatgctctttgagatggtaagtagagacaaaggaattattttcattttgacaatgcttcttcctttctttgcttattagctaatgattcgtcctcagacatgctctgaactagacgtcatggcaaatgccaactcacttattaaaaataaatgtattgcaatcagttcatatagcaatcactgtgccttcctccccatccttgctatcaacaaatttaaaaccagagctaaaataataacagctaccatttattaaagccgtaccacatggaaggcactgtgctaagcattttacatgccttatctcatggaatcatcacaatattgccacaagcgaggaactctcatccccattttctaaaagaggaatgataggtggttcaaaatgcataagcaactagctcaaggtcccacaactagctaagtagtggagccaggattcgacctgagatcttcctgtctctagaggctgaatcaatttcaacttgggttgaaatttcaaatgcatataggggctacgcagaccacataaaagtggtaggtaattggaccaggtgtgttataatagggagtggtggggcctatgacaatccagagagtccatgcttctgcctgaagacattcaaattcaattttcttaaaccactatgggacaaacaaaatgcctgcaacaggacctagaaggactgggagtggaaagtacacatttctgacctctgcactatactatatacctccttttagcagctaggttactggttgagggaagctctattaactggtagttataactactgagaacagcagagagaaaagctcttctcagtaaaaactctattttgactttcttcttatagtgtgccatcaaagtatctcaatatggtagaattttttctcctttgtggaaatacttgtggtgccatgtacatacactctatatctagtagcttttcatgactgagtgccagcttgactctaactaaccttcccccaggcaatgcggaggccctcagcaaggtcagaatgctggcacaaggtcattaataagcgcccagcagatcagaagaggtacatcaccattggtggggggaggctgtgctctgggacaacttcttaggttctagaacatgcaaaccccaggcccacaactgggaggccactgggtcaagtaaggctatgtcaacagccacccagggtaggaacttcccatatactctgagaaagaggctcaccaactttagaccagggtctaaaatagagatgtaatagttgtctggagttgtaaactaacctaacccaatctggtcattgacaatcattacgtactttttgttggatattaatagcctgccatagttaaagtgaggctatagatcttctccccattaacatcactaccagctataacagcaagactcagacaatattctacttcccattaaaataatagcaaatagacataaaataatttgatatccaattctgtagacccagacaaattcagctccctttgcttctaggtgctacaacaacaccttgcatgaaggtttacttgaggcacacaagacaacattctagtagcaggattcagctaaccaaaaatccccatcagtggctgtccacaggacaatttacaaattgaacctacagtaccattttttctaagggataatattatagagcttactagatgcttatgttttctttatgctaatttgggaactcctctaccatatttctagccaatccacatatgttgtacactattaatttcaccaatgagaagtttaatgttaattaacaaagcctctggtgctcattggagataaactcctgaggtgattgttacaatcacttcttgattagaattctttaaatgctaaattactattcctggtctatgtatttccaaatgagggtaactgaccacctctacagtatagattaagactaactgacccatatatacaccacacaatttatgttgaagtcttatgaaataaactataagtaacagaacatttgagatatcatgtttcttatggccttggaaaacagtaaaagttgtaagagcaataggagggtggtggaatgaacaatgggacagaaattaggagatctgggttccagtctcagctctgatatccactgcctggatgaccttggataaatcacacctatctctggctctagtttttatcatgtgtaaactagggaggttcttctggatgatgtttgtgacttctatctttgacattctatccactgggcatggcagctcaggcctgtaatcccagcactttgggagaccaaggccggagatcacctgaggtcaggagttcgagatcagcctggccaacatggtgaaaccccgtgtctactaaaaatacaaaaattagccaggtgtggtggtgtgtgcctgtagtcccagctactcaggagtctgaggcaggagaatcgcttgaacccaggagacggaggttgcagtgagctgagatcgtgtcactgcactccagactgggacagagtgagactccatctcaaaaaaacacaaacaaaaacagcaacaacaacaaagacattctgtcattaactcttgtccaattcttaccatctcatttcatttcttactgagaaaaggccatccaaaatgaagctcctcaaattctatatctagaaattcctcttcatattcatctactctctgcctttatgagagcctgtgataaaaatattgaatccttgaaatcaatggttagtgtttcagccagttgtggcttatccttgcacatcccaactcttccacttactagctgtgagaccttgggcaagttacttaacttcattgtgccgcagattccccagttataaagtggtgatagtaatagttcttacctcataggattgttgagagttttaaataaaataattcacaaatgcatgtaaacacttagagcagtgccagggccatcagtgagctttcttcgtgggccctggagtcaagagcccgagagaggccctccatactgttcattctcctctggagcaggcactgccctggcacacaaatggcacatacctatttctttgttcttttctacttcctagtgaccacttagcagttgataatccttttagtcacttgccattcatatgatgaaagctcaacagagatgcacctctggaacatctctgagtctaggcaattcttccactaatatattacagtctcttacagcattcagtatactttgtgcaagagctactaaatgcattctaatcttggctctcttactagccatatgaccgtgagcaaattacagaacctctgtgagcctcagttccatcatctgttcaatgagaataaatataatagtaactatcttataaagttgttgtgaagattgggatcatccacgtaaaatattgaccataatgtctaacatatgtgttcaatatattaacacagagtagcgaagtggttggtaaggaatagaattagtcagaaccaaactgtggaagatattcttaactatccccaaagcccttcaaactaacctgtatgccctgtgaatttgtagctgaaaagaagctggatgagatcacctttgaatacccacaatgctgccttgggcataagaggtttgcttggggacaaaaaaaaagtggggaaagaaagaatttgcttgatacctcaaaaaagccagggcacacataccactaagcctaatcatgccaccattaagtggaattgtccagaaggacatgatcccttctgatattttttttctctaaactggacatgatttgggtaaagcagcatggatagtaatatgataaccttagcacttgctggctcaaaggaaagaataatctttcttcaaatgtgacctctattttaatgtgtttaaagtgggagcatggaagagtggatcccagatcctggatcctgatcctgcactcagactaggaaaaatgtagttccaactgggctctcccagccatgagttttctgagttttttaattaaggctgatgcgtgagtggaagttaagaacgtattcgtttgagtggatggatttttttcttttgatgttgcttgcctaagtcagattgaaaatagcaaaggaaggagatatggaaaagattaaaagagaaattttgctaatgtgattttccagcattttagtctctctctattctctccagaacaaaggttaactagctgattccataagcatagattcatgagaaaggatcctgctaaggaccaccagactttttagtcttttaaatttttttttttttttttttttgctcccctctcttcttctgtattctgtatctaacagcatggtgtatccagcaggccgaaacctgggttatgaccaaaggcaatttttagccacttcctatcccagtgtacccataatccatgagtatcatctcctcttctcatttcctattcaagcctattcctatattttcatgtggaatcactgatctttttttcagatgaagaaactgaagaggaggaacagagatgctcagtgactagcccaaggtcacacagctaattgataactgagctgaggttgtaatgcaggttttccaacttttggcacttctctaagatgtcttcccaacataatccttattctcttggctttcactgctgcacaatgacatacataaaaatgacaacactgtcagttttaagtaggtggcagagaggaagaataaatccacagcaagttaattagaaatacagtaaaacatgagtttcaggcgccacaattaatcgtatctaccatttagtgcctccaatgttaacctgtcatagtttaccaccctctgatctatagtcaaaaatgagcaaaacaaagtcttgaagtcctattacagatcatagaccgttggagctggatcaagtagttttaatctaattacctcattttgtggatgaggaaaataagaacaagaaaggaaaagagatttgccaaaggtgatgcagctccctagtagcagaagtaagttgagcatctagactaacagattatcagagcggggtcttttccaccatgttttgcagccttatcagcagaaaactgtactaaagtaacaccacagatttattactttactaccttctgttatctctttttctctaattgtctaataagagaatcgtctaattctcttattctctagtaagtcatattacccctacctgatttttttaatgtggaaaacacttgtattattatagaatttaaaatgtaaaattaatttctgctcattgtcaacaaacaaaaaacttcaaaaatatagagaagaaaaattacccaggtaaattaaaaatcacccaaaattaagttttaacatgtgttcagatttgtatcctgcctttttactttatattatattggaagcatttgtccagactctttaaatgttctttaaaattttgatttttaatatttgtgttactgtatcacagttattttatgacacatatgtacatataaaaccattaccttatgtacatatatttatatattttatatatatacatataagtcattatatatgagcccatatatatacatatacacacacacacatacatacacacacacacacacacacacacacacacacacgcaaccattatacaactttatgcattgaggtggattcccaattcactaaggcttactattatacctcaacttcctctaatgcctacattctatcacagatctgaacacacagtaaatatgtaataaatacttgctgacttttagtttttctggtcttttttgggatgatcattattcctccaccgggtagggcaaccaaattgagaacatgactttccatcctctttaaagcacatgttatataactcaacaggcagtatagcaatggtggttatgatcagaagccagactctctgagttcaaatcctggatctatctctttcttgttgtatagccttgggtgaggagcttaacccctctaaatctcagtttttctttctgacaaatgggggaaatattagtatccactgtggtaaaaattgaaagataaaatatgtggaaagtgaatactcaacaaagattagttgccattattattacatttgccaaagggaaatagagtacagatttggagtcaaaaaacttgagttcttgttccatctctgctattatctagccctatgtccttgcatgagttattttagtagtccatgtctcagtttcttcatctacaaaatggagatagcaatacttgagctgtatagcttatagggatgttatgaagattaaatgagagaataaatgtgaaagtcctttgaaaactatgaagttaagtataattgctaagtatataaaggtagatgtaacatgattgtcgtatggtaggactggagatgcagagggtgcaggagactaggctgaatacagtgagcctgggaagatatttttaaaataaaattccttgtattggaaatatagactgttatagacagaagggaccttagagatcatctagtccgtcatcttaatgttatatttaagaaaaaagattcaaagaggagagagctcaaagtcacaaagccagtcacagaaatgaaactagaattcatgtctcttgatttcccaaacacattcctaaagcaatcactgcagatccttgtttgttgaccttcatcaaaaaaaaaaaagtagtaaagaaaaaaatacagttatttgtggcatccatgttggtagtaactgattatttggggttttatcacaaggataagccacatataacatagctttattatatttttaccaactttattccaggtgagaaaagtaaaggcgcaggaaagtgatgggtcgggggaggattcagtcagggcgaatgacctcagacttggccagattcccaagggattgctgtcatccccggcaatgaccactgtagcacatggtctttctttgattgttaatatttactttgcagtcagtccttagttatgtgtttttggaaaactcggtatagtagatgaaattatcagttgcttaaaaatacaattgccaattgtttgattcatgtaaattgattacagtcagaggactattcattttatgctggcatgcatacagcccacgtcaggcaagggctgcatcactgatggcagctcagatatcgtcgcatttcctgaattatatcccgtcaggtactcagtaaatatatgtgttggatactttcatctttacatttttttagctgagatgagagcacataaacatttccatctgacaaccttttcaacttcaacagcacagaaggttattttcaaaagaaacaagaaaggagtttttcaatagcgagctccaaaggtgactaaaaatgccttccaacaaggcagaccattaagaaatgtagtgtgaagtgtgttaatacaataaactcaaatgtggtctcactagtcttagctcctcagaatgttggctgccttccccagctgccactgtggcctggacagtgtacatcaaggttcaccctctttcctcaatcttgaagtgccccctttccacccttccgctgaaggagacctatggccagaagcagcttcccctcaccttgtcacccccacaggtcctgctgaaagggactacctgccttggccaggaagcatcagggaaaacaattggacagctctgccgtgctgcaaagatcatgggctgctgcacctaaaatgttcaccaggtgggcccgccaaaactgggcctattgtatctggggtaagtgcccatagtttgaaatcagcaaggtggaaggaaaggggaaagaatcttgttcaccaattcctgttatgccgcaaagaagatctccccactctggaagcttgaaaggaacaaattccaggcaagtcaaagtcaagcctactttacacagtgggaagtaaacatatggaaccccttagcccagagttggtgccagctgaaaatataaatactgtcagataaggttcaatacatttatgactgttaaggcaatgataggttattaaaggaaacgaggctgtttggggacatgttaaatctctgagctcaaaattagtgaggacaagcggatcctctgacagcctcagtgaatgagtcctgaagatatacatggtctcagaactgtgattgtgttctccaattaagctaggaaaaaataaagatgtggtatttagggctgcttggctcaaactgagatgctaaaatctctggtttgctcagagttaaattcttcaatacatgtaagggaagcaatgcgttatggaagaaaaaaaccctagtatcctccctttgcactgctgctactaactagctatgagactgccccctctttaggcctcaccttttcccatttgtaaaataagggaattagagtaggtgatttccaaggtcctttctagcttcaactaggtttaattcaaatgatatcacgaggttcccttgaagggtttggagcgggggagatcctgcatctttccttgccctcccttgctcaggagctcagagtcttcaagatgtttgaaagatgcccctgattctaccaagacttgactccttcaagtctggcctccacagcagacgtccatgctctgaaatttatatctcatggcctattcccccactcatcaagctcccaattgcctggtaaagaggtagaactggttagatacaggggtttgttttgttcagtgcgatagcaaggttggagaaagtttgggctccaatattagagacagcattgtatgggctttaaagctagagctagcccgggttagaattctggttctgccatttctgtgctcatctatagaacttatctcatctatagaattacagtgataatactgtcatccctctagggtgattgtcaggattaaatgacagaattcatatcaaatccttagcataatgcctgccataaagtaaatgctgccactagtgggcgtcttttcctgttctccactaaatagatgttgagttaaaaattaaaaccaataaatcaataaatattgagctaataatcaaggctcaacttttaagttgtggcaaattatttggagtctcagggcccccatgttttgataactataatggcgtatttgcaatttatcaggggcattctggaaactgcacaagccaatgagagaactaattctggtgggtggcatttaattttgcagtaaccccgcagatcacactacttagatgagtgctactttgaccacctcatggaaccagtgcagcctgtgggcatcctgcagggaggctgacagaaagggaagttccaaaaggtgaccccatgatgtggctcatccattcatagtgctgaacaatattttacctttcctgttcaaggcgttacaggtgaactgtaagatgagaacaagatcacaagtcagcactacctcctcccttcttgagttctcaactgagtgagcatcatggagggagaagaaagaaagaagttcagcctgggtgtgtgaagctgtaaagttgcaggttgaacccaaacccattttagagacagaagaaactaccctctggagataaaataaaaagatgaagctgagatgggacaggatcaaagttgatgaaatatcaagagaggttaataaaggaacattaatttattcctcaaatcctgtgttcagttgtgtgggtgtatttttgggagttgaggggaaaatggaaatagatatgataaagaattaacttttcttaatgcacttccagttgattattattatgaatgtcagctttgacctggaaatcccatagctcatcttacacaggttgcctaaagataatttctcttcttaggcttttctgagtaagaagccctcagtctttggtggaaaaacctcagtaattaattggaaacatgcatgaacataaaatggcttaagagtttagtggatcaggtaaggaagtcaagagatggagatgatccctaaaggtgtgtaccaggtccagtgtaagggagggtgagagagatggtgacttgcagtggttggcggcactttactgggagcatcgggtagaaaatctaatacataataaggtaggtcaggctgatagcattactatatccactttacagtttaaagaaacaggctcgaaggagttaaagtgtttttcccagtaagtggctggggtgagactcaaaccttagtctaatcttatgctccttccatgcaatatgccgtctccattcaactagcattataagggaatgagtggttctaagctaattttccagatatttgaagcacatgtctttcagcagtgcaagtgctatttttattttaatcatttttgaagaaaaaactttctacaatgcatcaaacacctccacaccttattatgcagaagatacagattactgtgcttttaattttctgtctatttccatagccttctatctcttttcccactgtagctgacaatgttcagtacttcctaggctactgaagatagacagcatattagaaatgaagcactcctaaaagtagatatactaaaatgtgacagctgacaataagtgaacaccatgcagaatcaccaactacaaaagcacaacagtctgggattaattcaggtaggggcaaatagacctaagaggccaagtaaccgcatggacaacgaactcagtaccggagctggagttgccagtaaagaccctgaatcatccatagaaaattgaattctgttcattcttctgcactggtatactgtggggaaggggtgatatatgaggtccatcccagctgggaggagtattttttcactgatatttagaaatgcctgtgcatatgataataaaaaagcaagtagacagtttattactgtctttaaattctctacacactaccctcttattgtttgcaccccagacagaccactcctactgctcctgcgttggtatgccagtgctttactgtgtttaaaaagatggtcgtgggggagggtttccactttagaaagatatccactatctcaaatggctcaagatttggtatgtctaaaggggtaaatgtttactgatctggaaaacataactcatgtaagaagcatggcaaattattgtgtgtttagcctgtcacttctctttccttgttccacctgtaatttcaaaggaaaaaaaataacactacaagcaaatcctccatagaatgccatcctattggcctgctgcaagtacttggatcttttcaaattccaatcagaatgggccgtgctttgccttctccatctctgtctcctctgacccggcaaagtttcccatcttttatcctgtcacttagctaatggtgtgtgtccctcttgcatatattccatagtcaccggcttctttcgctagtagagtcgtcagcgagatgctcggcagatggctcactggctgccgttcttgtcccctcactgcagcaatctgctgttctaaatcaaaatgttaatgaaaaataaaagaacgcagtgccaatgtctgtctgatttaaattaatacagagtcatacctttggaggcaggttttactggcacgaggttctccatacaggctacccatattgtgtgtggcttttttttcctctctaattaaaattaagcactttcatttatctgagtctctcttggtacccccaacctgttctttttaataataacaaagacctaacaaacagtggattttagtgttccagggaatggcatctcacctggtggaacataattttgagagatattatatgtgatgtctaattataaacatactttgattggattctgttctcaatactgaaatgacacatttactaaatgcttcaagtgcagctctaagttaggcatgtagttattgaaatctctttcaatccatttgttttaaaactggtggcaaaatcactgctaatttgctactttatttacaagggcccttcactttctatgtactcagcacagtattcatttctgttgctgcaacaggactgctcccctctttggggaaaatgtatgtgtctgcaagattgactatgcaagacaaaattttaacttcaatttagagacgaagggaccacggtgatgttaacagacatggtggaggaaaatcacctcagtattataatttgcaaaaaaaaaaaaaaatctatgaaccaaaagaacagcagtttcaactgattgcagaagaccacacctttcattttttcttcctatgactcctttgtagatactgctaggaatagtattgagaataatgagttaacatagtgcttcttacataccaggcatccttctaagtgatttacatttatttattgttccagtcatcaaaattctgtgacttaggtctatttcacagataaggattctggggcacaaagaagttaagtcacttgcccagtcacataactggtaagtgacagagccagagaagaacacagcctggccccagagccttctcttttaaccactataccattctataatgtgctgaaagggccacgaaatccagcctacttgaaagtaagctactgtttcctttcagattcggcaaaggatattctctttgctgaaactgctgtgtaaaaatcaggtttctacttcagtggggcttggtccttgttaaatgcatgtactatttgcatgtgtcaccaccattaagattaaggtgagccaggtaaattaagctgaagcagcaggcaggcaagcaggagaaaagcctgggttttcaggtgggaactggggtgctagtcattaggtcagtcatctcagggccacctcacagttctgacaagagaaggccaaaagaggtaaggcctacaaagcccacatttgaaccagccaagtatatagggactccctcctggaacacaacaggtcaggtcacctggcttcaaactcagtacttattcctacctacaggcagggccaacacacaaaccaaacactattgaagatcagccttcctcctgctgctcagaagccagctcaactggaaaaacaaacaatagaagatgattatctctaattaaatatatgcatcccaggatacatttactggggtatcaagttattcaaaagaaaaagcctctagtcggaaggggctaagtagagaggcagtcatttcccttgctaaacctcattttggtggttgcatttttctggccttaccagggactaaatgaaaatatgagatttgaaaagaatattaccagacagcaggataggttacacagaaccctgggctgggagccagttgtcctgggttccagccccaactctgtttctaacaaaccatgccttctctgggtttcagttagatcttttgtaaaatgaaaagatcctgtgagggcctttctaacattaaataatttctgattttagccacctcccccaaccaccagtttttaatgaaagatgattctccctacagaaacaaggaaactcagaggataatttgaccaaatgaagcaaagatttgagctgttttggggtgtttccaaggaggcaactcaaaccattgaagtcagaaagtagatttctttttggcctgatctctcccagttgatatcactagataattgctcacccctctgagtcatcgaatcataggctgattgaatctctgggatataaaggaccttaaaggtcatcttttcccacctaccctcagagatggactccctttctccaaacacagctagtctaagtagtgggacatgtctgttttataaagcttgtgtatatacaggtgctgcttacctggatggatgtcacaggtcattggaccctttgactcctatttccaaatagctctcactcctgctcactgataccagagcatatttaacagagggactttcattctccactgaaaacatatgatataaattccctttgaagaggtggcactgtctaaattcataatgcaatgcatgcaactctatagcagatcctatcatgagagcagatttcaataggaaaggtgcccaaagacatggaattcttgaagagagtgaaacaggtttcagtgagaggtaaaaattatatagaatgggaagacagcaagggtggaggccctagagtgatagtctaatagaatgtgtaacaacctgaagtcagacttgggtttatagctcaactctgccacgtaactaaccatattagcttgtacaagtctcaacctccctgaatctaagtttcccaaactgtaacacagggataataatatctactacataaggctgttgataattaaatgagataattattcaaaggcataatgacagtatgcttgatttaagtacattttcagccccaaatctacaatgttgtcatagtctgatggcctttgatgtgtttgttcttggttatgcctctgcaacactcgtgaatatgaataatgttgatgaccatgtctgcagccaccagtacaaattttaactctcttactcttctatgcaactaactacacaactgattctagtaccagccaggatatcaattgtcaagcaactgaaatgcccacctaaactttgatcaagatttgcaagcacaaagagattagctccatgctcataatttcagaggagctcatattttcaaacctgtttcaatttagcccagttaataggacttcaaggtagtttccctaattaattagctccaaccaggagtaaatatgtatggtggctttttgaaaaatattcccaaggtatatttcaaccttattatgggagaaaaaggttaacaaatgggatggtaaggtttcagtacaaatttcaggttgtgtgggggaggtactgagtccatatgcctgtcaaaaataatgacagacagattacaggttgcctctgaacatactgttagatagccttgaagcccccgacttctacactattattagcttaaatgctgtcaagcttggagttgggttttaccgtgattttgtttgtttgtttgtttgttggttggtttgtttttctctaggaggtgttgttggtttggagaggctcatcaactccatgatttattattttctatcagagaaacatgaaagtttggggtccagcattgtcttccttttcaaaaacatgctcaaagctccatattaaaaaaaaaaaaagtttcaacctgctcctttttttttttttttgccatcctccttttgcttcctaaatcccctaatctgagatttgtgtgagttgcctttatttcctatcccacattctgttcctaactcctacactctgtttctattctcactaatctaccaacatttctcttttgagttcaccagtgatcttcttgccaaatccaagagctgtttttcaattgtttatcttcctcaatctctttggtgtatttgacacactggttttatccactcaaagtatctcttgccttagcttctgctgacacttcactttcttgattctcctctgattttccatctaattccctttttgcctgtaacattaggcaaaaatgttctccttctcctttctgggcatgagtttcttcctcagtaaaataaagggtttagacagggtaatatccaatgtccctttcatataaaacattctatggctctgagggtcagtgagttatttgactttaacatgttatcatgtttttaatgttgaaggttttgtagctattccagtcgactttagtgttccagtaattgatataagtgtctgaacttcataaggctaggcctttgctgatttatacatgtttaatacatgcttgcttttcttctttatctaagactatgcatattcgaaatacctagatactacactgttcctttcttgaaaatagatgtaaggtacattctagaagaatatcctgttgcttattattaatactagtctttcaaaaatgtatttggatcagaaatccttcatcttgttccatttaatttggatatttagaaaatgaaacaacaatcttttcagccaagtgaaggcattatgaccaaccgtgagagccagaattcaccaatgtcatcaacaaagggtcaaaaataatatatttgacagcttaatactgaattcatatgttacacagaaataggtggtaatgctttagtgaacccttgtatatctctgagaaacataacatcacttaaagacactcaaaaaaatgtaaaacaacacaatttctattgatacttcttttccttcacccatattttaggtgctatacgtgatactgccaagagttgcctgagaccccagggcaaaagactggctataaataccttacaagtcatccccacaaatccaccaaataagaagtttcccttctcctaattaaaaggcagtaatgcaattactgatcccaagggtatacaataaatatatgtcagtaatgagaaggtcagaaaaagtaaattgttagtgtacaaaatagaaaatgcctgtccctgctaaggaagctagtcaagagtggggattagggtcctttagctgctcccaatgcaagacacataaaaaagtagctgaggttttgttttcttatttatcaccaaagaatatatgaatttgaaagaccttgcacacaggagctctcttgatccatggaacataaacatgtcagtgtcttaactagccatgatatactatcatcttcctctaacaacagaaattcagtgacttatgcaaagttgtaagagtcagtggctgagtcaacagtccccaaaaatctctgtcaaaaattcaaaacttgttaatttatacaaaatattacaatgactgccactctcgctctttcttcgtctccttctccctcttcctctgcatttctctctctctcatacacacacatactccaccctacctaagtgcttctcaaagtcaacatgatgggctaatttttattgtaccgtatagtatcgttattgagcatggactagagcattcaaattaatagacttggtattcaagttattagaaaccactaaatatgtcatataaggtttaccaatttttaagagttagaataaaataaaatttactcatgactaaaaatatattgtgtatgaagttatctttcattgatgattcagcactgctctggaaagacttcacacagttaagtaaaagacaccatctttggaatgacaggaccatgaaagtttgttctaggtaaagcaactgatcctaaggtctctgggaaaagaaacaacctagattatttctcaagtgagtaaacattgtcagaattgttatataaaatgctaaaaaaaaaatcttaccttgagattgcaaactcaaatattcttgacaccttgccttctattttcaaatcagaaatcccaactttctgcccttaaaagtaatattgtggtatctcattttgtagatcagaatgtttacttctctagaagtatcttcatcttttgggcttttaagatattaccctgagaggtcaaatttactatatggcattgtcacaacttcaggcttaaataggttcaacaaaatgccaatttatctatcgagagctctaggtgatattgtgtgaatgacaaagagtttgctgttgtgtgccaagagttatatttaggtttctggcacaaattaataattacttataacattttataaaaacaagaaatcatcttgacagcctttcatccaaagcaacatcagtcgttctattagtattggagtttttgcagtgacaaggagaaaatgatgggtaataatatcagaaataatagcaaatgctaggcatttgctaaatgcttttacatatattatgtcacttaaatcttcagcaaacctatgacataggtactattgttagctccaatttacaaacaaggtcgccaagacctagagaagtgagggtgtccacagcaggggtccccaacccctggtaccagttcatgacctgttaggaaccaggacacacagcaggtgagccatgagcttgcattactgcctgagctctgcctcctgtcagatcagtggtgccattagattcccataggaatgcaaaccctattgtgaactgtgcatgtgagggatctaggttgtgtgctccttatgagaatctaactaatgcctgatgatctgaggtggaatagttccatcctgaactcctccccaacccccgatggacagtccatggaaaaattatcttccatgaaaccggtctctggtgccaaaaaggttgagaactgctggtctacaggatcttttgctcagacaaaatgacctgggtgtagaattgcattggttgtttcatatgacagagcattaatgtttagtgagcatctaccatgtgccaggaactgggccaactgctttacataagttgccttatttaattctgccatcagccttatgaggttgttacttttaaacatattgtacagatgaagggaagaaggatacaaagaagttaagaaattttcccaaggtcatgctactagtgagggcggagctgggatgttaatctagataggtttgattctacagttcacactctttccactatgaagtaaaaatcaaaccagcaaaaggcaggaaataaatttagtttaagaataatttccatattgtttccttggagttaaaactttaatcatgaaagctaatcccagtgtcggtgccaagagtaacttcctgtacacagagcttttatcctatggaacacagggttacagcattccgatcacttttagcttttagagcagagaatgggaacaggttgaagcgattctccagaattcttttcaggccaaataaagggaaaaaatagacacaaaatgcaaaatcgtccaaacttatccatatgcagcagggcagctttctctaagacaatgagttaactcttccatcccattagatctccctctgagtacaagaagtcagtccctctagcctcagtggcctgaaagctttaatagcctacccaaacagaaacaccccatcagcatttctcattggaatcccttggaatcattgttaaaaattgcagttcccaagcccaagccttgaaagcaggacttaggaatctgcattttaataagtatcccagatcacttatatgcacagtaaagtgtgagaatcactacacaaagcaatgaaagtctcaagccttgtgttctgaatttaggatgctcagacacagataagctgaatttattttcaaggaaggaaagtctcctttaatttaattaatattaacaacctacttaacataagcttttaaggttttcagaagcagtaaccggcaaacagatttaaggtctgttcacatcctttgtatctatccattatagcaggacataggatctgcaacacgaccatatgtagatctcagcaaccctctcttagcctttaaagttccctatataaagttcaatgttcatctaagaacattccataacccagactttaccctaaataagactgatcttacataaatttatccctaaataatgaaattgaactatatttcccttctcacagttgaaatcagtctaaagcagggaatagtagtctccataataaatagcaattagttgagtgtttactgtataccaggccctattacaaaacaaaatactccctggattaaaagggcccacaagatgattttgcctactgtaaactcctcttgaacattcataatgcacatgaacctattaaggactgcaagagggccttgaaggaaagaaatcaatttatttttcttaactcagttacaaaaacctatctgatagcataccccttttatgaagaaaacctgacatacactttgagaatgtgctgctacgcaacagtgtttctctaagtgtcagtggcatcaaaatgcaaagtcaggagccctacctcagacctaaagaaaccaactctgtgaggggcttcaggaatctgcattcttaggtacactgctctaaggtataccaggagaatcagcagttgccccaaagatgacagttgagggaaattgttatagctacactggcaaggctgactgaaaattaaacaaaaaattccaaaatggaaactaccaagtgactatatttcaacaattgatagttcgccaatctaaaaaacttgggctttttatagggggagattcttgcccatacataactgggatccaagaacaatgcacagaacaagtcccactaaattgtccagcaaattctgctgccgcctcaaggtataataggaaaacataggtgggtagatatgctctcccacttgctaagctgtaggactttagcaaaaccactttacctctctgacttagttttctcatctataaaatgagaacaattatctctacctcagggagccactgtgagaactaaatgaggcagcacacacaaatcttctattataaatatgaagttcacaaactgttcgttccttttccccttctctccttcccctcctcccctagtacagtacagcactatgatgtcagcatcattagcgtggagaagacaggaaatgttgctgtcagttttagtgtagttactctcttctgagggtagtttcctttaatgaacccctatgtcgcaatactgaagtagccattcaattctgctaagtaggagtcaacacccactggggtacacagagatgaaaaggcaagtcctgccctcaagttgctcatatcatagtagtgaaaatacctagtgtgtcagaaaatgggaactctttttctggggggcagagagatggacgcagctggtcacagaggcaagccaaactgatgcaaaatgcattatggctaagttaaatcagagaatccaaggacacccaatgtcatctttatctgtccagaaaagccaactgctgacctaacccagggctgcagttccagggctcggttccagcaaccagcacaaacccagtcacaggctgctttgtgctttgtgcccggtgctgtactacatatcagctaaagccagtaagctgagctgacctctgctctctaggaggaaaagcacagatgaaggcaaacctctaatgcacacgaaaataagtgaaaacttggtatcaaacaagcaaataaatacatttgctcatatcattctcttctcaggttcctgttgatttttctctaagatgaaaaagcttaggtgagactgaaataaatgaacctcaagtccccagcctcccctacctcagcaacttgtcaagagagttggagattttttccatcgttatttttcaaaaccaatttcctaactgttgcatgacaatcagcagtcaaactaattggaatgttactttaacatttcttcctccttttagcattttttgtgctgtgttgtggggaggaagggatgtgaggtttcagcgatgcttacatagaaccttacctttcctttcctttcttatcactgctcccaactgggtcttcagcttcttgggtcagtgggacaaactacaagcaactgctacagtgtccctttcaacttgcatctcttctcatatctagtggggttttggggattgacaaggttggcacttctcagagatggagggaagggagaggcagtggttgaggagcaggaccagaggatgaagtgcagacttggctagtaatttcttgtaccttccatttaaccctatgccaagcctccaccaccaccaccactgaggagaaggaatgtcataattaaagaaggctctacgaatagcacagatattgtttctaaacaggaaaaagagtggtaggggaaggaattctattaagcaaacattgttggtttttctccccctgattttcttcgagaaatgtgtgtagggagagactacaatgaagggtcataatctattaaatacacggactaaactaagtatgccatctcaaaggaaaacataagtagtgtttaaaggtctggtctagtctcagctggtcagcctagaatccactggacaactgcacttcattactaacatctaactcctcaaatagccttttagtactatgtgatgctgctaaagggcaaaaggtgctgacagggaccatggacatttctgcagtgcctgtccccccggtagtgttcagatcttgcaaagccaacaaaactgcagcataggtcagctgcaaactccccctcatcagagacctccctgagccagcaaagtcaaggctgtgagctcagggccttcagaaggtcactggagaggacagtgagtctgcaggatgagtcaggagaattgagaaagcccagccagtccccagagccaggcctctcgtaaggcagccaaggaaaaagctctgtaagaacctggaacaccctgataatggagaagagggtggaggaaagaagcaacagacagacaaactccctgtcctcagcatcagcaaaagaaggaagtagaccagctttatccttgacaagtccttatcccactttcaataccctctccaaattacctgagacacccacagaaatgccagccgaccaggcatttcctaccacccgcaggttacccctttccccaacaaactcacctttctcagagcttccccagtatttcatgtcttgtttcctcagcatttctctgccttgtcattttatcataactgatctgggccaatacaccaattcctgagttactgtggtccccagcagggtcacatattggcaagtaaacagttgcctcttagcaacagagtacttgtaccccaaagggtatgtgtggtgaaaggatttccaatgaaggggggacctcaggcagataaatcctgggggaccccacattcaatttcatgtgtactgttacctctctctctccttgttaaagtgtaagccagctcaacagatatctggccaaaagcctaaaaacaaattaggtcccagagtaccaagataccatcttttgtgggccccaagataaaagagcttcatctgaattatttccgacagattgcaaactgctcatttgtgatataatcgtttgggggaggggaagaaaaaacaggagttaagaaaactgtagaggaagaaaacttttaaagcaacacatagtatgacaaaaattgtgtgcttaaaagtttttgaaaccttacattgttccaaagatgctaaataagaaagtgtataacctgaaaggcctacccatggcatcagcttgtatgcctggcacctgggagaaagttgggaggtgggactttggtggaaggaagaaggtaatgattggcagttgaggctttttctgagatgactgaggataagacaagcagctggtattcaggttatccagcttattagaggctgtagacaccatttgacttgcgatgggtctgacttcctaacatactgttctgagttgcagctgtgttttcagaataaaaacatctagtcgagttttgagttctaaactatctaagaaagcatctaatgatgctgatttttttgttttgttttgttttttgttttttgtttttttgacacggagtctcgctctgtcgcccaggctggagtgcagtggcgcgatctcggctcactgcaagctccgcctcccaggttcacgccattctcctgcctcagcctcccgagtaaatgatgctgatttttaatggatattactgtctctttaatgagacttctctggagaaagaatactgtgacctcaaattacttgtgcaagtggacttagcaggcctggcaaatggaccaagcttgtctttgggttccttctccttcctacttcatagctctgtctctctacacccctatcattgggacccatttttttcctggtaatttagggctccccgtgactccatgctttctcccatcacaagaatctttcctatgagggctcagttgtctgctttccaaagtgacagctgggggctaatgagctaaagtggtagtggctgacagtgagttaaattcttgacccttcaaattagagcagtttgattggcaaggaatgcctttctaatgataacattttaagcttgtactaggctggaggagatggcacttgtgtgtaacggggtgctgcttgacacacctccagtcacacagtggaaatggctgcctactttaccctgaacatagcacagaggaggtgccttggctgtttagaggatggaagcaaccagctaacaaaaaaaaattgcttaatttacaaataacctattagcattgtcaagaatccactcacaggcaggtgtccatccctaagaaggctgtgtattttacctatgattcttgctttgtcttttgcacttctacctttcttaactgagtctgaggcaaagtgaagttgccaaactgttagtgcatttttcctgggtcatctataaacttgccttccttactaatgttttagaatgagtctacctctaatccccactttcttttaaggttcaagaagtagacctcactttactcaacagctgcattactgaaaatatgtgtatatgggaagggcaataccaataaacacacctcattgaatcgatctataatgtaaagaattccattattcagtaaacaagcataaggctgacctttggccaaattgaccagtaatacacagctgtggtcaaaatattatatgctcccataccagttggtaaatagctactacaccttgtcctggatgccagactgtactctgagatccctagacctccacaagatccagcagctaatacagtaatgcctgacacagcaaagggcctccgggtccttgctccagggctacagctggaacctagactgatttgttgtttcctgtgctttcctatgtgaatattatccacaatttcaaagctactgagtagcaggcactaggtgtggccatgaatgtggaccataattactttgcttaaaactgtaatagtgacactgaggtttgtgtcagttcactctgccccatgcattcccatggagcagaacgtccacgaccttcaaaagatggacgacatgagccctgtttccaaaatagcacttggcaggcagcctagatttggatgtgaacagcagacacaggctatgggcatgatgggccagccccctgtcacatcacctcaggggatcctcagcctcatgggactcactagaaaatcctttacatctgaaaagcagaaattatctagtccacctgagtgccctgggagtgggtctgtattcttagcctcatgcttccagtgctgagtttagaacaaaagcctctattcaaggtcatatggtgagtcagctactgaacagggagtgaaaagaaagggggaacaaacaacccacaacaggattagcttgagctgcctcaacctatgagaaaggcctggtcaaaccatttatagtcttcatatatagatagcttgaagaattgcctctgaagggtgttaatgaacataggtaaggaagaatggtgatagttaatcagcagtcctggagacacaaatttgtggtcgccttgtgatacaggtaaattatacaatgagtttctgcttgctgtccttatgtgtatcttaagaaataactccttcattctacctcaggtaaaagctcactctttctcccaatgcaccttggctactgtcaaccttgcactaatataaatggattcctccttgtgctaaagggaagcagaaagagccccatgtctgaatttggaaggtctgaattctactcttgactctgctaactctcttggtaacattcagggagacacattctgttgtttcattttcctctttttatcaaatagggatgacactacttcctacttcatgggctggcataggaagaaaacagtattatacataagactattcgaacattccagtaccctccaaatacatgaggaaatatgactgtctcagagatgctcaatgagtacatggaaaccagcacttatagcacttatcaagcacctactatgtgcctggcacttacacactcatagttttgttgatcctgacaacaattctatggagtagatattagttgtggcatgttaaatgatatgggataaaaatgacaataaaatatgtcagtgcattcaaattttaactttatttttgaagtaagtaaatttgatcccccttaaataacaagcttgcacacacacactaaaatggaatccaaactacaaatgacacaacagatcagtttagcatcaacttgcatttctaagataaaattgaaagtaaacgtgtgaatcattccataatttatatcacagaagcaaaatatggtttgtgaaagcttggaaaacatgtagggtaaggattattaccctggaaggaatgcataggtgtttaaaaggtagacaataagtctaaacaactcctcacgttaaaatgacatagtacaaggaggtagaaatacagcttatattgggcttaaggtagcagcactgtggggcctcccagaggggcacacagaatgccttaagaaaggtactgggtggaaacccaggtggagatataaaatgaggcaacaaagaaaggaaggctgatttatataaattttcaaatgcaagcatgtgtgagactatccaggatattgcagacctgtagtttcctccctgaccaatgacaggctacagccgaagctgaactctgttccttacaaccttggccaaaggagggatgagatgcttgaggggaggggatagagagagggtggctgttaacacttttatcctcatcttacacaaagaaaatggggcccagaaagttgtttcttcaggcatgcagctcataacaagggacactgggagtcaaacaaaagtatatatgaccttcctatacatactttgtgtaaacaaagtatatatgacctttttatactataaaaatccatgttttttccaagaaaatgcaccacttccccaaatcacattctctttctcccaaaaatggtgccaaacccttgggtgatagtgaaacattgctccaagccctttctaacttaagcgcccctcacaatgaccacaccactagtcataaatgatgaacatctgtaagcattcctacaaatgctaaatatcaccatttcattggtcaataaggggagactatgtgaccaagaagcagagcagttctctattaacaaagctaacctaccttcccaggagatcaaactcatccatggctttatcttgtctctcttctttcctcagcctcccaggcacagagatccctgaaggccaagactctctctaaaacattccatccaaatagcccccatagcatccagcacagtacttaacacatagcagacactcaaaatattttatgaatcaatgaactctgtttctcccaccatgtgtataacagtatgtccttaatgtcttcatgttattagaatccttgtgaaatttaatcagagattataatgcaaaaaatataagaaattgagatgaaggtaatagttggcttctgagaaactctcctctttctcaatcactaacctagtaacattcgttctagtctcatatctaataccaccaaccagaggaactagaagaaaacatctcagcttcaccatttttaaaattaatcgtatttagctagagcagaagttctcctccctaagttttcatgagaattacctgggaaagctttaacaaaaactgatgctagattctgttcccagggtttctggtttagttgatactgggtgagacctgagcatcagtgttttttaaaaactccccagtgaatctgaaatgttgctagggttgaaaaccactgggctagatgatccttgaggtcccttcttactctgaaaatcaatatgctgactatagctgggtgtctgttgatgtcatgggttgttctgactgttctccactttcctctctaatactgcacaccacgagatctatatcaagttgctcaacagcctaacatcttgtttccctccatttacctattgacttaaaactttgtgtactcttggggctcctaagcacaactattgagatctacttttaatgctatgtgggtcattttgccaccaaagaagctcccctggcaccacgatgtgtccccaaagcactatctggcctgccctgcttccaggcgggaaagcccaacaagcaagcatgaacagctggagtgttcccactgatctggaaggaatccgtaaggacaatgcactactttctatttcactggactctttcatggcactgagcctgcctattccattcggccctttgtcaagaatgtccttgacacttaaggaattgatttcttcttcctttcctttaaataataagccaacagatacgcaggagttttataaggtatcaatttaacatacaaactgcattatggcctttgaatgctacagcaagaaccaatgcctcatcagccagaaagaccaatatagtgacaacctaacgttttcttaacctgtcaaaacattcctgtgctctgggcttactgagagcagacatgccaaggatttagaaatgtcaaattaaaatagtctgggctattttcaaaaagacatgagcctttttaaccactagcattctatcagcaatgctttttcagaatgtagggctgctagaaggccctctttctgaagaacggtgtgaacattacacagggaacagagagtttctcaaggtcatatgatggttttctagaagcacttcaacacaaatgtttgcctcatctgtggttagatgagaagggctggaaatgtggggcaggataagggtggaagggagcacagggcaggagtctaaatgaaaaattcccatactacaaagatcctaaaatacaaatttgaaaaaatagaatctggcatggccttttagtgatacacagctaaggtgctcttcaaggatgggaaagtgcagaggtgctttgttgtagacccttggtcaaattgccaaaagtacatgaggtcattattcttttcattgccaaatgtgtgggaagagtaatcatctcaccttgcccatttgttcttcagatttacctcccatattcaccactctgctgcaactgctctcattcagacaccagtgatctcctaacagccaagtcctgtggttagttttcagttctcattctgactggcacatctataactatttgatactgttgaccatcctttccttctctgacttctgtgatggggtctctctctagattctcctcctatttctgtacttttattttcagttgctttcttaagctagtcttcccatatccagctcttaaatgatggagatttttcttagcccttttctcacttttgcaaaagcttccatgctatgacttacatgattctaagtctttatctcttgtcccaaaatccttccaaactctaagctcatatagtcaacgctctttttggacatcttcaacccaacagacacttatccccattcccagtctgctccttctcttctattatttcagtcgctacaataactttctaactggtctcccaactggcattctttttctcatctctaacctattctcctcgtttttttccagagttttctcttgaaaacatagatatatatctgacatttccactctgtttaaaaacttttatcggggcttttttctacttataaaataaatctactcattatcccataacattcaaggtatctaacaagccagtcctgttttacctttctagttttacttctgatatctcccctgtcatccctactacttcccaacacctcaatcccacctatcttacatatttaaattatctaaattatttaaagcagttaaatatttaaattttaaatcatttaaatatttaaatgtaaatccttaaacatgccgggctagctcatggctcaatgctttctttcacactatttcttgtagctggaagaattcccccttcccatatccaaatcatagttttaaaatgtcaccttgaccaactaaaatgtcacctcctgtgtaaaatctccaggcagaattaatcgtggtttcctctgaactttctgcaaaccataactgtagcacttatgcacattgttttacaattaggtgcgtgaaacctctttaaagatggggattctgccacagacttcatgtttaatatgtctggttctggaatcagagacttggattttagtaccagctctggcacttactaggtatgtaatttggggcaagtcaaccggtgtctctaagcttcaatgttctcatctgcaaaacaataacaatagtgttgcaagtaaatgagataatgcatacaaaacacctatagtgcctgacacataataaacactcaacaaatgttagctatgactatttttctgtgcctggcatatggtcttgcacggagcgagtacccaataaatgattactgaataaattaatcatagcatggaagacctaagaacatttgctaaatggacagtttcttcctttattgaatcttggaattcctgtcagaggcataaaaaatgggttacataatgaatttatttctctgtagtcaagtaataattacagtagcaattgggataaccaaaagctttgtctgtgcagtttatcttttgaacctgaacctattacatctttagtcccaggaactacatgttttgaagtgtacatttcaaacttcctttccaagataaatccaaagactttttttctactctaacatttcacaaataggatgaatcaattaatgtgataattatttaatacaccaagcaataacttttaaggtgtaatggtaattgagcccagcatgcttgaaaataccattctctgagtcaggttcagcaacatgtcttgaagttgggaccttagaggcttaattcattctaaaccccctctaccaatataaaatttaaattaatggtatttctgactcttggtccctttcacctataattcttcttaatctcttgacctctatttcattcatgaaatcccaaaagattatctttcacagtgaacccacagtaatctgtttaatatcccttgataagaaatatccctttaaaaagccaaattctgccatgctttaaatagaaaccctatttgctgagacaagacaaacacttatagtctttttcctttacttggtcctagaaaaggcccaaaataaaacatacatgtcaagtccattgtaaatggatgtggaaaccagacatttgaagtgttatcatcaccatcattagcatcatcatcaccatcatcttcatcatcattatcataaaaaacaacataacaacagttcaagaagtttggaaaatgaggatatgggtttatctaaaactccactacccacataaaactagaattatttttgtatatttttccattctttctcattggcctacattttttcaaagcttgctcccaagtattcccaggtataccaaggagattttaagaacttcagaaaaactgtgattctaaatgtataactgcctagaaagtttcccattgcttcagtttttcagagaaagacactctgagagtacagatggtataatggcccaagtctacaaaaagtttcatttctgtgcatacataccacccattctacgataaggtgttggggatcagctgatgagctgaccaaacatgcccataataatcctggacaaaggctgagaccagcactttttacttcaatttggactctgaaagaaaaattatatgaggaaaggtgaggattccctaatgataataacctcaatcttcatgatattaaaacataataattaaaaggcagagagagactttaaaaaccccattgagatttcaaaagaacaatacaatatgcaaatagtcattcttgtatgcagttcatcattgattatccatgagaacagaaaggagctgaagctttggggcatgttcagtaatatttatctgcaacttctagcttcctgtccctctccctgaccccctccaatacacacacacacttagaataatatttattttagattatgttttgtatgttcacgaaaatctaatatgaccactaataaaagctgaggtttatggccttgttacctttgtctctcaaatttatattccttcattatcttctgcacctcttgaaaaccacacagattcctcctcctctttttcccttttcccacttatctaggctaaatgatttaatactgcattttataatattttatgttgttcttgaatcatttaatgtcacttaaggttacttccttaactggatcatgagttctttgacaatttatgcatggtacctttttttctatctgctgtgatccttgtgacatagactatgagttacttgaggccttattttcctttgtctcctcagcacttattacagtacctaacagtggagctattcaataaagcaaatatttaataaaggaataaatgaatggacgaatgaatggatggatggataaaaagacagcatccaagaaatgttacctagctgatgagtggacttcagagcacttgccagcaagaagggtggccagcaagtgttgataagtcagtcagcaattacttattgagcacctactatctgccagacacagatattctgtgggggaaggggaggggaacaagagaaagcaggcctagaattgaaaatcagatgtgtacaagtcacaaagtggaacacaattgcccaattgtctgactttttgtcattattttctgagtgtagcatgggtgaatatttttctctaccatgaggcaaactaatttgggaggcagagtattaccatcttttctactattctcttgtcttaggttgagttgaatagttcaagtattgagatgtgtagtttcttctgtagtatcttccctgctctgtcaccatccttttcagacaatagaacatgagttggagagacattctgagttctagtgaagtcactgaagccaacttgccaatgagtaagaggtaaagacctagggtgtgaggaaggacttgcattcaaggctgtttgaactttccgtgttaagccttcgcttccattttggagactggagcctttcagctcctcctgtccttctggcaactcttaggaaaaaatgcttaaataacaataacagagcagcagaaaggaagaatggaaattatcgtaatagcatggacttgttgcgccaacattgttagcctctcagcagccaactccatggagctgccctatgcttgtcaatgaaaggataaaaaggatatgaaggagacattttatggggccatttcagctgttcactgtaaatacaccctccatcaaatatagtgagctgggacctagagatcacagacagctgggttgcttgaaaagagaaaagacattatagtaaattgtattattatacatttactgagttccagggtttctgggagggcctcaaagatccaagggagcatttccaaccagtggcttgaagcactgccaggctgggggtaagctcaaggccaactaatgggtccaatgacatgagactataactctggtggttgcgaatttggttaggggctagtatggacatttttttagggtagaagcacttagcaggtgagccaaaaatgaatattttttatagaaagattcaataacaccattgagtgtactgcctggcctcagtgatgccttctggtattaaggatccattcaaaagcagatgtctaaatctgaggttttatgacaatgcctcaccatatccaaaatcattcactctcatccctcacccctcagtaactaggcaaggacacataaaacatatccagtccaaaggcacaaatcaggcagttgtcctagtagggttggagaaggtgggggatcccttggattgccagagacctatgaaaatcagtatattgctgatggagtgaagttagggttgccataggagggcagttcaacacagaggtcagtaaatcagttgatttaattatataacacatattacaaaatggggccacgctttattgaagcctgattgccacaggcaacacacttgcttaattcaaaaggaggaatttctcgctggggttgaaatgctagaaactctgtgttcaacacaccagatcgtgcccatctccatgatgggtagcaggaattggcagtggaaaaaaatctgagagccggaagatttcttacagattagacattgacccctactcttgcagatagaaaaactgaggccagcagtgtactcaagggtgcattgcaggtctacaattcaggtcctgactccccagattgatgtgctttccattataccatattacttctcactgtatataacattcatcatgatgaccgtgaaactgtaaaagacttggaggtactttctgatttattagagaaaaaccatagtctgttccttctattgccagtctgtcatgaatttcatcacagttactttttttgcttttttgtatctataaaaattatttattaaacaaaactgtaaattaatctgaatagcctattccctaccagatagcacatcatgttaggaaatgcaatgtgctcgttccctcagcagccatctcctggattatttaggggatctgtgcctctgtccaagacctagggaaaagaaactgggagtaaaaacagaggccagctttcagagcaaggtgcttgtctgggattatattttctctttctttttcttccatagcacctaacacattgtggggcacacatttgtatccataactgctgattggttcatcacagaaatccccagtctgtgatgctctgctggagatagaagagagggtcattggcttagtgagataagtcattgtagcttaacagaaagataatagctcttgtacttatatggacctgaattgagataacatatgtagaggcctagcatggtatctgacaaatagtgagtgttcctcaaaaggtgttcattattatgattatcatgatgcaaaatatgtgtgccagaaggactaaagcttcccaggggatctggatcactaatcaaatgctgagggggaagtcagcatgctaaaacttaggagtctttgctaaatgcatgatttggggaggaggaagaaaaaaagaattcccagttcctctactgaaggaccacttttcagcactttcttctgaggtgtgcaaggtctgttgtcactgtggagtagttccagatggtttttagtacctcattggacttttggtgccatcacgaagtggaggaggccaatgctcccatgttgaacattagttacttgaggaaagcttattgcaatactccctaatcttctaaatagtaccccatgttctgcaattttcctaattcacccttaaagtcctaatggaaactaacccatcttgtgtcatatgcccccaggaccttggccttagttaatacaaaaactaatttattcagaagtgttaacgatcactaataccttgtttatctcaggtgatccacatatattttcactttcatgaaccctccatgtcaacctaaaatggtttggtagagatttctgacacctgagtaggctggtgggggagatatttatgggcatataggagcattttggtagtcctcaaaccatatcatgtgggcagctctgcttcagatcattctagaaaatcaactgggtataaattataaaaataacaaaaagagaaaattgcctactcaacctatgtgtagggcttcccagctgtcactttattcaattctgtagatattttgaacacctactctgaacctggcactgtgctgactgctgtggatacaaagatggctatgacacatcattggaactcctagttctatcatccagctggggccctaacaaaacttagagctacttatttggttgacaaaggaaataaaacagcagacaaagccaacagctgtttgcttataaccacttataatcagagacgtctctccctggtttaaatacttctctttatctcaaacacaaagaggatgaagatatccatgtgaaaaagcctactcttaaaggtaaaagctaaacaaagaacaagtgataagagaagtgaattctgcagtgagcaaattgctagtcttttcagaaacaaacctacacggtctggtaccaggaaatagcctttgatgaggaatccactaattaaacctgtttttactgtgactattcaaaacattagcaccctggagatctctggaaataaataaaaggcagaaaatcccaggcagtttaacagaaatattttctcccactggtgagaacgataaacccgacttcaaaggaatcataaaacattcaagccagaaagaaccttagagatcattggattctcatttttcaggtgaggaaattaaagctcaaagaggcccagggacacacctatggccgcacatctagaaaatgagctctgggactagaatccagagctcttgaatgctatttattcatgaatctggtcagtcggtcaactaaatttcttgagcaaccactatgtgccagtcattgtgctacgattggtccctatccctgtccttataaagctggaggaagcagatattaaacaaatggcaaattaattatttataaatgtaatccatgctgtaaagattaagtagaggatggaatgaaagtaatctagcctttttgagggagtaagggatggcatggcttaggctaagaaatgaaagataagggcaagttccctagccaggtaaaaattgaccatgtagttggaagtggaggtctgagggaagagaacattctagatggcatatggaaaggtgcttgcagtccaaaactatcccagctcccccatctgcccctctcaaaatccagacgtctcaccctttttataaaacagcgatctacagtatatagagatatattttcagaagtatgggtgtgtagtaggaaggaggcatcatagccatctggacctattaaaatacttattaaatcacttcactgattaaacagttatttttactaaccaatgccatacaccaaggcagataatcagtgttttatgcttctggaaaggtcacatcctcatccttttgcatggcacctggaaataaaataagcctatattcaaagcagtagatgttaaatgatgcttactgaaaataagtcctcactttcaagtagaaataagaagtaatggaattttcacatatgtatgcagaagatgacatagcagtaggtcagcaggcaacaaccagaccttaaccccttccagctctcactagaagtaccctgtccacaagggcaagcaactaaaactatgtagcagttgctaactccacaaggggtttggagtcctgcatcccaaatgaaaaggggtaattctgaggctctcagaggtcatttctgttatggcacctggaatgtgcctaccatctagtcccccactttcaactcaggttaaaattaactgttaaaaagaaagcagaatggtggttgccaggggataagggaagagggaaatggggagttattatttagtgggtacagagtttcagttttacaagatgaaaagagttacggagatggtggtgatggctgcacaactttatgaatgtatttaataccactgaactgtatacgtaaaattgttaagatggtaaattttatgttaaatatattttaccatgataagaaataaatttaaaaagttaactgctatgcctgcaccaaaacatctcacgtactttataaatatatatacctactatgtacccacaaaaattagaaattaaaaaaattaactgttaatattaaactatgatgagtcacaagcagcataataatgaaagctatcctgttatgggcactatttgttttatatgcattatattattttactttcatgacagtcctttggcatgggttctattcttggcattttgcaggtgagaaagctgagcctttgaaaaattaaacaatttgaccaaaaccacacagataataaatctacccccaaagtgagtgagcttattttcttgaaataatcaatgaaggcaaagatttgtgtcttcttactcactgtcatattcccaccaccgagaacaataattggcatagagcaagtgcttggtaaatatttggtggagttggagtccaatcaaagcagtcttcttctagagtctacttagccactggatgaaatgcctccaaggtctctatccctcagcctccatctatttaggttcttatctcttatctgggaaccacagtgtgctcctaactacttgtcttcactaccattcccaggcttcccaaggtttgcaactcttcctgacataacacttaagcctagggataccccttactgaacagccttccgaatgccacaggccctgcttagtcctcattagtgcatttcagatattccatgttcacatcctagctctgacatatgctagctatgttgaacaagttgggttacttctctgaacctcagtttccttatctgtaaaatggaaaaaaatcacttaccctctctgagcctcagtttcttgtttatctcccaggtctcttctagctctcaagccttcatgactaacacactggtaccacagatctattgctgccccacccctaatgacttacagccccttgtcaaagttctgcaaataggtctggtgccatgagaatttgctaggcttttagttactaagatctgcctgcagttaccaaatatgcagaattcaatgatttcttacctcttttgaagaggtatacatagtatttctgcctttattcctacctaagacattttatgcttaagatctagaaatgaaagaatgagcaagatgtcttctgcctgggaatttgatgatcagaggttgaagccatgaatagtaagtatttgaggagaagtattagctatataaagctgttagcttgttgataggacctagaaggactcctatgtataattcctaaaaacttacctttttttcatgttttccttttctgaaaggaaatgctacagtaaaattaagaaaataatggtccctgttttatggcctcaaaacattgttccttccatttgcatgggtaacaccatggagtcctggaaaaataatattaaccttgtagaagaaaatgaagcctgttgccttaggcttgcctggagctattcccttctgtggcctctccttcttatgaactatgaccttcccagatgctaccacctggttgacagggatctgccccagtagtggaaggctaactgacccccttacaaactggccctatgactctggcttaagcaggccacagaatttccagccacttccatcattatctatgaatccatcccttccacacacagcaacagagccatccccatgacaaacacccttttggtccttatgccactctctaaagcttctaccctgaaaagatttgtactttctctcttggaatccatttcacaaatgtttatgactctggaatactgatggtattattataagtagagtggcaaagtgatatgtagaggcaataactatcttcaggatgggccagttcagagtgagcttcttagaggaaattacattccaagcaggcagtaagcaatgccatcctggctccctgaaattgactgggtggcaatccaactacaacatgtatctgatcattttataccttgtggcaacatattgagatcagaccatttcaggggagtggaatattccacctcagcggttggcccactcttaatgggtccttaacacatatataaggagatataataaaataataactctgttctttaagagctaaggtatccatgggtaaatgtgttatgtcatagcaacaatatatcaggcaataaggcaagagggtgcaaatgacaaaatctcttctaaagacgaataactggatcgtaagctcaaatagcacatatgcattgagggccaggataattggtcctttatcttctctttataaaaacaaaggtttatttgccctttaaatggttcaataaaattaaattggtaccctgtagtgtgtgctgaatacataatcagaaattggaagcaataaaaaaaaagagggaaaaggcaaaagtaataaaatctaaaatttggaacagtgtacaaaaacaatgtaggaaaataatgcaattcccaataacacctcctcattgtgtagcagatcctgtaacaatcacttcttctcctgaaagccagagatcaccaactggatccacagtacctcaaaggcacaggctgcttgactttgtagtatcctcagaaaaggggaggggcagggcaggactgggtaagaaaggaagtgactctctatttactttgtccacttttggagggatacacaaaactttgaaagtaaatgtagtactcatgaaaaggaatgcttcgtggaactcaaaatgtcttttaaaatatattccctgtaatccttccaaagctgctcatgttaagatcttcagagaaaaagcacaataaaaacctcataatacataagcatacagcaatccaacctccagaaaaacgggagagttggtgcttggcaactgatgaacatgaaacacaatacattaaaaaaaacacattcttctttctgatttctaattttgatggccagacacagaaatatttgtttaatgagtgacagcacattgataatacttttctgtatgaactggatagatgaaagagaagggaaattgtgttattgttcaattattttttgcaccaaatatattcacatgctttactcagagaaaatattaatcatgcacacaagaattttgacttggaaatctcagaacactttatagaaatccattgtgtagagtgattccggtggccagatacattaaaaaaaaaaaatgaaaaagagggacacagaacgagtttcaaaaaataccttcattaaaatgtcttacagttgaagattcttagtgaaggtgaaactatctagaggtcatctctttgcctccaaccaggagtacattaagtcatcctgaataaattaagttcatctgctttccacacaggacgtttcttcagcctttccaggggcctctcttagttttctccgggctcaacagaccaaaagaccctttcataactaaagaaatacacgttttatttcctttatgtctctcccaggcacctgccaaaggactctgcacttcgtttaccctcaaatatcattgctgcctggctggcacttatgtttagtgccacccataccacaccaatctggagctgggactctttcttaaacacagatgaaaaccaacaagagaaagaaaagtagccaaagtaggagctttaagggtgaaagagagcaagacagtcatagagtcactgggtctgcagcattgctttgtggagcctaggccccatactgaagattaatcttaaccaacttcatcagtgattccatttaaaaggcaaagaggcaactaggtcccagttgtgcacagaaacaaaaatcacaagcaataaaataaaattaaatactcataattaactaattggtggtacagttggctgcttttccccccagagaaggcatcttctatatgaattttggagcacttaaccaagtacaacaactgtaattattattattcctataataatagggttcccacagatcttcgtatttttacatgttttatactcattatggctaatccacaaaacatctctttagggtatgcaaatacttttattgccagtatgctagagaggagatagagctaaaaaaaaaggtgaaatgaaggtcacagattatcagcagtgacttacgaaatagaactagagaattcctcatctcagaacaaatttatgtcatcagctcgctaaatgcttacagtatgagccaaattatactgagtctgacacaaaagtaacagaacacctgtttcctgggccttcaaaagcttctcagtcattgatgaagttcacatttacacacatgaggcaagcaggccacaactcagtccaggcaagctatgatcaaatgccaaaatgggggcttcaggccaagtgctgctggcagtcacagtaataatagatttcttgggggatgaggcaggcaccaaatgctccacagagcagggagtatcagccaggttttgaaaggcaggcaagaattggaatggcagagatttagagaatggcattccaggatggggacacagcatgagaaaatgctcagtagcaggaatgaataagaagtatctgaggcatagaaagaccactagtctagggcagaaaattcctacaggagacctgtggaagacaattttagttagatcctaagtcctaaatatagagagccatggggtagaaaacaaatacctactgtttgttgaacacctattatgtacagattctgtgcttcatgttttcttaatgtaaattccagactgaagagtttggactatatctgaaaggcaatggagagcttagggcccagtcactgcgttccaatatctaaaataagacagagtgtgctcagttacctcactcacatgtccttggccaacctctgaggacttacttgagtgttttataactgagtatacagcttctctcaggcaataccattgttacctgaaaatacaaagcctttaattttgcgtgacatcacacaaagagaattacagagcccgaatcctctttctcttggagcaaatggaccactctgatgtggtcagatgtattcatcagtagcacataaaagttacaagttaatacatgactgagcagcaaagtgctagaggggctacttattccgtctgcagatgaaactacattctaagagttgcatgtgtttacttaattgtagctatttctagctatttttagtcagattccaccccatggagcaagttaggtactttgggagacacagttttactttcaagccactgaaggagcatctgcaaggtccatgcaaaaggactcagctgttccgtgttgctgcaaaaggctaaagtaggaattaatttgaatgatgttctgcaccagtggtttctcttcccaccttgcaaatggattgagttctaaaagatgtgtaatctggctggcctacaggtggccttaaataccagagctgcttgttaaagcacataagacccagggtacaactgaacggttttacagcactgaacctaactctattgcatgctcatgtttctgtgggaagatgcgttcaccttcccaactcaaaagtttagtaacacatgttccctaagcactcccatctgagacagtgggagcagaaatcccatcggcttccatccccaggtgttggcaattcaatgtgactccagctgggtggtggggatgagttcagatggaggctcagagggcctagggaggagggatggattgtgagaacaggaaaaagaatgagatgggtcctctgcaggaagtgataaacagtgaggacacaaatgttgtagatcaaaccagtactaggcttgggacagggcatggaactacagtggcataaggtagtaaagaaatacattttattttatgacccataacacatatgcatgtatttaaaacccaaaacatatgtttcatgaaacaatgaaacaatacgtacctttactacaaagatgcaccttggcatttttctaggctgtttcatttatttttaatgctaggtcatgactcactacattgatttcataagccactaatgggttgtaccctgcataatttgcaaacattgtaggaaaagggaagaaagattagttttcctttattctttttttttctcttatcgatcatagactctggcctggaacaaatcagaatggaggttgaaaaaacaggcactgggataaaagtgatgaaggtgggttctaggcaacattcagggagaaaagataaatggataggaaaggtgtggtcatgctgtcactggaccagttatgagttccctagcaggaggtcatatgaaagggaacttgagagtagaactctgtatatctccagcatctggcacagtacttgatgctgttcaataaatgtttaatttaaaatatctaccaaattgatacacatacattagaggctgattgaacatacacatctgatcaaaacacagagtgaatatcagaatgtatgcttggccaatggcggtgttgacagggtttgttgttagcaactttatccctcccctttgtctctgcgttcaaatgccaaaaggtccccatgcagaggtatccccaactggagagtcattctcctagaggacaactaaaagactcagatctcccctgactgtcactaacggccctcaaaattttatctgacctgtgtcctgtttcctcagtgcctggttctcgtcagaactaatctgacaaaccaatccatactgaagtagtcatgagaaatactgaccgcatgtttcccttccagaccacatttgtaatttaatagggaattttgccatgctagccaaaaaaaggtggatgtttcaaaccttgtggtagtcaatggagaagagaaactgaagatgggacatctttctagggaccctcaaaccacactacaatgccactatctactctgcctacaaataggaagtttccattagtcattaaacaatgccctcctcccctccaaaaaaagtatgaaagttgctagtacaatgcctaaaacagttagtaactaataaatactggttggattagaatctaaaacatttaggtgggtaggcacaggaggcagctttaacaggtcctactcacctagcattgtctgtgataatggacaattaaatgttgcactgtccactagctgcacgtggctatggagcacttgaaatatgactagtgtaactgagaaaagtgtagtcacatgtggctagtggctatcaagctagacaagacaggtctagacagttaacagacatgagacacacattttgagcaagtacctttctctcactggtgcccttgttaaaaagctggatctttttctagattagccccaagacctaaaatgcctgtcttcaaagggttgtccttcttcttttaggacaaaggggtgtaggggatttgtgggagctggttacagagggctttgttcttagattcgagctagaccatctgttcccaatcaaagcagctttcaaatagagagcagtgcaaccctgaaacatcctgcaagggccactgaggtttacctgaatgtacaccctatgcttgtcagatggacatctcagcgtggacctccttggcacaaagttttacacagagccagaacaacctcccaaaccacaattgggcaattacttttaaaaatccaactggttgaattcaagttagaagaaatgccttttactttaacttgcctttttttttccttgatggaaaataggtttttttgctcttcaggctattgagacatatttgaaggaactgaggttgtatggatttttaatgcagcaaaaaggtgaactgttttgagtacaccaatcctgggtattgtgaagatggcttttcaagagttgctgtccatcaggattgcatttgggaaatttcataatgctgcttacaattgctttaaagtcttctagcagatatggatgctgaagaccatgaaccctagggtcggatattaattcaatttttccacctgtaaaatgggtaggccatttgcttcctaacaacaaacagcaatgaatcagcattttgatcttaggtaataacacactgcttgagttattctgtagaaaacaggagtttcccaattcttctggtggctcattcttcaccaaagaggtacttctctgtttgatcatcctctctcctctcagcatccttttctttttttttacttccttttcataaaacttgatgataaatggtaaagatacattgtcagagatgataaaacccaggagagaagaaaattgttccagttattttttacccaagatttaggcctgtgaatgtgtgtgaagaaccaaagtcagtgttaagaatcattcatattgcctaaactgtgaatgtgttaaagatataatatatttggagcatactgaagaactttagccagactatttattatctagttattgtcatcctgaaaggtataggggtgaagaataaagtagcatgcccaataattttgtccttggccctgtcctcttcagcatttttgtcaataacttggattatactacccgaagcagactgaccaaattgcagatgatgcataactgggagcgacatctaataaacttgttaaacaaatcaagattaaaaatgatccctagaggccgagtcaaaaccattaggacgtttttaaaaagcaaaagtctatatttaggtacaaaaaatcaacagcacatatccaaggttgggggaagcctggtttggcagaagtttcttaatatacctgggatataatttcaagaccacaaagtaggagtggtttccatggaaatctatggtgagctgtttgtttgttgttgtggttttgttttgttttattttgttttgttttattttttaaaaagccatgccatactcagcagcactgacagatatgtgttttctagtccagaattggggggtggggaggggtatcagttccctgtcttctggaggggttcaaccttactcacagtgtggtgctcaatcctggacgccaaactttaagggtgacatttgacaaactggaacacatccagagaaggatggccagagtggtgaagagcctgggatctctgaagaacagttggcgataggctgaaaaaaagaagtcatagacaggtgggatgcatattgtcagatgtttgaaagcctgtcatttgaagatgaagtagattgtttctgcatacttcagacaaaaaaaaaataatcctcaggtggtgaaagttacaaggaggtagatttgcagtcaatatattaagaaatttctaataattagagccatcccaaagtagaatgcactgttttgaagagtagtgagttcactatcatcagaagtattcaagaggggatggacccacctgccaattaagctatagaggggattgttgcattttttaggaagatggaggaggtgactgaggccattacaacattaagaatgtgatgctaaggaatccaaacaaagtgggaaataaaggcatgtcttcttcactgatgatggatctaaagattttattacttatatatggttttggctttaattatgaaatattttaagcctacagaaaataaaacagacaattattagttcatttttgagaataatttttgtttggggacccatctcaccctctccctgctcagcatgggctgcaaaatcaaagaaaatggctttcaaatactatatgatgtgatatcaaacttgtagctcttatctgtccatgacaaaccttagggctgatccaaagacatcataagagttcatcactttcctgcacagctttaaaaattgtttcattgactgtgactggattactggatcaattattttttcaattaagagtcctgctaaaccccatgtaaaatgagttgcaagtcaagacaagcccctgactactttagatgattgatggagatatgtggatgacagagacaggctgtaaagaatgacaattctgtggattgatttgttatgtggatgatgattactggaagccaagtaccaatactacttactcgttgatactcagggacttttgtaatttttaaaaggagaaatttagctattacttccatttattctctgcacgaacctgtgaggtgggcagagcaggtgttagcattgctgggttacaaatgacagacctgaagcccagggaagtgaccggcccaaggccatatagccaattaggggctgaactgtataaaaacccatctcagtgcaaacacactgagaaataatttttaaaataatataaataacatatatcacttatcaattgagcacagactatatgaaagtcataagcactttacacatattcatttaatccatacaataatactatggagtaggtactattataccaattgttatagatatggaaatgaagcttggagcatctaagtaactagcccaagtctatttaaccaataacttgaccttaaaaaaaaactccaaaactctttaccttcagtgccacaacacaattcaaaccactattgtctctcacctagactatagtaataacatttcaaaggtgttccctactttcgttgatgttcccttaaatctactcttcatacagcagcaagaaaagtcttttaaaaatataaatcagtttatgctatacccatgatcaaaattattctaatatttcctcccatagtccttggcataaaaatacaaattccttaccaacatctaacaaggtcctccacggttggttcctgcctcctctaccagattcatcttgcattatcctcttcctcactggccatgttccagccaggctagtcttctttcagtgcctcaaatgcatcaaatgcatttcagggccttgtcacatgctagtctctttgcatagggtgctcttctaccatcaggtgtcagttcaaatgctttgtccacagataacctttccctcgcctaatctaaattaaaaccaccttatcatgaagtcacagcatcctacacattctcctcttcatagttagaacgtgataatcacacattggtatgattatttgattcatatttatcatatttactgccagtactagactgtaagcaccatgaaggcagagatcttgtctgttttgctcaccaccatatttcagcacccagacactgccacacactaggaacctgaaatttatttaatgaatgaataagcaaaaaattaaagcccactcctgactcctgagtcccaatgcttaaccatattatctcgatataaaagggcctaaaaagcaccctcttagcccaacccatttcaacacctttcccgtcatctctgacattgctatggaaggatgatttacatttacatgtgcaaaatgaattttccaaaatacatgtgttcatatattaatgcctgcatttgctagcagttacattcaagtaggatcaaatgttgacaataagtgttttctttgccagcatttagatacatgccatgtaattgcaaaaataattagttagactttcagaaggcagtatgctcttgagagctgaacaaaatgttcaaaggaattaaccccaagatggtaattaaaccatgcaatcatcagctggagaatggggctgacacactgttctgactctgaaacctaaaaggacccactgtggttaccaggacacaagaccaaagggcactggggagggatcatgatttatatgaacccagggaaggtatgagctgactgctaccctatactcaccccaccatatccatcctctatctaatttcccctctcctacatccccaggctaaacacaaataactcattaaagggcaggatcaggaagatagctgcctgtatggtaggcttggaagagtccagaatatccaccctttttaagtttctactgctaaagtaactcctttggggttttctagatatgtatgcattttcattggattaaggttttgctctttgtaaggaggaattcataaggtaaacctttggttctcaatgtgggagatgagctatgttgccctcctgagggatatttgatgatgttctgaggcattttgggttgtcacaacaggtagtaggagtggtgcccatggcatttagagggtagaagtcagtgatgttgcaaaacatcttacaatgcacaggacagcccctggacaaagaattatccagaccaaaatgtcaatattgccaaggttgaaaaaccctgaactgacccacttacaaagattcatttattaatccattaacaattcatacacagagtaggttcttgcagaaataggagatgggatgagtatattttgattgatcagttgaaacagaaagaaggaacagtaattttatagcagtattcaatagtctgggaaaagactggaagcaactgaccagttaagagactactctcagtcaagagaaaaggaatgataacttgaactgacaatgaacaggaggtagatacacgtaccttagaggcagaattggtgaagcattacaaaagaatggtatagggaaatgagggagagaacaaaggcaatcatgatccttaagactttagctttggttcctggaacaagagcaatgcattagaagaaacagggacaacgggagcagacacataggtggaggatggacgtagagaaataatatgctgagttcgtgatgccttgagggcctctgggtgaggctgttttatgggcagttagaaatgtggctctggagctcaggagtgtggctgaagctacaggtatctagttagaagtcatccacatggaggtagtgagattagatccccttgcctggcacatagcaggtcctccataaatatttgttgaattttaaaaaaccatatttaaagtgaggagaaaagagggccagggacaaaatctttgaaacacatcctcattgaggaggtggacacagaggaaactgaaaaggaggagtaagagaggtagggccagcagagtttaatgcactggaaatccgagaggagagtttcaagggctaagatttagccaacaatatcaaatgcggctcagcaatcaattcgaacaacgtctatgaatagagggggatttgacagtgaagaagtcatcatcgaacttgagagagcagttcagtagaggagttggaacagaaactaggttccagaagctgaagactgcaagatctttattatcccatcattagtaatagtgataaaggagttagaatgatagttgatggaggtggcagggatttaggaggaaatggaatcttagcagatgtttagcctgacaggaagaaggcagcatagagagactacagtgtggcactcaagaagcccaaagagtaaaattaggttcaatttaaggacgagctccctagctgtcagagctgccctccaagggaagtagtgagttcccttgttactggatggattcaaggagaggcaatatgacctcacagaaggtggctcatgtattgaatgggaatttggactagataattcatttccaaccttttggacttatcagattaataatattttagggggaaaaaggtagggcaggtgcacattgatccagagagttaccaaccttttaattttgctatgttaaatgtattagctttctatttactgctgtaaaaaattaccacaaacttaatagcttaaattgacacaagactattatcatacagttctgtaggtcagaagtctggtacaggtctcaccaggctaaaaccagtgtgtcggcagggttgtgttcctatctggaagccctaagggagaccctgttttcttgtctttttcaacttctagagactacccatatttcttggcttgtggcctctttccacttttcaagctagcaatggccaggcaagtctttcccatgtcacattactctgataccgactctcattttgcctctgtcttccacatttaaagaagcttgtgattacactgggccacccagataatccaggatattcttgatattttagggtccattgattagcagccttaatcccatctacagcctaatttccctttaccgtataacctaattcagggactttgggactcagacatggacatcttttggggagtcattattttatctacccacataagagatatagatatataaatatatcttccatgtgatagacatcatcatcatttatcatcaacatcatcatttcagaaaataaagactacatatagcactaaagagtagaaattatatagagaaaagtactgtctttcaaaaaaaaaaaaaaaccacgagttgtctaccttactccaacacacacaataaaacacagcatacatttatttatttccttacactggtaactccaccaattactaataccacagctttagaaagcaccagactatatgatctctcaaggtccctcctagctctaagtttctttgatccactggacttcactgtactatgaaggaattacctggagaaccttgttgtgatgtagctctatgagtttcttcatagctatatttttcgtcttcctgcttgctttaaatgcaatcattaaatcagcaagagacttcagtttccctctttcctccttgattcaaaaggtatgaaaagtgttctgtaaatgatatgcaatattgttattctgaactttgaagtaatcaagttgtttgacatttttgtaatgatgccttttggaatatgggtggtataatttggtgccacactgtacattaacaatacccgtctcgaccctacagactcggggactataaataaaagcgtgacagctggctccagccttgcttgccactcaccattgaagggaacgcagctggggagctacactagagtccccaggaatccagaatgtagtcagaaacgacatcttcaatgagaaaaaaaattggtattttgttactgggaatatacagagacaggcactcttaggaggcagacaaccaagctatttcacactgagaaggcacagaggccccaggtagggacagcatttcaccagcacaaaggcattatatagggagggaagagacagaggacaatggcatcttcttgagccaaattggcagagtttctttaacccattaccacccagaagtgagactaggaaagaagaaatggataggaaaagtgaaagagatggaaagtgatatcctggggcttggtatgagatagagggcaatggttactgtggggaggataacacaatagagctaacagagggcaaagtacacagagagagagagagaggtgaagctgatatacttcatattttatttatttgtctcatttattgtattttcccctcactagtctgtaagtcccaagaggacaggatctttttcactcctgtatctcccaacatctataacagtgcctgacacatagtagacgctcaaaaaatatttgatgaatgaataaatagctagtattcattgaatgtctattatatgctaagcactgttataggtgctgcccatgaatgaacgtattttaactttcacagcaatgctgaaacagttattgtcattatcccaattttacagatgaagaaactctatcagaggcacagagatactaagtaacttgcctaataagtaaaggatacaggatttcaacctatgtggtctaactttagaacctgcctatgtaataaccatcctatactgaggctcagaaaggtcaaataacttgcgcaaagttacgcagcttatgactggcagagccatgattggaaccaagatctgcctgtctatgaagttgctgcctttccctctgcacttcatgactttataagattgccaagacaaatatttcttccatcaccattttaccagagagtcttctgagataaagaaatgggtgtgaggctgggcatggtggctcactcctgtaatcccagcactttgggaggctgaggcgggtggatcacctgaggtcgggagttcgagaccagcctgaccaacatggagaaacctcgtctctactaaatatacaaaaattagccgggcatggtggcgcatgcctgtattcccagctacttgggaggctgaggtaagagaattgcttgaacctgggaggcggaggttgcagtgagccgagatcgggccattgcactccagcctgggcgacaagagcaaaactccatctcaaaaaaagaaagaaagaaagaaaaaaagagaaatgggtgtgcttcattaaggattcagataaaggaaacagacatcccccaaaagaatcatgactcccaaaagatcaccaatctgcaaccagctctcactgctgttattggggctggagggagctgagggaagcagctggcagatgaatcatgggaaacccctggtagagccatctatgctaccttgtctgagggctaggcattgaaggtaagtcactttcatgcaggtgaatcctgacccacgctgcaaaagatagctctggagtagggatggtgaggaaatgccaataaagcttttctaagagactagttcataattcttgtgtgaccttgtgtaagacactccctccctttgtgtcatagtttctttatgatagggagacatcagaccagtgaaactctgttcaatcagaagagctccactgtctcatttgtaaaataaacttttccatataaaatttcatttggagaaaggatttcaccactaaaaactatgcttgagaaacaagtgaataaaaaataagttccttctagctcaaacattctaagaatctaaaatcatagacattgtgggtgggtcaactcagtgttccattcaaccctacttttgacagccaggaacaggcctaggatctgctgtgaaaggcccttcacaggtcccccatgccccagcttctttcagaggccattaacactgtcctcatatggcagttgtcttccccattgggctaatccttcgcaggccttctactgatgtctgtctatgttggagtgggtggagcacaggggtcaatatttgaaggacagttgtacttctgttttatatgaaaggagtcaaatgtttcctgattttcacctaaaactcttcttattgatgtccaccaccaaaagacagtggatctgccttttggaccacggtggcatattattccctgaggattgccactgatctataaatattcctgagtcccttgtctgagtcacaaccagagctgtatgcttagtttggaaattttaaatttcagtgggttttctcacacaggctccctacacatttttataagttcttcttttgtctcattcttcttgtcataatatacaggcttaaagatttcactgggttcaccttcctggagacaactcataaagttttaccaaagtctgggtttcacatatacaatatgactcccttgatataaagctttaaaacaagcaaaaataataatatatcgtttaggtgtatgtgtttgtatatttttttaaaaccaaggtaataataaatacaaatttcacgatagtagttacctggggcaggggtagcagggaggagtgttatcaatacagggagatggactagaggaggaccacatagataaaagtaagttaccagtaatgttatagttctcaggttgggtaatggctttataggtgttcattatagtctaaataaataaatgaatgcaataaataaaatattaaaagtccgtgtatgaactaacaatgattaattaattctgcaccccgagttcaaggtcaatgattagaagagcaatacaagattttttttaatcaaccagaacctcgccacttatcttctgtttccttccactatttcaagagtttttgaaactgaaagtggatcatggctatagttttccttctttttaagtttatattccccctcaattattgcccataatctagtcaggttggagttctccttactgaaaatatgttgcattttcccatgagactatttttgtataggattcatggatcctaatttttcttttgccagttggtatggatctgagaattaccagctaccctttgaatcattttggttgaagggccatgattgcttgttctagtcttccagcccatgaccattattagtaaggagaggttctttctagggttgacagataaaatacaggatgcccagttaaatttgaatttcagataaacaacaaattatgtttttagtgtatgtatgaatttgaggcatacttatactaaaaaattatttacctgaaattcaaatttaattgaaaatcttgtttttatttgctaaagctcgaaaccctatctcttgtggagcaatgattactttttaataacattattggatttgagtacatgtgagtgtgagttttggatcaagcacactcagattcaaattctggctcctctgcttaatagctagaacagtttttttggtctcagaatttttatctattaaataggaataacagcaatacctcataaagctgatgagaatattaaatgaaaaaatatttgtacagtagttagtatagtgcctggctaaatactattctcattattaatggctgttattatcaatggctattatcattattattggatgttatcattattattgtcaattttgtacagaacattatgtgcactggccaagatttgatttggtattgcaaaactccacttacaggattaatttgagaatgggacttttcttagcatcacccttggtgatgatcaagacatcccttttgtttctgagtattgtactccctttggctcttgtcatgaagtaccccagattcactctagttggatttttccttttatttatttatttgtttatttttgagacggtgtctcactctgtcggtcgcccaggctggagtgcagcggcacgatctcggctcactgcaacctctgcctcccgggttcaagcgattctcctgcctcagcctcccgagtagctgtgactacaggtgcccgccaccatgcccagctaattttcgtatttttagtagagacggggtttcaccgtgttagccagggtggtctcgatctcctgacctcgtgatctgcctgccttggcctcccaaagtgctgggattacaggcgtgagccaccgcgacgggatttttccttttaatataaagacgtttcctgtgcatgtgtctgagggtcacttagaattcttcaagttgaagactattgtctcctatgatggagatggttaagtgactgataatcacttttgaaatgctaccctcaagccaatggctaatgactttggttgataaaaagagaacagctctaatcaacatagattcgaatcaaatgcagggaaagcaaaatactacatccactgagaactctatctctcacaacagggtcaagaaatgaattaaattggttttccacttgccttcatgctttcaataccttctttatttttggtgctcaacgtcttcactgtttctcctctcagggaggactccagaccccatacacattctcttctctgacccactcatccccatcaaaatttacccatctgatttcccactcatccttgcatctaatcagacattaatttatcttaccacagtaactgctaaataagattctatttaatcactctcccaggccacagacttcttttaaacacttgaagaagtaaacttaacagtggtatttagggttttctagtaggtaagggagaccatgcaggaccccttaaatcacaccacattatgcctgttatgtctgcttcgcatgaatggaagtgagcagtggtgcagataatctaaagatcatttccactttgtttgtgaatgctccacagtgttgttgtagctgatttgttttgctaattatgttctactgaagctaatattaaaattggttcacattttttaagctcttatgggccagaagagagaagaggcagcaatgtggcccactttgaaatgaaggaaaggtgacaactgtgaggggggtgtgaaaattctacatgtgggctagtggagtctataagatacatgcaaaaggatcaagatagaactttcccaattacacatgggcaggataggcagccacctaacccctgtgactcgatgagcactgaaaggacagtcttcccatggcctgcccagagccttaaatcatctaaattaatagcccacattaagggctttaataataacataactgtggctaagacattatgtaacctgaagggtaacacatttcctagcagacttattagcagctagtcttactaaattctcagtcacctatgagaaaaaggaatgaagggtggtacaaaaaacagttgtagttgtagtttgatggacgcattagtacactaagaggcccctgggcagctaaagtggaagtacaagagcactgaatgccttggagatgagccgggagggttttgaaagggagtaagacgactttcacctctatttttcccacattttcttagtttccagctcattgtgcacatagagaatgtgtacctgtatcaaattaattctcttccctttcttactcttctcctgttgggtaactgggttttcaggggcttctttcttctgaggtatgcaatttggggcctaattgtacattgtatttctaaccctacaagttgcagcaaaggaccatggagctattgaatctttttctctttttctcattgcagtctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggtaagaagaggcacctgctctgctctttagatattcatgtaattgtgttcaaacttcctcagcttatgtgccctttgcttccaataaataaaatctaattctgttttaaaattgtatttaatattccaaataaatcaaaggttaagattaaaaaataaaagtaatagtaattttagaacctaatttttcaagctatgtaggccctccctgaaaaagcagtttggaatacctcttgattgagtcaccatagttgaaaaagaacgcctcccccatcaaaaattttatctggtctaaaatgtatgaagtaaaagcagcttagtctaagtagagagaggcttaaattggaaagttttggaaaattaatcctgtcagaaactgtaattatccccatttcatagatgagatagctaaagtccaagtgctttttcatacagcagtttcaccactaaaatgggactggtagcaatgtctcttgcttccaggactcattccatcagatcacattaggttttcagcttagcaggcctcaacaattatctgatagaaataatgagtgagacagctaaactgggctttggggattgactttttgttttgtttttggttttgtttttgtttttgttttgttttgttttaaatagtgagacagtctacggccataccactctaaatatgcccagtctcctctaatagtgagacaatatattgaggatacactctattaaaacaggctcagaaattaagagtctgatcttaaataatatacagtaaggtctattgattaatttgctagagcacacacatcataattcatctaatcaggctcctccaacacccagttgtctttgacgggttccttggtaaaaccaagggattctatcaccaagacgttccagaagacaatgttactttatcactcatttgcctgtggttccatttataggctgggggtggttctctctaactcagaatttttaaactcagaaggattaaatgaaaggcttatctgcctgaggggtacctgtagaagaggtccttctaagtaacttaacttgaacggccattttgctcttgggaatccagaacactcttcactttactctcattttgctgcatcatcaaatcttaatagcaaatacttaggcctgtatttccctattgtacttacctccaaactatcatcaaatttcatgaacctgaagcagaagaccagaggtctagtccaagctctgccacttactagctcacttaacaagttgaccttgaccaactcattgacatgctcttggacttggcctcctcacctaaggtgtgttccttcttaatgttatattccatgattctgtgattttttttgagatatttgaccagctactgacactttgtatcttgctactaatcgtaacttatatattatcagttaattagtcaatccattctacaagccattatcaacccccaatggtggtctccaatcctgtgatacatacatatataatatggtttcaagggggtgtgtacagaaaaagatacttataaagcaattcatgaacaacacagaacaacatcaaattgagtgctacactgtatactctgaatactttaagaattgtggaaaggttgcactccagaaaagtagagttttcagagaaagcttgctagagaagctagccttgaaagatagataagttgtgggttgcaagagagaagggagatggggctttggagaggagaaaagagaacaaacaaacagcagggccaggaaggaacactgtgtgttcaggtagagccctgtctgactgagatacaaaatagcttgaatattctaattcataatttgccaaattttaataaatttcattttgtccaaacagtatacatgtactgtatacagcgtaatctagtgcatatcaatttcgttttcagaactgaactttgtaagtcaggcaacttctctcctgaaacattttaaaaacgaaatattggttccaccaacagtgtacctctcatttattcaaaagcagaagacacaattaatgaattttatcctcatctagtgtgacccttctctgctcattagctctctactagaagaacgggaggaaaagaccatctatctatttcttacccttgcatcttttctctaatcatctaactaaatagtttggacaagtctatggtcttggagtcaaagaaagctttctgactcatgtaactttatatttttcacctgcagccatttagctggtgggactaatccgctctgcttaagaagtacttcccataaacttttacactaatttaccccttgaaaagccttcttacattactgtactaggatcctgttccaaaattttcaatggctttctattgcccatattgaaaaaagcagtctattcttcaagacttggcatgagtatgcctcaaccaactaacaaacccattctccctatgctacccaatgagaacctcccattgtaggaagctcccattttccactgctgcctaaatgcaccagaaccatgcctgcctcagcaatcgtacttttactactacctggaattctctcctttatcttgatatggtaatcatgtccattcttccaattttcaaaacccgcctcaaactctacctccccaaggtagccttccttgaccactctagctcacaattattcattaatgcaatagatgctaaggctacaataaaaaccacatagatatagttagatatggttcctgctttataaacctacattctaatgatggagatagacaaaaaccaagtaaattaacaaaaaaacaattgcacatttaaataaggtgctatgaaggaaaaaaatagacagataataatggatagggcttaatttccaaaggatgttcagtgatggcctcattgagaaggggcatttaagctgagaactaaaggactggaaggaggcagcatgtgaagagtagagggaaatagtttcaagcagtagaaatagcaagtgcaaaggtcatgtcgtatggttgaggaactgaaagaagtccagtgtggctaaaggataacaagtaggtagaaagtggcctgagagcagactgtagaggtagacaagagccagatcatagccatagagtataaacagaagccatgctgaggagtatgaattttattctaattgcagtgggaagtcattggaggattctgagcagggaagtcacatgatctacatttctgtagagaatggagtgtggtgcaagtaaaaaagaagggaaaccaattgaaagtccattgtggtcatccagatgagaagtgatggcagctttggactaagctggagatggagaaaaagaggtggagttgaagtatactttggagacagaattgacagaacttggggacagattgactgtgggatgtgaaggagaggaaggcttcatggatgattactatgtgtttggcttgagagattgggtaagatggtaagatggtgatgccatttactgaggtgactggacaggaggagacttagttttgaggagcagagatcttgcctacctctaaacacccacagaacccttctgtccatgtcattcatctggcattgaatataactgccttctgctgttatttcactggctatgatctatactataccttcccaagcatttctctccagtgtgataataaacaactggctagcccctagatttatactttgtgcctcccctagtacatagcacatgcctgtgtgcctacttagtgttttccaacctcctttagtgattcatcaacaataagcctatgtctgtttttcaacactggactgaaagaaagagagaaagaaagaaagaaaaataaagaaggaaggaagggtgggtatgggtaggagggagaatgggaagggaagaaagaagataggaagggaagagaaagaagagaaggaaggaaggaaggaagggaggaagggagggagggagggaaagcaggcccaattcataaatcataccaatcacttggtacagttgtttaaaatattcagtattctgtattttcttgttttgtgcaatgatcatctcttgctttagtaataaaaattacagggagaaattacaatagaaaatataattttacaatattttaaattatataagagagatagaagagaaagagaaacagaagagaacacctataattacattcataagctaaatatacaaatgatgtgactctactgtataagggcagggatgagtggggagctgagaaatgggttaaatgtttgagatcatttaaaagaattgtagcacaaccagggtaaagttttctctgaaattatgaaacattgagtggaattcagggctttgttgactctgcttctatttctgtctgcagacgaaagtctgatttggggtttgcagtttgtcagtttctaaaatcctaccttgattcattaatacaaagttgaaaattactttcttggtgctatatacataaaagaacagtttttgaaaaaattatgaggttaagtgtgttgtctgccctatcggtaccctctcctattaacaccctctttccttactatggcattatgtttacacctgccctccctggcaggagcaaaaccttaacatctctgtctcaacctgcttctacaccttcataaaaacttccctgtcctgcattttcttcccactgattaatagtctttctctgctagtgacaacagctcagctgaccaatttattcatgctaatttatctatgactattaacaacttgatgggttagtgcatccagggaagaagaaatttctattcaggcaaaggccttctgtgaatacagaaccataatccaaggtgtagctttttaattctgggattccaggcaccatgagtccagtttgtgaggtcctttgcccacatgccttcctatatagaaagtcctaaaaccatgccagggaggtggccatctcttccagttattagacttatcttttgggtgcaagtgacctagttctctgtggtgctaacatttcccccagaacagcaacatacttgagaactgcagccagactctcgtgcacctgacaactctccttggcttcaatgggcacagcccacagagatgaaagaatccggcccagctgtggctctcagcttagataatgagataatagctctgggtgccctttgaggcaactagtccctaccttcttgccagtgttcaataaactcctgctgtctcccattctcaacctgaaactccctactcagttcccaagtaactctctggaagtcaacagccttctaacagatctttctatttcctctcgaaggttgtgacaggaacataggcagttgtaacaattatcctatcagtcaacaagcaattattaagctttctccagtgttagcttgtgctaggccactggtggggtttaaaagaagcagaattagatctcagctctgagaagttgacaatactgttgctgaaagagtgacttatctaagaggcctgaaaaaaataatttttaatacaactgtttccagatccaccaatgaaatatgcattcattagagcaagaaccctgtgaaaagattaaagagttgtcagatagctaggaaggtgggaaaatgttggaaggtcctaaagggcttaagaggtaaagggattccccaagaaaaggagaaaagggcctgtcctcagaggattatgaatgtttcaaccggctagatttgaactctactgagagacaagcaaagtttcagcctcacacttttctgcatgttgtcattctccacctacttacatagcctagcctcatcccattcacccagttctactttcccaaataaagcacaaaatacctctctctctctccctctttctctatcttccttctctttcttcgcctcctttcctcctttctcctctccactccttacgcccttttctttctctctacacacacactcatgcgcgcgcacacacacacacacacctcaataccaatcaatgacacatgtcaacaaatctgttattgttatcattttattcttattgtgataagagcaactgccatttcttaagcacttattatgcactaggccctgagcttatggattatctcatttaatctttgtaacatccctgcatctttacaactgaggaaaccaaagcatggaaaggttaaatgatagttcctagggtcacacagctacaaagtaataaaaccagatttcaacctgggtctgccacgttccacagtctatgtactgttctctgactgacatactgcctcctacattcttaacagttgaacacaactattacctcttcctttagtcttcccttcagccattcttcaaagaccaggtacttagaccctccctatcctggttgtcttcccgtggatgcaatccaattgccaatttccttcttaaggcatggtatccacaaatgaatgtaatatcttgttgtctcagggtaccaggaatccagacaggcaagaggtcaaaaatccaggttaagaggtaaatgagttgcaaaggtgaaggcagagagacagcagagttctaaatgcaggcagaaggtaactgctgtgatgcatactaacggagggttgtgctgaggccctgattctgagggaagggaactcatctattcttctctgggtcagagactttcctgaacacagaaagaaaaatctgcaggttgtcattggtaaggggctatatttctggttggaggagcctattctggttcaggataggccactatcatgaacttctttaaagttccagctaagtaccatgactgcttggccaaaactgttaagacagtagcagggtatctcaattatgaaagaaagaaagacagacagacagacagacagacagaaagaaagaaagaaagaaagaaagaaagaaaggaaggaagaagaaaggaaagaaagaaagaaagaaagaaagaaagaaagaaagaaagaaagaaagaaaggaaagaaagaaagaaagaaagaaaaaaaggacagactatcatggattctttttcttcttcactttaagaactgattaaaagacgtacgaaggaaacagatggctccaattctgattgtgtccatttgccttctgggaaaagtgaagtcaagagagtttttattgaaattcaagctactttttacatctgaataaattaggaaggcccagcgagtacattatcgtgtgagagacggatactaaattcccctgtttgagcagcaataatcagggttgacagtacctgagacatttggtagtttccacagcctgcctaatctattgtgatgagtcttcaactatgagagcatcttgagagcccgcacaataataatagtgaatgactatttggactggattgtgaataaaagactgtacatttgtctgtaatgagaatttcatcgaaaatgaaaataccagagctgtcatattttttaatacttcgatttgcacatccttgactgctttggggcataagaagagaaagtgccgagcaatttgttgtcagctcttgaaataaattatcatttaaacacttactctccacaaaggttattagcttagtagctcgttcctggggttggaccatcagtaggggaaaaaattcaaaagacattaaactaccctttcagaagctgaatattagttactgtggaaattgttctctcggtagcttaacatatttttctgtagctctccaatgctgcagattaggctgcagcaactattaataaatactgtcatattttacagctgtcatgcaaagctgaaaaaaggcttcactgtgattagatcctgtttactgtaatatttccagctcagactcagaaaagcagttttcctataaaggtattttccataagtagaatatttctccagaaaatgacgattaattttaatgtatttttaactccttggtggcagtgaatttgaggttgaattgacttcacagccagagacattcctctctagagacaaattaagctaaaatgtcaaaatttctctcttgggttgtccttcatatgcggaaatggtgctactgtcaggagatgtgcattgagtagccccccacccctatagaaggacaaatctgcactggtttatccaacttcttttaccctgtccctcttgtgaccaattgcattgtttgcaagacagctggtaaggatgttgggtaggaatatcacttcagtaggctagctaaaaattctgcttcctgagctaaaatgtcatcatacgagctaaagaaacagatctctagcccccctacaatgcattagctgtttgaaatggtattcacatctctgaaaaaaaaggaggtgacagctggcagggttgcttttgctctgaccttctattgctttttatcaagctccttgagggaattaaccctcactaagctgaatatctagtttttaatgaacaggtagttaattaacccattaagggttatctggagtagtctataaattcagggtttgggcctgaaacatccttgaaaaggttcttccaaatgttccttggggcagggatggacagcggtatagacctgcaactgtgactttgaggtttgtcccttgaagccctttagacaacaattaaagccaaggcagggttgttgtgagagtttaacaagataatgcctctaaagcctttatcatcaagctgaacacagtaacaccccatgctcaatgacttttagctcttattattttattaccattatggaacagtggtcctcaatagagagtgagggtaattttcccccctcagaggacatttggcaatgtctagggacattttagtagtgggtagaggccaggaatgctggtacacatcctacaatgcacaggacagtatccttctccacgctctcaacaaaaaaattatccagcccaagatgtcaacagtgccaaggaagcagcaggccaaataaatggttgcagaaactccttaaggggttggcagtgaaccaatctagcatttattgagtgtctcttactatgcctagatcagtaataacagctctgttcaataagtagagcctttgattctgaagagcttacatcttggccagagagacatattaagattaatgcacagaagcaaatattagtgcaaaacagcataaagcaagagctagattgtgtggtatggatgtgaagtaccgtgggagtccaaagaagagaaatttcatgataggcaggctggactagccagggaaggcttaatggaagaagttataaacgtttctgaggccaccacagaactgcctcccctagcaatgaccttgccttgattactaaggccaagttggtatctagaaccaaaacaacatggcattcccatcaatgctcccaaacgtcacagctcaaggcaagaaatacaattaaaagaaaaaccaaaaaaggaacaatgttccttttactaaatggaaagcaattacagggctgttgaaaataggcagtaaacaaagggagggagggaaatactggcaaaatcccattttctcaactaatcctgtagcaaaagtgcaatttgcaacaaaatcaacagtgctctttccctctctcttgcagtcaaacacactgtctggcatcagtatggctacacatgatgccttagccaaaaagtgcatgcaagcaaggaggacagaatatgaattggagaggagagcagaggttaaggtggagcacagctcacttcacctccaactgaagtctctgtagagcattcccattcagaggaaagagggggcacacatagagactacttcactccctgtcttcctggatcctttccaatcaataggttgccagtgtcggctgctgtcctgctttgtcgactccacaaacgatctgattaattctctggtgctaactgcctcagcaggctttctcagcagtagaacagaggctaattaagatcatgtcaggcgaggaggctgacaggttatgttcctgggctacactgaacttttagagggtgcttcaacttcactgcaggcaggcagtgcttggctaggcgctgattccatagcaggcttcccatttatttccacgggttcctgtgtcaatgggtctccgttttgttaacgatttacatcctcctcctggggataaatagttgctactgtgttgctttcaattgcattacttgggctctctttcatttaaatttttaatatgcttgtaaacaaagataacaattaatagtgaggtcgttttccatcctaaatcacatgtgtgtctgagactgtgtatatgcttttgcatcttatcaacataaagcccacagaggtgaatttaggacaaataaaggaaactctacttctcacagcaggtagaaaatggaggagacatatggaactcattacaccaagtggtggattagactgaagatataaatagctttcccctccccctaaataaaggcttagatgaattcatggatgacagacccatagtgagctattaagggaaacagagatgtttggaaactgaggttggcacaaatcaccaagtagatttttgaatccatatttaccttctcataggcaaatggccacacagagtactggcactctatcctctgtgttttaaaataaaatcttaagaatccaccaagcatctaggagacaggaggaatgctcagaaatagaggaaacttctccaggagcattctgtctggtttcatatagagtctctaaccactgtcaaagataaacaaagctggacatttgttaaagagctaaagactgattttaatcagtaatatactattgcagtagggaaaagcgttcagcataaactgaactcaccttcaatctgtacagaggtggctgggcattttgaagggaaaatgagggaaaggggagggagatgaaagggggcccaatagagtcaggaaagtgaaaagttacaaaaagcaggaaaggggaggtttggcctatgtgaaactcatctgagtttgtcaactggcacttactgaagttaggctcccacccttccatggagactggcagacaggagaactatattgaggtgttgggtgaaacaaacaataaattattttggcagccttgagtcttctcaggcagccactttaaggaagactagaatcttcctagagatgttgtcttgggctattagaaactatgttagtgttttgttctagtctttataggccaaggttgggacggggtggagaagagggctcagaggagcatggtgagaatttggtcaaagaatctttgtcaccacatgtcaagaacactctgttatgagaggtgaatagtcccgttaagggtgttgaagaaaagcatcatcaactcagaacctcagttccaggcccccaactctgccactaagtagctgtgtaatcctgggcaagtcacaatagcttttctggtcctcagattccacatctgtaaaatgacagagtggactccatcattctgcaactaacaattcctgagtgcaggaattttgtgtcagggaagttacaggagttatggaagtgaatgaaacagagtgcctccccttaataagctcacagtttagaagggcagcatggacatataaaaaaaaaaatacgtaaatacaatctagagtgattccttttgattctaaaattctgtgggctattacaacacttccatttacaattgacccttaaataacatgggagtagggggtttacccacctgtacagttgaaaatccacatataactttggactctctcaaaacttaactactaatagcctactattatctggaagccttaccagataacataaatgattcattaacacgtattttatatgctatatctattatatactgtattcttacaataaagtgagctagagaaaagaaaatgtcattaagaaaatcataaagaagagaaaatatatttactattctttaagtggaagttgatcatcataaaggtcttcatcctcattgttttcatattaagtaggctgaagaggaagaggaagaggagaagttggtcttgctttctcaggtgtggcagaggcagagaaaaatccgtgtataagtggattcatgcagtcaaacctttatggttcaagggtcacctgtataatgaaactagaacttattttcaaatgaagtttgaaattaactcttaaggagagttatggagacacaaataaccagccacattggctttggaaattggccagaggccttaagtgcactcacatgtttcccttcgtgttcatttctgagccctgaaccctttcaggaccctgatagataggcggcaaaaggaaacaatgcctagatagtagattaggatatcccagtagatcttaaaacccttcctggtagatctccaagccaggggctgacacaacacacttctagcaagttttcttctaacaaggtttgtcagtattctcaacagtggcctctcctccacttaaggcctttactgccatcactcttcgaggtcttaaaacacagacctacataaccatttgcaatttccaggattccttaaaataaaaggagtatttcttctcaaaaatgatatgaatttctaggataaaagataaagcagttttgcttcttgaatatttttgtaatgattcaaaacccttctctatgcaaaacagttgcaatttcacatgggctttccagaggccccaacctctctttccagttctggatccatagtttggtttccctctaaaacctttatcttgatgccctacctggacctcaaactcaatgttctgaattccgaatttattcttttttcccagaaaacttttgcctccacctatgttcccacactcagtgaatggcactgcccagttgcccaaagtagaaacctcatccttgaatcttgcctcttcatcatattgcacatctcatcaccaaagaccttcgtctacgtttccactgccactgactcaagctcaagctcccaccatctcctgcaccattctcctaactgatctccctgatgttaccccctccaccactgataaacagcaatcttcccatcatgtcactcccctgcctaaaagatttcaacaacattcctgttacccctagattctaagcatggcacacaaggcccttcatgatccaacaaaactccaacccactttcctactctcttctccacccatcccttaactactagtgctctatactataaccatatggaactatgctactttcagtatgtcacatggactatgaccttttttccctccattcctttgcaaatacttttcctttttttagcactcagccccctcactccattccccccatacacacacactttatctggtaaatgatatatcttcgaaattctgctgaaatatttgcttccccagaccctagatctccagccccttagccctgctgtgtgtcctcatagctatttatgcagcactggtcttacaatagtattattatttgtttatatgtttaactccctcacaatactatgaacttcttgaagacaagattgttgtcttatttatctctgccaatagtgcctggattattattatttgtaaattgaataactgaatgagtaaatgagataactttagctaaaaacaaaatgtaggattacaggaacattgaggagctagcaaaggacatggccttgagtaggctgtgtcctcagataatacattagatagtcatctacctcctgtgcactggacttgccttgattttgacccaatctccctaccaaaaacattaccttcctggtccgaccaacttagaagcaaaacagatatcttggttctgggaaccttagtcatgggtttctggctagaggacaaagctgcagtgcgccttatggttcctgagtctcagccagtagaatcattaacatatgagtaatctcaagagctagaatgtagatataacgctatttcatataaatcaatggtatttagacagccacatgaattctctaaagacaagagtagcatagtattattttccacagctcctaatgaaaaactaaagaaggaaaactgcttcaaaatgtctgtgtaggcaatgtaacaaggatgaaaaatgatgtgagaactgttataggtagttctcagttatctgaaccagaggaggtaagcttggcacagataatccaaaaggcatttctgtgagcataaaatagtgcctattcataatgcatcttccttcttggttctatctttcttaggcttggctgagcatgggaagtaagggaggttatctcagggataggaatgttttggatgtcccttcaattacatattcccaaaagtcagggagcatccttttgagggactagcagaagtaagatacaaaataattgtatgcagaaatatgagtggatgggggaacacagaagaaaagagagggacactaaatccagggagaaaaagaatagtttcagggccataaagacaaacgttactgatctcacaatgacctgagatccttgttcctgagactataatgtctgacggacacaaataaagaataaacaaaatcaacaataaacatcataagcttagtattttttgctaaagaaatttgatgtgatgttttatacttgcttaagaagctcaaaagaattgcatcagctgtaaaatttccaggttccaacacgcatactacagaactatttcacagaagcattttatacctctgagaggctgagaaaaaggcttccaaagattggtccagtctctttttctcttggaaagctcttggcacaaatgtattccttctgaaaatcctagagaaagaattactggttttcatttggcacagtatgaaaggaagcagtacaatattatttaccaaagctacccattctcttccattttttattccttttgataatataaataataatataaatataaataataataatataaatatgtcatggttcatcagtaaggtagaaaccttaaaaacctttaataatcactttaacaaatgattttttttatcccaccacttctatccacctagcataatgctgaatagtagcatttaaaaaatgaccttagacatgtcaagctagaaaggtctttaaagttcttaaggctgaggtttcaggttctgaaaaatgaattggcccatattttgtcaagttggtgagtctcctaatctgtaattctacttaaaatgtgggattcgaaaaatctaaaggctagccccagatttatcgcgttaagccttttctaccctgtctcaattcttttatctgcataatggcagtaatatactttgtaccctatcttgcaggaataaagaagaatggcatagtgatgtaagctaaaatcaaaatgccgagtatgactgggcaattgcctaaagctaaaagaactgctctgtatataagtgattaagatgcgggaggaaagcctcttccttttgtgcccacgcagtcacagtgctttgtgtaaggctttacccaacagaattgaaagagtcaatgtaccttcccatgttcctcatgtactcacccacccaggagaatgcagtcagttctatctacttctcacatcgattagcaagtcaacaagtcacggcattaaatgctaatcagaacagcggcttttgtggtatactctctgggccatattgtgacgagaaagaatgaccacaggcattaggctctgtgttgtgtggctgtttcctcaccaataaagtgaacataataattgcccctaacttatagaattgttgtatgggttacatccatgaaaggcacctagaacagtttctgccacatagttagcattctgtaagtgcttgccactaccattatgctcttactagggttacaggaaagcagacttctgagacatagaacgaagatctttagctgccctagctgatgtctcccatgccttggtgccaccttgctcatctctccaatgtgctaattttggttttcttctatgagaatcagaacctgttcccaggagaggagctgggaaactcatttacactctatgaaggtagaaacggctgatggacaacgtctctcagacatctctgtggtttaggcaagtgtagaaggcctcgggccaaaggaaggaagtcttgtttttggaatcgcaatactggtgatcagaaagcggaggttcatttccttccaacaatcctaactacatagccagccatccgcctatcccacattttgctaaggttaggcccattgctgcagagaagaatgcaatcagaaaagctggaccaatgcatttttatggctttactgggcatatattttggagaatcataaaaaggaaaatgacattctctttattcacaagcaaacggaagtgcctaaaggcagcttaagctaaacagacttctttggaaattcttgaagtcagtggctccaccaaaaatatatctacattttcatttcttaataagctgagagaaagcaaaaagcatacgtattttctgacatatttttaggctcccctggattcatagtacatattgaatcttagaattgggaaactaagcttagtttacggtcttgcatttgtttggcttaagctggtgactactaggaattgggaggaatggccatgtatctagttccaatttcctttccaagctctcccttcacctgcaggcccatttcctgaggccattgccatatggctggatggacccagtcatttgtgtgtatcatccactaggagggctatgaagagaaagcaaaggacagccattggagagcatgcagaatatttggttattttgtgggagatcatgggaaagattttttgtggccttaaagacaaacaaataaaaagataggatagccactaccctcactgacagcccacataaatctaaagtcagtgttccccaaattcaagcttccctcatcacttgatcgtaggggctgtccccgccaagtggatgctcagaattctgtggtacaatggacctattttctgaatgcaaaaacaggacacatggtctgaaaatacgttttcttttctttctggcttttctaaggcaatcctgaggattcaatcccagctctgacagagattagctgtgtgaccttgggcaacaacctgtctgagcgtctgtaaaatggcaatgattatagtatctacttcattgggctgttatgaaaataaaatgagatactgtgaaagtgcttagcacagtgtctgataaacagaaatactcaacaaagtgtaactattaattatgataaatgattaaaattgtataaaagcatcaacatgaaatcacatttagttagtaatttcacatttagttactaattttatagaaaagaagaaagatacacgaaatttggattgtcctagaaaatcctgggtgttttatcactgtatctgtattcactgtctccccttcagattaataaggcatcttagaagaagagacagaaagaagacaaaaataggaggcaaaggcaaccttctcactgaccccataatttcttatagctgctgataagctatttggagctctgtagatctgattttgtttctagaacccatctgttttcctctctgaatgtgctaacttgaaattagagaagatttccataaactatttgtttcatgatgtcatctaatatgaatctgaaagttcaaaattattgtttaactggaacctactgaaatggaagaccattcagttattctaattaatattattcaaaaggtaacctaccactttacacttccaagcactttccccatgtcttttatcatcattcatacttaatgaggagggcagtgcaggtatattgttgttactttacagattttaaaaatctatatttttagagagggtaagtgatttgtccaagttcacacagctaatgagcagtgaacgcgggactaaagcccgtttcctaacacccagtccaaaaatcttccattacaccagaccactgcacacctttaggacaaaagattattatatccttactgacaatgaaaggctcagcttcagagaaagttttggggccaatgaataatcagttcctcagactaacatccacccttgacgagcattcatgtgccatgctctgggctaagcctattaaatgcatcatttcctttagtcgtcacaaaaattttaccaaggaagtactgtcatgatcctcattttacagatgaggaagtagaggcatgaattaagtaatgtgttcaacatcgcattcctagtaagtggtggagccagtgctagacgccctgattcctaactcccagtgaaagtgttcttcctgtcactccatactgacagccactttcaactctcctattagcaaagaaaggatgttacttttaaagatgctttagggaaaaagggtaactcagtcctctctcaattccacatacaggcagagggggagaagtttagaatacaagcacatcatgcctaatcccaaagccatgaatgtgcaaatgtgggaggacagttaggaacacagagtccagcagagagaactcagggatagggatacatcctctcttacttattcatgccttgggcgtcagtcacatctggttctcagccaaatagaagggcaaagtaggtatagtcagtctgtagtttccttcctcctatggggagcctggggccctaaccacgtttcaacctaccccacagacctcatcaaaactgctctgttcccttttccctagaattccactagatgcatggagccaagtccaagtgttcatggctagggagaatagtggctacccgcctcagtgacatttgctttttaaagaagttccttctaggccttcacctttgagcctctgaatagtgggtgcagaagcaaacctgctttccacccttcccatcccaatctgaggtggggacagccagttaggcgggatgctgaagggttgccttggctaactcactagtaattggaagttgacctttctcattttcttgcctccagaaatcctcccctggggatacaaatgtgtgcaaatcaccctaaagacaggacaggtgaagctccaagtgcacatttagactgggaaagggaaaaatcagttcattatttcaagacctcttgagatgctgtaaatacacagtcaacacagaacaaagatccctttttcccccttacattatttatgtgccatctaaaaattacacacccgttctctttccagcactgagagagagaaacatgcatattcatgatctgataaatatttaagtgggatttatttaaatgagagagtccatttacaaacattccctggctctgagatcttatcctgggcacacagagggaggataatttcctctggtagattcaaaacctccgctggccacctgtccccctaaacttggagctcttccttgagagctggtgaatgccacccgcagtatttcaagggagtcttccgtacctcctccctacagtccggccttcctgctctgagctcatgtcataggatcagtcgttggcaaaatgctagagctggcagtttatttggtagtcgggggaggaagtcacagctttctttgcctgggcccttcgtccccaccacataagcccgatggcagcacccaccactgatattcctagctttcttgtgggaccatcttcccctctcaaggagaacagttatgtgatacaccaggtaaccaggactggttgactgtgctgcccctctctcaggaagacatgcattttaatgcttcaaaagcgttttgtcagtacctgttttcaaaggacttatacatagagtgtttccattcactcctcacaacaatcagatgagaattgacaagaattccaaggcaaaaatcattttcccagccttaaaaatgaagaaataaaaaagagaacccctgcttgcccaacctaagtcacacagtttgtaagttgcagagttaagacttgaacttaggtctgactctaagatctgggatcttttcattatacaaggctgcctctcatcaggaaggaggactggagagaaagcaatggtaacccaaaaggaagactaatggtgacctatcaggcattgtggccacgggggcccaagacctcttcattcctatcatatagatgactttctgtatatgaacttaactctggactttccattctggtgcccattcttggacatcactctgtctctagtcctatcccacttcttctcgctcaaattaaactcacctgttttgtgtctcattttatctagactttatgagatgatcagtgaactcacccatagagctaatctgggctaaggcattaaattaaatgctgattaatggctcaatatgcaacctctcttaggtcatacacattttttgacagaagcttctaaaactttactcaaggatactgtatatgacaaatacttcaagcaatgagccaggccagtgagagcaatatcattgggcaaatgggcttctcaggcctttaacttatgctacctaagtgaccatctattctgcctaatttagggttaccagatgaaatataggacatcccattaaattcagtttcagatgaataacaaatactttttaagtataagcatgtcctaaatatcgcatgggacatacactaaaaattatttgttgtttatttgaaattcaaatttactgtgtttcctgtctttttatttgctagatctggtaacccaaacttaattgtaagatctgttccgctgcgcataaccatcaaaaagtacctattaggcatctgcttcctcatgacacttgcttgtgaccaatcctatagcatggaacactggtggaggggtgagggcaatgagaaagaaaaagcgaaagcagacatgggaaagagtatcccatcatgagactggtcttacctagtcacttgtccatgacataaaagtaatgtcactaggtcttttcagaaaatagaactagtcccatttgcctctcatcaccaacccctcctcccatctgctatgctatactgttctgttctattttgctttttgataaatgaaaaaggaacatgttttggcaaatgccagcccctgtgttctctaagtgatctgggcctcagaaggcatatcccaagcaaacatcaaggtgggatggagggcgctaccaggccactgcacagacagtgaggctgcccaaatgtaattaagcaccaggcgcagaccccaagagtgacagtgggaagaattccatgaccaaaaaaatattagggaagtgaagtggagaatgtttacaaccctaattagcaatttgcacaacaccagaattaaaatttttcccagtgtcaagcaagtttgtagactgacactatggaagctaaactgggcccatgggaaaaggcagcactaggctcctgctagtcagtccagtccagtggctaacgcacctaccaaggcattcaaattgagaaaatgactaaattagaacacaaacagtagactgactcatatgtaagataacaacagaagcgaaggaatgcaaactccagaaatgaggcctttgagtagcaataacaaggataataacaataataataacaataataatataacaatattataaataataataacaaagataattataacaatagcaaacctatgtgagcacttatgtgtcaggcactgttctatatactttgcatgaattcgctcatttaatcctgatgacaatcctatgaggactgtcatccacattttatgggacacagagagattgtgtagcttgcccagattcacacaactattgaatgatgaagcagaaaatcaaacttaggcagtcaggggccaaggcccacatatttgaccactaggctttaccacttctctaatctgttcttgaagacattttcccagaagtgggatggatttactgagcccttcccaccacattttccagtatttcactggtgcaagagacacccatttgtcaaacaggtagaaaggttaaaggtacactgcatggatctagggcagaaggagcctagtgactttctcagcatcatcatgttctaattaaatgaactaaccaccactgggctcttgaaagtatcctagaactacgaatttaaagtgtgaattacacggacacttaaagagatcatacatatctgatagtactttggaacttggaactgaccttgatctgttaagttggctgatatcttagttatcctttaagacacatattaacacctcctccatgaaggctttcccattttcccagttggaagcatttgttcctttaagctccaaatgtgccttttcgtgtatcattgtatctagcttctatctgtctctccaaaaagaatgtaagcattttgaggccaaggattattttatttatatttatatctgcatacatttcccccaaacatacacattgagtatttttaaaacaaataaatttagtctaacccattatttctccatatgaaaagacaaaggcccagagagggaaaatgacttacctagggtcacacagcaggtcagtggctgtctcttgactctcaatccattgctccatccactatccaaggatgcatttctggagattctgaatgggtgcaatttttctcctccatattcttgctattctagtgcattttcttttagttccagaacctgctggtttcaagctttcttttttgaagctcatttggaaaacagtcactctgattcctctccttacaacctactccctcccttgggattactttttccatcctttccataaactctcatatctaggtgatgattttgagactattacattttttaattgacagagatgcagctgggtcctgtataacagctgagcaacacagaatctctccccctttcctccctcactgagccatgagctgatgaaaatttgtaaactatacagaggtatgcctattctatgccagccaatgcactaaaacaattcatggattttatcttatgtcatcctcacaataattctatgatctaggcggtgttactgtttttattttgcaggtgaggacatagaggctcagagagcttaaatgatgctcccaaagttacacagataatacaactggaatttgtatccaggcagtctaactttagtgctcatagccttagtctttacataatcccctctggaacatctcacatgacataattctgccagagaacttttcctaaagtatgtcattattgtgtccttccctactgcctctagagctgtacctctagagcagtgtattagagacagtatggtaactactagacacatgtcgctatttaaacataactttaagttaattatgattaaataaaatttaaaatgaagttcctcagtttaattacccacattgcaaatttcaaaagctagatgcagatagtggctactgtattggacagtgcaaatagagaacatttctatcattgcattttatttctgcaatgaaagctctattggacagcaccactctagaaactaaagtttgaactcctctgcctgttttttttttaactttttttttaattattaaaaaaaaattgtgagtacattgtaggtgtatttattcatggggtacatgagatgttttgatacagacatgcaatgtgaaatacgcacatcatggagaatggggcatccatccccttaagcatttatcctttgagttacaaacaatttaattacattctttaagatattttaaaatatacaattaagtattattgactatagttgccctattgtgctatcaaatagtagatatttcaagtgccctgcagtctggttcctacaaacttttcagcagaaaagcagaaaacaagaagcgaggaatgaagctagaaaaaggggtaggagtctgaggatgaaaggtctcctatgccacactaaggaagtaaggcctcgtgatgtaggaaggacacaatggatttcctctctgagaatagatagagccagtgcatgttgagacctggctcaaactcgcctctctcaggaagcctgagtaaataactacagaggtctgaatatcatgtcactctgttgactggttgctccccaaaagtgacaggaagggttccaacacttacagagaatacaaaggtctcacattcaaaatggattcaaaggacctgttctcaaatcacagttctatgtcgtgttgggacctgccactttgcatcactgagcttgtttacctatctgtgaaatgcagccaataatatctactttcctgattttcatgaccatcaagtaagacaatgaggaaaatgagataatgatgtggggtggggcctagacttttaacttcctcatgtgattctagggaatgccagggttgaaaatccttgaactggatgatctctgaagtcccttccagctttgaaattcgaatcaagctttgactcatagtaagaaaagtcagcagtcattttgaacaaaatagttacctaggtccccacaacaggctgcaggcttcataagcagtcaacgtttcaacgatcacagatagcccagatttccaggtaaagcagcttctttgatgagagtgcagaagcagttccatgtacaatggtgagcattctactcttgagagtgcaggatcagttttggcttcttggaagagtcccctccccaccaggtggcagatgtactccaaaaccctagacaaggactataccaccatttgtttttattgtcctcaaaataagtcatttaaaagagtcaatggatattaaccccttgtcacatgtatagtgtgcaaatattttctcccatgctgtaggttgtgtccccactctgttgattatttcctttgctgttcagaagctttttactttaatatagtcccatttgtctattttggtttttgttgcctgtacttttgaggtcttagccataaaatctttgcctacaccaatgtcctgaagtgtttcccctgtgttttcttccagtacttttatagtttctggtcttacagttaagtttttcatctattttgagtttatttttgcatatgatgagaggtatgggcctaatttctttcttatgcctgtggatatccagatttgccaacaccatgtattaaagaggctgtccttttcccaaatgtgtgctcttggcatcttggccaaaaatcaattggttgtaaatgcatggatttatttctgggttttctattctcttccattggtctatgtgtccatttttatgccagtttcatgctattttggttgttatggctttgtagtatactttgaaatcaagtaatgtgatgcctccagctttgttctttttgctcagaattgcttgggctattctgggccttttgtggttccatataaattttagcatttttttctatttttatgaagaatattattagtatttcaatagggattgcattgagtctgtagatcactttgggtagtatggatattttaacaatattaattctcccaatccatgaacatgggatatattcctatttatttgtgtcttcttcattaagtgaaataagccatgcacagaaagacacacactgcatgatctcagtcatacatggaatctaaaaacattgatcttatagatgtagagaataaaatggtggttaccagaggatagggtggttaggagtgggagtaggtgatgggaagaagttggtcaaaggatacataattacagttatataggaggaagaaatttcaagaaatctattgtgcagcaaggttactataggtaacaatattgtatttttgaaaaatgtaaagacagtggatgttatgtgctcttaccacaaaaataataataataaatttgttaattagctagatctaaccatgacacaatgtatatgtacttcaaaacatcatgttgtacacaataaaaacatacaatgttatctgtcaattaaaaattttttttatatagagccaacagatttcaagtttggacgttggttcaaagctttctcctttcatatggaattgctttgtttcaaggaaatagaagtttcaaaacagcaggcagatggatgtacagaagtatgcaaggtgaagaggactgagaggagctggcagagggaggaagaagtaggcggggaatattctaactaattcagatagcatccctacaagccccagcagaatagcacaacaaagctgatttcccagcatgttaatttcccaaagacttctctattagccagccctctgcacatcaacaacatatggggacctggagttctacctatggctcaggaactctttaaggtcttgaagtacctccctaaattaccaaagaaagacaaaattatgttcaaattgatacaacattataattatattttgctttatatttactctttgaaaatcacaaatccctataaagtgaatagggaagcactctgttaaactagactatttgatgaatcaaggtactccattcccaactgtgcataaaactgaaagtttgaaggattgtagacatttgtaactccatcttgcaaccagagaaaaagaatcaaatgaagatcagcagctcacacttcacaaatgaatatcatagctccaaatagggctcccagggcaaatcattcatcactttcttgattctcaatcacagccacactcctgagttcatcttgaaaagacaccctaaggttttagacatggaaaccaaaacacgcagacatttcttcttttcactatagtctcactttatttcacattcatcttttgcctctaaactgtacaaaaaaaccacttcatctttttttgtggtgcttttgggtctggctatcaaactggttctgtggcggaatgccaaattaaatacactcttttttattattaaaaataaggtagctgaggattagttcatcaaaattctcgggtaatggactgttctaattaaaagaatattctgataaactgggtttagctgcaactacaagaatgttgaaacaacgtatctagtttggtctacttttggcatattttctgaaatgtctggtttcatgtcccaccttaaaaatatgattgaatcttcggtacttgaggctctttcagggttttagagttattattttgaacatctatttttaatgtccagagttagaaatgaatatagataaaactatacatgagctgagttctggacatagctttggtgaaatttccaatgtgagaggtttattgtgtattgcctcttttaagtcaaggacaacggaagaggacaattatgctaactgaagtttctggctaaacaaaatttaatgtaacaatacattcaacttttccatacattttcacacctggattcacttgatcttcattatactctcgggagactgactcttcattttataagctgaaacctagagatgctaagtgacttactcaaggccgagattatcaagtttttgaagtcccagtctagtgttcttttcagcacatgcaatatccatgtcaattctagttttactatatttgtattgacttcctcccaagcaggccacactgagctcagctaatctcaacacagtaggagtaatatatgaatatatactcaaactttagtagcactcagaatagcttaggtgaaagtcatggctaagataatgacagctgccagaagagtgtccttaagcactccagttgagagctatttattttgcataatatgatcttggcatactaaatgttcatttgcatcctcacattgaggacactttacttgtctatggcatcattgtctgtggaaataaattttcttcagaaggttttagtgtctctaacaataactgctggacttctgagtggccaaagaattctagtatttgaaaagaagggagaatgtgtgttcttagattgcttgtatgtcttttaagaaataaaaagaaattatctctgttgatctttatagtaattttatgaagttggtactgcaggtgtcatgattccgttttacagaagtgattcctgagattaaacaagcttgtcatggtaccttaaacctagccacacattccttttcctatggtgcttactaaagctcacttatcatcagaatgccctaggagcatgttacaaatacatatagccttcccagctccttccctgacatcctgaaaattgcctgctccaccaacttcataagatgactatcaagatcaactgataaaattttaattttcttactgaaaatgaaggaattaagacactaaagaatggcagctgcttagagcaataatttaatgattacctgctctgtgatgaacaccacatcccatggtggaggttggataggaataaggacacacaagatacataggactcagagtgtggccttggagagtttataaggtagttggttgccaactaccttatagcagtagttgcaagaaccaactctagcatgcctcagaaatcatctggaggacttgttaaaacaccaattactgggcctcagcctcacagtttctgcttcattaagtctacaggtggaactctgagaatctgcatttttaacaagttcccaggtgatgccaatgctgctagtacaaagaacacaatttgagagtcactagcttaggcatcatttaaaattgtatgactgtcttggagttaaaagtgatatttcagaatatatgcatgaaagaaaattaaaacaaaaggaaacaatgatctgtagtattatacggactaccctgtgtccccctcctctttcccttcactgccctcacagggctacatgtccatgcactgcagtcacagaaataaatctttctgatatctgaaaaacaatcccattttcttaccacaaatgcactggctggcaccacttcaaatggaaacatttgcttccttcactgcctggtttctctagaaataggaaaaccctctgctttagagtccagaaggaggcagaagagaggaccacctctccccatcgccaaaggcagcgtttctcatactccagtcctcagatgaacagtggcagaatcattcggtgtctttattaataacgaaaattacaggctgggagcagtggctcatgcttataatcccaccactttgggaggccaaggtgggcagatcacttaaggccagaagttttagatcagtctggccaacatggcgaaaccctgtctctactaaaaatataagaactagttgtgtgtggttgcacgtgcctgtaatcccagctactggggagactgaggcaagagaatcgcttgtaccagggaggtggaggttgcagtgagccgagattgcaccactgcacttcatcctgggtgacagagtgagacaatgtctcaaaaaatataataatgacagattaaaaatgaaaacatgggtggctggcaagacggccaaataggaacagctccggtctgcagctcccagtgagatcaacacagaaggcaggtgatttctgcatttccaactgatgtacccagcttacttcatggggactggttagacagtgggtgcagcccacgaaaggcgagccaaagcagggtggggcattgcctcatccgggaagcacaaggggtcggggaactccctcccttagccaagggaagccgtgacagactgtgccataaggaatggtgcactctgacccagatactatgcttttcccacagtcttcacaatccatacaccaggagattccctcgggtgcctatgccaccagggccctgggtttcaagcacaaaactgggcagccatttgggcagacaccgagctagctgcaggatttttttttcataccccagtggcatctggaatgccagcgagacagaaccattcactgccctggaaagggggctgaagccagaaatccaagaggtctagctcagcagaccccaccctcatggagcccagcaagctaagatccactggcttgaaattctcgctgccagcacagcactctgaagtcgacctgagatgctggagcttggtggggggaggggcgtccaccattaccgagacttgagtaggcggttttcccctcacagtgtaaacaaagccacctgggaagttcaaactcggcagagcccactgcagcttggcaaagcagctgtaaccagactccctctctagattccccttctctgggcagggcatctctgaaagaaaggcagcagccccagtcaggagcttatagataaaactcctatctctctgggacagagcacctggaggaaggggtggctgtgggcacagcttcagtagacttcagtgttcctgcctgctggctctgaagagagcagcagatctcccagcacagtgctgaagctctgctaagggacagatggcctcctcaagtgggtccctgacccccatgcctcctgactaggagacacctcccaacagggggcaaaagacacctcatacaggagagctccagctggcatctggcaggtggccctatgggacgaatcttccacaggaaggaacaggcagcaatctttgctgttctgcagcctctgctggtaataaccaggcaaacagggtctggagtggacttccagcaaactccagcagactggcagcagaggggcctgactgttagaaggaaaactaacaaacagaaaggaatagcatcaacatcaacaaaaaggatgtccacacagaaaccccatctgaaggtcaccaacatcaaagaccaaaggtagataaatccaagaagataagaaaaaccggcacaaaaaggctgaaaattccaaaaaccagaatgcctcttcaactccaaaggatcacaactcctcgctagcaagggaataaacctggactgagaatgagtttgaggaattgacagaagtaggcttcagagggttggtaatagcaacctcctccgagctaaaggagcatgttttaacccaatgcaaggaagctaagaaccttcaaaaaaggttagaggaattgctaaccagaataaccagtttagagaagaacataaatgacctgatggagctgaaaaacacagcacgagaacttcatggagcatacataagaatcatagctgaatcgatcaagcagaaaaaaaggatatcagagattgaagatccacttaatgaaataaagcgtgaagacaagattagagaaaaaagaatgtaaaggaacaaacaaagcctccaagaaatatgggactgtgtgaaaagactaaaccggcatttgattggtgtacctcaaagtgacagggagaatggaaccaagttggaaaacactattcaggatactatccaggagaacttccccaacctagcaagacaggccaacattcaaattcaggaaatacagagaacaccacaaagatactcctcgagaagagcaaccccaagacacataatcatcagattcaccaaggttgaaatgaaggaaaaaatgttaagggcagccagagagaaaggtcgggttacccacaaagggaagcccatcagactaacagtggatttctcggcagaaaccctacaagccagaagagagtgggggccaatattcaacattcttaaagaaaagaattttcagcccagaatttcatatccagccaaactaagcttcataagcaaagaagaaataaaatcctttacagacaagcaaatgctgagagattttgtcactgccagtcctgccttacaagagctcctgaaggaagcactatatactgaatggaaaaaccggtaccagccaccgcaaaaacatataaattgtaaagaccattgacactatgcagaaactgcaccaaccaatgggcaaaataaccagctggcatcataatgacaggatcaaattcacacataacaatattacccttaaatgtaaacaggataaatgccgcaattaaaagacacagactggcaaattggatcaagagtcaaggcccatcggtgtgctgtattcaggagacccatctcacatgcaaagacacacataggctcaaaataaagggatggaaaaatactttccaagcaaatgaaaagcaaaaaaaaaaaaaaaaaaaaaaaaagcaggggttgcagtcctagtctctgataaaacaaactttaaaccaacaaagaccaaaaaagacaaagaagggaattacataatggtaaagggatcaatgcaacaagaagagctaactatcctaaatatatttgcacccaagacaggagtacccagattcataaagcaagttcttagagacctacaaagagacttagtctcccacacaataacagtgggagattttaacaccccactgtcaatattagacagatcaacaagacagaaaattaacaaggatattcaggacttgaactcagctctggaccaagtggacctaatagaaatctacagaactctccaccccaaatcaacagaatatacattcttctcagcaccacatcacacttattctaaaactgaccacatgattggaagtaaaacactcctcagcaaatgcaaaagaacagaaatcataacaaacagtctctcagaccacagtgcaatcaaattagaactcaggattaagaaactcactcaaaactgcgcgactacctggaaactgaacaacctgctcctgaatgactactgggtaaataacaaaattaaggcagaaataaataagttctttgaaaccaatgagaacaaagacagaatgtaccagcatctctgggatacagctaaagcagtgtttagagggaaatttacagcactaaatgcccacatcagaaagatggaaagatctaaattcgacaccctaacatcacaattaaaagaactagagaagcaagagcaaacaaattcaaaacctagcagaagacaagaaataactaagatcagagcagaacgaaaggagatagagacacgaaaaacccttcaaaaaatcagtgaatccaggagctgctgttttgaaaagattaacgaaatagaccactaaccagactaataaagaataaaagagagaagaatcaaatagacacaataaaaaccgataaagggacatcatcactgatcccacagaaatacaaactaccatcagagagtactataaacacctctacgcaaataaaccagaaaatctagatgaaatggataaattcctggacacacacacccttccaagactaaaccaggaaaaagtcgaatccctgaatacaccaataacaagttccgaaattggggcaataattaatagcctaccaaccaaaaagaaccaaggaccagacggattcgcagccaaattttaccagagatacaaagaggagctggtaccattccttctgaaactattccaaactacagaaaaagagggacatctccctaacttattttatgaggccagcatcatcctgataccaaaacctgggacagacacaacaaaaaaagaaaatttcaggccaatatccctgatgaacatcgatgcaaaaatcctcaataaaatactggcaaaccaaatccagcagcacatcaaaaagcttatccaccacgatcaagttggcttcatccctgggatgcaaagctgattcaacatacgcaaatcaatacacataatccatcacataaacagaaccaatgacaaaaaccacatgattatctcaatagatgcagaaaaggccttcgataagattcagcacccctccatgctaaaaactctcaataaactaggtattgaaggagcatacatcgaaataataagatctatttatgacaaacccacagccagtatcatacagaatgggcaaaagctggaagcattccctttgaaaagagacacaagacaaggatgccatctctcaccattcctattcaacatagtattggaagttccggccagggcaatcaggcaagagaaagaaataaagggtattcatataggaagacaggaagtcaaattgtctctgtttgcagatgacatgattgtatatttagaaaaccccatcgtctcagcccaaaatctccttaagctgataagcaacttcagcaaagtctcaggatacaaaatcaatgtgcaaaaattacaagcattcctatacaccaataatagacaaacagagagccaattcatgagtaaactcccattcacaattgctacaaacaggatataatacctaagaatacaacttacaagggatgtgaaagacctcctcagggacaactacaaaccactgatcaaggaaataagagaggacacaaacaaatagaaaaacattccatgctcatggatagaaagaatcaatatcgtgaaaatggccatattgcccaaagtaatttatagatttaatgctatccccatcaagctaccattgactttcttcacagaattagaaaaaactactttaaatttcataagggaccaaaaaagagcccatatagccaagacaatactaagcaaaaagaacaaagctggaggcatcacgctacctgacttcaaactttactacaaggctgcagtaaccaaaacagcatggtactggtactaaaacagatatatagaccaatggaacagaacagaggcctcagaaataatgccacacatctacaaccatctgatctttgacaaacctgagaaaaacaagcaatggggaaaggattccctatttaataaatggtgttgggaaaactggctagcattatgcagaaaactgaaactggaccccttccttacaccttataaaaaaattaactcaagatggatcatagacttaaatgtaagacctaaaaccatcaaaaccctagaagaaaacctaggcaataccattcaggacataggcatgggcaaagacttcatgactaaaacaccaaaagcaatggcaacaaaagccagaattgacaaatgggatctaattaaactaaagagcttctgcacagcaaaagaaactatcatcgagtgaacaagcaacctacagaatgggagaaaatctttgcaatctatccatctgacaaagggctaatatccagaatctacaaggaacttaaacaaacttacaggaaaaaaaacaaattaccccatctaaaagtgggcaaaggatatgaacagacacttatcaaaagaagacatttacgtggccaacaaacatatgaaaaaaaaagctcatcactactggttattagagaaatgcaaatcaaaaccacaatgagataccatctcaagccagttaaaatggcgatcattaaaaagtcaggaaacaacagatgctggagaggatgtggagaaataggaatgcttttacactgttggtgggagtgcaaattagttcaaccattgtggatgacagtatgatgactcctcaaggatctagaaccagaaataccatttgacccagcaatcgcattactgggtatacacccaaaggattataaattattctactataaagacacatgcacacgtatgtttattgcagcactattcacaatagcaaagacttggaacccacccaaatgcccatcaatgatagactggataaagaaaatgtggcacatatacaccatggaatactatgcagccataaaaaagaatgacttcatgtccttttcagggacaaggatgaagctggaaaccatcattctcagcaaactgatgcaggaacagaaaaccaaacactgcattttctcactcacaagtgggagttgaacaatgagaacacatggacacagaaaggggaacatcacacgctggggcctttcagggtctggggcactaggggagggatagcattaggagaaatacataatgtagatgatgagttgatgagtgcagcaaatcaccatggcacgtgtatacctatgtaacaaacctgcacgttctgctcatgtatcccagaacttaaagtataatttaaaaaaaatatatatatatatataaagataaagataataataaataacggaaattgcagtgacccactacagaccaagtgaatcagaatttctagaagtgagacctgggaatctggaatcttaagtgccttgagtcattgggcttttctgaggcacagtgaaattggagaatccctattaaaagaattttcccaatattcggtttggataaggacactaaaaagtctgatttctcctaactgaccaccacttcccctttcctgcgtcttcatgtcccttgagaaaccttgtgagactggaagagacacaaggctcctccctccttcacccttacacatgaccaccctccacccccccaaccaagacatgtaaatccatttggactgagacatttctgaggttgctaaagtacccaccctagtccctgccaaattccacccagtgaggaaaacattcctttattttttaatgcactttttataatttttttatcttctctgttctaaaatgtttctctctcctgcttctttatgatatattctggagatatttcaaagccatttatacttcatactgatattggtgttttcactgttctgtgaaatgccatagtttatattgaaatgatgcattaagatataggagaaaaagagacattgagagaggaaaaaaatggtgaggaaaataaccgagagcaacattatgagaaagatgaacagacccaagggttggaactctccctcctatagcactaaaatattatcaattcattacttggcatgcacctcttctttctagggtggggaagactttggaagttaggggatgaaatgcaattctttcacctgctttaccagctatgggtctgcccgagtttttgctttttggtttattgtcaagttacagcaaatatatattttgtgtcttctgggctagtcactatataacttacagtttttcattgtgagcttctcaatacaattccacacagagtagattaactaatgaaggtcagaaaacactatggagatataggttgctaggacacagaaccaaacagatgagtcctctatatgggagggggcacccaacatgtgcaattcactaatgctcagttttaattggcttctaaattctgtttctcttgctccctctcctcaaaggactgtgtgtgtgtgtgtgtgtgtgtgtgtgtgtgtgtgtgtgtgtaagggtatatgtataaaaaaattatttgcattagacatcataatcatgttctcaatttatatagcacaataacttttacatttctgcagaggatcttatccaatgctctttttcgcattacttttcaggatcatgcaaatattactgagaatttgaataaaatctgtgaaagtaataaaaagtcatccctacaataattccaaatggagccagaccttttgaaggtggccacttataaggtggggttaatgagcatccaaagtctttctctgacccaaaatgtgtcccttgatttccctgccacagctatcaaaatccatttgttacaatggaggggggtcaccctttgaggctaacacagtggagaactctgctataagttaaagctttaacacacaggcatttattcaattagcttctatcacttcacaaggccctgagggaaacaggacacagaacagattaagctttattggttttaatagtggtagtgaatggagatcaggaaagacctgaaactgggcacactggcatagcaggctgacctggacaaagcaccctactgaggagaactgaatagccaggaactgaaaagccttgaaggtgctggaagcctggtagtaggtagatatgtatctattaagataacaaggctgcaagtagcaaatcttgactatctgtgctttaaataagtagtaaaagccttcaagcaggtagttgtaggcattgtttctgctgcttaagaataccatcaaatggcaacaacagacaccgggaactactactgagagagggagagaagaaggcaagagttgaaaaactgttgggtgctatgctcagtacctgggtggccaaagcaatcataccccaagcttcagcatcacacaatatacaaacctgcacatgtacccctgaatctcaaataaaagttgaaattatttttaaaaaaagaaaagaaaaaaagtacaatttttaagagaaagtataaaagaataacatcaaagacctaagctcttcctttttgcttctccatccttatcacctggctttcacctatatgcttgtttcccattcacatctcgtttgccagaactatattgcatggcccgcctcctcaatatcagttgcaagggagcctgggaaacaaagtatctagctgggcacattgccaccttaaacaaaaccaggattgtgttagcaaagaaggaggaaatagatattgggtaggcaacaaacgatgcctgccaaagaccaaaggagagctctggctgcccttagatcaaccatattcactgggcacctactaggtgccaaacactgtaccatgtgcttggagatctgacttttgcctcaggctaaccagaattcagagaatgaagctactccagagggataaattaccaaaactagcatctagctgtgtgtcaagttttatttttttttcctagccaccaagctgcactgagctttgagaacataatttcatctaatctttcaaattatttggggcagagattcaaacatcagctaacccgctcaatatagggaccatcacaaagaaaggtctttgaattttagctatcaggatcatttttaaaaactgtgcatcagagttattttatgcatgcaaatctctttctgctttttaattggatttgtgcctggatgtactacaaattgcttttaaagatgggctgcagaataggttccagctatggacaccaatacaatggcataggcaggtacttttggtgtcacctcacctccacacctttatttccacacagtctccaatctcatcctacttgctgactagtcggtacaaaggacttcttctaacctaaaaacaacctttgaagacctccccccaccccacaccccaaaaaagcaaatgcaaaatcattaagagctccagaatgatttttactaaggaatttttcctggggattctctctccaaggaaagataaataaacggctctcacaaaagaacgagtctttgctgctttgatgtgaatgaggccaaccagaaaatccctgcagcttaaaacctaagctcagtaacactttgtttttagtaaagtcagaatggaaaaagactttggggaagtcaagaagtggccagtaggattacatggcatagactcttcaaaatccaactttctgcaggctggtagcagtggaatacaaaactgtctaccaaatgtgatttgagaagaaaattcatgcccacagatttctttttaccttggacgatcatggcgaaagtccaagtcccttagggctttctggtaacaggtgcactccatttctagggaaggataatatgttatctgggattagtttatctggttggcctattgtcacccagaagagatcagagccctaagggtatggtaccttctggtgtttttaaattttgagaaataggaaagggatggtttataatttagaatccaagcagaactcagtgaggtgcaccagaaggaacttcaagatagacacggaagagtaggtggccactagacccctgggaagagagtgaaccaaagagaagtaggagagcggcagggctctggaatgagtcaatcatgacacctatctatgccaagcttatgttggaatcaaaagagtatactgaagtgggatatttagacccatttcttaaatgatgcagagtgttacaaagcacccagtatagtgtcttacagacactcatagaaaatatataataaatcctaaccacgaaacatttcataaagtagaaggtttgaggaaggataaggttgatagaaaggcagcaccttagtgaaataaatgaaagtgttcattgatactcctgtaccatccactgcatcccctgtgcttttgcttgcccatacctgatataaaatcccacccaacataacatctctatatatgagtcattagaattcatgggtggggagggtagtaataatttatggagtagaagaaagggactaggtggggaagggacagtaggaaggagaataaaagaagcagttgagggtagaagcaaaacggagaatggctgtgaaagtgcaaagcgaaaatacaggaagaagacactggatattaacataataacaacaataatagtaaaagttatataaggcttactatgtgccaagtcctgttggaagcacctcacgtacattaactcactcttcacaataatcccatgaagtagatttattattatcttccaattttatagattaagacattgaggcatagagtttaagtcaaaataatgatacttataaagcagagacaagggataaagaaagagactgaattctgacatcatttgctctccagatttttcaattaagccaataatgtctttctttcaagtcaatttaagtcaggtttctgtcccttgcaacaaagagtccttgctaataaaaaaaaaaaatctattggctgtttatcatggacaaagtactgggctaagtgtttttatatactttttaaatttaatcctgatgactcaatgagtttggtactgttattattatccctattttgaagatgaagaaactgaggcacagagatattaaataacttacccagagtcatgcagctaataggtagcagaactgagaggtaaactcctgcagtttgacttcacactctgtgcttatcacaaccatactaatctttgatgtgcacacaaataggcagataaaggaagagcatgtcactagccagtagtgaataatggaaactgaaggccacttcattccaactgttccttttaaagagtaacctgataaagttatagccacccattcaaatttccaagaaatcaggtcctatgcaggtgaacatttgtttggagtctcctgactcttgggaaaccattatttttgatggtatgtagccttgactctccagtgaggagtcacttagcactaatagaaactagctctaggattttatgtccccaaaagagactccctttcaaacaggaaaaggaagaagttatggtgaagctatctctgtgggtacggctgggaatacttcttagaacaggaaaccagtagcatcacaccctggaaaccaccataccaagattcacaaagctagcatcaactgagcaaagccttcttccatttcttacgtgcctacagcctctccatataatcaaagcttgcatccttaatggctttcagtcaatccctatgagcattccttcttccacaagtgtactacaattagttgctgtagctttactgcagaaggaactatgtatatgtttttaattttttgttgttttatttttaatgtatacaaatgcctatctgctagcgataactattggccaaagaataatagtctattcaactgggattcaaacagttaaagattacaaatggctttcattgttttataactattagaaggctcccctgataattccttgctgatttatatcttggtctctatttctgcatagtcaccataaaaatgctgtgttaaataatttcatattaaaaaacaaaaccaggatttaatcgtcacttaagaggcaaacgataatttttatcagcctttgcgaatgggccttgtttctccttcattacatgtctataaatgtttgctagttcttagaagttaaatgactagaaggatagaagagacgtgaatttttaaaaatcagtcactgtttttagctccattctaaaatacatcctgcatgacacagtagatcttctccatgagactagttaataacaagcattctgcatattttataattatgtgcactaccagcagagtgccattggatttattgcacatttgagcccccagaatcagagtcgtgcttcacactacctatcataacaaatggcatggaggggttctttatgttacaggttactgagttggatatttaaatagcacattcggaagtgttctgagttatggtcaccctgcaagaaaggcaccatccaaagtacactatgatttaagtgtcatggcccatgctggagctagcagctagctgactcagaattgggatctataaaaaaggaaatgaataaaaccctagttgattaggagcagattgatcagaaacatctattgtttctgattgggtttttggcacactccaatttttagatgtaagaggcaagaaacacagacatacataggtcatattacttctttttttcagtagatagtccaattgcctatacctcttttctatctccatcctttaaaatgttggaatgtatcactaagtgatatgtgtgtagaaaccccttctttctctggcataaaaggtattccacacatggagcagtatttctctcactcccaccttagaatgaagggagaatgacctttgtttttccatcatatacatagaaagtttgaagaattttttatttcaatgtgtgcaaaataattactgatgcaaccttgactgtttataccacttttactcatcaacctattatcctcagataatgtctttggatatgaacactaacactggtacaattaactctacattggtatgcttggagtggtgacataacttatcctaggtcccacaacaaggtcgatataaaggacagactagattacaggtctcttgacttctggccgaatgttcttactactgaatggtgttatctgcaacctgtactgcccttggttaatttactttgagaaacatatgcaaaaaaaagtctaggatgttgttttcttaccctatgctcatgaatcaaacttgttcttcttccccctcctgttaccagcaccctccccaattcccaccccaacctccacatatcatttaaaagcctgtgtttccttctactattcaagagactggaacatccagatcatctaactatgacttgagataaatcacgctatgttccctcagaaattactttgacacaaacaattactccaataatatacggtggaaaatagtgttaagtacaatcagcaaatctaaatggcagtaattggcattactaattcttgcacacaaataaataattatactactttccttccaaatttcaatttggacatgcaaagtccacttagttcactggagcagaaaatggaagcctttaccaaagttgacagtccacatgataatgtgtagcctataccttaaactcatctttatattgttcacagtaactgttagcatgaggctttgcatgtagcagggttttaaataaagccttgttaaatgaatggttgttcatgaccagtctctaatttccatattattttttatcccatgagaataaaatgctcgatttcactttgtattgtggtatataatagaagttcttatataacttagtttattaaatatattcaagcatgcctctcccaaagcataccaattatggagaagaccctaaagacactaccctatagccttgctacttaaagtgtggtccatagaccagaagcatcagcatcaactgggagcttgtcagaatttcaggccccatcccagacctatggaatcagaatccacatttacaagattctcatgtgattcccgtgcatgttaaagcttgacaagttctgtgccatgggaacagttgttaatcctgtcacctgactccaatcgtcacactgcacattccagtctataaaacctcttgaacccctatgggtttattaggcactagatagaatacagacaaaggaaaagacatagcttttagcaaggacaatatataatctagctctaattcatgtggtttacattgcagtaatgcaatcatagggaagatcaggtagattgggttgttcagggaaggcttattggaaatggaataatttactaatcagtacttttggaagtggggaaaagtggtaacaatagctaatgtttgtctagtgcttactatctgcaaaggcctcaggttacactttttcatttatcatcccatttaatcctcacattaattcgatgagttaggtttagtgtagtggcaaagtgcgtaggctctaaagtaaaatggtctgagtttgaatcctacctttgctacttactagctgtgagatcttggaaaatattttttttaacttttattttatgttcgggggtacatgtgcaggtttgttacatagataaacttatgtcataggggtttgttgtacagattatttcctcacccagatattaagcctagtacccattagttatttttcctggtcctctcccttctcccaccctccaccctctgagaggcccccgtatgtgtttttcccctctatgtgcctgtgtgttctcatcatttagctcccacttataaataagaacatgcggtatttgtttttctgttcctgtgttagtttgctaaggataatggcctccagctccatcaatgtctcctcaaaggacacgattttttttatgctgttcttttttatgctgcatagtattgcatggtgtatattatgacattttctttatccaatctctctttgatgggcatttaggctgattccatgtctctgctattgtgaatatgctgcaatgaacagtcacatgcatgtgtctttatggtagaaggatttacattcctctgggtatatgcccagtaatgggattgttgggtcaaattacagttctgcttttaggtctctgaggaatcaaaacactgtcttccacaatggttgagctaatttacactcccagcaagggtatataagggtaccattttctccacaacctcaccagcatctgttattttttgactttctaataatagccattctgactgttgtggcatggtatctcattgtgattttcatttacatttctctaatgatcagtgatgttgagcttttttcatatgattattgactgcatgtatgtcttcttttgaaaagtgtctattcatgtccttttgcccactttttaatggggtcgtttgctttttcttgtaaattggtttaagttccttatagatgctatatattatacctttatcagactcatagtttgcaaaaattttttcccattgtgtaggttgtctatttatactgttgatagtttattttgttatgcagaagctctttagtttaattagataccatttgtcaatttttgcttttgttgcagttgcttttggtgtcttcctcatgaaatctttgcccatgcctatgttctgaatgctatttccctggttgtcttccagggtttttatagttttgggttttatatttaagtctttttttcatcttgagttaattttttttatggtgtaaggagtccagtttcaatcttctgcatatggctagtcagctttcccagtactgttcattgaatagggaatttttctccattgcttgtttttgtcaggtttgtcgaagatcagatagttgtaggtgtatggtctcatttctgggttgtctattctgttccattggtcaatgtgtctatttttttgcaccagtaccatgctgttttggttactttagccttgtactatagtatgaagttagacagcatgatgcctccagctttgttcttcttgtttaggattgcttggctattcaggctctttttgtggttccatatgaattttaaaatacttttttatagttttgtgaagaaactccatggtagtttaataggaatagcattgagtctataaattgctttgggcagtatggccattttcacgatattgattcttcctatccatgagtatggaatgtttttccatttgtttgtgtcatctctgatttctttgagcagtggtttgtagttctccttgtagagatcttttggctccctagttagctgtattcctaggtattttattctttctgtggcaattgtgaatgggagtttgttcctaatttagctctaggcttgactgttgtttgtgtataggaatgctagtaatttttgcacatggattttgtatcctgagactttgctgaagttgcttatcagcttaagaagctttggggctgagactatggaattttctagatataggatcatgtcatctgccaacagggatagtttgacttcctctcttcctatttggatgccctttatttatttctcttgcctgattgccctggccagaacttccaatactatgctgaataggagtggtgagagaaggcatccttgtcttgtgctgattttcaagggggaatgcttctcactttttcccattcagtatgacattggctgtgggtttgtcatatatgacttactattttgaggtatgctccttcaatacctagtttatttagagttttttaacataaacagatgttgaattttatcaaaagcattttctgcatatattaaggtaatcatggtttttgtctttaattctgtttatctgatgaatcacatttattgatttgtgtatgttgaaccaatcttgcatcccagggataaagccaacttgatcatgatggattagtttttggatgtgctgctggattcggtttgctagtattttgttgaggattttgcacgtatgttcatctgggatattggcctgaagttttcttttattgttgtgtcgttaccaggatttggtaccaggatgatgctggcctcatagaatgagttagggaggagaccctcctcctcaattttttagaatagtttcagttggaatggttccagctcttctttgtacatgtggtagaattcagctgtgaatctgtctggtcctgggctttttttttttttttttttttttttttggttggtaggctacttactactgcctcaatttcagagctcattattgatcttttcagggatttaatttctccatggttcagtcttgggagggtgtatgtatctaggaatttatgcatttctgactgtttatttgaattttctctcttttcttattagtctagctaatggtctatctattttattaatttcttttcaaaaatccagctccgggattcattgattttttaatggttttttgtttgtttgtttgtttgtttgtttgttttttgtatctcgacctccttcagttcagctctgcttttggttcttgtgttctgctagctttggtatttgtttgcttctggctcattggtttttttagctgtgatgttaggttgttaatttgagatctttctaacttttcgagatgggcatttagtgctataaatttcgctctaacactgccttagctgtgtctcagagattctgatatgttgtatctttgttctcattagttttcaaaaaacttcttgatttttgccttaagttcattatttatccaaaagtcattcaggagcaggttattcaatttccatgtaattgtatggttttgaatgaatttcttagtcttcatttgtaatttgatcgtgctgtggtcccagagactgtttgttacaatttcagttcttttgcatttgctgagaagtgctttacttctgatcacgtggtcaattttagagtatgtgccatgtgccaatgggaggaatatatattctgttgtttttgggtagagagttctgtagatatctatcaggtccgtttggtccagtgttgagttcaagtcctgaatatctttgttaattttctgtctcaacaatctgtctaatcctgtcagtggggtgttgaagtatcccactattattgtctgggagtctaaatctctttgaaggtctctaagaacttgctttttgaatcttggtgctcctgtattaggcgcacatatgtttaggatacttagatcttgttgaattgaaccctttactgttatggaaagaccttcttggacaagatatttaaactctctatgccttagtttcctaatctatagaatggagataatagcagcacctacctctagtacccattagaattaaaggagttaatatgtatgaaacacttagagcaatgcccatcacatagtaaccatccaataaatgtcagatgctactattttcattttatatgtggagaaactgatgcacagagaagttgaataactttttcaaagtcacacagctagtaagtggtggagctagaacttaaatgttgctttgtgtgactacagagctcacactttcaactctttattacataatttaaaatgttcctgaagagggagaaggagaaaactgttctaaatccaaacttttccaatgattatgagcccaatcctcctgtggaagctgggcccacacaagtattaggcaataagctgacaatatttgagatagtgtcttcatataagattccaagcagatttcactatttgcaacaaaattcatcaaaactttaaattgttttcccagcagtggctatggctttgcccagtaatttataatcttctgcctggataacttcgtgaccagacaaaagtaagggatacaggctgcacaaggcctagaataaacgtatctggccctcatgagcctggtatttaagaaatggtgtttctgtgcaaagcacacctttaaaagacagactgaacaccttctgaatagcctggaatcggatcttagacatagaatcagatgtcactggattagagggtagtttttggttctttctaaattctgggtcttattcagatgagattaattctgtgtcaaaatcttggctaagatctcttctgtatgaccttgagtcagtcagtatccttctctggacctcagtttccaatatatgtaaaataagactaatgggatggtctctacatgtctttccaattccaatatagtctttacagttttgaaagtgtgttttatccacaccacttctctcctccctggtctttagtgatgtggaaagagcataggctttggaatcagatagacatagggttacctccttgcccccaggacttagaagctgggtgaccttggtcaaaatatgcctctctctggatctcgattctctcctagagatagtaatactcccacctcacagggttaccaggaattgtatgtagtagaaggcatgcaatttactaataaatatctctccctgaatttctgaggatcattatatgggtctattactctatcgtctacacagaaccacttttgtatgcttagagaagtcaagggtaacattggcctgtgtgatcttctaatactgaaacctttccctataagccagaaagatccattgaggagttttaatatcttgataaggtcagagaagggccaaggaagagctattgtaatggtcatggcgtaccccttagcaattctatcctctgtctaagtctaataggacaagtgtttaatattacacactcacaatagaatttcctttctatgacgtgggctcccagagactatttcaaatctgagtttcatagcaaaaactttccactgccaaccccttcacaattttttcaccccagaatggtctcctattacttttaaggactactgcaacatttatttaaagtaaaattaatgttaatgcatttagattttattcagatattgggttgcaggatctagtaagagtgtgtccaagctcctgatcaatcacattggaaagcagaattctcagtagtgggaaaaatctagatttgtcattgactaaccaaacaagtcataaaatcattcacttgtttttagagcagtgctttggttcagctaggaaggcttagttccttctagtcaggaaccatatagaaaaatgaaagaacacttccgaagaacatttgtcaccttggtttgggtgacggtgtgatgtatacaggaaaagatgttaaggtgaaataaaatatataatttacccagcaggatatctactgctgggaataggttgtcatccattgatgagagtcataagcttcactatgtaaacattttaaggaaacatatatctgtgaaggcactatggttaaaaagttcatctctttctctgatgtttcatctatgtttcatgttttgcatcgttacttatttcaggcggggtcagtactggtctagttccattctttgcaataaggccatgttatttgacaccacacttcttgaccactccaccccaacttttgctcccatacccaaggagaatcttgactcacttcagacacttcttctgtgaggaggatctcccattagcccccaaagccccacttttagtgctacaaccaaggagaatccagtgaagatatagcatgtgtcagccctaatttcagattccaaaataacatttaaatttctttttacagtaaaatctctatcaaacagagtctgatgggtcagaatcttcaaatagccaaaatttctgcctagagattttaggaaaaaaaaaatgatttcaaaaggagcgggtgatatcagggatttagtaaaagtgacagtctccttgggctgctccagggtcagtacacatttagccagttgcctccattttaacttctacagtcctgggtaatgaatacctatgttcagaaagatgaccctgagacattgtaatatccttgggcaccaaaaaagattctgcaatattcagttggttatatttatcaaggaagaaaagtgggcttacatattttatagaaactttcaatggcatttcaataacaacaacaataacaacaacaacaacaaaaagacttcttggtaagcattcaattctacatatgttactgaaaggaacttttccccttcctcctccctttacaatttccaagcatgccacatttccctctggcttttagtgtgtacatctgtaaaatcaaaagattaaattagatgatatctaaggtccctttcacttctgatgtcctgcgattataccatctctgtgatttcttacatggcctctataacttcagtattatgcataattctagcagagtctacctcagtggaaaatatttcctccaggctccttctcttattcagtgccttcgaagtgccaaagaccagggaacagtctcaggaatactagcccaagttgactaagcacagaggttttgcggatcccatctgtaaaggctaccagagtccctttgatgaccaccttcaagagggctaataaggacaactcccatgtaagaagaaaagtccatctgacaagtataaggcagtagtttgaagaattaaataaaggacagtttggcaactgcttccaaaaggctatactggcctggaggtagtttgaaataaagtctgtattactaattgaaaggcaagaagagagtcttggaataaatcagataaaataaataaagagattattttacttattgtcagcaatgccacaggcagtcttggaatttggtggcagtcctatcttcttaagcttttcgttgccaactctcaaaatgttcaaaatccatttctaggtcttctttccaccccatggttataaatcttcaatgacaaaaaagcaaaccttgaaagttctataatgttaaatatttctgaggatacaacccactccccaagtagagctagcacctggatacttcctcccacaagaaagaattgctggagaagcttgcctgagccacatctattaaacttaggcttctaggagtctaagaaaaatgtactgttttcacgtcgagtttataccagctgacctgattttgaacccacacccacccaaacacaatgtaaaactctgctcatgattctaactactggagagtgacttgtttcacttaccaaagagtgtcatgccaagacttaggaactaccaaaatatagcaaaaacccacaaccaaataaataagataaagaaattagagaaatgatgcataagcactatattatctgtatatgttctatatcttaaaatatagattttctacacatacccaaaagatacttcttataccaaaaataaacattgagactttggaagacttgtctcttgcattatccttgtccaattataagggattcgttacctataatgccaatactgctttcgagtttggccattagcatttatttttctgcactgagggaaattctacataggcattttgtatatgtctgagagatgagcatggagagagtggaaagtagaaaatgcacaagaaactgaggcagattctcctttcctctagcatcaggcctttatagttaaattcattcccacagcatgcagacacattcaaacaaagtataaaataggttacacaattaaatacaagtgagtttaagcatattcactatttggtactattcgaaccttggattccctgtccccgttgcaaataattgagaaaagtaagttttaaagcataggtagacagaatagctgaagatgggaggtggtgggggaagatgggttgggtagactaaatggtctattgagacttccacttgctctatcattctgttaggagtcattgacgttaatgttcttagactattctgtatgcataaggcaaattataatagaccctcagattgatcattcaagaatctgagggctgttttgaaagatggagcttaagttcttttcttattcatcccttgggtatgtggataattcaaaagcaagtaatagacatgtctgttgggtctacctggcttattggccagtttgatctttaatattatacagtcactactctagctttatctaaggctttatgattcccttatgccaccaaatcgcaagttgaccagatattacacgtgcaaacacaaggctcagagagcagaacaggtgactactgtggctgtgccccagacacactcttccctagaaagaagggagggagtaaattaacatttagtgagtacctactatgtgccaagtactgtgctaataacttccacatacattctaaagcatgttctacattggaagcagggttgatctattcaaataatatatgatacattggaaagtagaagaagagaggggtgttgcacctgggaatcaataaatccaacagcaaaatattgattcaagaaatactagcaacctctggccagagaagcttaccttccaaaaagatataatcacagcctcagccagctgaagataggaatgtcaaaaggctcaggggaggatgcatatctttcgaaatgatcacaacagcagtatttctccaagctacattgagctttcttggcaccacagacagagtaggggagcctagggttgaaccaacatacttgtacccatccagctgtgcccacatatctgccacctccagataaccctctctctagccctggggcacaagctgatcacacaccattttctgaaaataattcttctttgtcttgctccagggactttggcagagaattggggaagatgctttgtgcatcctgtggcactcaactatctaatgccgaaagcttgcagccaggggaggtttgtccaaatgtctgacctaaaagggccatggcttcacttcttttctaattaggataattaacctcccctgctcattcatcctgttccaatccaaaaagctcaaattaaaatggcacaggagactgtcaggctctagggacaagagacagtttacaagtctttcatttccatgccaccaccatcaaggcaaagccaggacaaagttgtcacagcaactttacccttgaaacaaccttggggcccctggaaggccactttcagaattttcatcaatgtaaatactccatcagctataaaattttgcacagctccataacacttgctgactaaattggggcagaagggagggacagggaagatgataataggagataacatttctctttctattgtcatgtggattctgtggttggtccaaggagaacaaaaactagatgctttgagttggtaggatttgatatgggattcagggaatgtattctttgggaacaatcactggaggcaaaactttgggagcatttaaaaaactggaagcaaatagcagcacttcaagcagggcagagacacaactaaggggaagcaattctacagttcttcctctgatgactttaactgtcctttccccacctctgagcaggttttagagtttcatatcagatgcccaggcagataggactgatgactgtcctctggatctcttgcccctccctactctaggattcagtccagcatcttcactacatgcagcccttcctacctacctgtgtgggaagccactgtgcgctgtagtctcggtgccaagaattcgttggctacagacctttgtgagcctccatggctgataggaaaggcaacggacaacaggttaatagatgagattgtgctgctcatttggactgagtactgaaaagttctttccagcccagtagtgttgattttccctgggtctgccttgtttggaatatctccagtagtgaagaccctgacttgcaactcagtatgtcctagatccatctacataaatttttcagcatgttaacagctttgacttgggcctaggttgagcaagttggtcactctctaaactttgccaaatcatgtcctggtcccctgctagccctacactgttcatgtcccatccataatctccactgcagcctgggcctttcctgctcttgaattaccaatctgtgttaaccagccaaagcgtagttctcagtcgttatacaagaatgactaggccagtgcttctcaaattttgatgggctaatgaatcacctgagaagcttgttaaaatgtacattctggttcattaagtctagagtggggcccaagagtatgcagttctaacaatcagccttggtgatgccaatgctgctgatccatagaccatactttaagtagcaagtagagcatctttagggtcttctctgtaattgatatgctgatgtagaggccacactttaagtagcaaaaacatatgctcatttcccaaatgagttagacccgacttggctgcttgaaataagacattgtggcacatcaacctctcttcttggcagtcaacaatagcatcctttcatattaaggctaaaagaatttttagggtaaccagggctgtgcagagggtgtgacaaatgtgaaccttagtgtagagtattcttcttaggacttgggttactggaaaaaagccttcctgggcacctgaagccaatcatgcaggccaaactcatttcgtatccagccactccattcatcgcacccactttcatagtggttctggatggctgctgccgccacatcactcatgctgtgatctgcatcagtggttgagacaacggaagcagctacatcatccaagccacaatccatttatttcatgctaagaaaaacaatcttctatccaagtggggcaagctaagctgggcagttgccacaactttaaggttataggaaatatgccttttgcgctatttacctcctcagtggagagcaatgacccccttgaagaggacccagatttcatcagtgcatcagtgccatgccaggcagagcaagcccatttctcctctgaggcataaggcgtataactcctggagttgtttaaacatagattttcaggccaggcgcagtggctcatacctgtaatcccaacattttgggaggctgaggcaggtggatcacttgaggtcaggagctcaagaccagcctggtcaacgtggtgaaaccctgtctctactaaaaatacaaaaaaattaacagggcctggtggcacatgcctgtagtcccgagaggtggaggttgaacctgggaggtggaggttgcagtgagccaagatcgtgccactgcactccagcctgggtgacagagagatactctggaaaaaaaaaaaaaagccataagttttccagagaaactaactgccttgtttctcgtttctctctaaaggtaattcttgaatcctttcctctttagcattgctgctgattgtgttctttgctcaaataatagctaataaacttcaaagaacatttgtatttgttttgagggatgctctgttatgttgatatttacagagttaaacactgcagatggggagttttccctaagaagattccaaagcattatgattttgtggttttgatccaaaatatatacatgttttatggcctaagggggttgtcaaacagtgttttaaaaaacactggcaaatttaagatgcctttaaaagtaggacagcttggggatccagaagggccccacacctacatttcccagtggctgtgtagaaacaagtcttgctgggctggcctattgctggctctggtggggtctccaagctaaaggagtagtcctcattaactttttccctcttatccactatccctgcccacctaggcaggttactaaactctcctggagagcttaataaatactttcatcttcacaggacctgacaactccattttcctcaaaatgatacataagacttaagacactggccaaggggatcagatgcccagccaagaggaactgaaccattttgttaagttctgtcaatgagtactttgcctgaatgagcatagaagctctttgggcatggccaactagtccctgcactgacccagtcattatgatggctagctatgtgatttataattagattcattttattcaaataaattcctagccagtatggtttcccagaagtccatctcaagagttgtcatcttaactctaagtgactcagggctttccccctgtaaactctccagccccagattctagtttgctgaagcactcctaaattcagtcactgccatgtggttgtttgttctttgcaaatattatagttagctcagctgggtatatcccctggttaaatgaagccaaagtcatgactttgatgactgctagtgccagtcagcttacttctcatccagagatctagacttttccctccatcttggccagccaaccttcttagtaatctatgccatcaatggcaaagaagactagatcaaatggtgagctggctttgcttacatctctttgctttatgctccacagctctagacaaagtgttaatttccaagtgaaatattatttgggaacaatcagggtaagggagcagaaatctttagaaatatattttctctatctctcctcctttcatattatctttcctttttttctaaattctagcctccttttgtctcttatcaaaatagaattctcaaccaggcatggtggctcacacctgtaatcccaacactttgggaggccaaggcgggcggatcacttgaggacaggggttcaagaccagtctggccaatatggcgaaagcctgtctttactaaaaatacaaaaactagccaggtgtggtggcacacacttgcaatcccagctactcaggaggctgaggcacgagaacctcttgaacccaggacatagaggttgcagtgagccgagatcatgccactgcactctatcctgggcaacacagtgagaatctgtcaaaaaaaaaaaaaaaaagaaattctcttgatctgtcctgcaaattctgacagtacctatttatacaatccttatgggactcccaggaatagaatatcattttacagatgaggaaactgagtcccagaatggaaaaaaacaaccacatgctcatgtattttaatgaggtccccaagacttttttagaaggtaaatcttagattgcacgcaagttcaaacatttataatgccttctctgaactttctcctatgggcaaagaaaaaggttggaaagtttttgagaatgagcatggctgtaacataatcaaaagagtgaagaagttaaagctgaccttagtgagaagcttgcatgaaagaggactgctggagtagcccaagcatgtaccaataataacttcagaatagctggtactaattagagcgtaaagaatgtggcagaacacaaagaattaatatatttgactttgtgtactcttagggcagtggaaggctccaagatagtattcaaattttgtaactaggaaatttgacagaaataagaaagtcagaagaaaccgctgctttggaggcagggatatctgagagagtgtgaagaataagtaaggacacaaacaataataaaacctgcccagtctaggaactccagctcaattacaaagttggtgattaactgacaggaaacataccattagccagagaaccatgactgtgtttcttttaagcactgacttacaattgattgcatggcctgtatccctgtgagcctgaaaaatcctgggcatcttcaggtatttacacaacaatgtgttctagagccctccctgccatggagtaacacatagaaaaatgtatgattccaactttcctggacaactgcacatgttggaataatttcagtcactgatggggggaagaaataagagtgcgaacttagaatccagactagttaagtgtttttcttcatgaacatgtgcgtctctgagcctcaatttcctcacctggttatttgggataactatgtactctttaagattggaagaattaaacgtgataatgtgtatacattgttagctctgtactcagcccaaagtagacaataaatgttcatttctatccttgaccccgccttgacagcccaagggaaaatagttcaatttaaaacctgagggatgagagtaaaaacattatacatcacaatacaagaaaaccacaaatctcttagtcaaaaaatgatttaaatttggcattcagctataatccctcagagatgggagtaaccatctatagcctaagattctcaggctaatagaagatggatgtgagagctcggaatcttcgtttcccactatctcaatcagatgatctgttcagtgatacgtattttaaggtgagtcttaatgaatgaaaggtttgtgggatggaagtgaggctttgtggtggagggcaaccagagtaaatcatgagagatggaaaatgctggagaaggctgtgccttgcatgagaatttgtgtgagtaagcagggtgaaccaagccaaaggctttggagcctgcgtagattagagtgggcctcagtgccaaatgggagtcccagctagatttgaggaggaagatatgctttaacacacaaacttgtttgtgggctctctcactcctccatgcaaaggtactgaaggaaaggagaagagcccttaaggaagtcacagatgtgttgtaggcaaagtgcaagggatatatccatcatgacattcctattggattttaacttttagtctatatcaaaatgaatctttattcagaaaatgccacagaaactttgttttacattaatattgaaagttaaaagaagacaagtattgtggtcatggtcaagtttgggatctatcattggggcaaaccattttgtctttctgggcttcagtttcttattggcacaatgaagagattgggaccatcactaattctggctctcatatttgagaattctgagaaacttggaagaactctggccaccacaaacagcctgacttctctgcagctcacacaagattcagccactctttctggaacccaaggccttgacattagcctataacccgcctccataatgccaaattcactctcatatccccattggaaaaaactcaattgaaagtaaacaactaatcaaagtgagttgatcttgggggtgttttacgtgggtttctttagtatggtggatggcacatgaaaatacttatttatcttgtgagttttgaaccccattttgggtgtttcccaagcagattttaaaccacagtattaagtcaaaaagaacttgtcttccgcaagagaacagcatgttctctgttgtcctcaggactgtatctttggctcctctgtaccctctaggcaagagtttgcccttaatattacctttgacagccctccaatggtattaggatcaaggagtctcagcactcctggaggcacagcaggcagaataagctacagtcctttgcactcagatccagacacttttcatctttggcatacattcacccccacttccttcccccttttccttctcactggtaaccatcattcatacctcacacccagaactcagaaatgttaagaggtttatcttggccttgctttttaaaaattgagaatgctgaagaatgttcccagataagtgacttgcctgatgagaagccttttgcttagtggaacctaaacacatactttctgagctcaagtctcacttcagtcagttcactttacaagtccataggcacaggccacaatgtgaactactctgcacagaagttcagggtatggatgctcaatataaaatatactcacttctgggaatctcttcaaagttcatcttctgctggagaaggggcagcagggtgggtggtcatcttcttctttgtagtcactaggttccatgtggaataaatgggacctgggaagaagatgtactgtggctgactggtagcactccttcctccaacccataagtgaagcccccttttaatcatgcataaggccttccccccactgccacccaactagggctggcaagtgcattctctggttgtgatctatggtcagctctctgccccgggtatctataaagtgcttactaacatccatgtcactcactacttgctctctaggagacgcagtcacaagatcagagctggaaattacggatttcaaagggattaagatgccgaatgaggaaatgtcatgtaagaaaccctattcatgggcatgattaatcctctcatggcatctgttaagagctcaacagtccatggagaaactttgagatgactcctgccctctgtgagtttgcatcgcaggcagtctatcccagaacaattatttagataccaaacagaaacatgaaggaactacacacaatcattgtagcatccccttcaatccaaaccccagttgctttctgttatttttattttttttattttttatatcagatattgtgtgggtgaggatcagaggcttgcctattctgctcttcccagatgttaagtaaatctactccagatggtcttctaaatttcctttcagctgacaatgcaaagcaagtttactttcactcaatgaaactgacatatctatttgggcatgttttcttagctcacagagaggagaatggagctacataattcaccaacagggagacaaagttcaaataaggaacaagatgaaagagaaaaatggaaaaggcaggattacatgcattgccagcttcagagccaaggttacacttgactagtagtcagtagctgcctcctggagtgagctattggagtacttggaatgcctcaagtaagatattggggtacctgttagctcaagttgccaaacaatacttgatcaatcacttacggctgtctacaatttgcccctgtattgtaagtctttggttctaatattaaaacatacatccttcatgaaggaggtcacagttgaagctgttatcagtcatggacagtctagtataagagtttcgtttggattgagagacaatttgtattgggagagaagaaaaagcacaaacaactgggaaactggggtcaccttctgttcaatgattccacaaattagccaagtactcatcctaataatgcagctgcaaggagaagaagatttgcagagggtcagctcttaattaaaggaaaatttaaacaaatacaattataaggaatggaagtctcagggaaatattaatttgctaacggtaaattaaggattgaatgtcggtgaatatttgtctttaccttgttccataaaattcacagactgacatccatatgcaaatataaaggggttcttgatcttcccatatcaaactcttcacacacagaacagtttctgtattagcgtctcaaatttagacaatcactatattgattttgatggaaaataaaagggtttaaatcaagttaaaacaaaaacaaacaacaaaacaacaaaatgtggattcaaatgtgctatagaagtctttccatgaattatttttaaatgaaagtatactttgtaatatgaatagtaatagcctgaagtactggctctgagttcagatttttgtatatcaggtttctgagatatgggaaaacataccatgaaataactaaattgagctcatcatctttctctttcctctgcctctattttttctttacttctgtctcagaaaccaccttcacactccatatctagcttctccattgctttacttggccacaatatgcaagggaaatttattggaaattccatggagaccaaagacattgcaagaaatggaaagagtggttggcataagtttggatttaaagcccatgtgagcactagaataagagtagaagagcaaattttggtcaggcacagtggctcacacctgtaatcccagcattttgggaagccaaggcaggtggattgcttgagcccaagagtttcagaccagcctgggcaacatagcaagaccccatctctaaaaaaaaaaaaaaaaagcaaattttattcgtcattcacgtgattttttgatgaaaaagaatattaatttcattaaaatgtcaaacttttattcatgacaatgtatcataaatattaaaagtaaaatacactggattaaatatatggcatatgtcaagatacttaatgtcaatatataaaggctcttataaatcaataataaagacattaacatcactaaaaagttggacaaaggaaataaacaggcagtactcgaaatgatgaataaacatggacaaaaaaataaaaaagtcactagctttactaataaagaaatgctaacaaaaaaagagaatcctctttattcacctaccaaatgggcaaatatattgttcagtgctggcaaggggacagagagacaagtactctcataacctgctaatgggaacacaaagtgggacaacctttctggagggcaatctggcagtatgtatcaagagccttaaacatgtccgtaaatgtttggcccagtattcctactttgagatattaattctatgaaaataattagagatgctgtatgagtgttgtcagcacggcattattcataataaggagagattggaaaacactgaaatgttcatgttgcagaatagttaaataagttatagtatgtctaaaggttggaatactatgtcatcattaaaactcatgtttgaaaatgtctaataacaagaaaatgttcatgatataatgctagattttttaaaggcaagacacaaatacagtcatgcgccacataatggcattttagtcaatgacagactccatatatgacagtggtcccataaaattataatactatacttttactgtgtcttttctatgattagatatgcttagatacacaaatatttaacactgtgctacagttgcctactgtattagttcgttttcatgctgctgataaagacatacccaaaactgggaacaaaaaaaggtttaattggacttacagtcccacatggctggggaggcctcagaattatggcgggaggcaaaaggcacttcttacatggtggcggcaagaaaaaatgaggaggaagcaaaagcagaaacctctgataaacccatcagatctcttgagacttattcactatcatgagaataggatgagaaaaaccagcccccatgatctaattaactcccctgggcccctcccacaacacagggaaattctaggagatacaatttaagttgagatttgggtggggacacagccaaaccatatcattctgccctggcctctccaaatctcatgtcctcacatttcaaaaccaatcatgccttcccaacagtcccccaaagtcttaactcatttcagcattaatccaaaagtccacagtccaaagtctcatctgagacaaggcaaatcccttccacctatgagcctgtaaaatcaaaagcaagctagttgcttcttagatacaatggaggtacaggtattttgtaaatacagccattccaaatgagagtgatttgccaaaacaaaggggttacagggcccatgtaagtccaaaatccaacagggtagtcaaattttaaagctccaaaatgatctcctttgactccaggtcacactgatgcaagaggtgggttcccatggtcgtgggcagctccacccctgtggctttgcagggtacagccttcctcccagctgctttcatgggctagtgttgagtgtctgcggcttttccaggtgcacggtgcaagctgtcagtggatctaccattctgggatctggaggatggtgcttctcttctcacagctccattaggcagtgccccagtagggactctgtgtaggggctctgaccccacatttcccttccgcattgccctggcagaggttctccatgagggtcccacccctgcagcaaacttttgcctgggcatccaggcatttccatacatcttctgaaatccaggcagaggtttccaaaccccaattcttgacttctgtgctgccacaggctcaacaccacatggaagccgccaaggcttggggcttccaccctctgaagctgcagcctgagctctacgttggcccctttcagccatggctggagcagctgggacacaaggcaccaagtccctgggctgcacacagcacggggaccctgggcctggcccacaaaaccactttttcttcctaggtctctgggcctgtgatgggaggggctgctgtgaaggtctctgacatggcctggagacattttccccccatggtcttggggattaacgttaggctccttgctatttatgcaaatttctgcagcccggttgaatttctcctcaacaaatgtttttttcttgtctactgcatcgtcaggctgcaaattttctgaactttaatgctctgtttccctttaaagatggagtgcttttaacagcacccaagttttaaatgctttgctgcttagaaatttcttctgccagataccctaaatcatctctctcaagttcaaagttccacagatctctagggcaagggcaaaatgccaccagtctctttgctaaaacataacaagagtcacctttgctccagttcccaacaagttcctcatctccatgtgagaccacctcagcctggaccttattgttcatatcactatcagcatttttgtcaaagcaattcgacaagtctctaggaggttccaaactttcccacattttcctgtcttcttctgagccctccaaactgttccaacctctgtctgttacccagtttgaaagtcgcttccacatttttgggtatcttttcagcaacgccccactctactggtaccaatttactgtattagttcattttcacactgctgataaagacatacccgaaagtgggaacaaaaagacgtttaatatggacgtacagttccacatggctggggaagcctcggaatcatggcaggaagcaaaaggcacttcttacatggcagcggcaaggaaaaatgaggaggaagcaaaagcagaaacccctgataaacccatcagatcttgtgaaacttattcactatcacaggaatagcacatgaaagcccaacccccgtgattcaattacctccccctgggccactccaacaacacaggggaattctgggagatacaattcaaattgaggtttgggtggggatacagccaaaccatatcacctacagtattcagtacagtaacatgctgtacagttttgtatcctaggagcaatacgctatgccatatagcctaagtgtgtaggaggctattccatgtaggtttgtggaatacactctatgatgtttgcacaatgacaaagtcacctaacaacgcatttctcagaacgtatccccatcattaagtgatcaatgactgcattacaatccattttgctaaaataaaaagtgtgaagtctatttatataaaacagaatgtaaagagggataaagtcacctatactttttcttttaatttttgtactttctgtgtttttccaaatgtccaaactgagcatattaattttatacttagagagaaacacccagatgctacctcagaaaaggaaagatatttgtaaagtgctttgagtacatctgggtttgcttcccacatactgtactcaaggtttccagattcttcatctaccacaggaagaagcaatttgtaaacctggcctgagccctcccttcttgcctctgtgtctttatttgctgatgtctaggtagtatatggcccttcttgaaacatgcctttctcacccagaacctttctgctggtcatgaagaacacctcaggaaaaaaaaaaaaaaaaaggcctgctttaatatgccacatttgtattgggtagcccttagaataggtcagtgattctccactctggctgtacatgagaatcccccagggagattaaaataaaacaaaacaaagcccaggaatcactttgagaaatcattattttattgctccagagtaagccttggccatccatttttcatacttcctagggtaactgtaatgtgcaaccagcattgaaagccacagaggtaggtgaagacacagaaaaggaaagaaagaaatggttttttcagctgatttcagttgagtaacatagacaggaatggacactaaccttctgtggacctgtctcaccattgtcttcccactccactggcccctgagataccccatatctacaagctgttcatttgttaaactccgtaagatcatcaagcacatcaccaactttcaaattcatcatctgaatgaccccataagatgggcagactcaaaaacaatgttaacattctcttttgttttccttccaaactcattcatgttaaggtcactgctaaaatgtacgtgtgttcgctgaaaggataacatgttatgccattagctatttttacgctggcacctggaaaagggaagggtgctgagggaattgagcacaggataggaaagttttaatatggggaaagaggaagaaaaagactgggattggtagtgataggcctactcaaggtactggggagacagggaagcgaacatcaggatgttgtgtgacatcaaaaagagaagagaaaaggacatgaggaattaagttctgtccacaccaaaatgttgctaagcgtcatcttaaaatgagagctataaagtaagttggacatgatgcacttgaaagaccactaaattggaagccaagagacttgcttacagggtcaatactagggcaaggtaagtgcggctgcacttgtgcaaccctcagaaagtgccttcttgaatatttaccctaggtgcttcacctgcctcaccttagctccagctctgcttgcttagattccagtctcgcttcagattctaaactgtgtgatatttggcaagtcacttcccctgtctaagcaccacctctcaaacccgagaagctccacttttacctgtctaagctattgggcttccataaaaatttcatttgaaaagagttacacagctttaaaaattgtatcctacttctctgagtcatctgtaagagtactagcctgtaatactgtggttctgtgtctaataattgtaagctacaggagttttcatgggccacttaaagcctctctttatcaacctgaaaatattgacaaggtaatttctagcacaggccactggaaaagtattgaattaccctctgggaaagaccaacttgcctctctatagaacatttcgagagggccagtaaacctttttggggctttatggcaaaccctctgagaatcacagccaggcacaaattgctataaatgtcaacactcatgagaagcctgttcatcaatatcagcaacttccatcatttgggggactgttaaaagaccccgtcagaagtacaaatgctgtggctctgagagatctggtgcagattcacagctgacagcaggtggtgatagtccctgctggaagatgcacaacaggaacaaaattatcctcaactatattttcttgggtatctttattatgaacttccatatgtcaatatcctacttattgttcttctgtgttttcagatgaaatactaaatgtgttcagcatggagcgggttttcacttgtttatacatttaacaaaatcctggccttctttcccctgtgaaaatgattttgacaattgtatatttgagaactttttgtatctgatgctatccctgtcatgagatcaacctcatagtcacagatgaatcccccagaaataaactgaaatagagattcacatgcaagaagtttattggctggtactctcattgtcagcaattgtgggaagaagagaaggatgcaggtgagggcacaaagagaaaatgagctatggtgcagtcataacaaaccctcagctcccttccgggagctctgaagctaggatgacttgcccttagagttacctcgctgggggtatgagggttgtgcctttctatcctggggcaatcggtcattggatgcaggataccccaggaaagggtcataaccttaagctgcaacttttccaacaactgaaggaataagttctatggtgctgaaggaggatctgggtggtacagcacagcatccaccacactaccctttgccaagattatcacaccttatttgccaagagtagcccaaccaccactccagtaggattaaattggtcatagctgcagcccagttcttcatccataatttccttcccactccttgccacaaactgcattatattggtaaaatgcagatgacaatctagcattcacccacttacctatatggtaactaccattctttaaaatgaggaagaagaggaaagtggatagcgacagcagtctggaatcagaatgagagaatttgctgctcaagtaaaagtagtttttagtgttgcaaaattgggcacgttaaagctcacagagagtggatgacaattctgaagctgctaaaacagcaggcttatttttacaaagccaagggtttgttacgtacctctgctcctacaagcaccaatgcctgtttttttctctgcctcctgtgtcaaatttttctctttttttttctccctcaagcgcatatttactctctttggtcagcttcatcaggaaacagtcaaactacaataaattaggtatgaaaacaaataaaagcttttcttgggctgctcagtgacaggtacggagctgaggtgaccattccccccagggttctatagtacacagccacatgcttaagcaaacacagagaaattctgcatggtaaaagacactgcagtattcagccacggttctgacttgctcaaaaaatgtgagcaaggcttatagcccaggaagcttcagacatgccctcattaaaaagcagtgtgctttttctacttaatttttgaataggtaatacattcacatggttcaaagaacaaaagtataaaaagatttgtaagtcagtgtttagtaaaatgcctctcatttgtggcagtatgcagcctacaaaggagctctcatctatcatctatgtcttccagaagcctatgttctgagaggacagcatgagttgtacttctttttaatctttattgtttttgtacttacagaaaataatacctgcttcttgtaaaagggccaaattttacataactaaatgacagtgaaaataaaagttcttggtaatcctacatctcagagataacagccaattccttcagattttttccacacatatagaaacatatagtttctttacaaaatagaattataacataaatgccattttacagcttgttttttctattattacctattatccaatatattatatatactgtacaaatcttttcttgttagtatatatagattgagctgtcttttaaacaatagcatagtattctatgcgtatttactataatttctttatgcagttttattttaaaattttaaatgtctgtgacataattctttaaacccatttctccattgcttataattaatttaccatgaacttaaatctactcatttctggagaagttaatgagaagtcagtaaaggaagtttcatggacaaagaagataattcagaaaggtctgcaggtgtagacagatgtgcctgttaagtggacagacaagtgtggctgcctggagtactgaataagtgagtgaggccattttccagatttgaatgaatttgaaaataagggagaagtggggactggaatggggtgagggattaaacaaagggagataaaagcaaattggaatggaagaaatcttgatacacggatggtgagtctttccagacgaaagatttttatggagagaactgacacgttttagttgaatccaagcttgatactaattaacaatataatttgggtatttaaaaatattggcaaaggctgctaaaataacaacccacgtcaaagcaagcaataatctcattgtcgtccacactgatcagatcacactggaattatcaggatcaataaaatattgacagatatccataggagagagcaacagtgagggaacttgtcatcatgccataaaagtaacggtggaaggactgggacgtctttagcctgaggaaaagaatgttaaagggaaacatgctaactgccttcaaaaatgtgaaggactaacacatgcaaaaggagttaaatttgctctgtgtcatcccaaatggtggaataagaccaatgagtagagattacgagaaggcttattttgattcaacacatgaacagctgtattctgctaaagggcctttaaaaaagtttactttaaatatattaaagactctgtccactttcattaacattattatttagccaatgttttcttcataaatagtacaaaagtaaaattcaactcagtccttgatgaagtttcataaattcttaattagtgagattcaaaataatgaggctttatcgtacactgcttgagaaagattttcaattgccttaatctctttcttcctatgtttatttctcaatcccatgccttggcctaccatgtcccctcaactcccactgaagcagagagcacatcaacaacccacacgaaaatgtaaatctgagaaataaatatgcgtggttggtttaaaaagagaaagaattaacatttaaagcaatggtaatttactctgatctgtaattttgagctcctgtgctgaaattgctcatttggaaattaccaagtgcttgggtctcatttgtgatcttcttcctgcatacacccagcacacaaaggagtcataatgaccggctgagtcactgctgccatctccctgaagcgtgctcttcaaatgtcaataccattttctatggtacaatgaagaaaattccgaattgtagcctgcttacactaaagggtgagcccgaaacagcacagaacctggaatatgctcaaagggcatcgcaatcctctcccattctcttctcctccagtcatcaaattgctatggcatggatcattttggctttgcaaatcatccctatcacccactcccattagtcattacttgaatataaatgaaaaactatttaggtttatgggaagaaatgagctgcttttggcaatatcccaataaaattatatctatagttgaagttatattcagatatggattcaaaccagaagcgaaactatagacacaatgtaatattagagacatgaagactctaaaagaccagcatgtagaaaactcttgtgctattcttatggatcatacttcagatattttgttcttcccaacttcttaaaccctaactccaaaaaggttacccaaaactcaagcatcagatcttttctctttttctcattcaatatagatccagggtaatggtagctaacagttatctaatgtaaattagataaaaaggaaccaggaattcctggtaaatttaattgagaaagggaaagaactcaggaaagcttaatatgactgaactttttaataatgtggtgatcaagagctcacgagtatgatatctttgttatagattgtctttttcaggttttcataaaattattttacttgggagacataatttaccttgttggatagtctttctatgtaaggagaagccatattataatgaggcgctatctctactgaagttatttctaatttgccacaatgcttatatagaagatgaaataaatgagcttcaactgcagtaaggaaattgcaggcagttgtaagaagttcttgattttattccatagatattttgagagtgcatgtcaataaaaacaattagataatataattcagctgtgagctctcatgtagccacttgatgcggggtgcccaaaagttgtagaatcttctttcctttgcaacaaaatgaaagtgcaaactgtctggagggttaaggctgaggttatgagtaagcctgctttccataatggataaggttcaaaggcacctgatggactgtgactagaaattcagtagaatctttaatacctacagaaagatttttaaatcattgaagctgtttttccttccttcaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggtacgtttgagatttatttcaccgccagccaacatgttaaattatcaacctaagtcagctcccatatctgctaataaattaagtagccaacagactaaacgtgccaacagtttttgatagtctctctaatccttttttcctccccagtggctgcagaaaaaaaaaaaaaaaaagaaagaaagaaaagagaagaaaatctaagctgttgaaaattgcatgccatgattaatctggaagtatttgcaatttaatgctacctatcagataaacatatccctccacacctctgtttcatagacaactgactttcaaagtaatccccttcctttcccataccttcttcccaacagggaacagacaagggactaagcagtgcagatggaaagggtttttgtttcaggagcctcattgctggaatatgtactatttccagacccttctaaagatcaccacccattcttgatgactatggatagacagactgtcaggacagtactcaccaagttttgaatttgtctacatttttgcagattatccctctggatcagagagagagagagagaacaatttaagaccattttttcccattttataactttttaattcattcactccacaaatattcatttaagacccattacatgctgacaatgtgggcaacaagttatcactgtcccataatttctcaaaggagaaataagatcttgtattactttaaaataacaattttttttgagacagagcaagactctgtctcaaaaaaaaaattatgtgaaaccccatctctgttagaaatacaaaaattaactgggcgtggtggcgggtgcctgtgatcccagctactcaggagactgaggcacgagaatcgcttgaacccgggaggcagaggttgcagtgagctatgaccgcaccactgcactccagcctgggcaacagagcaagaccatttttaaataagaagtggcatatgagaaaaatgtttatgcttttaaaaatagaattcaatgggccaaaatatattcattattaagcttggatatttaaatttaagactaaaaaatattagaagaaatgtttcaccctaaaccagatctgttcagggtagagtcaagctgaaatgtgaagaaagtttatcactttccttagaagtttcaatttgccagttaataacaatgtgcccacgctgccataaacaaaaatgtaagggaaacatttccattctaatttaatcccagtgtacctaggggccaaaacagcttcagagattgaaattatagtgagcagctattgcctgggagagctgttttatagcaaattaaatattaataatttgtcagatatgcccccataagaagagaaatgcaaacaaaaataggtgacaaaaggaaagagaagggaagagacggaaggaagggaggaaaggacaaagggagaaaaggaaggagggaaactgctgactctatatcgtagaaatacaaagtgtccccttgttaagatcggcattaccctctagtgaatcatacttcacagaaaatctacagcactagcctggttaaatcaagtttctcaactaacattctcttgagctacacaaatgatctacctgccccttcccccccacaaaaaaaaaaataccttcctttgattttcttagatcttgaaagtgaagaatcaggtcagtgatgttggtgtatgtactacatgccctctaaaattttataccaaaatagccttttagtgggtgacctacttaatagcccaaagcagaagaacatcctccttgtcatactttgtttttcttcttttgtattagtgactttggcttcttagatatcttatattctgttaaagtcttttggattttatagaactttatactgcagtctgggatttttcagcattatgtaatagaaaagtagtgggtagagctctgaattctatataattgtgggaccttgggcacttaaatatctatgcctcagttttctcatctacataatggagaaaataaaattttctctacatcacatggttggtataattgctttaaaaagcgtaaaatgctacagaaaaaacaatcattattactagacactttcagaaaaactaaactagtatcattcaaaaactctattctcttttcatgtcatacttctccatcttcctttcttctatacgcacattcacagtatcctttaaaacactttctatacaatttttcaggaaacattgttcaaagaaaagttttagcaacatctaggtaaggatagagagttactttcatttattctttttccctctttcaaaaaattgtcataaaaccatcaactcatgattgttttctctgccatttaaggtgttcttactaggccataaattctatgagggaaggactagatttatcttgttcactattatatctccagtgtccaacagagtaactggcacatagtgttggatgaatgaatggatagatggataatgaacaagaacatttcagaagttccactgcaattttgctgtatttccatccagaggcaaaaaagtacctacagttacatgatgtgattattattaaagtacacattttctcaaaggtgtggctttctgcttaagcttattccaatgatccagtgaatttgccgtaatttattttacgaaaataaattttcattaaacaaatgatctaaattaagcaacaacttcaacatgatatttatttatagaaaacattttttaaagacatcaaatgctaaaatacagagatatctatcacctttctcattggttcctaaccagtcttttgataaatttatcatacttcactatacagatcctgattggaatgatagcatttataatccaatcagtattaagttctccctagagatgctcccatcctccaagagtgtattcagctctgtttgagatcatttttatggaaggaaacttctacagtctcccacaaaatgatatttcataccactatctgaggtagaagagcctgttacaccactataacactgtttcctatagatcagattttggcataaattaagtttatattgtactctatatccaatgagtgttaataaaaatgcctcaatgtggtgcaattttaaaatataagcaggtcttcaacatagtgttatatagcataacctcctcatgtcatgatataagttctggttttccctgtgaatattcaaatacataaggtaaatcaaaattctttcaatattttttccccaaacctctttttctttttaactgtttcaacccttgagattacattaggggaaaaattcaattaggtatcaatctgtctttcacatctccatttaatagttaatctaccagagaagcattctaaacttatagatataagaattaacatagaaaaggacagcactagagagagatgaaaccatgaagggttggtagggcacatagagaatatttagagatggtatatcctgaattcaagaattaagagcactttccataagaaggtttaggtgaacaagggtgaatgaaccattggcctgacccaatatagcattcctattactgtgttgtgcttatgaagctctcctcactggtggacagctgccttactcaattcaatgaccaatctaaacattaatttttgaaaaggttgcctctctgggagttatctattctgaagagatcctccaccacagtaatatataccttatggctttgttgcacctttaatgtctattcagagacgcagcataacagcgtttcagagcatggactctggagccagtctgcatggattctgtcacttactatctttgtgacccaaggcaagttattcaattctctgtgcctccattttttcgtagtaaagtgagagtgataactgtactatgatgagttaatatatgcaaaccatttagaaaggtgcctgacacgtagtgtttatatagtgctttgatgccaaagcaaagtgttttcacatagataatctgatttgacacccactataggaggcaggcagagcagataggttttatcccaaatttacagatgataaattgaaacttggagacatttatatgacttgtttaaatgtaaccctctgctcaatcctagtaagtggcagagcaaggataaaactcaagtcttctgattcctcatacagttctcttgcccctacactgcactacctcttttaatttgtaagttactcattaaataaatatttagccaatgccaaaacttggatttggcctgcttatcaggttaaatcttaaaacagttgcaaaacaattagagaagatccaaagaagagcagcaaaaatatgattaaagtgttagaaaatggggcctgtgaggaaaggctaaatgagttgggattgtttagcctggtgaaagagagccaagaggtagtttaatcaccttctcaagtataaagagttatcattaaaagggcactgaccaactgttctgcatgcctaaggacagtaccagagcaaatgagcttaactagactagagagagagtcagtattagaaatgactcattataaaacagagaggaaatgaagacagtaaaatctcaccagttcaggctatatgaaggtgaagccatactgaattagtgaaaagtcagacctagatatgtcttaacattgttttcaagaatatacaaatattccaaattaatcctgtgtgttgacaagtaaatatccttatagaagacttatttaataaatagacttatttaataaatagtattttctaatttgtctattcattatatatctaaaaggctgtccccttaaaaagatttacacattcctccttcagtcttaaccatgtttctctttattccatagaaaatttacagacaagtctcagcatatcctctgcctaaattatagcatgtgctaatctagtggggcccaaaccaatatgtttcaatgttctacctaaaatattatataatgtataatttccccttgagatattccaggctaaaatcacttcatcatggatgatgtgaaggtagcatttcttaaggacagattcctgaagcaggtcaatccttcaggtagatttcatttcagaaaccccggctgtcactttgaatttggtagttttaagaaatgaaagtaagtcagtttcctaaataaaacagtgtaagcaagatgaacaacattaggggcccttctaaattatgagactgtaactcaaaggggagagtgctcacacttcaaaatatgtctagaaattgtggtcactagagcactgttgcctacagctggacctaggacaagtgaagcaaaaatgttatagctacatgcttgctccctgcctcaccctcactcagcagatagtggtactgcccagttcctctccactttgttggtccctttttattccagcccttactctcaatgttccatgtagaacattaagctcacttaccaatccaaaagacagtttgggttagcattctttctttttggaatattttgtttgccatatagttgagtaaacacaagcttgggactcaaatagacatgatttctaattttagctccctgatttccttgttgtgtgacaacaggggaggtgacaatttctttggggctcatttttctcagcttaaaagactgttccactaccttcctttcgtggttgttgtgaggatcaaataagattctatgtggaaagcacttggtacagtgcttggcactcagtaggtactcagtaactgataaccatagctatttgctcatgagtggtgagtttctgtgttcatgaaaatcagttatttgagaactattgctgaagaacaatgtccttgtggcttccccaaggtatcagttcaatctaaggtcatatcatgagagcaaagtctgagagttgggctatgctcaggtctcactaatataagtttagcatgttagaaaacctctctggttttttttttcctgtgatataacactgggtaacacatattgattgataagctcaagaacaatttgaggattaactagatttttcagcatcacctaaaataattaaaggcactaaaaccttgaaccaatatgctaactgggcatttttaataacaaatatatatgtattgaatgcttactatgtttcagatattattttaagcaatgtatgtgtatatatgtgtatgcttatatatctcatatgagttaatcctcatattatccctgtaggtagatggaaatattatttccattttacaaatgaggaaattgagacttagaagtcatgcaaccaataattggtagagatggaacttgaaccagggaagttgacaccaggtactgttaatcactgctctgactggcctcgcatctgacagaattttccaatcagaatagattcaaccggaagtcatcagacttcttgataccctcatatcttttgccttattccatagtattccctttcatcctatccgaagtctgaaaaagaagatggtcaggagccatggttaatataaattataaatttggagggacagggatacagaagtaaattactcaaatttttcttcctcttctccacaactactgccacaacttaccctgaagcactaagtctgatcagactcttcaatgctagagtttatctaaaacattttctatacttaggattctaaagttcttctagagacttgctttcagagacatggttgtaagcagagagttaaacagtcttccgccactaaatagtagtggctctatacttcacttaggtctctgtgtcctccatgacattcaaattttatggtgggttgggtactagatgacagacagtacagctatactggagccaccctaaagcaaatcaggatgtcatttctttaccagcctatgtctagtgtgggctggctgagaagtctttcagcatcttcaaaagacaaacacaagtaaaggatatgacagatgttattacctggatttcagaggtcaatctgaggtcatgcccccatgagagaaacaaggagtatacagaaagggatctcttggagtagatgagtaattgcttagctacctaagaaatcactgaatattcaggaggtaattcatatagaagaaggaaggcaaatgggatcagacctccagaatgggcattgaaatttacatggaaactgtcccagacaagagccagccaactgttgtgaggttaagcgtcacacaagggcttatattcagaatactatactaggcactattgggagaaacaaaagttctttctttcttttttaagtatttgtaatagcccttagcaatgcgattcaagtcagagagcagcatcttgacaaatgcaaaataatataacaaaaactaggtatgtaaatgctgatagaatgaaagatattagaaaagcctagaacttatttttgcatacgattgaatcaatcatgaaatgtaaggtgaaagtgttcttagtacctataatatctctccatcttcttctcccaagtgcatattaagtactatatgtaaaagaggagatcccattcctctttgctttccttgcttcccaatttcctaatggcgagcttccagagtagatcaatacatggccaaacaacccactggccttccttcatctcttactgtattttagtaggtggttcccttttttcccctgcctccagccattccaggtgtctctctgtaagttggttgccttattcttccttttcaaggacactttttgttacctaaccaatcatggtgtccaaatcgtggtcactatttcttaatctaatgacatggcaatttgatgctattacttaacacttattgggctacctgaattaatatcttgaagcaataatgcaacccaaactacagaatggtgtcccaaaagcaaaacctatggttggatttcttaaagatgttcattggaaacatggtttcttaagtctaacctagtatctttaggccctaagcaagcgagactctacttgtggtaaaagccttcaacaacatatgttaggtgactttgacactcactgacagccttaaataaacttgttctataaatgcaaagatatttatcctaggagttagtagcagacatcaatattctatatttaggaattttatcttcagcttattaaaaaagatggcacaattctctggtcatacctcacactagactggctagactggctttgtgactgtttagaagcaaatcccctctgggaaaataaagagaaaaaaaaaactttttcaataacattactttgaaacagcaagactcttgtttatttcagatgatagaagctttagggtcaaaaaggaaatgttctacttaatcaacagttccctcctcccattaaacaaaaatctgataaatgtttgattatttcttgtcaggtttggggggttttatttttaaaataaacacaaattcaaattaattttcattagggaactttttgagagtcgttgggatgactgaagacaccttggggttttgtaaagcagagtacagaagccttgaggcaggagagctggattctagccccaagctgtatgagttcaaaaaatcaatctctctacatctccatttcctgaactgtaaaatgaatctatggaatatgatggtcttttccagttccatcaggctatggttcccacagctgtgaaaaacaaggtaggaaatccagttcaagaaatattgattgattcccaacccattttgccacactcaatgctagggtgaggagaaaaggacatgtcttccctgctgaagaagcttgcaatctagtagggcgatatgtcaatgcaataattctagaagtcagaatataataaatatctaaaaatgtgtgaatcaactttcctgctttctcaggtttccaggctggtgaccatcattgatttcttagctgactgacactcttacacacctcaacatcagtgagctttgctgagacttggagacagagatgataggaagattgagataatgtatcttaaggccagggcacagcctggaagtttatcatttacctctatccttagaacacagaacaacaaacgtctgcattaaaaagagtttctggttgatcaaagctgtgccacatatgtatatataaataaatatggcctcagcccttctaggaaatacctagggaaaatccctattaattaagggcttctggtaattggattctgattaactgagatttgtttgtttatcataagcctatcataagttcctcattatatctatattcactgttatcctactactcagatccaacatatagtagattgcaatacagatgtattaaatcaaggccttttctcccaccctttaatgccgcattttagcattaaggctggtatcttattccaaaattataaaaatatggaccaattcaaatagaacaataaaactgatgcaaatatcctctttattttgagttaatcccatcacttaagtcaagtgagatctccaattcatactttaaaaaaaaggaaaggaaacactagccatatatagccatttcatccctccataggcagtgaatatgtttttagtgggcagaggaagaaagagccctaatacctcttacttcatatgacttacactgtgaacactcagttaagcctttgcagacactgagagattaagtcctatgagttagaattactagcttgtaaacattaatgaaatttttaaaatcatcatccagctttattaggaaattttcccagattaagagcaacaaaaatgtagcaattagagtgttcatcacacagctgcatgattacaggagtcttgttctagattctaacagatgctgtaacaaacagttttgtgagggctgcaagaaccatagtttacaaaagcaacacaaaagctagttattgttcaagctcacattgccacaggacccttatgtttaaaataatttacactcttgagctcctctactgagaggcatcaagcatgtaaatgagcaataacaaaaaataaaataaaatgtgcagactcaagttcttcactgcactaacatggaagggcaagggacattaattgatccgtacaaagttctggactttgatgagaccaaatgtgggaatcagccatggactagtttgatgtcattgttaccaagccaccacctggctcgtccagtcaaattaagctcatcctttcagggacagctttacttcagtccagatttggcaaggtcaaactatctctgctcaaaggttatgacaaattgacaagtgaggggcatcactcaatgggcccaggtgggggcttgaggagattggtgacaattagtgttacatcactaggggtggagccaaagtggaagagattcatagccagataccactattacatatatatatttagaaatatatattatatgtagcctcccaaatacaaaccaccaccaccctactctgaaaaagaatagcaactgatcaaatatttcctaaaggactccagtattaagccaacgactagcaatctggctgagttctatctatttcaagatcattgtgtgaccttgcacagccacctcacctttcatcatctcaggaacttcagccataaactataaaaatcctttcttgccttactgggatgacattaggatgaatcaggcaatttctctaaggtattctaagatcctcagagagggcaagtctacaaatacaaggtattataattagaatcactgcacctcatttcttaagggggagaaaatgaataaggaaaggaatgtgtggtcactgagcttgagactcaaaaggcatttaaaagctctttctatcatctgaggtaagtctcaagagagggaaactgatctggtggagtcagagaagagttcagtgaagaacctttgtgccacctgtgaaagtggctaggacatgctcccaggacattagaagccttcctgtttgtctttgacagtataacgttacttcactatgatcaccataaaggtttagatttgtgaataccaccaagagagtggcaagtgctttgattatgatgttgtaggccaaaaaggtcttgccttccgtagtgggattaattgttcataaaagaagaatagtatattcaagctcaagtggtttagctgaaattgttttcatgcctttaattatctcaatagcagaaatcatagctctaggtataactggataattagtggggacagagaaaggaagaatgggatccctttcagagttcagcattgggccagaatgcgcctgctgagcttaagaatggggacacagaaaaaggataactaggtgaacggatttgcaaatcagaacctggggattatgctatctaaaagacatacacatttgcgaggtaaataagagaaaaaccaaaatagagtgtgacctcagtaatactctgtcttggattaagagataaggatctagagacactgaaacaatggactaggtagccaacgagggtactgtagaaagcttcttagtgggcacttttaagtaccttgccatcactatcttttgaacagctctgagggtccttttcagtcctcttgacctatttcaaactactacttgtgcttaacttgaaaacttcctactcaacaaattgttcctcctgcttcctttgaccaacataaaatcaattgttgtttgacagaatactttgttgctgttttctcaaaggtgcaaaggggaaaaaaacaccttatttttgcacacattaacttaatttcagtcttacctactcaagcacaacataatccttcaaactctgaccgaagccccttcaccatttggtgtccatggcaaccgccaccaagccactcagagagttgcaagcagtggcagaaaagtgcatctcccaacagagccattagctcttctgcattaaccccatcaataaaaggtggcagcaggcccagccctgcattttctttcatcagggaggaggaatgttgtccgtgtttccttcccagattgtgagaattgggtgtggctacatctcacacccaacctgttgaaaataaagcattgagggtaaattactgcaactaagtcagagaacgattttcacttgagaaaacttcccactggtatgcttccccaacgactctgtcaactgcagcctccaccacaacactgcttgctaaactacagccagtaatcttaaaccccacaaagacaataaacatgaaatcctagccacttcctgctatggttcttagcactcagtgacctacaggtcatactctttgttacccatgtcaagaatgcatgcgtgacaatttcatgccatcaaactatattttatttatttatttatttattgagacagagtcttgctctgtagctcaggctggagtgcagtggtgtgatcttggctcactggaaccttcgcctcccgggttcaagcaattctcctgcctcagcctcccgagtagctgggattacaggcatgtgccaccacgccgggctaattttttgtatttttagtagagacggggttttaccatactggtcaggctagtgtcgaactcctgacctcgtgatccgcctgcctcggcctcccaaagtgctgggattacaggcgtgagccaccatgcctggccccatcaaactatattttttaatgaaaaagagcaatgttaataatggtctaggtactggaggatttatgagccaatagtaaatggtatggtttctccaaatatagacaaagctgttcagtctacaaactgtttttatgtgttccatattatttgctttgttcagagcttagcttaaaagttgtcagataggaatttccctttactgtactccagaggaagactaggatgtttcatggggatggttctgtcattacaacagaatccaacatatctaacagagatatttttgcataaagagaaccatctcagactaggttctttgtagaaactaaaaaggacctactactcaagtatcttcttcatagaatctacataaataggaataatatttagagtagaaggaacaagtgagtggttttatcttctcaaccgcatgaaaaagaaaacagaaggctattatgcacaatcctttccagtaggtcctctgaaatctaaggaaacaatttcaagctctccataaaaagcaagacatcatgactaatcacactgcctatctctgtagtcctggataaggactagtaaagaaaaagtgaaaaaccaataagacatagttccaggcctcaagaaactcatagttcatagggaagcagccaagtaaacagatgatcatagtctagtgtgataagagcagtggcagaggggaacacagatcttaatggaaatgtagaagaaacatcctaactcagcttgactcagatcaggaaggcctttctcctcaggattggttgaactaagtttccaaggacccattgaagatcatctggtttggaaagggatggaaatgtataattgcataagtatgacaatccccacttatgtgtcagcatgaacgctagtaagaagtgctgattcaaaaattgaaactgactcagatgtcataagacagaacagtaaaacctgatactaataagaatacgggttatactggccagaacacaacttgacctttcatcatgacctttggatcctcaagaaacagacattttccgtctgccagtacactaacatggtatctgaaatgagacgattctgcttaggcattaaaccacctcccttcattttacagtgaagaaactggggtgctgagagagactgacatacataatggccacacaactagtgagtgaaagagcaaggatttaaacacagattttactccagtgctcacactcttggtgccacaccacccaagactatgccattacatggaccaaataagcatctatatatgggttcacctgaataggtcacctgccttcttacccccatttcacatcccacccaactgtctgtaattagcatttagattaagatagcctattcacatgaaagcatactaaaccagagagataaaatttaaagttaatattacttcccacccttcttcccagtttttggagtcctttcctttctcattatccacaaacattaattgtatatctgcatacaggcaactgtactggatgatgtgcactctaagaagtatgaaactggagccctgtcctcaaagacatatcatttaattgggatggtaagacatgtgccctaagttgggtaaataattagtagactgagggaaagatgagaagtagagattatataggaattcacagggggaagtgcactagacaaatgaaccagaatataaggcttcatgagggcagggtgttttgtgttttgttaactgtcataccccttgcatctaaaacagcttggagcttagtaagtactaaataaatatttgttgaattaaataaatatgcttcttgacttgttttaggaaaaaagtcctgatgtttatcatttggagactaactctcagtcctatatgcattccactttgtggattttactcacggtacacacacagcaggagctctctagggagacttgtagaaatgactattcaccctatgatgacttaaacctttgcaaaaccctagcaaagctgtgttctctgctgctccctgccacggatgggtgtttcccagcgatgaaaaacaacagggagccagagctttttgtttgtttatttgttcattatgacctcaagctcttttcagcaaagggcacagaccttagatagcaatgcaattctgggaaatacaactccattatttgcttggctcatctaacaagatagaatgcagactctgatttaaaagcaagctcctttaatgagttttagttagggttgatggataaacagttgttattactgtcagtaggcacaggttgtaaatgtctgttttcaatgcttatattccattacagggaactcagatgggcatcagaatacaatttcctttaaaaggtggaattaaggggaaacaaaaaagcaatttcaaatgtggtcattttgtgtatccccagatggtcaaattcttggtcttccaaggctccacattgcgttatgattttttgtaacttatttcatttttaccattgtacaaattcttattacttttggcttcagggcttggaaagatacggacaattagaatgtatcagaacactgaaaggaaacccaagcattcattaaaaaaaaatgagtgaggctaaacccatccttctctcaccatggcttacactaacctcgcagcaccacagtctgtgccagcaggtaatttcaagtaaaagatctatattaacacaaatggagaaggatctgatttcataacaaacaatgctaaatttgtgtgctctctgatttcctccaaaagcttagaaagccaaaatcgtgttcagttctgtgggtgcatctaagaaattagaatatcacgtaccaccatacaggtattgtgctaaacatattgcccactataatcctttcactttctgagaggtgtagctcagaaggtacctggtttatcacggagtctaaagaaaaaatgagaggccacacctaaagcaggcttatactttaaaaacaaaaatgttttattaggaaactttcctgaactaaagcaagagtaaacactgccttgtagagctttccatatttttcaaagatttttcctgaagtagcttcttcatcctctgaagtagataggactaagagtgggtttttttttttcattacatagatgagaaacagacataagaaggttaaataacttgcctaagaccacatggttaaaagcactaaattttaatccttatttcctaaagacctagacctattttatgtaccacatctaaagggatgcatttggaaagacagcaatgaaattcttgttatacaacattaactatgcctgccccaatcagcgccccctgcttttgaaaggtatagctatagctaataacctttactttgggcttggacatttctctttaccccatccccactctatttcctgaaagaacaattaagatccatctgggactaattatagcgattcttgaatttgaactcgcagccattacccaattgaggtcacttattttaaattaacttgcctggtcagaacacaggtttggttatcttcagaacccagtgcagagaggtaccagctcactcagacttttaattaactagctaaataacctgcactgtgacaagctgcctatgatttgatggactcattcatttgcattcagacaaggatcaaaatacattgtcagagcttcagggactgagtcctagaaaccttcacagtctcttgttaaaggctgtgagccacttccctttggttcgctctagttatttttcctgtgcttttgttctgattatccaacattcatcacaagtgcagcttgtgattaaacaatgacaactcatgtcatatgctgatagggaatcgaaaattggagccatgatcatatgaaccaagcacaaagctttgcaaaataattaggggaaaccaaagggaattccctggatgcccagcaacaaaggagaatttccaaagtttcgggccacaactgttccccacttaggtaataatacataataatggtaggtactcagtctttttttaattgaattcatggtgggagctgaccatcccacaatagtagtgacagttgttatcatcaataattattattacagcttccaacatttagttcctgggttcttgagtcagataaatcagattttgacttcaagctctatcattttcagcctgtgaggcatgagacaaattatccaacctctctgtgcctcaatttccttacctggaatataaaatcaataacaatgcctaccttaaaggattgtggtgaagcttcaatgagatgaagtgtgtgaaaaaatcgtttaacaccatgcgttgtacataacaaaagctcagtacattttagctaacgtttgtcttgttacatcccaccaccaggtttttatccagggcatctttccacctgggatcctctcttctccctgccagcaacagttcccctcatcattcaaaacctagtctaaagatccttcttttttctccagtggaaagccttccctggttctatcccctgcatgtaaacttgttcagtgcccatcctttcagtacactttctgcaatacacttttcagattttctattattttaaataggccatcttctactgtttcataggcaatctggacttttcttcaggatgtactattgtttaagacttccagaatatttatatagataacatatacagagagagagaaagcaagagagagagagagaaagacagagagagagagagagagagagagattgagcatctcattcagagacagagagagagagagattgagattgaacatctcattccattgtccaggctggagtggcgcaatcatggctcactgtagccttgacctcctagtctcaagcgatcctccttcctatgcccggcaattttttttttttttttagagatagggtctcactatgttgcccaggctgtgaaacatttactgagaactactccagtgccacacactggggctgtatgctgtggagtacaagagatgagtagagatagggatgggagaatgggaagcagcattggttgaatccccttatattgcagttgttctgttaggaattttaaaagcattttctcatttaggtctcacaataaccctaaaagtaagtgtcctagttactcttaatgtacagatgtggaaactgaggttcagagaggtaaaacgacttgtgaaatatcacctcatcttggaagaggaagaactggtcgatctgactccagagtgcactcttatcattaactatgctttactgcccaactcacagttttgttttgttttatcacttgcagtgttgtatgtcaaagcaatacataaactttaaagtgttacatatgtgacataaggtgattgcagtgtagcagatgctgttggtgccctacccatatcccctcagcactaacctttcctatacctgccaaaagcatcctattgtaggcacatgctgttctcctcttgaagactttctctcagcctgggagtgagacaagtcagaagagtgagggaggaattaatatttcccaaagcagttataagctaatggtgaatgggagttgaaagtcaaagaccccaacttcctggcccttttggtaggtgtattgtccatcacctccagaggtcccagaggtaatttgctgattaatacactgttttgtcacctttcttctccctgtctcatttcctcgctcccctactagttcttcatagaatcacttccaattaaactactggccctcaaatctttgtctcagggtctgccttcaggagagtcctggttaaaacaacaatgtttcagaaattcttttttggctcctttcccaggagtctgggtgaatttcctcatgctgctccctgcctacccaggactcaccatgggtgatccctaagggaccacctcatagactcagtgtgtcccttcctatccactttgatgaggatcccatcattgagggtcctgcttttagattttcaaagtgcatttattatcagatggaaaggtggttcttaaatttcagtgtgcatcagaatcaccaaaggtgagatgttaaaatgcaggctccctggccctaacctagacttgagaattagagtccctggagaggagctcaggtgcttgcattttctagattccccaggtgatccacatagtgtacactttgagaaatactgtcctaagacatccatgtagacttggcctcaagggaatgtagattatgttccttagtgctatctctacctccaaggcctctgtggagtcaagtaagaaagcctggaatagttatgcttccctgctcctataatgaagcacgaataaggccaagagctagatgctactgtcagagtagggcagcccaagacgcctaggcaatgttctacaatgcggaggagatatgcatcttactgactgccaaattattgctctcacctctctcactgcccacccccaacccctattctcccctgtattggaaacactgtgatgactgcacatgcccagttaggttatgacctgtgctcctttgtctctgagtgggagccccccttcacaacacacacacacacacacacacacacacacacacacacacacacacacacacacacctccttcccaaacaaggctactgtagagtttgagttcatggttttgatcaatgctaggggcgggagaggatggcgcaggggaaggtggcagtgcgggttactttgttgtcagtttacccccagcttctcttctcttgtcctttttgcactctcagcataaacgcccaaactccaagtacaaacctcaactccttccctccatctccagcccagtgccatcctaaccagtggccccaatactcctctgcacctgagtaatgatgcctttccacggcccccatcccacagcagcaggaaacctcttctctaccttttgagcttggggaacaaaaatcagggaaggcttcttggaggaggttgcatatgacctgcgccttgagggattgatgtgatttctacagagagggatgaagggaagaggcattgaaataaggagtaaggaagggagagcataactaatataggataagcattgggcaatctgttaagaactatagatacattattttatttattcctcactgcaattctatgaaataggtactaatggtagacccattttacaaataatgatactgaaacccagaatatttaagttgattgcccaaagtcatacagcaaagtaggaattctaagccaggcagtctagcctgtactcttgactaccctactctactgcctctcgactattgtaatccttattttacagatagaaaactgaggttgagaggttaggtaacttgcctaaagttacacagcttataactggcaaagctgggatacattgtctttagcagataccattctatttactatctaatcattcataccctctgtaacttagcttttttcaccaatcatttcagtcaccactccaattcttatggagtcagccctggataccatcacaccaaatgcttatagttgctcccaataaaaatctttcccctagtgtgtaagcactgtaaaagagcaaggctcttctgaaatcaagagaaatagccctctaaaacacatctctcttcattttcaaaatagcattctgtttaagttacctgtttgtcaggttcccacttataaaagctacaggaaaaatttctctagatctttagttggagacaaagtactttctatctatagcaaattatgagttaatcattctctcctcagttgtaccttgtacatatttctgttcttgcacttctcccactgggttataattgtctgttaacttggctttctttcccactcgaatgtgagatcctccaggctaaggaccaggttactgtgacctctgtatctccatggtccagccccagaattggcacagagcaggcattcaaaaatgttcattaaaagaagagaataatgaaatgtggttaataaatgcagcccttccatccacttgagattttaatcaatattctttctgaatccagtggtatgctggaaaactggctcccagagagcaaaataaaaagccctgatttgtagtattgttcgatttttgtggtgttagtactctcatcatggctgatttcaagcaaccaatggtttaataactggctcacaaaatttctgaatatttaacaatgggctttcaagagccccctgtatttcgctgaaagtctataattctgcctagggtgcttgaactgttagcgtgtcagtgtgatcagaaaggtggatgagctggcagagtggggaaaataatgccagatgcaaatagcaggagcgaaagaccaaaccaaacatttgtgaattaagagaattctgtgtttgcctcccatgaactaagcctctatcatttgtcatccatttgcaaattgagatccacttaaatgacatggctcccagtagaaagagaaatctgccaagtaagcaactatcctgaaaaatcaaaggcccaaagaacacattaggtttctcagagatatttacttttattcgaaaatataaacatgttcactcacttctttcagcaatcagaaaatctccatagatgaggatatcaagtgctggaagcactgcacagatggaaaatgcatagacgaggcatacctagggagttcaaaaggagaacatcccaccctctacatccccatatgtttctcttccctccccactcggaggctccattgttctaggctggacttggtctctaatacaatatcctaccagccatgcttaaattttgcacacaataatggaactaataagtaaatggcaggatttaaatccagaaccatccgacttcgaggtttatgtctctttctagtacatcacctttaataaataccaatttgtttgcagctttaagggcaactcagataacatttataaagaattttagactcttacaagtttaaacactgtaaggtatcattttaggtgtgacgagttattgatcctaataaaaacctaaagatggagaggtgtgactcttgagccaatgaaggaagtcttgttttatcccacccaccctcaagtagctgtggctggaaataacacacatttgagtaactactcagccatatacccgatggtgccattccttaaaaaataaaaaatcaaagtaatgagttcactggcactctcaagcttgctactcagtacccatacagtgctttcagtatatctgtcagatattcatgattatattgctttgggcccaaatgattttgcaaagtctatagagaacacaaagatacaatttgatatttagaataagggtgtcaatattaaaaccaaacattgttgtgaatgtgaatatagaaatatataaatagttcacagtaaatttcacaaaagaagatatcaggaatgctgtaatttaaaatttactctctaaaataaatttcttgctaatttggggagatagctaatatcagagaagctacagaagtcataaacatggtcgtgttaaagaaaaactaatttccctttgctgtgatactctagattgaatactagttaaaaatcactccaattctgccttccaaaaaaaatctagaatatttccaaatataaacagggtgccatgaaaagtcctctagataaggtactccaagaacagcatttgaaaatgcaacatagcttgataaagcatcattttacaggatgctggctggtggaaagatccaggaatttaaagtatttactgttggacccatgaccaaggactctagctgatcaaagctgcaggcatcctgtgtgggaaaatacatgtaaattgcctcaggaaatggttttgtaagtttccagattttttacacagtcccaggcatcatttgctaccttccgaactctgtccatcattttgctcctttacaatactcaagaagatttgaaagtagatgaagatattcttaaaatttcaaccataaatgggaaactaacctttcatcaggacagggaaacctgatctacattctctcccctaaagatatgatggctttaaggcaatatttcccaccatccctggtggtacacaagaggattttcagtgacacctagatgaatacattctattttcatacagttgtatttattttcttgtattagtgtcattgatattatccctctggacatgactagatttaagtagtgactagctataaaggaaaaaattaagtaaataatagtcatgtgatatgcagataagacaaaaatcattaaggacgtttgtgaaggagtgaaatttgagaaatgctgttttaggattaagacaatgaagtgttcccacaaaggtcaacatgtatttaaatggctgtttatccccaataccaataataatctgttgctcctttaatttattcatggccatttattgcctcttatttgcgttggttctttgcctctcctgctgtttagcattaaatcttccatgtattccattgagtcatgatgaatgcaatgttaaagtctggaaagtgaaacttcccaaagacatgttctttggtgaaatccttgttctctaatcctcacatcctagcattttatttgatgccttattcaattgccttctctctgcataagcttccctgtagatagcataagcattgatgagattcctcggttatacttccgttttccttctttacaaaaagcttcagcctgtctttctccatctgtaccacccccacccccattaccattgggctgactttggtatgggtgattggctcttctctgcctcactaatccagcacatttattcaagtcagatgactgcaatatgaagcattgtcattcggtgataggagagcatgtgtgtgcagattaagattattagaaaataattctaacagaattgacttctggtatgtatttacgaagactcaggcaatttagtaccttgggggttttattcatgaagatgaatgccttttatcatatggaagatttcttctgtaaagtatggcatgttttaaggctgatttctgtagcacacctcttattcaacttccaacatagccaaatgtaaataggatgccataggacaacagtatctttttaaaaaaaaattaactaggagagcaggaaaaaatgaagggggctgaaaaatatcccctctttgaacataaagaatgtggtctaatagctttttcttaaagagaaagtattcatacaataaatgaagaaaacttggtgaattaaaccagcaatcccccacacccacacttctctcctagcccctcagacatttgcaggatgcctaaatcaaagagaaatagagtaaggtgagcatcaaggcatgttgttctgtactcaaagcaagatcaatctttatacatagatccttttttggcgctgatgtagaaaatccaaacaaggagatacttaggtctacaaataacctaatctgcataccagatggatctaagggggaaaaaaacatacacacttctccacacacatatttttttctaaaatgtgagcatagaaaaacagatgcttttgcctcccaacggatctgtgggcctctctcaagtagtcttgtggagcaatttcatttcaaatttctaaaattatgaaaatgtctagattaaacattaaattgaaaaggaaagggcctcttacatagaaaaccaaatgaatattttatgaattatttttaactgctcagtgatacccaacccccagtttcacagatgagtggatatggggagggggccagtaagaggaagtctccccagaatgggttgactatgattcactaacttctttgacaaataatttgatgctatatgcatcactctgtgtgttagtatgtaagagctctttcttctacgaatgaaactctactgataaagcttcagtgaataaggattgtggcatttttttctttcagatcctatatgtgaggattaaaataaatttccttaaaacaataaattttatctatatttcacacatttccccttattacatttaatatatctgctatcatatcaagccatccatcatctccaacaaatcttacaaaagcaaagtgaatacagaacatggatttggaaacttgctatttcttccttaaatttcatggtcgactgtaaaaacagcttttatacttgaagttctgcaactaattcagaaagagctattataattactgtaaaagcaaagttgaatattcttttggttaccagagtcattaagtaactgagggtacaatttatgccttgttcatctataacagatggaaagaacaaagatttagggtgagctgaacaagaaccactcccattaactagttccattatgcatcgcactaagtacaatcctcccatcccaccctattcccataagccctgtaccaaaaattcaaaaaagggaaagatcaagagcaaaacatgacactttttgtggtgagggctcctgtagctcacatcagtaggatcatagctgctccacgtaagtaagatttcaagataactgaaatttactgtcttaagtattgggactttgagcatttcttctggaaaccttccctaaaatatgcatatccctgggtttttcagcagagattactgaacacaataaaccatagcctgatgacttagggaacatccatgattatactgtgcactagtatgatgttgtctcgttttctcatcccttctttctcctttaagtcagtctgtcacttccactgctactaatgtacctctttctaatatcagtccctcccttcacacacaccctttctagtttgcagcttttaatttactgtgaactggaaaaccaagattggtaagaactatatgttaagtaagagttaaggcactgaaagcaaggatgaggaattaattatgggcttcaatacatcagctttgtgacactttaatgttcctatctttagataagcttcctatcccagtttaaagctaaattttgaaagggtgttgttataagacagctaccttcaaataagtaaatttgttctgagcagaccaaagtgggcctgaattaaagcagatatcttgatagctccaagtttttctgaacctgaaaaacaatgtctcaatgaatgaccccttcccacatttatatagcatcacacacttaaataatgcacatttcaaacattttttttttttgagatggagtttcactctcgttgcccaggctggagtgcaatggcacgatctcagctcactgcaacctccgcctcccgggttcaagtgattctcctgcctcagcctcccgagtagctgggattacaggcatctgccaccacgtctggctaattttgtatttttagtagagatggggtttctccatgttgttcaggctggtctcaaactcccaacctcaggtgatccgcctgcctcggcctcccaaagtgctgggattacaggcgtaagccaccgcacccagcctcaaacacttttggagacattatccagtttgatcccagcaacacttctgatataggcagggccagattatagataaggaaatgaaggctcagtaatttgcccacaaacaaacaattagtaaatgacaagactggggtcctgggttctcattcactgttcttttcacaacactgatgtcttctattgctccctctcatcttctctacacacaaaaaaacactaaactctgcctctgatgaaaaagacgtattccttttccttgggattccttccttattcccctctaagcattgccagatgtctttaagaatattgctcatttttctagcagaactcaaaaccctctggttttattatgttgagagttgtcagttaattaaaaattcaacaaatgtatggtcccaacttgccaccaaaagttaacaaatgtcaccggcaaggatgtttctcgcaagcggacactgaagaatacatcccagaagatacctaacagctcattttgtgtcatggaagcatgagaaatcacatcctcaagacatttattaacctttcatttcctctataaataatcagtcagaaatgtggctcataatttaaattaatcaaaaactgctctcttgtcctctctctctctctctcatacacacacacacacacacacacacacacacacacaaacacacacacacacacatacttaaaatgacttgttgaaatgacttgagggcttgtaatgccagcatcatagtcaaatgtatggttccacttctctgggtcaacttaaacattgcctcgtccatgaagccttccctgttcatatcaggccttaaatatctcttcttcctcttgtccaagactttatagcaattactagcatttgctatttagcatatatttagaaaccatgtgaagtactgccaagagtatgggttctagaggcaaatggacccagattccaatcccagctttaccgcttcctagctgtgtggccttggaaaaattacataaactctctctgactgaaattcctcatctgtaaaatgagactaatgatacttaatctgttaaactgttctggggattaaatacatataaagcacttagcaccgtgcctgcatatactaggcactcaaataaggacagttagacttattattattacaatctttcatgtatagttctggtttgatatatgtgcaattttgaggccttctcactttgttctaaaccctttaatagctgcatccagagagaaatttatcataaagcttaagcttaatggcccctcacttgcatagcttctttccaaggccttgttccaaattatgacattcataattttatatttttttaaagaaagatcctaaaattgcattagcttcaggccagtacaaaacctggttccacctctggttgtgtctttaacctctatgttatcctgttccgtccatgggtactcattgtagtactttgtacacagtcagtactcaataaaaatcctcagttagccagagtttttggtgaatttggcttcaaggaaataaacatcaattatttagtcaaaaacttctaacttctaaccaatacatttgattggaaaatattcagcccactcacatattttgagataataaaaatgtacttcgtgaactgtacaaagtacatttttattaatacaaagcctattattagacttggtactaatatagcattattcataaaaattatggtaagaatgatgatactgaggaagggtttctcaaccttagcactactgacattttgggcctgagaattctttatgtgtgggctattccaagcattgtaggatgtctagcgacatccttggccattactcactaaatgctagtagcacccttcccagttgtgacaatcaaaaatgtcaccaggcattgccaagtgtcctcgagaggaatccctcctcagtgccctaaggcatcatgatcagcaccaaaagatgtacaagcgattacaagtctttcaaactaaagcaggaaaaggaagataattattttagaaaagttttcaataagcaaaagcaacctcggttaacctgaaaatcccattaaccccattccttgaatgttctattcccttagcattccagataaaaacaacaaaaaaaaaatactgtacattctattttctactttgtatgcaaagttcagctgattttccatctcaaaagctaagtacagaaatcgagttcatgagtgggggatcttcagcttcatcacttttgccatctattttaagtgacagtgatgctattgacctgaaagtttagggagtttttttccccttgttttgacattttaagtttggtattagcaagtcttcctgttttatctagttgaaagcgaaatgcaacaacaagaaatctgatccaattaactgtgattttcctgtatataaaagctctaacattttgttctagccaccccactgattgtgcaattgaaaatgtccttcttgaataagcaatatgtcttatttcttctttctgcaggttgtgatcctagggaaacactcaagaggttatcactacatgctcgctaacctggtaagaacaagcaagtgtccctgggcaatatatcctatttagtttgaatttttctgtaatcatccaaaaaggaaatacatcaagtacctaatgctttctccagaaacttggagaaatgacttcggtaaataccaaaacctgaatgcaatagccttgctttcaattatgctgtcgttttagctgtgaagcagctatattctttcctaatttaaaaaataatttgatatgattcattacttatttttagattcaatttcggtttgaaatgtaaactattttaattgggtttgaaagataaaccatggaattggggacacaggaaactgactctttcccaattgattcaagtatatgtgcagatcagtactgcatttgtcctttcagaagcagaccactaccaaatctttttgagcagatgtcagagtaggtttcaacacagtacattatatgaccctgccaaagtgtatagccacctttctacttacataaaacacaacttgaatctttactttcaaacttcccatgcctttaaaatttgtgacactgtagaagctagtatttcattaaggttattttatacattttctttctctggaaggacaatttgtttaggaattaacaaaattgcttctaaattagtaatatctgtttggcagaggttctgaataataccatctccatgaaatgaaagagaaatgttaaattatcgctataatactaaaaatctattaagttattacatgagttctaaccccaattttgtttcattagcacaagaaaatcatgatcattgtaaagctcttaagccaaaagaatagaaacaaaggtgaaagattattgtaattatattcttatattttttaatcaaagaaatatctaatatcttattttgttttcataatgaatattttttaaatgaaaaaggaaatgttacttaaacctctttcttaggggtatgtgcattcaaacactttataagatgcagattagagctactgctttcaaatgtagtgtgcatttttctccaataatttgctctaagtggagcacttagtccattttgggaataaatgaatctagtcttttagaagaagaaatcttgattcttaaattacatccatatattttcaatatggtttttaggcaaccaacaaataaaggacttttttaatgcaatggaggttaaactgtggcttgtcaggatatatggatgtcacaacaaggcacctgatacagttattgatgactttttgtcattactttctcaccagaaaatattttgctctccttctttccttcctttctgttttccttccttcctttcttctttccttcttttcttccttcatctctttcccctttccttctcctcttccttcatctctttcccctttccttctcctcttatttgtatgtcctagaaagcagcaaggtttatagcacagtgtttaaaaatgcagggttcaccaatcactgaccatacatgaggtgactttaggtagtatacgcacgcaaacttttttattttaatgaaaatatatttccttactatgtattagaaaaatataaaactagcatatcaaaattgaaattgtatagatactattacttcaaacagggctaaaatagagatataacaaaagtaaaatatgtttttaatgttcaagtaaacaatagcaagggggataaagagatatagcaaaatctgggttttgcctacctggttgttttatacatgaatgactaagtttgagatataacattgaactggggatcagaaagtttgggttgtcaaactgactttgctactagcaaggtaagggaccttgggcaagtcacttcaactctacagacagtgttacaattccattactttaactcaggtgggagtggtggggggcagtcattgatgtgtcggatgggtcatttgaaagcagataataattagaagtgcaagatatttattgggagtaatacctgtgaaagataaaagggaaagggacataagtaggcagggagagcttcagaccacaatacaggtctataccagtaacagaagggaaaaggaagcaagtttaataggaaaagcttcagactgtgctgtagcattgataaaatcttggccaacacaactaggagatcagttcaaaagatagctcatagaggagtcctatgcttcttccaaatggcaaatcatttcatcccgactttgctcagtcattagctggcagcagcccagaaagcacacaccttccacttgaaaaactgaggcagatctgaaggtacctgaagctggaggttgtcagctaacttaattctttgagacagattttgtcttaaagagcgatctgagccgtgcataagaatggctatctcatttggcctaccatgaccgatgatctgtaaaggcctttcccattctataattccaactgggtctccttatttctactgacaaacttttttattttttttatttttgtgggtacatactagatgtatacatctgtgggttatatgagatattttcatacaggcatgcaatgcacaataaccacaccaggataaatagggtacccatcatctcaagaatttatcctttgcctactgacaatcttttaaatcagcttttattgcaattttgagatccagacctgacaaaaattaaagtctatggagtgatagaactgaaagagaaaaatcactaggacaacgttgggaaaaagaatggtaaactgaatcctatacacacaactcagaattatgagactttgggggaatgtctactacaagaacaagcaaagtctgttcctttaaaaataaagtaatgtatagtatgatgtcagtctaagtaatgaaaatgtgacttcctttaccatgctttgagctgccaccctttttcttcctttagtgaccctcttttcatttgaattcagccgtgtaagtccctgtactctatatcaaattgcatttgggtaatagagataggagctgctgttcatctctgatgataataataatgagccaaattatccctactatggtccatggttcccagttttttcaaagcagataaaaattaccccaaatgcctccatcaaagacagacagagagagagagagagagacagagacagagaaccaaaactatttagaagtaagttggatggtcaagaaaaggggaagtggagataagaagatgtttcctttcaagatgagccagctggatgaaagctgagggtggatatctatatacaaaagagcaaagtccaatgtgagtcttggtgttacagacagcacaaaaccactgctttcttctacaaatgtagagtcaagaatatttaagctacttaactaagcttcctggaatcacttcctgcagttccctttgatactgagctctatctggcaaagacatctttgtacatttacatggaacttcccctggtaacaatcctaaagtgagaagacttggatattccatgaatgctttaacgaagacctctcagaggtcaagatgtacatttcagagtggacaatgagctgcagaaaattctagcttgttgaaatcccggaaagaaacagaagatttcaccaggagtacaacccagagatgtgatctactcaggctagaagtggacatcccaatagagcaagtaagtctcttagaaattcttgtatcagttgatgatgtcattttttaggagttgttctgtaattaattgttgttttatcttccaggactctctctaacatggcgctgtttgtcaacgttagtcccagaattagccatcatgtgtacaatctgtcagtcaagcagcctctcaatctctcatggtaaggtcctggatctggatgctttacactgcattgtcaggcatgttatgtaaagtgatttagtttttttcacctatgtcagtaatgatagctcagttactgtgtgtagagccctagagtaatattaggaatagatgcaagggcaggaggcagtgtggtataataataataagaagaaaaaaaagcacgaggctaggaggtaggagtcaggtttgaatcccaagaattcatctaactagctatatagcaaaccaaacccctctgaacctgattatcaatctgtaaaatgcagacgtagacaagatcagtatttcccaaaatgtacatgagatgattttagatactacatagcaaaacttctcttttaacttattagttttgaatgtatattaaatacatattggaaaaacaactatcccagcaattctgtgattttatagataccattccttagaatgaggctaaagtagatatatagataaaagaaactcagtcaatgtaaataaaaatattaagtaaattatagttcggatggtccacctctatggcaaaaaattgaaaaggtggtatactaatgactagaatttggaaaatacaccactgtcgcttctagatctacatttcttccctcttggagttcagtttgggccagggtaggccaggtgaatgctgaggacacaaacagggaagcaaaaccagagccccgttatccttggggatataaagttataaggcagactaaagctttaaaatcagtccaagggggcaaaaaccaagatagatatgagtattcttagccaagttctaagcagagctgaggatctgaaggatcaatcaaaaacagtctagcagattacacagggcaaattggatctggattgaatgatccaacaacagatgttcatcactccccaaataagaccaaaaacaaaaacaaaacaaaacaaaaacccacaaacaattgaagtgcccaggggagaacatgagccatagcagggctcattcagtgttgcaccagttaaccactgccttagaagacctgacattttccctgcctaggttgatactggtaccagagttggagacaattgctgaccctttaagtggaggaatttaggtaatgtctgctgttagcagtagagagctacaggcaatcaaacaggtcattgtgcaagaagagaaaatagaagaaagttcatctatcttatattcctctctgatgtgttagctgttttctttagactttcatttaattttctcagaacttctatgaggagagacttcttgcccacccaccttcctaagccttttacatatcagaaaatggactcagaaaatatatataacttgcccaaagtctcatagctaatccattgccaaactaagttttctatctagattggtaacactcttagtagagcacctcgctcttcccactttacccacccaagcttctcagtgagatagaaagccagcaccacaaaggtcacataaaagcatttgcaaagacacaaatgtaaataaatgaagcacaagctctaaatttatgaggatgaagtgatcagagataaaaagggcttttaaaaacaaggacacgttgggccgggagcgatggctcatgcatgtaatcctagcactttgggaggccgaggtgggtggatcacgaggtcagcagttcaagaccagcctggccaatatgatgaaaccctgtctctacttaaaaaaaaaaaaaaaaaaaaaaaaaacttagccaggcatggtggcatgtgcctgtagtcccagctacttgaggggctgaggcagaagaatcgcttgaacctgggaggtggaggttgcagtgagctgagatcgtgccactgcactccagcctgggtgacggagcaagactctgtctcaaaaaaaaaaaaaaaaaaggacacctttgtgaatctggttttgaaaaaaaccatccaaaagcccaacatgaactgtatcttaacaggcatcaattacatccccatcactccctgctgtctaaccattttccttccctcctctctctctctctctctctctcacacacacacacacacacacacacacacacacacacacacacacacattttcattccccttttttcttatgcttcgtcttctctctccctcctcatccaacctcacttatgccagaaaataatgatggaaggggggtactagatgacatctaatttttccaaaattttactaaaacaagagcattactcataagattgaacccaaacaggcagccaggagcttcaacaagcttgaggaagtgaactctgcagctcaccagatctcagaatgtacttgaaaaacagaagggcctattttgcttagagagaaaacaagtttaaataagatttagttatgctgttttgcttgccaataacaactattcccttctctcttccccttccaggtcttcttcttctgttctctactttccctttctttgttccgacattttttatgttctaaataaaaaattcaaatgctcaaagccacgtgttgtgatcactgacacctcagcagatggcatgtaaacacagagctcactgggctggagcctggctttgcaggcaagggaggtgggcttgcaggtaaaaattccccctggtcccaaatgccagggagcccagtcacctctcctggtgcacaacttctctggtagctcaggattcactttcttctccaaatggaaatggtacatagaacaccaagggaatgaggagtggggactgggctggtttccaacttcctgccatgcatttcaaaagccacaggcatttgtcagcttaaagttgcgaactctgagactcctattctctctctcccaaaatgcctttattatagtcaaccactgcactgtgtctctcttctctctctcccctgcctgaaattaacaaggaaagatcatttcctacccaatgttatagcaagatgaattaaaagcattttatcttctccccaaactctcagattatgtcctctaaaacagtgcttcctaaactacctgtgaagaagaaccagtttttccccccaagatcttcatggaccagtaaacatgcaacaaaaataaattacttaaaaaatgaaataagcaaaataagatatataaaatataagttcagtatttttagtattacattcaatagccattatattaccctgtcaagttcctatgaaggttggtaaagacttaccctccatttctttccttatatcatctcagactggtaacaaacaatgaaccagcaccagtctgcacacattttgagtagcactgctctgaaggtctttacagtaagtgtttttttctatatataccactgtatgtccaacaacttgttcacttcacagcaaggaaaacagagtgtattgtccttaagaaccttataattgtattgttcagaccagacttgcatagcttatgataattgccactgagatagaacaggtgctgggacaatgaataaagagaaggcagattgtggaagtcaataccgtggaagtctgcatagtgtagccagagaaggcctttcagaaaaggtgactttgaaaccataatctgaaagaggagaaagattcagctacatgacgaaacagggagagttcatgcatagggaacagtacatgtcaaagtcctgaggcagaaaacagcttgatgtcttccctgaacagtcagaaggcaattttgggtagagcagaatgagtgacaggacagattagatgccaggtggaagagttttacccttttttcaacagcaacagaaggcccattgaagaatttcaagcagggaaggggtatgatctgatttatgcttttttaaaaatccgtgtcaaatggatgagttttatgtgatataaattatacctcaatgaagctgttagtaaaaaaaaaaaagagagagagagagagagagatcagtggctatttccccattaatagaacttatgccacgttgtaattatttatttattcatacaaataacccccactgaactgaagtgccatgagggcaaggaccaagtttgagatggctcgccattgtaacagctagcacttaataggtttctaagtatgtttgttggtcagactagagaataaaatcatgagtgaacaatataagcaacttgtaatcaagtactaatttatatggtgtaattgtcaactctacacattgtatcctcccaggaggatggatctgctttctagaaaaagacttgtgtctctcattagcaatctgacaacttgaatcaccacaattactatgcatttctttactgaagcatcacccagatgaacagtacaaatggcaccaaaggcagagccagtcttcatccaaaatgtgagatagatagttgtctttggcagccttccaaccctcattctactgcttttatctttcctataggcaagccaccttttctcacccataatctatcatcaactcctaaaagtcacccaacttatcttgtctctgttttccccctgtacaaaatgtgccctaataatagtactgtatgaaggaaaactccacatcataccttgaaaataaatgcacttaatgtaagccttggatatatttatttccaactctcaaatatccacacttccaaaagtaaagtgaaattcagtatgtgaaaatcaacaaagatgggataataccaaagtcatttggatctttggaagactgaattgtcgggctattctcaaatcatggatggtctgtgtttggatgacagttgtgtaaccagtgtctatgtgaaagatggctttggagagttaatcaacagaagcttacaagaccctgcatgaactgcttaggcataaaggtcatgttggttttatatagctgcattcagatgtgagcaaacatgcactgatcaaacaaacagacatgatatgattgagaagtggtgcaatttatgaaatatagcagaacctacaaatcaaaatgggtagtttccgtttcagaagaatcacttctggatattatacccatatttctaacaaatatcaccattgttacacagaagcagtcaagtgtacagaaaacttagaacgcagagagtgagaaagcagaatttcaattcaccctatctatgagcagtaggattgcttccaatctgtccctgccttctctcatatcttttaatctcttcccactgcacacaaagattaccgttcaaaccaaagaaaaggatactaacatggctagccaacaaaaccattgattgcaaccaaatagaattggtgaaatgcaaacagcactagaattcgataagtttagtccaagcacacaaaaatcattgaatttgtaatcaacccttaattattaaaatccttatgaaataataagataggcttaacagaaattccatagcacaacaggaaatttgggaccttagagtcacttagcacctatgttgtagagtatacacatatacttattgcacagaaggcatgggaagtcatgcaataataagacaaaaatccataaacagtcatccatatgtacaatagcctatgtaatcattgggaagggggaggataaaggagcacaattagcccccttactacctagtagaagatacagggacaaatttgatatagatgttcttaaccattatttcactaattgaaaatgttagcaaggatgcagaaaaaagggaatgcttgcacattgttagtgggaatgtaaattagtgcagccattatggaaaacagtatggaggttcctcaaaaaactgaaaatagaactaccatatgatccagtaatcccattgctgggcatatatccaaaagaaacaaatcagcatattgaagagttatctgcactttatgtttactgcagcactattcacaataatcaagaagtggaatcaatctaagtgtccatgaacaaatggataaaggaaatgtggtatatgtacacaacggaatactatttagccataaaagggtggaaatcctgtcactgtgacattcatttggatgaatctaaaggacattatgtcaagtgaaataagccaggcacaaaaagacaaataccacgtgatctcacgtatatgtggaatcttaaaacgttgaactcatagaagtagagagcagaatggtggttaccagaggctagggggtgaggagagagggaatgaggagttgttaataaacaggtccaaagtttcagacaggcagtaggaataggttttgagagctattgcacagcagggtgcaataacaatgcatcatatatttcaaactaagagggtaaatttcaaatgtctcaccttaaaaaattgtaggtaagcaaggtgatggatatgtgaattagcttgatctaatcatttcacattgtatatgtatatcaaaacatcacattgtaccccataaatgtacacaattatgatttgtcaatcacaataatattaataattaaaaaagaaagaaaggaaagaaaagaaaatggttcttgaagaatgaaatttcaatagaggcacctaaagttgtaagtaataaagtaggggccctttgtaggcaaagagaacaaagataccaatgttaaaagagtgcatgatgtggctagagcatgaggtctgttgaaggaaatggtgtagatgaggccaggggagcagaagataacagataatggaaatccttgaaaatgaagttaagatatttggctgttaatagaaagtagggactcattgcagtcctttgagaaaggagtcttatacactaactggtattttaggaaggtaaatttattatgtgaagaataaactggagagggaaaaaaaaagaaatcagagcaccaactaggaagctaggacaataatctaggccagtggttctcaaaccctcttgtacttcaaaatcacctgttgaattagatgcttgggcctcatactccgtaagtctaaattagagaaagggatacaaaaagaagagattttaaaggaatgtaatcaccttgctttggggcacattctttttttattttttttaagtgaaagcaagtttattaggaaagtaaaggaacaaagaataggcagagcagcccctagggctgctggttgcccatttttatggttatttcttgattacatgttaaacaaggggtggattattcatgagttttctgggaaagtggtggacaattcccagaactgagggttcctccccattttagaccatagggtaacttcctgacattgccacggcatttgtaaactgtcatggcgctggtgggagtgtagcaatgaggacaaccagaggtcgctctcattgctatcttggttttggtgagatttagcaggcttatcagcaagttctttatgacccatatcttgtgctgacctcctatatcatcctgtgacttagaatgcctaaccacctcggaatgcagcccagtaggtctcagccttattttacccagcccctactcatgatggagttgctcttgttcaaatgcctctgacatttctcctctcccttttataagagaacctttaatcctaagggttctccttcgtagaaggatgaagattcatcttctgtaacttctttaggctgaatagggcaatgatattcccgcttaactattggttcccttgcatttggggtagagaggagctcagtcaaaatgctgacttggtatgtcaagggccatttataactcttgagttccaacaaaaggtgatatctggaaaattattaagtgttcaatttaagagaacattgagtaagcttatcctgcattcctacacgtagagtgtaacagcaatatattccacaacagtaaagcaaaataagccaaattattccaagtaaactaaataagaaggctttccatgaactgggaaactgttggaaccaagctgatatggggttgctagctgactccagtatgtaaggcacattctttttacaacgcacatggaatatgtaagttaatttagtcagcaggtggttagagaagggagttttagagatatgagaaggtttaattggagagtcattggtatcttattcaaagtgaattcaggttgaaaatgccaaaataaaataagaaattaatttgttttacagactctaaagcctcaaaatgtaacaagttcattttctgaggtatttgtgtggtaaatgtcatccttttgaaaaagcagattctcagagcccgactttatgaaaaatcatgagtatccccatagtcaaacactcaaaattaaaaatataaaaaggcaaataaaaaagaacaaaaaattctaatgtctttgggtagacgagaaatgccagaagaaggtacttgttttcaagcagaaaatgaactgctgaagcagtctatgattcagtgaagggagaaagcagttgctgcaaaacagcttaaacaaaaggaaccattgtttctcgcaaaaatatcaagtctactgaaacacattttgttttcggtaaaaatgctattttaaaatatattattttaataccagatgaaattcagtgaggaaatagaattcatgacacagaaatttcctttgaagtcaaacttgttaaaaatgtatcatgtattaaataaaaagatgtgggttctctcttttttttgttttttgttttttgttttttgtttttttgagacagagttttgccctgtcacccaggctggagtgcagtggcgtgatctccactcactgcaacctccgcctcctgggttcaagcaattctgctgcctcaacctcctgagtagctgggattacaggcacccaccaccacatcaggctaatttttgtatttttagtagaaacggagtttcaccatgttggccaggctggtctagaactgctaacctcaggtgatccgactacctcagcctcccaaagtgcacggattacaggcatgagccaccgtgtccagccttctggatgttgtttgtttgtttgtttgttttttctgaatagtcgtcattggatgaggagttcaggtcaagcatttaaaccctgaaacaaaagtcagaacaaactaaaaagacttaagaacatgaaaccaaatgtcaactttgtttgagccaaggacatgaattaaaaagtaaaaacttgtaaaatcgtttatcatgtatttaaactagtaatcatatacttttttctaaagacttggattttctgataataaaaatatctgtctgtgttcacatatattgctgtctggtcactgctctacttctactcacaacagcattcattatacaagggaaaaaatggaatatagggaggaggctgggctgtgggacagagagaagtctgagtgacagtaattggagtgtgtctgataggcagatgcttcatgggactagtcggaactgattggctgagggagctatgtcccactcgtgggtgttattatcagagaggaggagtgagaatggaactttctggaaaaggtcacatgataaagaggaccagtaagaggtagcttcacgaatggagtctgagccagctagctatggagaataatttgacagctggcaggcagacaggtaggatatgtaccttcctctactgctccctaccccttaaaaccccatctctttctgcttttacctctcgggtctgggtattgaaggcctaatgctgtttcattcaatttttacagaagttttaggaaaccagggactctaaattctccgacatggtgaactgtgggtggccatctccaactgctggtgatgccagaaacgaaggcaatggggaaccaggaggcaatacacaccttcctttagctagaagctgtctcctaaaatatctgtctctacatattacccccaccctttccctttccacttttacctaatggctttcaagtgacaaaaactgtgtgggcaattttacaaaagtttcagaaaggccagacatttcaatttctcaaaagagtgaagtggcaagtcccactgtagatcataatacaaaaaaaaaaaaaaaaattggccaagagctaggaaactctaataatttagctaatcatttagccagattatatgagcatttagccagatattcatataatagccatctctacattccttaaccttctcctgatagagattggtgccggatagcaaattctgttacaataattttttggtagggtttaaagaaaacaggggatcaaaattcccaaaagtgcagactttgggtggcaaacatcaagtaaaaattaccaaaagggaaaaaagcaaaaaggagccactaacttttaatatctcccacccttccactctctcctctcctcctttccccttttacttactgtatgtgtgatactcagatctgttgatttaatgtcttaacagaggttttatgtggattcttcctcaattttccaaactcaaggactgcgaattggaagctcacaaaaggaaatgtagcaacatgctatgagcaagaataatcatttaaaataaaaggataggcagaagagagccaagagccaggcaacctctgtcccataggcaaaacatctctcttttttgtaggctagtcaagtgcagcagtgggagtacagaaggcactagaacttttctcttaatacaactatgcctaccattcatcccttttttcccagttgctcagatcctcaattcctgtcgaagattcgctggccagctctgctgaattagtgtctttgctgagatgatagggagcgtctggcctcaattttcaaaatgttgtatgcactgtgcttgtccatgactccaataatgtctagcgatatgtgaaagaaaacagaatatattttaaaacaatagagtagagatggaaggtggactaagagccaggcatgtctgcctctcagccagcaactgtctccgaacttccttctttctactgttattctttacctttttctttgatctgtttacctatttgatctgtatggtggccatttctgctatgttagttgttttacagaggttttagagctacttggcatttatatccaaacttgaggtcagtgtgttatcaactcaaaaaaagaaatctagcaagagttatggataagaaaaatgtcttaaaaataatgagattctaggtgaataaggaccaggaaccagccaacttctgctcttagacaggatccctacattctaccagtgaccttaatccctttattttccttttatcctctaggtgttcagtggacatttccactgcattaatgtctttatagtgttgagtgggacttgggttcagtattcgcacctacaattcgcaagtggtcagctaaagaagtgaaacctaaaaataatttatgaacaaatgaaatgtcttaaagatattgtgataggagccaaaacaggattaggagccagcaaactgctgtccttcatacaaaagtggtcttctaataagcccctttttaacacacacccatcctacttttccttctccctcttacttccaggatatggggtggtcatgctgctgcatcaattacctacatgaaattgttgggagactctaatctcagttttctatacactgctgactgtatttactcatgtcagctacaccatttagcaatatgagatggaaaagacaacatgctttgaatcacattagaaggtacacagggaaaccaagagtaagccaacttctgcccaatagtcagtaccactctcctgccttccttcactctgccaacgaccttcacacatttgtttttcccatttccctttcaggttttcagtggtcacttctgttgcattattttgtttatagagatttcagtggggcttgggaaaatattcccacctgaatctctgcaggtaatcagaagtaaggcctaggaataatgtattttattttattttattttattttaaagggttttttatttttaatttttgtgaatacatcataggtatatatatatgtgtgtgtgcatatgtgtatatatatatgtgtcatatatatatatggtacatgatatattttgatacaggcatgcaatgtataataatcacatcatgaaacattgggtatccatcccctcaagcatttatcttttgtgttacaagccaattatcctcttttagttattttaaaatgtataagtaggtttttattgactacagtcaccttgtcgtgtaatcaaatactaggtcttattcattctaactttttttttattaatcatccttgtcttcctcccacccacccccactacccttcccaacctctgattaccatccttctctatggccatgagttcattgctttgatttttagagcccacaaataagttaaagcatgtgatatttgtctttctgtgcctggcttatttctcttagcataatgacctccagttccatccatgttgttgcaaatgacaggatcttattcttttttatgactgaatagtactccattgtatatatttatcacattttctttatccattcatctgcttgtggacccttaggttgcttccaaatcttggctattgtgaacactgctgcaacaaacatgggagtgcaggtatctctttgagatcctgatttccttacttttgggtatatacccagcagtgggatcgctggatcttatagacgacctattttcagttttttaaggaacctccaaactgttcttcatagcggttgtattaatttacattcccaccaacagtatatgaggattcccttttctccacatcctcaccagtattttttattgtctgcctttgtataaaagccattttaactggggtgagatgatatttcattatagttttgactttgcatttctctgatgatcagtaatgttgatcaccttttcatatgcctgtttgccatttgtatctcttcttttgagaaatatatattcaaatctattgcccatttaaggaattggattagattttttttcctatagagttccttatatgttctgattattaatcccttatcagatgagtagtttgcaaattttttctcccattctgtgggttgtttcttcactttgttggttgtttcctttgctgtgcagaagctttttaacttaatgtgatcccatttgtccatttttgctttagtttcctatgtgtgtagagtgttactcaagaaatttttgcccagaccaacgtccgggagattttccccaatgtttcattgtagtggtttcattataggaggtctcagattcaagtctttaatccattttgatttgatgtttgtataaagtgagagataaagatcacgtttcattattctacatatggatatccagttttcccagcacaatttattgaaaagactgtcttttccccaatatatgttcttggcatctttgttgaaaatgagttaactgtaggtgtgtggatttgtttctgggttctctattctgttacattggtctgtatgtttttatgccagtatcatgctgttttggttactgtagctctgtagtataatttgaagtcaggcaatgtgattcctccagttctgttcttctttctcaggatagctttggctattctgggtcttttgggatttcatataagttttaggattgttttttctatttctatgaaaaatgcctttggtattttgataaggattgtattgaatctgtagatttctttgagtagtatggacattgcaacaatattgattcttccaatccatgaacatggaatatctttccattttttgtgtgtccttgtgaatttctttcatcagagttttatagcgttcattgcagatatcttttacttttttggttaagtcatttcctaggtatgtaactttatttgtggctattataaatggtaatttttaaatttccttttcagattgttcattgttggcatatagaaatgctactgattttcatatgttaattttctatcctgcaactttcttgaattcgtttatcagttctaaagttttttgatgaagtcattagatttttccaaatataagatcatatcatctacaaagataatttggataatttgacttcttcttttccagtttggatggtctttatttcttttttttttcttttttatatttatatatataccttaagttctagggtacatgtgcacaacatgcaggtttgtgccatgttggtgtgctgcacccattaactcatcatttacattaggtatttctcctaatgctatccctcccctagccccccaccccacaacaggccccggtgtgtgatgttccctgccctgtgtccaagtgctctcattgttcaattcccacctatgagtgagaatatgcggtgtttggttttctgtccttgtgatagtttgctcagaatgatggtttccagcttcatccatgtccctacaaaggacatgaactcatcattttttatggctgcatagtattccatggtgtatatgtgccacattttcttaatccagtctatcattgatggacatttgggttggttccaagtctttgctactgtgaatagtgccacaataaacatatgtgtgcatgtgtctttatagtagcataatttataatcctttgagtatatacccagtaatgagatggctgggtcaaatggtatttctagttctagatccctgaggaatcgccactgtcttccacagcggttgaactagtttacactcccaccaacagtgtaaaagcattcctatttctccacatcctctccagcacctgttgttttaatgatcgctattctgactggtgtgagatggtatctcattgtggtttggatttgcatttctctgatgaccagtgatgatgagcattttctcatgtgtctgttagctgcataaatgtcttcttttgagaagggtctgttcatatcttttgcccactttttgatggggttgtttggtttttttcttgtaaatttgtttaggttttttgtagattctggatattagccctttgtcagatgagtagattgcaaaaattttctcccattctgtaggttgcctgttcactctgatggtagtttcttttgctgtgcagaaactctttagtttaattagatcccatttgtcaattttggctttcgttgcgattgcttttggtgttttagacatgaagtccttgccgatgcctatgtccttaatggtattgtctaggttttcttctagggtttttatggttttaggtctacaatttaagtctttaatccatctcgaattaatttttgtatagggtgtaaggaagggatccagtttcagctttctacatatggctagccagttttctcagcaccatttattaaacagggaatccttttcccatttcttgattttgtcaggtttgtcaaagatcagatggttgtagatgtgtggtgttacttctgaggcctctgttctgttccattggtctctatctctgttttggtgcaagtaccatgctgttttggttactgtagccttgtagtatagtttgaagtcaggtagcgtgatgcctccagctttgttatttttgcctaggattgtcttggcaatgcaggctcttttttggttccatatgaactttaaagtagttttatccaattctgtgaagaaagttattggtagcttgatggggatggcattgaatctataaattaccttgggcaatatggccattttcacgatattgattcttcctatccatgagcatggaatgttcttccatttgtttgtgtcctcctttatttcgttgagcagtgttttgtagttctccttgaagaggtccttcacatctcttgtaagttggattcctaggtattttattctctttgtagcaattgtgaatgggagttcactcatgatttggctctctgtctgttattggtgtataggaatgcttgtgatttttgcacattgattttgtatcctgagactttgctgaagttgcttatcagcttaaggagattttgggctgagatgatggggttttctaaatatacaatcatgccatctgcaaacagggacaatctgacttcctcgtttcctaactgaataccctttatttatttctcttgcctgattgccctggtcagaacttccaacactatgttgaataggagtggtgagaaaggtggatgctctttatttctttcttttgtctgattgatctaggtaggactttcagtactatgctgaataacaatgaaagtgggcatccttgtcatgttctaagtcttagaggaaatgctttccattttttttccctccattctgtacaatactagctgtgggactgtcatatggcttttattatgttgaggtatgttccttctatacccagtttttttagggtctttatcatgaagggatgttgaactttatcaaatgctttttcaccatctattgaaatgatcatatggtttttgtccttcatcgtgttgatatgatgtaacatattgattaatttgtatatgttgaaccatccttgcatccctgggataaatcccacttggtcttgatgaatgacattgttaacatattgttgaattcagtttgctggtattatgttaaggatttttgcatcaatatttatcagagatattggcctctagctttctttttttgatgtgtctttattgggttttggtatctggttaataccgcccttggagaataagtttgtaagtctagggataatttatgagcaattaaaatgcttttaaatgatacgataggaaaatgagcaggataagaggcagccaacttcactttggcctttttttaaaccctcttaaattctggatatcttttagtgttctctgttatattagttctttgctgtaattgcccaaataatccagtctcagttttctggacctgcagactgtatttgcggatatcacccttagaatctagcaatatgtgatggaaaagtggcatgctttgggccacattagatgggaaatagatgaaccagtaatcagccaactctcaactttagtgagcacttatctcctaactcttctttataccaataacctttgcacatctattttcacctttcatcttctagatgttctgtggtcatgtctgttgtcctattttatttatagagatttcagtcagctcagccagctattcccacctctgagtcttcaagtggtcatctcaagaaatgaaaaactagcaacagtttgtgaataagctaaatgtcttaaagtgttgtcataggcaataaagcaggatcaagagccagccaacctgtaaagtttatggaaaaatggtctcctaatattaacattcctagcataccactgtccccttctttcattctctatcttatgtcctggatattggttactaagctctgccacattagtgtctttacttatgttgtctgaagaatctagtctcactttcctgcaccttgcacactttatttgtgcatgtcaaccatacaatctagaaatatgtgacagaaaaaaaaacaaaatattttaaaatagaatagaagcaagtgaactaggaggcagacaactcctgctattcagaaaaaaaattgggctttcagtgtttgcctcttgccacaacctgcccttttcttatttacacccttacatcctgggtatttggtaggaaaccatcttatattcgtgtctttgctaaagttggcataagaatctagtctcggttttctgtatctgtagactgtgtttgcacatatcatgatagaatctgggaatatatgatagaaaacataatacactttgaaccatgttagaaaggaaactggtgaatgaggagtcagccaactcttgcccatcagccatcccttttctcctaacttctttatttcttccaatgttctgagtttacttttccccttttatctttcaggtatttagtggtcatttctgttgtgttatttatatagagagatcagtagggttgggccaaatattctcacattttggtctgcaagtggtcagctcaagaagtgaaacctgggaagaggttatgaacaagtgaaatgccttcaaatgttgtcataagaggaaagacagcatcaggtgccagccaactcctgcccttttacaaactttgtctcctaatattcctcttcttatcactcccctcttcttttcattcactctttttttttttttttttttgaggcagagtcttgctctgtcgcccaggctggagtgcaatggcgctatctcggctcactggaagctccgcctcccgggttcacgccattctcctgcctcagcctcccgagcagctgggactataggcgcccgccaccatgcccggctaattttttttatatttttagtagagacggggtttcaccgtgttagccaggatggtctcgatctcctgaccttgtgatccgcccgcctcggcctcccaaagtgctggtagtacaggcgtgagccaccgcgcctgtcctcttttcgttcactcttttcccttgtggatatttgttggtcacttctgttatattactttctttgctgaagctttccagaggccgaagtctcttttgtaacttggagtttgtatttgcatatatcaacagttgaatctaacaatttgtggtataaagacatgcttgaacccaaattaaatggaaataggtaaaccatgaaatagccaattccctcccattagttgtaagttccttatttctgtctatgatatttctcattttattttctcctattcccacatggatttttaaaattatctctgtaacattagtatcttttgagagatttgagagagtttccaccttgaagtctgaggtcacaacatcaaacagagaagcttagcaagcattatagaaaagtgaaattccttaaaataattaaataacaagaaagtatgaaccatgagccagccaatttttgtctttgtgccaaactatttatcctaacttccatcatcctttatagcccctccatcatcaccattctattgccttccttatacactctggttgttgtctgggctcttgtctgtgttattgtctttatattggtttcaaggattcacagctcagctttaccaccttgactactgtgggtgtcttgcatgatgaaaaagatttaacaagatagtataaaaatgtgtattcccttaatatttttggattttataaaaagaagttccagaaatcatacacctcctgtcctctatcgagatcctcaatcctaaaataactgtgatcctcagtctccctatttcacttcacttttacatatattctcatgcttgctaaatgtttcatggtcacctctcccccatcagtgtctttgctaagcctgtgggaaaaatcaggcctctgtgttcaatcttgtggactacagtttcttacaatacaaagtagcagtttatgaagaaaaacagcacgtgcattacaaaacttaattcagatggaaggtggtccagatgccagctgacttctaccatttatttaacacctctctcctagcttccatcttctactgctgaccttctttcctctattttcccctttatcgtccaaatgtttaatattcatttttgtagtgctagtgtatttgcaaaggttttagagagactcagtattatcaacttgaggcacttttttttttttttttgagacacagtctcactctgtcacccaggctggagtgcagtggcatgatctcagctcactacaacctccgcctcctgggttcaagctattcttgtgcctcagcctctcaagtagctgggactacaggtgtgcaccaccacacctggttaatttttgtattttagtagagatgagggtttcagcatgttggccaggctgatctcaaactcctgacctcaagtgatctgcccacctccgcctcccaaagtggctgggattacaggcatgagccaccattcctggccaacttgaggaccttttgtggccaactcttaaagagaaatctagcaagagttgtgggcaagtgaaataccttaaaataatgagataataggtgaaaatggaccaagagtcagccaactcctgccctcagccagaacttgtatcccaacttttaatttctataactgcctgtcacctttcttttccccttcactattcagattagtttttttttaatttgtataaatgtatggggtataagtgtaattttgttacatagttaattttaaaactctactgtcaggagtgggattgttgaaggttatttttgttgcattaatcccacctcaaggtctctgtgtagccacttcttgcaagaaatgaattctggcaagagttatgaacaaattaaatgtcttaaaataatcatacaagtggagaaagtaaaccaggagccagccaacttctcccctgaatcagaacatttctcctaacttctatcaccctaccacaaccctccctgccatcaccattttatttccctttttatatactctatgttttatagtgtcctatactgttttagtgcctttacattgatttcagggatacatggcctcaatataaacaccatgagggttttgtgtgtccaatgactaaaatctaacatgctatggaaaagtatggtgccttaaaattcgaaagcaaagaggaccaggagcctgacacctcctgctctttagcccaaaaccatctcttgctctcttctctcttaccactttctccccttctttatttcctgtctacttggtgtatgtttgctggtcagttttgttgcattagttattgtattaaatctgtcgctaaactcaggcctcaattcacaattttgccaactatggttgtacatgacaacagcctctagcaacttgtttttttttttttttttttgtaaaatttatttttttattatactttaagttttagggtacatgtgcacaatgtgcaggtttgttacatatgtatacatgtgccatgttggtgtgctgcacccattaactcgtcatttagcattaggtatatctcctactgctatccctccccctccccccaccccacaacaggccccggtgtgtgatgttccccttcctgtgtccatgtgttctcattgttcaattcccacctatgagtgagaatatgcggtgtttggttttctgtctttgtgatagtttgctcagaatgatggtttccagcttcatccatgtccctacaaaggacatgaactcatccttttttatggctgcatagtattccatggtgtatatgtgtcacattttcttaatccagtctatcactgatggacatttgggttggtttcaagtctttgctattgtgaatagtgccacaataaacatatgtgtgcatgtgtcttcatagcagcacgatttataatcgtttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcccgactttttaatgatcaccattctaactggtgtgagatggtatctcattgtggttttgatttgcatttctctgatggccagtgatgatgagcatttttttcatgtgtcttttggctgcataaatgtcttcttttgagaagggactgttcatatccttcgcccactttttgatggggttgttggtttttttcttgtaaatttgtttaagttctttgtagattctggatattagccctttgtcagacgagtagattgcaaaaattttctcccattctgtaggttgcctgttcactctgatggtagtttcttttgctgtgcagaagctctttagtttaattagatcccatttgtcaattttggctttcattgccattgcttttggtgttttagacatgaagtccttgcccatgcctatgtcctgaattgtattgcctaggttttcttctagggtttttatggttttaggtctaacatttaagtctttaatccatcttgaattaattttcgtatagggtgtaaggaagggatgcagtttcagctttctacatacggctggccagttttcccagcaccatttattaaatagggaatctttccccatttcttgtttttgtcaggtttgtcaaagatcagatagttgtggatatgtggcattatttctgaggggtagcaacttgttttagaagaaaaaaagttccatgtttttaaaaaatgaaatagatgtaagaggttgagagaagccagcaaagtcttcctccttggccatctcttctctctgaacttccatccatctatctatatattttattctcatctcttttatgttagtgtctttagggaggttttaagaaactcagcttcagttttatctccttgaaaactgtgatccaacagcctaaggagaaaatctaacaagaggttatggggtcagtaaaatgccttaaaacaatgacattctgtactaggagaaggaagacaagaagccagccagctcctctaccttagcccacacatctctcctaacctccatcttcctaccactgacccttacctttttatttactccatttttatttctggatattatatcatcacctgtgctgtgtgagtatctttacattggtttggggggaccattggcctgccttagggttataagtgtcataaccataaaaattcatcaaagattattatggaaaggagtaatgtcttaaaatgttaggataagaagtgaaagagacctagaagccaaacaaatcctgcccttgtacagtacctctctcctaatttccatcatccctctttaccttttctcctttcccctcttactgttgaatatcagctctgctgtgttagtgtctctgaagaggctgtggagagaatcagtctttaatttttgcaatatcatggactgtcagtggtcacttaaagagtggaatttagcaatagttgatacaaaaggaaaagtctttataataaaaaaggtatcagaaaaagaaagatgacgaagagtcaacaaactcctgtctttagcttgacaattttccttatatccacctgtctattactcatttcccttctcttttcctcttctacttctttgatacttattaatcagttctgctgcattagtgtttcttcagaaggtttagggaaaaatccagccttgatcatctcaaccttgaggactattggttgctctatctaaatgctgggaaccagagtgacaaacaagtcatagaatctgaagaaagataacaagcaaaatgtacacaaatgggacagagggagaagtaggaccaggatccagttaactcttgccctttagtaacaagatctttcctttcatctccctaaacacctgttaccttctttcttttttcacctcacttctgctctcttcaccttgccaaaggggctgttagtgctttctgtccatatggcctggtaagctgtaatggccctcagtaggagctagtggtgtggaggtcttgccagctaaaaaaaaagcaggttgtgatgacctccccctggtttaatctgtgctgctgtggacacattttatcccatgagcacagccaggctaatgccaatttgcagtgtgccagaactcattcccgggatgtctgtcaaaaaacattagtcgactgagagacttctagttcctcagtgatatggttgaggttgggtatagagataagtgcactgtattcctataaaggtgtttccaaatcacaatgtgtttattggagatcaagacacccaggtgggaatttgtggggtgtatgcggcaggatgaagcttcctgggagcaaggggtggtaatttttgaggtgtatttgaggtggacatctccttttagtttctctgccagaaaaagggtaattaggcaaatcttcaagaaaagagtggtacagtagacaataaccagactgaattgctggctcttaggccttaaggcagaaagtgagatttgggggaccctttctccctcgcttttgctaattctacattgccattttaacatgctatgaatattaggtaaacaggagtatgaagcttatcaaagtgagagatactgctttctagtgcatgctgtgcctattgaccctgaggactgtaatggtggcagaagcattcacaacccctttctctcaagaaagatggctctacttttccagcccaggcttttaagatacaggccaagcacaagagatcccatccttcacccacaacagcaggtcaatgggcagttggtcaattttcttatgtaatatttgttaactgccaaatgtggttaggcatggtaaatgaattaaagctattcattaaagattttaaatgatacatatttgtacatatctgtagggtatatgtgatatattgtcacatgcatagaattgtaatgatcaaatcagtgaatttaggatatccaacaccttgagtatttatcatttctgtgtgttcggaacatttcaagacccctcttctggctaccatgaaatacacaatacattgttgttaactataattaccctactctgctattgaacaagagaacttttcccttctatctaactgtatgtttatactcattaaccagcctctcttcatcctgccccctctctcacccttcccagcccctactaactatcattctactctctacttccgtgagatcaaaatttttagctcccagatatgagtgaaaatatacaatatttgtctttctgagcatggcttatttcacttaacataatgacctccagttccatccacgttgctgcaaatgacatgatttcattcttgtttatggccaaatagttgtccattgtgtgtatataccacattttttgaaggccattaaactttttaagttttttttaatcttttttttcaacttttatttttggttcaagggtacatgtgcaggtttgttatataggtaaacttgtatcacaggagtttgttttgtaaattattttgtcacccaggtactaagcctaggacccaatagttattttttctgatcctctccctcctctcagcctccaccctccaataggccccagtgtctgtagttctactctatgtgtccttgtgttctcatcatttctctcccacttataagtgaaaacatgcagtatttggttttctgttcctgtgttagttggctaaggataacggcctccagctccatccatattcctgcaaaagacataatcttcatgttatcactgcatagtattccatggtgtatatgtagcacattttttttatccagtctatcattgatgggcctttaggttgattccatgtctttgctattgtgtagtgctgcaatgaacattcacgtgcatatgtgtttataatgcaacgatttatattcctctggatatatacccagtaattggattgctgggtctaatggtagttctgtttttaagtctgagaaatttccatactgctttccacaatggttgaactaatttacacttccaccaacaatgtataaagtgttcccttttcggccaggcgtggtggctaacgcctgtattcccagcactttgggagaccaaggcgggtggatcacctgaggtcgggagttcgagaccagcctggccaacatggtgaaaccccgtctctactaaaaatacaaaaattagccgggcgtggtgacacacgcctgtaatcccagctacttgggtggctaaggcaggggaatcacttgaacccgggcagcggaggttgcagtaagccgagatcatgccattgcactccagcctgggcaacagagtgagactctgaaaaaaaaaagtgttctcttttctctgcaatcttgtcagcatctgttatttttgactttttaatagccattctgactggtgtgagatggtatctcactgtggttttgatgcatttctctaatgatcagcaatgctgagctttttttcatgtgcttgttggccacacacttgttttcttttgaaaggtgtctgttcgtgtcctttgtcaatttttcaatggggttgtttgagttttttgtgtaaatttgttttaattgcatatagatgctggatattagacctttgtcagatgtatagtttgcaaatagtttctcccattctgtaggttgtctgtttactctgttgatagtttcctttgctgtgcagaagctctttagtttaattaggtcccatttgtcaatttttgctttcgttgggattgcttttggcatcttcctcatgaaatctttgccttttcctatgtcctaaatggtattacctaggttgtcttccagggtttttatagttttgggttttacatttaagtccttaatccatcttgagttgatttttgtatatggtgaaaggaaggggtcccatttcaatcttctgcacatggctagccacttctcctagcaccacttattgaatagggtatcctttcaccattgcttgtttttgtcagttttgctgaagatcagatggttgtaggtgtgcaaccttatttctgggtaacctattctgctccattagtctatgtactaatatcatgccgttttggttacggtatccctgtagtatagtttgaagttgagtagtgtgatacctccagctttgttctttttgcttaggattgccttggctatttgggctccttttttggttccataggaattttaaaataatttttatctagttctgtgaagaatgtcatttgcagtttgatgggaatagcattgaatctataaattgctttgggcattatggccattttaatgatatagattcttcctaaccatgagcatgggatgtttttccatttgtttgtgtcatctctgatttctttgagcagtgttttgtaattctcattgtacagatctttcaccttcctggttggctgtattcctaggtattttattctttctctgcctattgtcaatgggattgcattcctgatttggttcttggcttggctgttgttggttatatattttctttatccacttgttcattgatgaacacacttaggttgattccatatctttgttattgttaatagtgctgcaatatacataggagtgcaggtattccttagatatactgatttcttttcctgtggataaatactcagtagtgggattgctggatcatatggtagttctatttttagttttttcataaatcttcacactgttttccatagtggctatactaatttacattcacaacagtgtacatgagttcccttttctcctcatccttgccagcatctggttgttgttgtttttgtttgtttttgtctttttaatagtagccattctaaccaaggtaagattttttgtgtggttttaatttgtatttcccatttgattagtgatgttgagcattttttcatacacctattggcaatctgtatgtcttattttaagaaatttctattcatgttctttgcccactttttaacgggattatttgtttttgtttttgtttttgttttttattgagttgtttgagttccttgtatattctggatattagtcccttgttggatgaatagtttacaaatattttctgccattcaacaggttgtctcttcactctgttgattgtttcctttactgtgcagaagctttttggtttaatatagtctcacttgtctgtttttgtttttgttgcctgtgcttttgaagtcttagccataaaatctttgcctacactaatgtcctgaagtgcttcccctatgttttcttctagtaggtttatagtttcgagtcttatgtttaggtcttcaatccatctggagttcatttttgtatatgatgaaaaataggagtccagtttcatccttccgaatatggatatctaattttcccagcaccatttattgaagagggtgccctttccccagtgtatgtccttagaaatttttttgaaaataagttggctgtaaatatgtggatttatttctgggttcactattctgtcccattcatctatgtgtctgcctttatatgaatactgtgtcattttgattactatagcctggtgacacatcttgaagtcaggtagtatgatgcctccagctttgttctttttgctcagggttgctttggctacttggactctttattcattccaagtgaattttaggatttttttttctattttctgtgaaatatgacattggtattttgacaggaattgcatgaaatctgtagattgttttgagtagtatggtcattttaacaatattaattctttcaatccatgagcgtggggtgtctttccatttgtgtcctcttcaatacctttcatcagagatttccttgtaaaggtctttcacctccttggttaagtttattcctagatatttcagtagctactgtaaatgggattgccttcttgatttctctctcagctagatcaatattggtgcataaaaacactactgatttctgtacgttgattttatatcctgcaattttactgtatttaatgatcagatctaagaatttcttggtggagtctttaggtttgtcttgatataagctcatgacatatgcaaagaaggacaatttgacttccccctttccagtatggacctttctttttcctacttggttgctctgggtacgacttccagtaatacattgaataggagtgatgaaagtgtgcatccttgtcttgttccatttctcagaggaaaggttttcagcattttcccattcagtctgatttcagctgtgggtttgtcatacatagccttcattatgtcgaggtacaatccttctatgcctagtttgttgagagtttttattatgaagggatgctgacttttacccagtgatttttctgcgtctattgagatgatcatacagatttggtgttcattctgttgatgcaatgtattacatttattgatttgcatatgttgaaccattcttgcatccctgggataaatcccacttgatcatggtgtatcttttggatagattgtaggatacagattgctagtattttgttgaggacttttgcatctatgttcatcatggatatttgcctgtagttttttgttgttgttgcatccttgtctggttttgctgtcagagcaatgctggcatcatagaatgagttagggagaattccctccccttgatatttttggaatagtttgaggagaattggtattagttcttctttgtgagtttggtagaattcagcagtgaagcattcagtcctagacttttatttgttgaaatactttttattactgattcaatctcattactcattattggtctgtttaggttttcaatttcttcctgattaaattttggtaggttgcatgcctccaggaatttatccattttctcaaggttttccagtttgttatcatccagttgttcataacagtctctgatgatctttcatttttttcttttttgagacagggcctcactctgtcacccaggctggagtacagtggttcactcttggctcactgcaacctctgtttcctgggttcaagcaattatcctgcctcagcctcccgagtagatgggattataggtgtgtgccaccacacccagctaatttttgtattttcaatagagacaagagtttcaccatgttgccctggctggtcttgaactcctgacctcaaatggtccacccgccttggcctcccaaagtgtgggattacaggaatgagccaccgtgccaggccgatttttcatatttctgtggtatcaattgtaatgtctcctttcttatttctgattttatttatttagattttctctcttttttggttcatctagctagtggtttattgattttatcttttgaaaaaatttattttgttgttcttttgtgtttttctttagtctgtttcatttagttctgctctgatcttcattattgctttccttctactaatttgggctttggtttgctcttgcttttctagttctttgaggtgcatcattagattgtttatttgacatccttctacttttttgatattggcagttatttctataaacttccctcttaacattgctttttctgtttcccacagattttggtatgttttgtttcaatttcatttgtgtcaagaattttttaaatttcctccttaatttcttctttgacccaatggtcattcgggagcatgttgtttaatttccaggtatttgtatagtttccaaagttcctcttgttattgatttctaattaaactcctttgtggcctgagaagatatttgatatgattttgatattctaaatttttttgagacttgttttgtatcctaatgtataatctatcctggagaatgttccatgtgctgatgagaagaatgtgtattctatagctgttggatgaaatgttctataaatctctgttatgtacatttggtctcaagtgaagtttaaattcagtgtttctttgttaatcttccctctagatcatctgtctaatactgacagtagggtgttcaagttctcacctattttcgtactggagtctatctctctgtttagttgtaatagtatttgtcttggtgctttggtgtcagaagcatatatgtttagaattgctatatagtactattagattaatccctttatcattatgtaatgaccttctttgtctcctttcactgtttttgacttaagtctgtttttttctgacataagtatagctactcctgcttgctttaaatttttgtttgcacagaatgtctttttccatccctttactttgaccctatatgtacatttacatctgaggtgagtttcttgtaggcagcatatagctggatcattttttaaatccattcagccagtctatatttttcttttgtttttgttgttgttgttgttgttgttgttgttgttttattgaaacaaagtctcgctctgttgcccaggctggagtgcagtagtgcgaactcagctcactgcaagctccacctcctgggttcgccattctcctggctcagcctcccaagtagctgggactacagacacccgccaccacgcccggctaatttttttgtatttttagtagagacgaagtttcaccatgttagccaggatggtctcgatctcctgacctcgtgatcctcctgccttggcctcccaaagtgctgggattacaggcatgagccaccgcgcctggcccagtctatatcttttaagtagaaagtttaatctatttatattcaaagttattattaatatttgaaggctcatttctgtcattttattaattgatttctgcttattttgcatatactttgcttctttcttcctctcttactgcttatcattgtggtttgatggttttctgtagtggaaacatttgagtcccttctcttcctcatttgtgtgtttgctctatcagtgggttttatactttcatgtattttcattatggtatatactctcctttttcttccaggtgtaagactcccttaagcattttttatatggctagtctagcagctattaattatttcagcttttgttatttctccttcatttatgaaaggcaactttcttcagtatagtatccttggttgccaggtgtttttttgttttgttttgttttgttttgttttttcagaactttgagtttagcagcccattctctcctggcctataacatttctgctgagaaattcactgtcagtctaatgggaactcccatcagactaagtgactagatgcttttctcttgctatttttagaattatctttgacttttgacagtttgactacaatgtgccatggagaagacctttataaagatttagggatctctgagcttcctgtatttgtatgtctaaatcttttgctacatctggaaagttttcagctattattttgttaaataggttttttatcactttcattttctcttcaccttctgggacactaaaaattcacattattggatcactttacagtgtcctatatgtcatagactttgtttattcttttttagtattttttcatttttgtctgactgggttatttcaatgacttgtcttcaacttctaaaattatttcttctgcttgatctagtctagtgttgaatctttcaaatgtattttatatttcattcaatgaattattcagctttagaatttctatgtgtttttctttttattttagctatctctttggtaaatttctcactcatatcctgcattgtttttctgatttatttgtattgttgttctgatttctgtgttctcttgtatctcactaaacttctttagtatcattattgtgaatttttctgggatttcataaatttctttttgattgggatctattgctggagaagtattgtgttcctttggaggcaatgtattttttttactttttcgtactttttgtgtccttgcattgatatctgcacatttgatgtaacagttacttcttctaatattttaaatttgcttttgtaggggaggactttttcctgaagatttacctatggtgttggttgggtaggacactttggctttgattctcggtatgtgcaataatatagtctccatgatgatttatctggctgtaaacagcatcagtagtatttgtgatttccttggtggtataaggtgcagttgttggtggaggctgtggtgaagtttttctggggatggggacatcagatgggccagttcttgggcaccagtggtagtagcaacaggtcaaacatacctgtccatgggcctcagggaagtgtacatgggcaccagtgttagtgggtctagtcaggctgattcttgggccctccaggcagcttgctcagatgccagcagcggcagtggtgggccggatgggtgggtgggtccttggagccctagcaattgggcatagcataggcaatggttgtagcagaggcaacacaatcctctgactcccaagtgctttgtcctggtgatgatggtggctgcaataggctaggccagccattcttgaggcctgtaggtagcacatgcaggtgagtcccagccatggtggtagtgacaagctaagtcagcctgtcctcaggttcccaggaggagtgctaagttccaacggtggtgaatggggcagagcaatctccaggcccctggacagtttactcaggcactgggaattgaggggagtagagccaggccatctggtggtgcacgtgggtgctggctgtggtaggcaggggcgaggtgatccctagatccccagtagaatgctcaggttggggctgaagtggctgtgctgcagccctactgctggagaaggcatggttgctttcagtggcagcagccataaacaggtagcttgggagcatgtgctttggccctgatataagcaggggagcctttcctcagggctcttttaaatatgtagcagcactgctactaggagtgacagggtcactgccaatgactcgtgtttcgccctggcagcagcagccaacaataaagcccagccctgcattcaaggtattcaaccccattgatggggttccaaggatgtggaaatgcaggggctgttgggcccctggtcaggatgtagtctgatgggggctgggctctcaaaatggcaccctgctgtggctgcttaggactctggggtatgcaggaaccactcaagctccctctctagagaaatgccattatacaatctctaggcaactccttcaaagcccatgtgggttgagggctctcccagggctaggattgcaggagtccacattgagaatatggactgctaggggtctctcacttgtcctttacccatgctggggcacctcttcaggcttccagatgatcccagccaagcaggctaccttacttctttctcattccttgagtcagatgtttcctgtcacttctctattgaattccagcattctctcttaggaaatatattcaaagtgtgattatctactcactattttatttcttctttgtatgggaggtgagttctggatgcctctattcagccatcttgaggcccctttcattggagttttatcctcagcattttatttgaatataagtttaaggagtgagaatggagagttgggtaacagttaggcttaaaccccaatggtagcctctgctagactttctacacaagtgaggctctctgctgaatttattacagggggaataaaatgggagaaaacactgagtcttattttccctcatgaagaaagcctttgggagaaaactcatcatgatgaattaatgttaatttttaaaatactttgtggttatcagaatgaaggagtgattcccagtgatgtaaactatttgactctttgtccagtctcattgactcataccccacttatgaaaagaagaggaaggggctgtaagtaataactgaaaaagctgtttcactaaaatgttttctaagactgtcttgttatccatggtaaagaaatgtaaaattaagagaagcacggatggaggtgctgactctacagatattgtttatgtttagtttgtgaataaattcaccaagctatacacgtaaagatatgtgcacttctctatacaattattacacttcaataaaaccttttttagactgttaaaaaagagaggaaacattaaagaatggatatggatttgggtaataaaggtgtatgcatttatcaaaactcatcaagtacatttcattgatgtaaattttacctcaaaaaatgaagaaagaaaaagaactgtaaacaaacactgaattttagttaatgacctgcatgctgaaatctttaagggtgaagtatactaatgtctccaacttactttgaaatgaaccccaaagtgaaatggtttgatagatgagtagaaaaataattgtagaatctgagtgtgactatgtgggtattcactgtataattctttctatttttctgtatgtttgatcatttttatattaaaatgttggagggttctaaagaagggaggaagaattctacccatctgtttatgaatagaaatgatggcttcagctcattgaagaccctaacacattaatagtaattagcaggatatagttatccagcaaaagtagcagcaattcctaggctgctacttgtcccagaagataataatgcccaatggagctggcagagctcacatggagatactcctttcacaaggcttaggtggcagaagcaccagatggtagccacagcaaattagaagaaagtggtggatactatgtagtagttgttaagattcatttattgtctgggtgcagtggctcatgcctgtaatcccagcactttgggaggccgaggcaggcagatcacttgaggtcaggagttcgagaccagccaggccaacatggtgaaaccccatctctaccaaaaatacaaaacttgggagggcatggtggcatgcgcctgtaatcccagctacttgggaggctgaggcacgagaatcgcttgaacccggggggtggtgtggaggttgcagtgagccgagatcacaccactgcactccagcctgggcgacacagcgagactctgcactccagcctgggtaacagagcgagattctatctcaaaaaaaaaagaaagattcatttatggatacatgtcagataccctgggatttgtaccatcatatacaaccaagctgtcagtttcactcattggcatttctgtaaatcacaaatttctaaagtactcatcactagaatctgaagcaatccactgtgtttatcatgttaggctgaagaaaagtttgctataacacccatcgggtcaaactttttcaacattttccaattacataaagcattgtatttgtacgcaatgaagaaagactaaaaatacaggtaaatgaaacaaatcaaaatatttgcttaaagttggcacctatgtttgtccatgtggcagccacattacataaagacacatgaactaaaatggaagaatgcatattttctccattatgcctgcagtttcagggacatagtgccctaacaattaatttcatattcaaggctgtcttgattgctaataaatgatcctagggaaggagctttcacattatccttagcactctaacagatatggtgagtaagaacatacaacttcccacaatcatgatcctttcaatgtctttccagggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaaggtaatgttccatggcatgtaaaaaacctaaggccagcttttcaaagtatctcagtatgatctttatacactaacagtcatcttatgatcaagtgattttcctcagaagtgattcaaagatgccacaaaacaactgcaggtgatgctattgcatttgaaaactaaacccctgaataaagaagctgttgagaatgagatcttttaaaatccagtgcttggaaataagttaacttaatttttaatgaattttatttgtaatatgcctataacaatttacagtattacaagaacctgagccaggcaaagggtgggggcagtgggaacaggtaaggaagactgatagtctgaaacagaaaattagattttacattatttatgtgattgctttgttttaataagttccatgaatctcagtacacccaagtgaattagggtctaataaagagtgtacattgcctatatgtatattgaatggaaatgttttcctgcctgctaaagtatcttagaaaataattaaattacctagattgctcattttcacaaaatcaagataagaatattaaaagcagaaagtcatggttaaaaatgcacatttttcatgtgttcccctatggctagaaatcctattatttaaaaaccaggaattaaacagataaattaggggaaagttattcatgctacacaaaggacccttcaaatatatttttaagtaaatcgttccctcagtgcattgattcaaatatgaaactgactttaaattcttcctgatatagtgaaagtatgtaccatagctgtggtacgaaataggggatcaaaatagagtcaagaccctttcctagaaaaggaaaaggggaaaagatcttcctcattgtttcaagatactcatcctcacatccttcctccctggcaagaatagaataggggataacaggccgggcatggtagcatgcgcctgtaatcccagacacttgggtggcggaggcaggagaatggcttgaacccgtgcagcagaggttgcagtgagccgagatcatgccactgcactccagcctgggctggactccatctcaaaataataataataataataataataataataataatgatgataagggagaacagtaggcaacacagaccagaaaaaagatatagagatacattctgtaccatctatgcagctccaccttaaatgggttacgtcagaacataatacaagtgaaatcttactttatgcaattggtgtgttctagaaaagttatgggttaaacatacttttttcgttcagttaagccacttactagttaaatggtaccctgtggttgtagcgattatgcctgccagatttttccaagatagtcttattttaaaacattctgttttagggtccgatcaagtgtcctaatttgctttagtaaatatggtcacaatccctatgatgaatcctttgtaatcaaaaaaatttttaatgtactaaactgatatttactggaaaataatcccaagtgaattaggctctaatacagagtgtatgttgcctacacatatattgaatggaaatgttttcctgcttgctaaagtatttttgaaaataattagattacctaagttgcccattttcatagaaatcaagataaaaatatcaaaagcataaagtcatggttcaaatgcatattgcattacatttaggtgagcttattcaaatttagatttttcataaaactgcctacccacactgctttatgatctttagatttaccaggtaataggtagaagagagaaattcatttattcaatattttagtgggttagtagtctggcacctacaatgtgccagacactgtgttaggcatgagaaaatgagtaatggtaagaagtatgaaaagggtactgaagagtagtttatgcctgtgctgaagttgcagagccatacaaaagagaaggaagccaatctcagctctggactattcattgataacacttggtgtgtataatgtaaagttctagaacccactgagaagaaatgttcatgcttataagtaaaaccctttaaataactttaaaaaattgaatatttgaatagatgttacaacttacagattacttttgcttagtattggtcattatagaaccttgcacaatatcaatcaaaccaaaagcccactttaaaaattgatgtataatatttttgattaggaaataaaattgtctacagattaaaaatcctgataatttactctataaacattttcttttagggcttgggagggtattctcacccattggtaagtagaaactgaataaagcaaaaattaaatagctcctttggcatggtttggaaaggactacattaagattgctgacaatttatgcagtcagctgaaaaaatcatcaccatgttggcttcatgtattgcaaagatgtgcagacacaaagatttttcttcatgaaagaacatatgtcccctgttacagtcacacttgatgatttgcttctgaaagacaagtaacgtgagaaaagtcagaaaagctaattgatagttgtagaggcaataatctattcactcccaattgtatttggacatactgtactagagagagagaactccccctgggacattttgctacatttttaaaaagtcaacaacattctacattctaccagtatttgtcacccctgcaaaacaggggccagcttattttaaccatagtttgttatgttaattcatttaatgaaaaagcatccaccatttcaaattgcagataatcaaatcccttgtatttagtgactgacctcatccctagtagagcatatcaatatatccaaggaatagaaagtgttcttgcctgcaagaggtggcatcatgaagtattgcctatgaattgtcaacatcatcagatttaaaactcaataataattgaaattttctacaattgaaaaacagctttggtttttgctacccccaggaaacaaaaactcatttattgctggccagaagtcccacctcgccagaaacatggtccagacagaaatgattaatgttctcctccaaattaatttcaagctgtctaacttagctatttccattttcccctaagtaaacaccagatctctacaaacagcagtaacccagtcttgctttaggatgtgctgtttcctctccagtctatacatgccatcctttaacttcacacatatttcttcctctataaaggacacagccttttggtagtcactaactcagtataaaaaagaaacagtattgagagcaagagagagattgccttgagccatttgattgtaataattgtaacacatgcacacatgaggtaagaactatcactgtagaatgaatcgaattcaggcttgcccagagagatctcttaaataaataggggggtgactgcatagaacaataggtagaaatgaatgaaaattataagaaacaaggcaaattttgagggtatcatttatcatgatatcttgtttttcatgcatccatttcagtatacatctgcattgacacacgacgcaatactggtcatagcagaagctttccgctacctgaggaggcagcgagtagatgtgtcccggagaggaagtgctggagactgcttagcaaatcctgctgtgccctggagtcaaggaattgatattgagagagctctgaaaatggtaaagaccacaatgggttattggggtggaagaaacttataaagacataaaaaagatgagaccttgatcttgagagaagacatactaaaaggaataggaccagattatgtagaatctcagagtatgcaaagaggataagtatagccatttctataaatcatccaaacctagaaatctaaaagttggaggtcatttcttgaagcttgaaaaaaaaagagataaatttagggcaaatgaatttttggttatgcactatactatggctagtaaatgaaacttagtactctcaaaagttacagattgaatatataaatagcttcaaaaaattcaaagctttcaaacatatgacattctttagggagattagaatattttataagatgttcctaacttcaagatagacattacaaaggacagcatcctctggctcatcagacaaatgattagcctagacaggctgtggaacttagccagtgtgatagtatttctgttgtcaaaaagaacactcatgctattctacaggatgaaatgcaggaacatgatacatttctaggtctacttaagaagcttttgcctaatgctgcaaagaaaaagcctaaagaaaagtaaaaggaatcaatggatagacagtcaaataggtcacttgtttttagtatttgctgggtaggagatcatttaaggcttcaagcaatgtcctttgaacagatttcattatttataccagaagtagcatcacccattcattgcagttttccaagcaagagctctgtcctgaatattttgctttatgctacatgtgcctgcatgtattaaaatgagctttcaagagtacaagaatctcttatttctacttatttagttatcctgatgtttgggacatccaaatcaacaaagagatgggcaaagataagataattctgtgtgcaacccagcaaggaagaacttgtaacggcctcataacatacatcattttgtgtagctggctctcttattgatgccttaaatttgccaagttggaagcattcaatcaaaaggggttagtagcccttgtgtctctcttcaagaaagagatatgactcattttcccatcatgcagatttttatgtcattatgtcagttccttaacaaatgccctaagtgtagttttatggaggtagcactgtacaattttgaagagcagttaattaaattcaaccttcatagcagttacaagatttgtattgtcaggtgaaacataatgatgagtgaaatataaaactccctcagagtgaatcaaaaggagtttccatcaacaaaacctcaaggggcaagagccagcatctccaattgactccctattcatgacacaaataactaccttcccaaatagaaaactggctatcagaatgaaggataagataccaattgggctaggaaaaaaaaatagattgatcatactactgcacagaaaagtttctgcatgtctacctcactgataaagctcaagttataagccaggtaaccttcctccccaggccctaatgaccagacactcaaccaaaacaatacattacctttctataggacaatctctattgctccagagaggctggaaggcatctattttttccaaaagtagacagtgcctcagtaaaactgctctactcagagggactgtaagggaggctagtctgaagtactaaatgttttactacattaaaagaaatcccattttatttgaattaattaaaattgagactgcataatgtaaagcatccctcattgtgactagcacatagttgtttctcaataaattattctcttccttcaaaagaaatctggcaaacaaaatcattgcctggcagaggctcctaaggggcctgttttaatgaataaataagcacaacattcattcagtaaatatttattgagcacccatgactatgtatcaggctccatattagtatgcaagcaagaaataagatgaggagtgcacacatttaaattgttaatatgtaaacaaatgctttaaaatatcttaaagccacttgcaaattgggtaatcattctcctcacaatctgcaaataatgcaaagatcagcccagcacagtctactgacatatctgtcacagattctaagtctttgagacttgttcaatcaacatttattaaggatctgctctatcccaggcacaacattagttgctgagaacagaggtaaaaaaatgtctctcatctcgagatgctcctaatccagtaggaaagttagaaacacatagattataaaaatgttatgtctaagtcttgcacaggatgctatgaattaaagaagggatcccagacgggatgcggggaaactgtcactaacattcaatactggaccacatccttaaaaatagatttctctgagtggtagtccaattctacttctggtcaccaaacgttcaaatcatgcgtctggaatctgttggactatgccttgactattctccagttcatatatcatattcagataggttgggtctttagaaatagacaactcttaatgagacttaaagccctagctattttcactaatgaaggctttccttaataagttcctattgcccttgtctctgccctgtctaactcttctatcagaattcagtgctcaaaatagagtataaagagcccttcatgctcacattatgtatcagtctcatcccactggataagtaatttctatctcaacaaaggtcttttctctaactagaagtgtgatgccaccttctctgcaagcctaagctaacaatagtgcttaggtttgttggatcagttggacaatcatcttgttttcagttcatcagattggagcattttcctttcaacaggaattccacagtctcctactggtggtgaacaagcccctttccctttaaaaaatgttccctaatatttgacaacatttttctttctgcaacacaaacccactgccacctctgacttgtttgacagcttgtcattttccataagtgatgaaaaacaattccattctttcatactaggaaaatgagatatattctttctctttgaagcaaagtctttgacctttacttgccagatgagtaatgcaagtggttagcaacaattatttatatttgtagagggtatttcatccagtgtccctgcactgtaaaataggtaaagaatctatctaccctgaagagatggcctcttgctaattcataatactgagcccaggcccaggaaaaattgttccatacatgaaatcggcatttggcatcccaaacaagtgttctggcttccagtacttctacatttcttgtctagtgctccatactcctgaccccttaggcttaataaatttcatcagtctttggattatccctctatggcttagctctcttgtctgttacctgtctgtagctgagtgtgggttaaataagagggaaagctcatccctgtcactgtagtagctggcaaatgtgtaaccctctcaagaaacagaactaaatccattttggttaataataattaatatagctagcatgtattctgatgcttaatagatgccacatactgttctaaacattacgtttatatgtgtgtgtgtatatatatatatatatatatcttctctaatcttcccaataactctgaaagatagatactactaggattttcaatcttacagattaagacactggggtaaaaaagcattaagaacatgccgaaggtcattcaattaataattgaagctacgatatgagtccaggtgtaacagtgcccatgctgctgaaaccagattatgttcagatatgggaaatattaagataagacacagccatggcccccaaggaactcagtttagaatacattaccctagttaagggggtagcctgcagagtatttttaggaaggggctagtggaaatttcaggtccttgaaaaagtggcggtagagccctcattatattatataagtaacagcatcttacacctactcaatgcttcaaaactaaaaggcatgccaagaaaatactgtggaggaaatgaagatcttgtatagactcgatctggtggatagagctcaatgacttgcaataataattcttcaagattccaagatctgtcagcagacctcatcccagagacttagaaggcaataatgccgtgctatttttaaattttaaattttccctttctaccaggtgcaagtacaaggaatgactggaaatattcaatttgacacttatggacgtaggacaaattataccatcgatgtgtatgaaatgaaagtcagtggctctcgaaaagtaagtaaccaaaacagacatttaaagaaaaggactcttgaaagaggacagcatttggatgtaagaaaataagtattattattttacaaaatatcagtaaggatgagtgggagatgggaacctccaggatgaaggaatagcacacctatgtgtcagtgttgggggtcctggtgggaattacaagacccggggagacaggatgtcaatccttatagagctcaagaaagttttgttccacaacagcacttcaatttcatgcagtacttttctgagggaaaaataggcatccaggtcaaatgtcttctctttctaggctggctactggaatgagtatgaaaggtttgtgcctttctcagatcagcaaatcagcaatgacagtgcatcctcagagaatcggaccatagtagtgactaccattctggtaagtgtgaacagaaggtaggtgggctttctgtccagcaagacttccgttttctgaaaagtatttttccaccagtagaaaagacctcaagttcaaacagtaaaaacttccaacagggaagctcaggaaactctcaaagtatcttgccatgatgatgaacagaatgtcatttaacaaaaagagagaaagaaaaagaataggaatttagaacagttttagattatcattttcctctttctccccgcctccatgcccgcccgcataggactgatgcttcatctggacttgaaacctaattcttcattgtgggggaagcagcattgtgtggaggagagagtacattaggattctaaaattaggtctaccactaacctgtaaaactgtgcaagtcacaacttctctgagcctcaggttgttgtttcttcatttatgaaaggggtataataataatcacctacccatgtcataagcccgtttcaaggcacagttcactacacgaagaagttttctgcaaaactcaaagcacttaaaatgtgagatggtattctcatttagttttaaaacacttttctagaagctggtttgtttttactgaatgaagtacaaacctgggttaaaaacaaatacatctctaggtgtgaaagtatgactaactgaatggagactaggctgaagtttgcctttcatctaagcatacatatcaaatactccctttgtcttaagtactatactaggccctggagatataaaaatgtaaatgccacggacgctgacctcacagggatcacaatgcttccccagggctttgcctcaactacctgcaattcctacataataaatcttgagaaatgaaaggcacttcaccatcatgtaactaagtctgccaaatttgatgaaatcaaagacttgataggtgaaaactgggccatctttcaaactctcaaaaagaactgaaatccttctctgcttccttaaattaccagttaaggactccccctaccaaaaaaaaaaaaaaaaaagtgacccaatgaatactcaattaaagctcttctgtttactaagtaacaatttaaaggcctttttcacataccaaacctcaatagtcacagaggggaaaaattattgcatttatcttctcttagaaaaatgtataggagtaatccttttatcttgcttctggtcccaaaggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatggggtgagttttttccaattctgttttcatttattctgtgctttccaattaacaaagaagagagaagatttaattttcaagtgcagtgtttatccaattgtatagtttacatatagtctacaagaaaaatatattcttctacagttgcgctctgtaaaggtaggttgtcagtagtatcctttggacaacaggattattttactaaaaggaaaatagaattgggggattttatttggcaacattaagcacagcctgccctctatttaaaatctgttccttctgtgttctctagctcaggcagcagaattaccacccacatagttgcctaagcaactttgcctaagcaacctcatcatctttcctcattgttcccctcttatctagtcagtcaccatgtcctatgaattctacttttaagtctctcaaatctagacacactcttcacccccaccatcgtcaccttaattagggttcttaacatctatcagtcatttaacttgttaccctgcgtctgttcttaccctggcaaattagatctccacattactgtaatttcccactttaacaatcaggatgaaattcaaattccttcacatggcaaataaggcactttataatctagcacccgcctacctctctagcttcatcctgtactctttccccctcacacccaatgttccagctatagaaaagtaagtgttgttccctgaaggtgctgagctctcacttagtataagcctggaagtacttttgtgtctcttcagcagctaataccacctactagtcctctgaaacacagcagtgatacttgtttcagaaaaccttctctattcgcatctacttgcctgcagtctgggttaggtacccctgctttttgcttccttcctttccatattcatatagtacttctaagtctgtattgtaatgatccatttacaagttccactgttctactagactatgaactcctcgaggacagaagatgtagctgattcatttcaatatcacacagtctgaaacatagacattcaataaatccttgctgaattaatgaatgaaaaatgaacagaatggctctgccaggggcttatctatagtccaactgcaaaagaattaatatgggcaattagggcttttaagaaaggtacagtgatatcttcagagctcctggttcacttagtattaaatggttttggcctctgattgtgaatgacagatcttgggcagcttaatgaggcacatgtaaataagcagaactggacagaaaaactgcccatgcagtaaaccggtcactagagaactaacccaagtgcagtgggtggtggcaaaggtttagttctaacaaacaaagattacctgtaataataactctctgtctagacaatatctacactaagtaaggggaagacagaggaatctaggaggtagagatactgagaagctccagctggcaagaagcaaacaaccaggttatttatttattggactgaggttcaggagaaggactctagtgcttgggatggaaaccagcaagaataaggtatagctctccaatcatatgagagtactggggtcactaaataagttcttggaacaggcctttgggaggaaccacaaagtcggaagctcatttctaaaaataagggcacagaaaggtaacaaaagcaaagctggaccccagatataaaaactggagcaccatcctctagtcagatgaacagcaaggcaacttgaacctcagcctccatctacgggcctggagccatcatctcctgtcttgggtcaagatcggtcctgggaactgaggcagggctaagtggcagatgagattcaagtgaatccagcagtaagaaagagaagaatttccaacaccagtgcagagagggctgaacaagggtcagagcacccagtcatgatttctgaggaccctgagaagctctgaaccatcttgacatggctctaatcttttactttccaagttgttgataaggttttcttctctttcctgttcctcatctccccaacacttaggcttcaagaggtcttgtcttgcttacagctcacccttgctcttggcacattacctgatacatagtaaatgctcactttttgctttaatgaatcaatgcctggcatacagtaatgcctaagccagtattcattaaattgagttcatggtgggatataatcttgtaatatcattactatttctattactactactactattaccactactattactactactactgccattattagctaccatttgttgcatatttactggctgccagatactgtactaagtgctcttatatgtaatttaatcctcacaacacgcctctggggaaggtgtcattattaaactctttctacatgtgagaaaattgaagcctagagaggtgaagtcacatgctaaagaccaaacagtttacagtgactatcttagtttgtttggactgctataataaaacaccataaactgggtcacttataaacaacaggaatttgtttttcacagttctggaggctgggaagtccaagatcaagggagattcattgtctcgtgagggccactttcaggctcatagatggtaccttcttcctgtgttctcacatgatggaaagggtaaggggtccctcttgggcctcttttataaggacactataagttccatttatgagggcttcactcccatgacctaatcacctcccaaagccccacttcctaataccatcaccttgggggttaggatttcaacatatgacttggttgcgggggggggggggacgtggggacacaaatattcaaactgtaacagtgatacaataactttaacccagatctttgactctgaagtccatgctttttaaccattacactatctgcccaacagctaaagtgtggtttcaggcccatcccattctgaaagatagttgaaatttattagaaaggcttatggtgccttagtcattctggagagaagagtgtttggcaacaacagcatggcaagaaatttaaggcgtaagtgtctttttattttatttattatttatttatttttgagacagagtcttgctctgtcaaccaggctagagtgcagtggcatgatcttggctcactgcaacctctgcctcccaggttcaagcgattctcctgcctcaagttcctgagtagctgggactacaggcacctgccaccttgcccagctaatattaaaaatattttttagtagagatggggtttcaccatgttggccaggttggtctcaaactcctgacctcaagtgatctacctgcctcggcctcctaaagtgccgggattacaggtgtgagtcaccacgcccaggctaaggtgtaagtttctactagcccaggttatccgatgtgagctataccatgaactctaccaccccatcacaactgaatgaccatatttctcctgtcactctctgtaaatagatcactgctctcctggcattgaggaagacattacacacagtgacatagagcaaggcagacttattgacattgttcagacaaagaccaattttctcactggatttgttttctcctccagcatgttccctgtactgcactcatttaatctccacatatctcttcctcattccaatttgtctacttgtgagtgagggagcttgagtattagagtccctcatttgtttagcaacttagatgccttctctccacttctgaatagtaaaagtgttcccataggaaccttcccatcttttccctttagttctttctactaaagacaaaagcaatagccggggaggctcttacagaaatgtcctcctccttcccctgcctaaaacaactttctgatgctttctgggcttataacaggaggtgattccagagaactacagcaaaccaacccatcggagaagactgccaaattccattttcctctaaaacctgtggctatgaaaaatatacattcttatcatgcttggagtaaaagctctctgttaaagaggatgatctcatgagctaaatgtgtcttcatcttcatttagaagttttagtcttttggcattgggaagttttcaacttctctatcaatgacagaaatggagaaaaatgaaaacacaggctttcatttctggcaggcctggcctcttgtggtttgcaagttgctttaaaaaaagaagagcagaaaacccctaatgatttctctaagttcttaatgagcaaaaagatggagaacagggaaatatttcttgcagtgaacatgaaacctatacagataggcactgctttatcttaagggtatttctcttatgcttttagtatgtaaaacagagcagagtggaaagaatgaaaaaaatcagagatgaagaaagctctgcaagggagatttcagtgtcagtcataaagtttcaagaaagaatcaaaatgaattaaatttgctaaagaataaggaagccaatcagcctcttttcagatgatttataaataggtttttttctaaggaaattcaaatcaggttgatgttggggcaccttgtatctctaagaaggctatttttgaaacaaacctcagtaggacacaatgtgccccattatgtaagcccttcagaacatcatggacttgaaactgtccacctgcttttagcagttttgattttgagctggatgtctgtaacaccactacatggtaacagtcccagatcaaatggcttacagaccacaagtttttatggcttccaaataccatatgttttgagggcacttaaaaacagcattttttgctagcagggctcttaaacatccttaatcctaccttaccattcattttttacaaatgcatatggggaccagccaagatcagacatcagaactgcccctcaggtaatcaggaatccaaagcctgataaaggacacaggtacagcagtggcagcaggattggacaaagtcacaaaatcccacaacttggcaacacaggttttgtgactcatggtctagtgctctgtccactgggtcacactggctcagttcactaaacttgtgagattatggaaatattggtgttgtatcaatcagatacagcatccccacctggctctaaggggcttacaatctagttggattataaacttttccatctaagatacttattttgctatttttcatccaagatactcatcctgcttatttatggcctccaggataatgtaatccacatttctagttatcactcgaaatatttgaaaacccaatatagacagctgggggttctgcccttagagaggagatatgatctaagggaaaaagagagtcaggagaaaggctaaaaggaaattgaggccccaattaacagaacacctcccagtgggcaactgccatgttccttatgttcctagcagttacaactaaggataaagaagaagggggttgctttgggaaaggcttgacaagctgctgcttaaattgcttcttctgacttagaagatagcagagagcctgggggtagtaatggggctgcagggatggttgattataggtcatattccctgggtgtccccagactccttcacgctcccaggacacatggcaactttacagatactatttgcactgacattgctctgcctagaagaaattatctcttaggtcgtcactatcctaagctggattcattttccattaagaaaggcagagagtcgatttgtccttccagctaaaaggcagagaagcaagggtccagtaacagatgccagatattcttcaggtgattatactgggctttggcagaagggctgatgatttgataaaagtcccccctccttcaaatgatgcatgtaacctccaggaaggagcattaaggacacatgaagtatgccattcgaagcagaaagagtggggaaaatatttccagctaaacgtagtctcacaaggccttcatccagctacagagacacttttttatcttgatattgtctttaactctctcagctccccaaggacaaggagccctaatcaatagatccagtcggggatacctgttctggataaagaaattaggatattctgttgtgacactgcttgttgttgcacagatttaaataagcctcattcttttctccagatcttaacaattgcagacagtaaacatcccatagagtactgccaataaatcagtttaagtcttgtcccccagcacacagcaattatattcctattgtctagcttgattctgccccactcctgttttcaacacatatcaactttccaaaggaaatgtctgccaaaggcaactagagccctgtggttgatacagggacaaagggtcaggtcatgtctgcttcttctcttggataacatatagtacattatgattacacatcaatacattgtctacttcctctctcctgtccccttccctgctttcagaaagtgttttaaaatggtgtctgacaagctcctgctcattcgtagtctcatggtgggttacaagttttgtatcagataatcagatgaaaattcttaaagatataacaagcttgcaatctcaaagagattaaaattacgtttaaagtcagtgtcatctctggctaaaacctgtcagattcttaagtgcatcagccctacacatatgagtttgttggtttttaagttttataacatttacaactttggcaacccacctatgaaaaggattataaatcccctcaagctaaatcctctccaataatgcagttgctccatgtttgcaactggtgagtggaaaattcaaacctaattcagtgtgtttactgagcccacacagccacatttaggctgcttgattaaaatcctttaagtagtcaagatgcaagcaaaagtactagtaaactcttactctgtgctctttccatttgcttgattttgtctgtcaattggagcaccctcataccactactacacacttacccacctaggtttctgaaaataacttgcctactgctattaccagtgcaagcagaggcttgaggacaactggccactggagtgattcaggacaccccaagagaggcacttcattgttgagtcagaatttcacctactccctaaccccatccataattcttaccactctctctcccagcctacagctggctttcataagagcagagactaggaaaggaattccatttgaggacttacctttttcagtttttcatcagtgtgggcctcctcaatctttaagttgccttgaaagtgacctctccctttaccttcttgctatggcaatcccaggagagctcaatggttatttttggatgctagttagttacagggtggagcatataactaactagtgttcaaaatacctactgagctctcttgggactgccataacatgattgccccacataaattatgccaagcaggtcctatgctctgaaataaccaattatcacaacaacttattttaacatttattttacgttcaggggtacatgtgcaggtttgtaatataagtaaattgcatatcacaggggtttggtggacaaaaaacaaccccataaaaaagtgggcaaaggacatgaacagacacttttcaaaagaaaacttacatgcggccaaaaactgcctgtgggaatagtggtgatagagggcaagggctttgccaaggctggctctgagctgacatgagttctgctgcttggtttcttaccaaacatacaagaaaggagaagagttgctaagtctcctaccaatagaagggaagggagctacagattctgcctcaagctgtccttgagccttcttccacctgccttcttccacctgctttttgctattcccttgcctttttccatctgtaataggtattttttaaggttcatcatggggaattctccttttggagtcaggtctacatcagtgaggtacaactgagcacagatttaatgccattcttgattgggagagcaccctccaaaacatagacaaattccacattttttgaaaaatctccttagaaagaaacaatccagaaaaaaaaaatacagaaatgccaggctgaggaaaaaaaaaggcagtgcctaagggaagcagatgattcttcctgttgtcttttgtgatttcagaagtacttcaaactaggaatggccttctttgggaatctgttcttttgatgaatgttcctgggaatcagacaacaaaaagtcctgctttatccatctggccacgtcttgttagtatttagtggtgcttaccatgtagtaggtgtttcaattaccaagtagggtttttttaaaggggtcaagattctcaaactcctttctgtaccttctagaaaagaccccaaattccttaaattcattccaaaataattttctcatgtgaatgccttcttatttcttttttctaaaacaaacaagtaacaatttctcctagaactatcttttagacttaaaagatgaaaaatactggttaaattaagtaattaaattcaaatgaaatcaagtgagaaatgatactagaggggtatttgcatgctctgagcaggagacagacatgttggcaaagagaggaagtggctttatctgtgaattctcttggcatgacaagactctttctaactgattcagactctctctgccaaaaaaaaaaaaaaaaaaaaaaaaaaaaaaaaaaaaaacactctgctagctttctggccaactcattctcctcagtacccttttttactatgaccaggtctagcttcaggcaaaagggtaaaatagatgaaaatttgtctttggctcccctctagttagtaacgtggaactggaaattcagaagttagccacgatgagatgagagttgaaaccacaggtaacaatactgagggatgaaagtgaaggacagaaccttaaagaacaaaccttcattgattatctcctaagacaagcactctgaatagtcccttggggtacaaaggtgcaccttaattgagagagcagaactaggaaggaaagtcaaagaaggaacattcagaaaggtaggaggagaacctgtagtctttcataacagagagctaaggaaagcacgtacatagtgcaaaaggccaatggcatcacacaagcagttaatgtctgaaggaagatatttgaatttagtagccaagtatataattcaagaaacaatttcagtaatttggaggggctggaaattaagtctcaggggtataaggagaaagtggtgttgatatcaagacagtaaagctgtcttttttcaataatactggtggtgttagggagggatgtaatgtggttaagaaggcagcaggatcaaaaggtgggaggagtgttttctgtttcatttttgtctgttagtaaataggattacctgaaaatgattttaagtgaataaaacagatcaatgattttcaaattatagcaagcattacaacaaactggaaggccacatgagtctcacgcctccacaatttctcatcccatacatctggggtggagcccgagaactggcatttctttttctttttcttttttattttttttattatactttaagttctagggtacacgtgcacaacgtgcaggtttgttacataggtatacatgtgccatgttggtttgctgcaccaatcaacacgtcatttacgttaggcatttttcctaatgctatccctcccccagccccccacccccgacaggccccagtgtgtggtgttcccccacctgtgaccatgtgttctcattgttcaactcccacctatgagtgagaacatgtggtgtttggttttctgtccttttgatagtttgctgagaatgatggcttccagcttcatccatgtccctgcaaaggacatgaactcatccttttttatggatgcatagtattccatggtgtatatgtgccacattttcttaatccagtctatcattgatggacatttgggttggttccaagtctttgctattgtgaatagtgccgcaataaacatacatgtgcatgtgtctttatagtagcatgacttataatcctttagatacatacccagtaatgggatcactgggtcaaatggtatttctagttctatattcttgaagaattgccacactgtcttccacgatggttgaactaatttacactcccaacaacagtgtaaaagcgttcctatttctccacatcctctccagcatctgttgtttcctgactttttaatgatcgccattctaactgtgtgagatggtatctcattgtggttttgatttgcatttctctgacgaccagtgatgatgagcattttttcatgtgtctgttgaactggcatttctaacaagttcccaggtgactcttttgctgctaatctaggacccatactttaagagccaccggaatagattagtggagaagggaaaaattaaagatgtaaaagagatagtagatagagctgggttttaagaagcgacagagaaatatagaatgcatggaataagttgatcaaatcttagaaagtgtcactttctgtgagatggaaacacacagaagaaatgtataaagatgctgcaatatgttgacaaagttgggggagggggaactgagatgatagagcttatatcaaatggcttccatcttctcagtaaagaaagaggcaagatcatctgcagagaggataggactgataaggattaggaactgggaaaagtttgaaataagcatcatccacagacacagaggagaatctacttttggggggatagatgggttaaattttagaaatgatgagtttgaaatggtggtgagcctccaaggtagatttgatcagtaggcagttggcttcaataaacccatgctttctgcaacttccactaggatgtaaaggatgtaggatgccctccatgcaggtaagtatttttgtctgttttgtctgtcttgttcactgcttcattcctagcacctagaatagtgcttggcacagaataaagactcaaatttgcattggaatgaacctaagaggggttggctaaggttgataattgcatataaaagtagtgtatagtagaaacctgcaagtatctatggagttagaacattatgttcattaagcaactgggttctggaatctgaagaccagggttctaatcccagcctctctgtgctttagtttctccatctccaacatgggaatggtgattgtaccaatatcaaggttactgtgagaattaaatgacatagtaagtgtaatgtgcttagcaaagtgcctcatatagaataagcactcaataaatgttagctagctgtttatcatctgcatttccctttcaactaattaaggagtattcctcaactggtttatcatatgtaattcaaaggagtaaaatttcatttctttgaaaatatactctatatcagacttccctacctctgccctttggtaggggtattgaggcattactgttctgaacatagaaaaaaaatgatcaaaacttgtgttttcacttcatatatgatataccatccaaaagcctttccttagtcagaaggatttttctttgtgtgcattttaaggcctggcttcagactatgacttactactgttggaaaggaacaattacagaaaacaaaagaaataaatgtagaaaatcctagtgcctattttcaagggattaatataaaaaacattgcctgcctttgcctaagttaattgtgcagtgcactactgacatttattttattgattcaatccatgtgagtgctacactgatattatcactagaaaatatagcttactacataaattgtgttctgacaactgttttacccttgttattgcccaggcaaaattctttcatgtttgcatatgtcatatacagtaatcaacaacttattttttaggcatctacagtttctttagtttagaatctgttgcagtgatacatacaaaaatagaagattgagtctctgccttcaaaaaacctgttttaaaagatatgctttcaaaaaaattcaagaataacataagacagcaaacacctaagaattaaactgctgtggccctgtgtggcacctcatggtgtagagtgaagcagatataagaagtataggatattatgcctgctccacaagaattttcagtcaagtgagggagataagacataagaacacgaaaattaaaataagaaaacgagagttaaatagtgacatgtcacaaggcagtacaagttgtattataaggtagcaaaaacacactattaggaaaagaaagcagagtcggttgctctaagccaatgtgtctcagaagacaaaaggccagcaccctttctttaatttaccatcaagttaaagcactttagaacccactgaatgctaccacttttctaacctaagcattgataattcaattggttgtaaagatttaggacttgatattttcaccaaagaagtatattaagcgacaaataactgattaaagactgtctctaaaagtcatatatgttttcttttttttcttttttttcagagagctgatatagctgttgctccactcactataacattggtccgtgaagaagtcatagatttttcaaagccattcatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaaggtttgtttttgtggcatactcaatgcctcattgcattttatggtcatactccattcatgtacatatggtattcatccatctcaactccagatttttttcatttaacattccatcaaatgacagattatcatcaagccattgtgtttgcttatgtccatgaagtgagtgtgtcattggtgttgctttgaatgtctttcatgcatttctatggtattgtatatacattaaaacaaacatttgaactctggataaaggcaacattgccactaatattaatattattcagataaagtaaatactaaatcttcatcagatcaaacagacatggtttcctaattaattgtactgaagtgttttctcatttctaaagagattggatccagacaaaatttaaaagaacatagaactcttctttaaatccctcctaccttctcctttcaatgccctccctttttcattttgctctcagactgcctacaactatccattatagtatcccacccaagttttctagttaaaactataaaacttctcaaagaaaacataggagaatatctgttttaccttggtttggacaaagtgctcttagataagacacaaaaagcacaatccattaaaaatttgataaactggacttcatcaaaattcaaaaccttgcatttaaaaagacgtattaagaaaatgaaaaaaaaacccgactgggagaaaacattagtaaatcatgtgtctgataaaggacttgcatccagaatatataacacctcttacaactcaataaaaagaagacaatccaattttttaatggacaaaagatttgaatggacatttccccaaagaagatatataaatggctaataagcacaacaaaagatactcaacattgttggccattagggaaatgcaaattaaaaccacaatgagatgcttccatacatcctctagaatggctgcaatcaaaaagataggcaataccaagtgctgatgacaatgtagaacaactggaactttcatccactagtagtgggaatgcaaaatgctacagccacattggaaaatagcttggcagtttcttatcaagtaagataaatacttaaaatataacacagcaattctattcttagctatttacctaagagaaaggaaaacatattcacacaaaaagttatacacaaatgttcatagtaactttataatattaaaaaagtagaaacaacccaaatgtctatcaactcgtgaataaataaacaaaatattttatatctatatagtggaatactattcaccaattaaaaagaacagactactgacacatctataacatggatgaaccttaaaaatgttatgctgggccgggcgcggtgattcatgcctgttatcccagcactttgggaggccaaggcaggtggatcacctgaggtcaggatttcaagaccagcctggccaacatggtgaaaccccgtctctactaaaaatacaaaaaattagctgggcatggtggtgggcacttgtaatcccagctacatgagaggctgaggcagcagaatcacttgaacctgggaggcggagattgcagtgagccgaggttgcgccattgcactccagcctgggcaacaagagcaaaactcagtctcaaaaaaaaaaaaaaaaagttatgctaagtgaaataagccagatgcaaaaggccacatatcatgccatttgaatcccatttattgaatatctcatattgtatgattctatttgtccagaataggcagtctacagagacagaaagtacgttagttgttgccaagggcttgcagggagcagagaggggataatcagggccagtatcagggtgaggcaagtgagcctgagtaaagcaagtacagggatcacatccaagctttatttaaaattttgatattatgcattaattttttaaatattggactaaaattctatttatcttgattaatgagattttgatgcccctttaaactttgcatgtggggaagttgcctcacttgcctcatcctagtcctaggcctgccaggattaactgcaaatgagcatgaaggaactttttagggtgataaaaatgctctaaaattggatcgtgatgatagttgcacaactctacgtttactaaaatcactgatcgtacacttgtattggtgaattttatggtatgcaaattttatctaagaaaagcaaaatattgaacatgaatgtcctgagcctcacaaacttagtctaaacctaaacaaatatggcggtgaattcttaatcataatacattgtaggtgactgtaacatctttatattttgagacaaaaaagctgtaggttttggtaaacttgaacattaatccagatactgaccagagtcaattatacaaacacattagggattttcatgtgaaatataaagactcagaagagtcctaccatgtttttacagcatacttcattttgagattatccacttggaccataaaacatttaaaaagaagctttgcagcataactaattggtaaccatattcagcagctttttaaaatagtctgtatggggtatgcctcatttatcgaagtcacactttttttggcttttctcaatctgcttgattacattctccaaattatttcactccctgttccttttgtgcttagaatgtatgtcattttttgtattatctgggagtttattttgctagtttctttattttttgaaatgttcacttcaagagactatggtttctgaatgatcctataattaaatgatttttaacatggctggtaatctatgttgagacaatactaaagagtcattaaggctcaagattttattggtttctgtaagtgaattttcagaactaagtttgtggtatccccattggagtgctgcatactactctgcatactcaaaaagcactcttctcatttttagaagaatttatatatatattgattcattaagtaataacttaaagattatggcctgaaaatgacaagttgaacaggtttgttaatgtcttatagtagaatgtaagctgtggctcttctttggcactgagatatatcaaatgctttttttcaaagtatgtattttattatactaaactagacactgtcataaagagcaatggctttcaaaattttttttaccatgacccacagtaagaagtaaattttccatcacaactcagtatacacatatgtatataaccaaaggttcaccatactttacccttacaatgtgcaatgcactccgatattttctattgtgtcattttttttttaattctggttacaattcaacccagaaatagggcacacaacctacagaataacactagcctagagtaacaaatattattcttactatacttttaagtaataaattattgcctttatgagctctatgttttccaccatatgggtgatccctcctccaatattgtcttttgtgtgtctttcgaaataaattatacctttaagcattttaataaaatgttatgcttcttagcatatttctgatatatactagtgaagaggaaacatgtttctccttgtcttgagagctctattcattatatgtttgtgctcaattgtataacagcaatcactgtgatgtttctagaactattaacagatttagaaatttctgataataacacagttgttactctaagatttgtggttgccttgactacaaacaccagcagtatactttatttctgtttaatggccacagttggaatgcaaactcttcagaaagcccagaatgtgagcatgcattatacactctgacttttctcaaaattgaagcaattcaagaaattatgagaccacattttaaagtagaatttaagtattagagcaggagaaaatgtcagacataaattagcccaactgcttccatttactgggggcagagggacaacaaccaccttccctcagctcccactgtgtataggcactttacctccattatcaggtggattttaatcctcaaaacaccactgcagcgtgggcattatacttatttttaagttgaagaaggtgatagtcagattaaataatttgcccagccacacagctaatggcagagcctgagtacaaaccaagctccaattccaaaacatgctctttccacttcatgctgctttttccaatatcacagacaagggaacagcacccgaaggatgatgtgatgaaatccaaggtcatggaggttttcagaggcaacagtatgattatttccactactgcacactgcctcctactaccaacctgaagttgcactgtttgttccattcctctcctcatgctcaggcataagagctgttttccattctttcaacctctaaagaaactctaccttttttctggtttgcaatgaaagaaggcagtgagcatttaaaatattatcgagagtgtgtatgctcaaagtaagagactgggaaatcagaaacaagacatcatgagaaaaactgatggcatcattacatttccaccaaattattcacagctacctagaagcttaaagagtctatgtcaatattaggtttgaactaccataattgttcagagtgaataagtttgttctacatgaagctggaggctgagctaactctagagaaggtaatcaatataataacctgaggttttgtccacatacaaactgatttattaggaggagtcggtggaaggtacgaggagattcaattcaacctttttccccctgagtggggaaggagaagacaggcaatgggtacaggcagatggaagaagcatagtggttaagcacgtgggcactggagttagcctcactagattcacaatctgcttagcagttgtgtaacctggggcaaatcactaaaccttgctaagcctcagttcttcatctgtgaaataaaaagcacagtgcctagcatgtaagttctcaataaataatagctattgtcattattaaattggctgcacataatcatgctagtttcacaaatactaacagctaatataacatttgcattttagttcctaaaactccttgggaatacagttgaaataccagttagtatcaaagagctgacctctgatgagaaataaccagcaacactccttcttgaacttgcttttgttaaagattacaactcttgcaaatatttttattgtattattctactatgtcttactgatattggctggaagttgtaactttatttttaatacgaaatttatttcctttgtaaaacttggatagaaccactaagcagtccagagtccaagtccttccagacaaatgctccccctgctgactttctgtgcagctgcagggacatctgagggctagacaaattgaagacatgagagttgggggaattattacagagaaaatggaaagaacagatgaacttgaacctgattactgtgtatagatgtttccaaaggtgttactctcctgttaagttttcaagatatgaagtactttgttgaagagggcagggggtctgtccagattagttgacacgtagatcctcctttaaaatgtaaagtatgtgcagaataataaaagacatgaagggtataaaataaatgagatcaaagacaataggatttttggctatattttaagcataccctttcctctgctgatgtatgaccactgtctttatcttactgcaaattcacttcaaagtagtagtgatgtaataataaattaatgaggtaatagcagaatttttattacaactacttcatggcttttctggctaaaagctgtagttttcagtctttgggacatggttacttattcccatcagagaagactgtaagaaccaaagattgattctgcacattttttaaaaatctgccacagacatggcattaaatggagtatagaaatgatgcatactttggaagaaagaagagaaaaaaaggaatgataaagagtttgtacaatagagaagcagttttcagtcccagctcttcatcttgtaaagctagtaaagtgaagattataaaatttacttacaagatgaaggttatagcacatagctcacttttattatcatttcaaaggtcataaaatatattttattattaactcagaaaatctagttctttattattacagataacaagagcattgtatattatttgatgtacgtattttgcagtgctttttatatgtctgttttcctcttgttgctaatttactttcattaacttcacgcctcctcttacatttcctcaaaaggtatgatacgcttcttataatgcacttttataaacactaaatgtgcagcattttacagccatttcattacgctaaccttgaaatctgtcttgtgcaacaaaactatttgaaatgaatgttaaacattttgtagctgcattaatggagggaaagatactggaaaatgacaggtctttttaactcaactataaagtcttgtcttattttaatagatcctttataaaatgtgatgggattgacccatcagtcactttttatataacctccatgtgaaatgtgagtttaagtggctatagtttccctaatgagaaaaggtaaatgtaaaaatgcctatggagcttcttccctgtaggttccactgcactttttctcagtgaaaggattgaggcgcttatgctaaacaagggaataaagtggtggaaattccatcaaatcttttgtctaagctactactgttttgaggcgagaatgttgaatgcaagcttgtgcattccacactgattccactgaagctccttttctatctctgctgaggtatgcaggtactgttatagcatttttatgtgggtaatcacccaaattctccatgatcataggtatatcatgacattaaccacaaaattgccaaagtcaataaccatgtagacaagaggccatgaaaatgaccattttgcatttagatttattttcagtcatgtcaacaaccaacagctgagtcattcagatcaaccacatgatgatctgagtcagtactaaagtggccaaaataaccagattatgatgtgcaggcttgattttagatcagactgacacagccacagtccattagcctcaatacaatggcacagtgtaatttccataaattactgtatttttctccacattgtcaagtagacaatgcataaactaccattagtattcacagcagcaaaatatacctctttccatatcaaactgtgattctggaattactccaaagtcagttttctccttggtctggcaaaacctcatcattccaaataaaaatgacagtcacagttctgtcccaaatgaacaacagataataaacaataattatacaaatatgtttggttttcatgccactatatttctcagtgtttggagaaaatttgtaccttctataacttgcacaccattttggattttcttatacaaaatacgggtattttatactacaaaaatgtgggtatttctctcctagtgtataagtttaaatgttttattttctattctgcctctctgtgcctcagtttctttatctgtaaaatacctctgtttgcttatctttaaaatagtacctaaccatagggatagagaattaaaatagttggcacaggtaaagcaattagaacagagtctggcacacaagaagtgctcaataagtattagctataattgttatcatttttcttcctctattactatggatgtttctttggaatgttaatcttttatatagcaaaattatttctagagtcagatcagttcagaataaattaaatgtatgtggcaacaatgaagaaagactctgaaaggtctaaatgcataatcaaaacaccctgtatacttttagcattcagaagtgtgccacattcttttctgactcatccagatgtttttacttctgattaaaagagaaatgttcccagatgaaatcctgagatagtgtaactgttagaaaaatctactgcaaagcagattttcaaattcaaaaagctaaaagtgatcatgttcaggaaataaatacgggttgtctcaggaatccagggacgaacaggaactacagatttaaaaaaaatcaagtcagtttgttatagttaaccaataataaatatttatcaaaatacctgccaaaattattcagagtgtagcatctaaaacaactgagttttccagaggccagaaaaaggttaccttgggacacaggaatttaaatttgctttaaagtggtgaaatgctggtacagacagagaagagcttgatttgccggctctcagcccagaactaccctcttcccacagagcctggagatatgccaggctcctacgcctattcttgactttatgacagagtgggttctcttcctgtgagtttttctgggcatgggagaacatagcgtaactaggatggagctctgccacacagcagaattatcctaaggatgatgtggcaatgttttataaaacctagggagcagattttcatttctgcagacagagccagccttcagcaacactgtgaaggagatgaagtttcctgagtacaagccattacccatcactgagcattcaattccctcacactgtccaataacttcttatggtccctgtctctgaggaacactcatgatgcaggaccaaacttgcaaccctgtctgcaccttgagagttttataaagtgctgctgcttagtcccaacccccagggttatgatttaattggtcttgaagcctaggcaaggttttttgtctttttgtgttgacgtgttttgactgaagctccctagatgatattgatatgcaggcagaactgagaatcactgatgtagaagaacaatgtttctcagtttggtctgcagaccacttgcagcagaatcacctgtgatgcttaagaagtgcagattcttgggcattcagctattctgaatctgcattttaacaaacacctcaggtaatgctgatgcacagtaacatttaagaacaaaaatttccccttattaaaacttacccatcttctttcccattccctactaactgaataaacagtgggtgctgttgaagtaatgtgttacattttgatcaagcctcctgaaaacaacacagagcgtgattccaatagaatttctccatcagaccaggaggatgattttgttttcgttttctgtgtgtgggggtggaagggggtgtggaggaagcaagccttttgatgcctctaatcccactatacaggtagtttcctacttcacttggagtctgccctgagtggttaaggcttagttgtcaaaggagaaagtttctaatctcctgggccccaaaagctatttatatgaagatgatgagaaatattatcatctagctccttgccttatggatgaccaactccacaaaatagcaatgtctttgttaaatttattaaactcaaagtgaatagtgctcattttccagcacctacccatttatcttcaagtgagaagaggtttttgactatgtttctctcatgacattaccttgtagcagtggttttcaaccttggttgcactttgtaatcacctggtgagctttaaaaaatttaaatgtctgtgtcctacctcccaagttctgatttaattggtgggcctgggcatgagtttttttttaagatcctaggtgattttaatgtggagccaaggctgaaaaccatttgcttctacaggtgtgcccagcaaacttcacaggaagagaactcaataagttaaattattacctgtggaagcaggagatggtaaaaaaaatatatattttttcctgtaattaaaaggaaaaatcctgctaggagtgcacttgtagtcccagctattcaggaggctgaagctggaagatagctagagcccaggagttcaagtccagtctgggcaacatagagagacctgacctcattttttaaaaagaaaatcctgctttgaaacgtgtataggcctgacaagtattatgcatgcaccatcatagtatgccatcatgacatggggtattgttgttaacatgtgacctttgtttaatgttttaattccctcacatcatctatttccctccttcatcagctatactgaaaccactcctctttccagaaataaagaaaaggatttcttaaacttagatctggcccctctgggtctggatttgtttttgttttgttttatagatcactctccgggcgcattgttggaggggtttggtggttcttcaccctgatcataatttcttcctatactgccaatctcgctgctttcctgactgtggagaggatggtttctcccatagagagtgctgaagacttagctaaacagactgaaattgcatatgggaccctggactccggttcaacaaaagaatttttcagagtaagtgctctgcagttaattgagcctgctgatatttattttatcatcttctcacaaaggcaagttcacagtgcttttaagggagagttgggaaagagtgggaatgttatcaaaggagagcatcttaaatactgggctgcttggttggtgatctactccattgtcgtttagaaccaagacttgagtaagacataacaagctgcatgtcaagggcactgagtttggactcccaggtttgaatcccaaccctgccacaaagtgattgtttgtccttgggcaagccatttaacttctaccagcttcagtcccctcacttgaataatgaggggattgaactaaataatatatattctgctttctagcttttacaaaagcagtgcttttatgtctcagaggttcacagaagttaggcaattgactctaagactgatgagtaatggactataagaaattacatattctattttaaatgttagttgtctattgagatgtattacaattgtatcaagtatttgtgtacatggtgataatttcattttcaggacagctgataattgttttaatttcttgggtagacgtattccctcagctcctcataggcaaaatcttattgaggaaacagtaaattgttcattagcaaaagttaataaagctatgtaaagtctgtcaagaggaaagatgaaaggagattgaagcaggaaatgatagaaggataatatgagggacaaaccactttcacataaaccatcaagatctttattctgtggtaactggactattaaggaagaatactagtagagtttttaagaactaaaatgttttttcagttaccccaacaagaaaaatatgctaatttagattagaaaatggacacattctataatattactactgcctgctactgtaaccacagtaactagttgtagcaatgatccagaagccacttgggtagtaggtggagtagttagtcactctctccaaccaataatcaagttattggatgacagatataattgctgatttttcctcaaaggcccagagtaaacagatggtggttctaaacctcctttttaaataatcaataagaaatacatttctacatgtattatcatgagatttgtccaattacttcacagtaaaccaggaagagtacatttcttgacattacagcaattaactacaaacagttttcactccctgaaagagaatgtattagtcctgggaccctttcaagaattctcattgattcaagatatccatatctcacctataccacctgtttactgaccagatcataatccccaactgggaggaggggtccaatgttggtccaatgaagaccctctggaactaatctggccttgaccctcactactatggcagtcccagaagcttatttagaaacaattttctgcccccatgaaatcactcacatttatcggggctagaagccagggatttccatctgatgagtagtcaacacataaccagctccatggaaatctggtttgatatcaaccttcaacagagcttatgataaccatcccaataggcatgaagtttctatatgaagtaattaaccacttaggatatcaagacaccagaagcttctatatgaagtaattaaccacttaggatatcaagacaccagacttgaaccctcagataagagatacttgttccactggaaagcatttttctttcaaaaacaattagaggttagaaagttgtgctttaaatggtaatcaataaacggcatcaattcccattaggctttcaaaggccattcatccatattgcaggcaaaaggaggctctctggaaagatgaagagatttattagcccagaggcagaaagtgtgaccaaatattcattgccctcatgcccagaccccatctcccacttattctgtgtctttctcaaaaactaggaaagcatctactaaatcattcaatcatgatttcattaaagggcatcatattaccagagctgatttgaatcaacatttaattctgagcaaagctattgccacattctgattggtttgtggtttctaatgctcatcaattcctagccaatgagtaattcatatggaaattgagctgttttgaaaatctgattacacagggagctggatatttctaagtataaggaagtacaaatcattttctagttctggcatgccactttttctgtttccccaaatggtcactggtggcatcattaaggacttggtggggtggttcttcagggcagcacacgaatgttgattatctaaaagtggaactataaaagcagcatagaaaaaccaactcctttaacctgcttatactgaaaatgttatctagacccaacaaagactatctttgatattcgtgcaatacagggttgtggggccggcagccaattggtctccaagccatttaaatccaatggggcaaagaaggcagccagcaagagcacatcatcctttatttagggacttgactgccacagtcatgtcacttccccttcattcttcagtgatgtcaagtcataaaggcaattttaaaaactaactcctggccaggtgtagtggctcacacctgtagtcccagcactttgggaggccgaggcaggcagatcacgagctcaggagattgagaccagcctggtcaacacggtaaaaccctgtctctactaaaaatacaaaaattagctgagtgtggtggtgcatgcctgtaattccagctactcgggaggctgaggcaggagaatcgcttgaaccagggattcagaggttgcagtgagctgagatcttgccacaacactacagcctggcaatagagtgagactctgtctcaaaaacaaaaacaaaacaaaacaaaacaaaaaacagtaactcacatacacacacacacacacacacacacacacattggggatctctgatagcatgccttatgaacttcagaggatgaaacaagatcacatgcaacatttacaaacataatatgaactcatttcttcccgtgctcactctatactaatactacagggaccaaattgtaataacataagacagcctagggccagccctctagtccttccactaagagataggaataaataaaataaaattcttttctaattgccctgcagacatttttacttgtcctgagtaaagctgccattaaaatgatggtatttttaaatgattcatttgtttctctcattttctgagctttccctagctgtcatcttacaatcccatgatcagtggaacagagggacctgttccgtcaggaaaggcagggagcagaatgcatgctgctagaagagacacctggaatattactatcaactctcttgatttgaaaactgatttccttagacagcagctccaaaactatatatcccaaccagacgtagaagcacatatgccaaaaaaacaagtggacggctttattgttgttgcccagagaaatgctacaatgatttggaaagctgcactgaaatgaccattctccactaggttttggaaatttaacctgatacagattcatgttaaaaggtggcactggaagaaaaagtaattccaaagttctctctgcctgcagacctttaaaagtattagaaaataaccaggatgctggatttctttttttgtgaaaattgatattaatattttattaagatgcattcaaataattatttatacatttatatgcataaacacccaaaacattttatacatggaatcatataacatagtattctcttgccattatttgtttgttttttaaaactcaaataagtatagatttacttttttttttacttcatagtatttaactttacttcaactctattatttcctttatcaatttcctcttgataaatgtttaaccttttgaaaatattttggtgttaacagtggttcaataaacattattttccattgatgtaatagaattattttaaaatgtttttaaatatttgcccttcagttagatcccttaaagcacttagcctgtgatgtgacataagccatgtaatgcccagctgcagacaaagctggcttcacaaagttacagaatgtagtaggcacctggctaaggaaaactctaccccacaaaatatttagcccccagtaggcactttaacaggaatcacattttttcccctttttacattaaatgtctgatggtggaagaaggggacatgtttgttctaaagttaatcctaatggaaaagttaatggtccaatattttatttataccataatggacaatttttctctttctcatttgctgaactttatgcaaggctcttgtgtttatttgggcacaactccagaggccttcattcttattctcacctgactggatggcccagccaggtcatgtataacctgtgatatgcctgtgcatatacctgtgtgcgtaggctgctgaggccctggtatttggtttagtttgttgcttactttgccgttgcttggtttcctgattctctaaaagaatataaggcagaaaaatcccagagagatgtttcagagtttcagaacagtaccgttgaagatactagtcacactgaagtttacaaaagttacatataagagaacaaagacttctttcatcatttagacagagttggtttgacaaaggttttcagcaaatcacatcaccaaataagaaactaaacttgctgacttagcctattgcactaaccactaaactcagcttcctcccttagctacacagggaagaaacacaggggggaaaaatgccaccctttttgaaacaagcaaacttttggaaaatggccaggtctggaggctgacttgtatagtgcatcattttatgagatgtataccacacccagaaaccttgcagaaatcatcatgacagagatgagataatctcaaaactttctgattttatgtggcgatcatttgccatgctggtagaaggttttatgagaacttaaatgctctcttctggaaataggcagtaattctagaatcccagaaaatttaaatccatgtcaatttgatatgtttggacagttgacagggaaatagtactgttttaattccatgtatatagggcataaagacacatattaaaataagaaataaggaccagatcagaatgaagcaccataatgttaatgaaagcaataagttcaagggataattttataaaactgtcattagagtatttgccaaagagagagttgcattatctctatcatatctcttatttcactataccagagcctgcataactgcagtgattattttaggacttaagacaaatactttatttattctaagaacacattgatatacaacttatatatcacatataagaagtcaattgtctctttttgtattagttttgatcagttagctgatgaagtctttgagtcttaccccaatgccggatgccagatttcttttccagatacttggccatatccccattacagaaagtttgggggataaaaggaattcttttttaaaaatgaaatgtttaacattaatttaaacctctttaagaaagtaaatataaaagaagaggagtagagagagtggtgacttgctccagtgccctaggcaaggcagaagaattgaactttattaggagaccactaaggggactgtcctgcctcgtgagttacaggtattgtaagccctgtgaagcacagctgaattactcatgaagaatgttttgtctcaacacaagactctgattattgtcttggtcattatagtttttcattttttttaagcacaggcagcgaaaggaggggttctgccatgctgatttgaaaaggagtccctgctaatagcatttcgattctgcttacacattcacaaccacacacatacacaaagcattttcaactgggtctacatttcttcaatatttattggctatctataacagggcttttgaagtatatgcaggaagggagaaaaatctttccacaagcgcacctatgcagggtatgctgacattttgacataatccagaaaatcaaccattaatctttaagctttattataattgagctatgtacacaacagacctccctgacaccttaatccatccccttgccttaggaaacacatcaaaatgtaaaaatcttttgttaaaaatttttctcaccaaacaccatggtgaatttaagatcttaacagacaatatacctggaaagctgcagccaaattttatttgtttgaagacacatataatgtgaccaaatgtttgaggatacatccaaaccatgcactaggggaacacataacagcaacagcaacagatgagttgacactaagggtagtaggtcagggacatctgctgtacatactacttggcagtttaaaaaaaagaaaactgtctttcaattttgacatggctgttttgatgctgtcttatttttttttaagtcttactttcctatgttatataatacacagcaagagccatagaccttataggtcaagactggagacagagcaacagccacaggtgaggatgctgaggcctggccaaaaaggcctctggaaaagggaaagatgcagtaagaccaccgttggcttttcccatccttcagcagctaggaatctgtggctccatagctcttcctttcaggcaagtctcaggctggctggaaaggacaatctccaagaaagtagaggttgacctgacaactatgcacgcaactgaaaacacatctaatatctgcctccaagagaaaggaaagcatttagcaataaagacaagctaataatatgcctgatattccattatttattcagcagtctttcagtaacttttgagccaagcttcatgctaagcactgacgatcatacatcttataaacaaaattaaattcctatcttttgccaaattacctgaaaatacctagacaggctttttcaccatatttggagacagattaacttaaaatataggtatctcacataactagatgactttccctccagggaagctggtggtgtttatttctatggagctacttcccagcatgggccaatctctgggtatgctccatggtgacttagcagcagggttaatgattccctgtaacctcagtaggaagatcagctagtttatgaatgaaacagaaatggcctctaccctcttggagctcacaatctagtggaccattaattttcaacacacattcacatacattactacacaatccacacaacaatcctggggcagccagaacaagtatcattacacctgtttcatagaggagacaaatgaggtacatgacattgtgatttgctgaatgtcactcagctcaatggagaaaagctggcactaggatcctgatgctctgagtctctaatgcagcacatgttaaggcatctgtatcatctcccggttgatctatgtttttattccccttgatagatcaattagaaaaggaaatctatgcctacttttaaaagacacttcccatgctctgacaacttcaaagggttccaagataagaaggcaaagaaaggcatctataaagctagagtgaatgccataaatggagcaaacctctattattacatggcttgttatagtttctgacgtgctaagggttatgtcatgtgtgtagatgaaactagaaagaacaagagaaagatgaattgtttctagttccacatccactgatgactttcttatttttctttgggtaaagaatatttggtctcagtttcttcatttatcagggagaatattccttgctctactgtccttatggggttggtgagaggctaatatcacaaaagctctttaaaagtatgaaggtgtctacaagtcccaagaaacattaggaaaagggcccagcaatagagcaattaaaacctaaagactcagggggagggagagcatcaggataaatagctaatgtatgcagggtataatacttaggtgatgggttgataggtgcagcaaaccaccatggcacaagtttacctatgttataaacctgcacatcctgcacatgtatcctggaacttaaataaaataaaataaacctaaagactctccagacacagttctgtagagatgtgaggggtacttcacaaaaataaaataagataatctctctgctttcttgatggaagagatgtgggtttgttttttgtttttgtttgtttgtttgtttgtttttctggctttgggaagagaaagaaagctcattcaatattttccccatcctcttgatcccacttctacccttaaatataaaatattactattgtgctcatctcctagttgattcatctttagctattcctttgtggcctgcagattcaacaacttcaatatgcacaatttagagctgcccttgaagaccatctagaaactttaggtgcttccaaggtggcctgccggccatctgcccaaagtaaccaaccatatggattttattaaactatctccattagtcctccaaggtaacctacttgtttatgagagcgtttcacagcccagaaagcctaagggggttaagtctccattctttctgaggctgccaactctcacagacagcatcagggtaattaacatcacacaggacccccagatctttgtaagaactctgaaactctgtttcctagaagaactcatctaaggatctcactttcttttcttatctgacacagtcaaatcatctaatagccttccagttaaaggaatgaggcccatctcttcaattagactttacttgagttcacctggcaagcctgtgtaggttaattatttacagtcctccttcatgcagaagcctaaaaacttgaccgtaaggatcaagtaaaattcgacttacgaaaactcaactaacaaggacaattaactggaatgcttggttgcactccacttttgaaaggaaaaggcaacttagacacacaaaaacttgataagaattttttccccaaaagcctactagatgatgtcctgcagtcagattcattctagtcttcaacatcattcacactttggtcagagagtaaatgtattgaatgtttatcatagcaatttaggcaccaggtatacagtacaggaaacattgacagaacccttaccttcaaggagcttgcattctgttggaaggagacaaaccataaacacataaaaaatagatgtatagaataattccaggtacggataggtgctccaggatgctataataaagaatgacttagggttagaaaaatattttaaactgggagcttgggttggatggagggtttagggaaagactcattaaggaggtaacattttattagagacttaaatgataagaagaggcagctatgtgaaaatctgatggaaaagtattccaaacagaagtcatgcgaagtacaaagtcctggggcagaaacaatcctggaatgtttaaaggaaggaagaaaaccactgtggctgaagaatagtagcctacattagaattatagtgatggagactgtgtgaaggaatcagatttatgattcattttggaggtagagtcacagaatttgctgatggattggataacatttatgagcaaaaggaaagagccaaggatgactctcagattttgggcctacatcccttttcagtaatcacttatgaaatctatagtcacaagggctgaaaaggtatactaggactggttaagaaattttccaaagcgttggagaacgttagctgtctgaagggaagattgccgttgttataactgttttaaacacatctattgagatataattcatatatcacacaattcatccatttaaagggtataatggttttgttatatcacattattagtttttttaagttgtgataaaatatatttaacaaaacttgccattttaaccacttttaagcacacaattcagtggcactaattgcatccacaatgttatgcaaccatcattactaattccaaaatattttcatcacttcaaatagaaactctataaccattaatcaacttctcattccctcttctcccaggtcctggaaacttctaatctatttcctgtctctatgaatccacctatctaagtacctcatataaatggaacaatatgtccttttgtgtctggcatatttcacttagcataatgtcttcaagcttcatacatgttatagagcttcattcctttttaaaggctgaataatattccactgtatgtatatgccacattttgcttatctattcatctgttgatgaatacgtgactatttgtgaataatgctgctataaacattggcatacaaacatctgttcaaatccctgctttcaattctttggatatacacctaggagtaaaattgctggatcatatgtcaattctatgtttatctgctataacttttttttttccaagatggagtcttgctctgtcacccaggctggagtgcagtggcacaatctcagctcactgaaacctctgcctcctgggttcaagcaattatcctgcctcagcctcccaagtagctgggattacaggcgcatgccaccacgcccaactaatttttgtatttttagtagagatgtgtttttaccatgttggcccctgacctcgtgatctgcctgcctcagcctcccaaagtgctgggattacaggcgtgagccaccgcacccgatctgctataactttctaaaagtctattttgaaataaaatagatgagggcatcttctgttctgttttcttctcattcctgtttaaacaatctcagtcttgaggcaatagatgtttctgcttcagtaggaagagggatgctggataactggtgttgggggcagatctgtagttaatatcacaaagtttcatcttgatatcatgaatgaagttgaggaggaggtatatgtatgtatgcatgtgtcaaaaaagatctaaagccttgtctacaccacacatttatacaaagccttggacattttagttagtggccccgacttttagcaaaaacttaggggagcatgcttcccttttctgtgtttgggttgcaactctggtgcctcagcaggattgcactagcatgcaggcaaaggatgataaaaatggaactcattgtcctccctctgttttaaatggtttagaatgttacctgttggaagagaggggcttggatagagataatctattgcatttctctccagtcctgattgcatgaatctatctataagctgccctcaaaactgatcttctatctgtatactctgtggtgacctaatgaagatgtccctgaacgtggttaacttctatgcctagagaaatctgaattccagaactgagtcttaattcccagttttatcaaaattcttatgtgtttatagcctgatttatttgactctcaactttacttcctttgagtctggtctgggttacagactattatttttatgagaaatattttattttgtttttttttttaattaaggtatgttacaaataaaacttacatatcctgtcattcttggcaatatgaattcaccttgagggcattatgctaagagaaataagtcaggtattgaatgaattatctaatacctaaatccaataagcaaaaatagtctgttagttatctctctgttaggggtatgcttgttacactcaactcatattcttgttcttttttttttatttattttcattttaggtttgtgaaggtttgttatataggtaaatttgtgtcaaaggggtttgttgtatagattatttcatcacccaggtattaagtccagtacccaatagttatcttttctcctctcctctccctcttccaacctttcatcctcaagtagaccccaatgcctgttgttcccttctatgtgttcatgtgtgctgatcatttagctgccacttataagtgggaacacatggtatgtggttttctgttcctgcatcagtttgctaaggataatagcctccagctccatccatgttcccacaaaagacatgatctcgttcttttttatggctgcatagtattccatcgtgtatctgtaccacattttctttatccaattggtcattgacgggcatttaagttgattccatgcctttgctattgtgaatagtgctgcagtaaacattcatgttcatgtgtctttatggtagaatgatttatattcctctgggtatacacccagtaatgggattgtggagtcaaatggtagttttgcttttagctctttgaggaattgctacactgctttccacaatggttgaactaatttacactcccaacaacagtgtataagtgttcccgtttctctgcaacctcaccagcatctactattttttgactttttaataacagtcattctgactggtgtgagatggtatctcattgtggttttgatttgcatttctctaattatcagtgatgttgagctttctttcatatgcttgttggccgcatatatgtcttctttcgaaaagtgtcttttcatggcctttgcccactttttaatagggttatttttctcttataaatttgtttaactgccttatagatgctgggttaatacctttgccagatgaatactttagaaatattttcttccattctgtaggttgtctgtttgttgacagtttcttttgctgtgcagaaactctttaagtttaattagatctcatttgtcaatttttgcttttgttgtgattgcttctggtgtgtttgtcacaaaatctttgcctgttcctatgtccaggatggtattgcctaggttgtctatcagggtttttatagttttgggtttcacatttaacagactatttcttgtatcagtcagtaacattgattttccaacccactgggtaaagaagtctgtcctggacactctgggaataaaggaaatgccattcatactgagcccagtatgcagaaaataaagaagacaggtgatttcatcaggaacagtttctaaaaaagagggcaatttaaaattatttggagggagaaaagaattcaaaaatagttcaagggggatgtgagaatatttttgtggccaagaaagaaaaacaatgaacaataagaccatggctttatatcacattaaaccatggccactattgactaaggtagttagttttctctagtgttcacattaagatttgtttgtgagaaatagcatatgtatataaatttgggggagaaggatttaggagagataaaaacaattagtttctgagaaagaaattattgctttggaacaactgtatcatagtagaaatcaatatatagactgccaagggtaaactgggaatcattcctagagatcaaggtgctctggacatggtcttatttctaattttaaaacttacattttgcatgtgaaggtgaggttcattaaaaatgtgctctccaaagaatactttgctttcctttaaatgagcttcgggaatcaatgttgaaaagcaaaatccatctacacttttggcatacaatatcaaatgaaagaggattttatagcaaatctttcatatttaaaagcaacctcattacattagacattgtttcaaataaaataaacagcccctttcctgaacatgctagtatgaataagataatcataaaaagagtcaaattaaagcccctttgccaagaagtttgaagtttgatttccaaatgtttgtattcgccaccttcctctgaacacacacacacacacacacacacaattaagtacttatgattagcatattattgaagtttattatatatgaaagtcagagagaataaactgccccaccagccagattcttaaaaacacttttgctccattttcttggcctgggatttcagccaactgtacaaacaggaaggttgggaacaccatggtcaataaccaaggaaaaatataaataaattcaaggagacttggataaattcatacaatacggatacgtggaaagttgttaaagttaagggacaggtacttgaaggacactttcacgaaggacactttcacttttagagttgacatccagaagacaaccatggcttcccatagtccatagtcctgtcttaaaacattcttatctggaactgcccaaagagcagacctatagggactagcctataattttttacaagattgtttacaaacacagttgtttctcagttcgcaagaattgagactatttagcctgaagaagatatgtagcagcagaatatattagaattgtcttcaaaaatttgaagggtagacattttaaagatcgactggactgttccgtggggccccaagggacagaacaaagatcaaagagtggatattacagggatagagattttagatcaatgtaagaagaacattctaatatagcaatccatagataaaatgagctatattcatagatagtgaggtgttcatcattgaagggactcaagaataggccacttatcagagatgttgaatagaggactcagtaatctgatgaatgactgtactcgaccagtgttttccaacactgtgtatataaaatcatttggggcactattttaaaacatagactactgggtctcatgccccacctcaagatgctaattccatgcatctgtgtttttccaataatctgtgtttttaaagcagcatcctaaatgattacaacacaggtaaccaagagccactctttgatgaatatttgacgattttctgctttgcttttttttttttttccctatgcaaaggatgcagcggggaggctggaagttgggcctgtggtgtagagagaagcctgagtagaagtagctggggcctgtctgacatgaagtggtgtcttgagagtgatcacagctgactggctgaggtcaagccacccgctctgtgtgttcctgtcagggattgagaaaaaggaaaaacctttcctctaatcaacagggaccagtgggagataattgtttcaggggctggaatctgaggtcgaattggcactgtcgcattgatgctttgccaaaggtttagggagccccaaatgaagatctctatagggaagctcaagtaatggtatctggctgaagactatgaacaataacacaccctgaaaactaaaagtaagagcaaaattaaactgcaaagagagaaatcatggccaaaagccttgaaaggtttacaattttgatcttcttctcctctgatccagataatgcccttccttttccactgcccatttactgggtgagtcttgagtgaccaggactgttgtatttatgtctttatggatctttcagagagccccctgattcctatcctagaggactgcaggtggccaggtccaagtgctggttatcagtggagatcttcaattagtatgacctaggtaaaggctgtgggtaaaaggaacttcttagaaaaatatggagcagatgacaaatatatatcaggagcctggaaactcctgccctttggagagaagctctctcctactttcctttacccgacccttacttccttttctctttccttcctttacctgctgggtcttgggtattcaggactgttatgttagtgtctgtacagaggcttcagggaaactccccacaagcactcttacctgaaagaatttagatgaatagccatagatattagtcagcatgggaaaataagagccacagaacctggaaagaagtagggacataagcaacttcataaaaagaaagaagaaaatggagtagaggagcagactggtcaggagcttggcaacttatgccaacctaaagaagctgtcccactggccctttctgagacctaagggtctcaggtggtgaggacttctatgttggtgtttttacagaggttttaggatggacaaaaagaagagctacccttcacaaaggaaagttcattaaaatatggttggaagctatgggcaagagaaaggtccttaaaaatgaaaagggacagaatgagagattgcaccaagagctttgaactcttaacctttagccaaagatctctcctactatcatgttatccctcctccccctccctccttctttgtccttacacttgccttttatgatgaggcagctctactatgtgactgcattttggaggcttcagagagcctcatgcctccaagttcccaatctagaggactgtagctgggtagacataaacctggttaccaagaagagctcaaaattaggaggatgtaaatgttatcaggaaaagaaacagattttaaaactgatacagaaggaaaagaaccaggagccaggaaattcctgccctgtagccagaagcacaaccctaatgcacaactccttattccttactccctttctctttgcctatttgacctgctgggtgtgggcattgggtaatcaatgcagttgcattcatttacaaaggcactgaggagaccaggggtccaaccttccccacacagaagacttgtgggtggacagccccaagtgactgaatggcagggtgaagcctcctgagagtaagtggaggtgatctgtgaggagaatatgagctgcataccctcctttagtatctttaccagcgagagttagtgagggcacatctttaagaaaagagtggtatggtagatagtacccagactgaagtgctagctcttaggcctaaaagaaagaagtaggatttctgtaatcctttctccctccctctcttcttccctcccttttgttaattctacattgccattgccattttaacctgctatgggtattaggcaaacagaagtgtgatcatattcaaaggcacctatccatggagtgggcataaggtatcttttgaatacaggcaccggggtggcgataggagagttccaattctcaagcaggagagaaatgttttccagcccagagggcagattgcccagcctttatctacatcagcagttgggcacagttgatcaattttcgaatcagtgcaggctttgctgattaaggctatattatggacattgctcagcttcatatgtggttaagctggacctgttaacaaggtacatagagtatttccaccacaaattatttggatatctgatggatatttaagaggagccatcccttctttctaactttctttggagtgccatcatctcccaaacataaggatcctggcttctgcagaaaagagaactctgcccttcccctccctggaaagtaatactccgccttttatgaagaccagatcagtttttataaggctagggttcaatattttttcactcttttctactaggacccttgctattaccatggatacctattttgccccttgacactttggagatgcagtacagtatccattgtaccaggatctcccaccttgaagctctttttactggttttttgttgttgttgtttgcttgtttgtttgttttgtcttccaggcaatttccaggcttgcctatcttccagaccaaagattaccaaaagctagttaaaaatatttgttatctttaaggctttccctttcttccaaaatctttgactatacaacacagcaggaccctgccttaagtaatccattaatcagacaattcacaactgatgaaagcaataaatagtaattactcacattggaaacataatcttccctagaaaacagagatcccttagtgcatttagtgcatttgggtgctaacagatcattaactacttgtcagagaaacctaggaggagggctttcagaaataaacataaaacaacctatgcatcaatagaaaaataaaatttgattttcaaaaacgaatctaatttatggcacagcttttttttaggaattcccctgttatataacggaagacatactattttctaggcaaagcagcacaaatcagggaaaggaacatttaaaagtgttggaaaacttacttgcctatgttgagccaatctatgtaggtatggttacatcattctagaagtctggtagtcaatctcggagtctcctttacacacactggtcattttttcaatacttttggatccatgtcttcctaatgctgggctaaatattcagcatgtgccatgttgctaaaacagaaacaatgagaaacctaaatgttctgcattccttgattttgagtttaaatttgtaacgttattaatattgcattaataacctattttgcatatctgtttgattgtaccatcttaaacattcatttaaacctggggaggtcagcatgactcctacctgcttctcactaataacatgcttttcagcgagtagataatgagtgacctggatagaaatcagtggaaatgcagattgccttcaggtggagaaacaggcaggaaatccactttctccacaacactgacaagcagttttgaggctgaaggtagagaaagtaagcctcaaagagagatgactgtttaggaaggctcttaatcaaatattctgttgtctttacatgtggtagtatgaaggaaaagtcatcctaatggaaattaaatcttgcaagtgactttaaaaatcttgggttaatagaaataagtgatttaattatggagagaaaaacagataactcttggctactgattatcctaatgggttacaggcctgaataagcattccttagttcgttgaattaactactgttagtggcacacaggtaaggataggggtgggaagtagtgggcagtcaaaggtctgccattgattgatcagagctgggatagaaggcaatcaggtgagtcttaaaggagaaccacataattttttttaagtattaatggcccactccacttttctggaataacaaaatatattaataataatgcccttgctcaagatatagagggcctgtttttcaagttactgtatttctttggtaataacgtactggcacagaaacagggacttatgtgaaatgtatttcaaaccaatgtctgctaataaattatcccacaggccataggtttcacaggtattagaaaatgcatgagatttgggccggatgcagtggctcatgcctgtaatcccagcattttgggaggccaaggctggcagatcacttgaggttaggagtttgagaccagcctggccaacatggtgaaatcccatctctactacaaatacaaaaattagccgggcatggtggtgcacacctgtaattccagctgtctcaaaaacaaaacaaaacaaaaaaaaacacaacaaacaaaaaataatacatgagatttggaaatgcaacctgggctttcagtttctctcttctaagttctttacgattcaacatggcttccttctgcagtttgactatttatcttcactgaataaaggtgatagctgtatcagaaactcaagtcaaaccaaataatggtgtgatttgtttactttggagggttttcagactttggttttgtttctgttcgacggtggtaataaaaacataggtctgaatataaaacaacctagttttctacttgattcttgaaaaagaaaaaaaactttgcttcagctcatgagtctgtttcttattttttgttttctaatggagtttgacttgcaaatctgcaatttggcagcatttatttctgtttggggcttttggtatagcttggctcaagtccctggttactgtatgacagcaaccaagccaaatggctgtaacattcaatctgcccaattaaaaagcgttggttccatgccccctttggtgactcagatcaggcaaatttactgttgttttaatcttgattgtactcaattattcaacccatctctcagagctgatacagataactattttttaaaaaccttggggaattgtgagtgttgtcacctggctgctcactccttttggaattcttcccttggaaataagagtcagagagagtaggtctaaacaacttaatgtagcaactcacagagccagaaaaagataatcaggctacgtagaaacttaaggagtgcaccttttgttttttccacaaatattttcttctatctgctctttttgaaataaagtatggttcttaaataagaacagcaagaatattcttccatggaatacctagactcaggagttcatttattttcaattttacacaattaggataaatgtaaaggaaacagtttctgcacgtgcctaaggaattcttgcccatacaaataacacagcttacctttctctagagaggcttccatgagcacaggctgggggagctattccagagctacatactagctctgaatagagcagaagttaattccccaacctacccccctgtctctcaacccagatgatagccagccctccaaatggtgcaggcaggatgtccatttgatgtagtcatcacctccataatcagagtaaactagaaaaatattataaaatagggaaagtggttcttggtgctgttttctgccttttagttcctctctgcttttccttaagctgtagacctatactgtccaatatggtacccactagccacgtgtaactatttaaattgaaaataactaaaattaaaagtaaatttaaaattcagtatttcggtagcactagccacatttcaagtgctcaatagacatgtgtggctagaagctaccatattggagagcagagatatagaacatttcagaaagttctatgagatgttgcttccaactattagttcttttagcttcttgagcataaggaacatgttttccacatctccattccttacagcaggtaccacaattcctgatacaactatggaattggggagaaactaagtgcttactatgttgtcgtgagctatgtcaaattcattataagcaatctctcatttcattacctcaagaacactataaggtgggtcctattaccatccccatttttcagaggaggaaactgagtctcagtgaggttgaattatttgcccaaagtcacacagttaataagtacctaaaccaggtctttataacttcaggatctatactcttaacaactgctgtgtacaccaaaagaaaactgcacataactacaaatttcaacatgggacagacaggccccttccagagcattggtgactaggtggcttctccacagcactcatgctggccaaggcagaataaagacaatttgagatcagggcctgagcatgaagattggggacttaaataagtgtgctgatttgtgtttgcatatggctatcagattaagtggctatctgactacttctctaatgaaatagcagcaaattagtagttttatctgccattttgcatatggagaccattgccttgaccccaatggtaaagattagtggaacctaatcatttcatgaagtcaacctcacttgctgcacttatcagaagcttctgtaacttgagcttccatggcgtgcagtttatgccaggacacgcaaatgccagaaaatcaattttcctgcagctttcacagtcagtgtgtttgccagacaaaactgcagccagccaccttttttaaatcagcatagcacctttagaaataatacttaccagaacgctcctaacacagcaaggaggaaaagacttaaatctaaacccaactgttcaaaatcgagagccacaggagaaggtgaaatatgaatatattgaaagtgaacattttagtggccccatttggcactgtaaagtattctctgccaagcatctgttgagttaactttaattctaatctgtgccacagtaggactgaaaacacttaatatgataccatacttcctgtcacccacatgtgcccaggccctcacgtgcccctgacatatcggggtggcactccacattgcctgcctgccccaagacctatcttgattcttcttcctctggtattcttctggcacacattctcaaataaaccaaaccacacaaaggcagtggatgtggggtcatgttaccttcccatttgccatgagtgcataatctactttattgaagacttactacttgccaagaactgttatgggtgctttacatgaattatctcatttagtagtctatctccatttcagagataattattagagtcttagagaaatttaagtaacttgaccaagtcaaacagaaggcatgatctctaatggtagcatttagggcctgtgacaagctagtgagttatcatattggtgccttttacctcggagcatcttgcacaggtttcaaagctgaaccaagaaagaagatcaaggttatataaaatcatgtcaaaacaacaggtcaaagaagtaaacttcactcaattcactagttttggtcaatgtagctactaacgatctttccactgggaggcagtgcagagtagtagaaaaaaacaacacaggtttttgaaagccagcacacctggatttgaatactaattctgtccccctgcatctatgcaaacttggaattataactttacctctctaaactctggaagagagaagaaggagaatatagactttggtgtcaaatgagctgggtttaaatctcagctacgcatttattcattcagttaatatttattaagtacatgctatatgacagccattgttgtaagggctcaaaaccaaagtccttgtaatcactgtagtgggtgagacaaaattaaacaaattctgtaaataacatatatgtttctgttggtgttaagtgcaatgaagacaaaaagctggtgaagagacaaaatgttggtgtggaggtgctatttcatcttggctgattgtggaaggcctttctgacatttgatcagacaccctgaatgaaaggaaggagcaggccatgaaagtatgaggtggagttgcgtggagagaaaagcattccagatggaatagcgttagcaaaggccctgacatgggaatacacttggtaggtttgaggaagaaggtccatgtgctagagtgaagtaagtgagggaaagagtggtaagagatgagagcagtgaagaagacaaaccgtggtaaaaattctggattatattctgtttgacagaaagtcacttagccgactttgagcagaggaatgacatgatctaatctatgtgtaaaaggatcaatcagactgctatgtcagggcaaaagttgagaagcagggagacagaccacttaagaagtgattgtaggccgggcatggtggcttatgccaataattccagcactttgggaggccaaggcatgaggaacacttgagcccagaagttcaagaccagcctcagcaaaatagtgagatctccatctctacaaagaaatttttaaaaaattagctggatgaggtggcacatgcttgtagtaccagttactcaagaggctgaggtgggaggatccctgagcctaggaattcgaagctgcagtaagctaggatcacacaagtgcacgccagcctggacaacagagagagactctgtctctaaaaaaaaaaaaaaaaaaaaaaaaaaaaaaaaaaattaattcaatttaaaaaagaagcaattgcaatatttcaggtgaacaatgattagcttgaattaggaggagggtagggagaagtggttgcattttgaatatagattgagctgacaaggtgtggaatgtgaggccaaagagaggagtcaaggatgactaaaaggattttgacctgagcaactggacaaattggaaggtgctgccattttctctgatggagaaccctagaggagtagcaagcaggggtgggggagaatcaagagatccattttggccatgctaagttggagatacctatgagatatctaagtggagatatcagttaggtagatggataaatgaatctaaactttagtgaggtcagagctaaaaatttaaccagctgtatcaccttggagaagtaaaataacttctataagtattagttaacttctcagtaaaatggagataatattggtttcacaaggttgttttaagaattagcaatcatgtatataatgcacgaagcaccattcctgttgcatgtaagtgcttaataaatggtagccctctcattgtcagtatttatgcactaattggtagctagttgttgcagctgtaggaccattgttgattattctaaacacatcgttgaatattagaatcacttaggaagcattatttacaatgttggccccgcctcaggccaattaaaccagaatcacagaagcagtcatcagtagcttcccaggtacatagtatttcctgctgacaagctggctttaacagaacttctcttcagattagttccagctcaccttttaggaaactaacactccccccccaaaaaaaaaaaactctaaatggaaaatttgggctcttttggataaccccaagcaaattgcttcttcttttcttcattgcttttttctccccttagtaagaaaataattctccagggacctggaagtaacagccacagtggaaacaaaacattgcaatttcaggatagatttttcttcttaatagaagaacattttcccgctcatttcctaggacctgtattgtcaggtttggcctccacactacaattaattgattcaagaataacaatagtattgaacttctcttttgaatatcttagtaatagaaaataaaaatacatttaatccaattggtcaatggtaattggctttggattgctggagatgccgtttcattgaaaaatagaactctagaaggctgagggaagtgaccttggagtgttcaatagtgatagcagtcctagaagcaatccttgattgagagtcagggaatttgaggctttgctctagttagtagtgaaagggtgtggcagacacactttctttgtgacccattctctgtcttgaaaataggttctgcaacttttacactgttggtgggactgtaactagttcaaccattgtggaagaagtcagtgtggcgattcctcaaggatctagaactagaaataccatttgagccagccatcccattactgggtatatacccaaaggattataaatcatgctgctataaagacacatgcacatgtatgtttattgcgacactattcacaatagcaaagacttggaaccaacccaaatgtccatcaatgatagactggattaagaaaatgtggcacatatacaccatggaatactacgcagccataaaaaaggatgagttcatgtcctttgtagggacatggttgaagctggaaaccatcattctgagcaaactatcaaaaggacagaaaaccaaacaccacatgttctcactcatagatgggaattgaacaaagagaacacttggacacaggaaggggaacatcacacaccggggcctgtcgtggggtggggggagaggggagggatagcattaggagatatacctaatgtaaatgatgagttaatgggtgcagcacaccaacatggcacatgtatacatatgtaacaaacctgcacgttgtgcacatgtaccctagaactgaaagtataataaaaaataaaaaataataaaaaaagaaaataggttctgcaatctaaaggtgaaggtacatagcaaagtcaggttttcaacacacacacacacacacacacacacacacaaacttctcctccatacccaattaatgtgtccaccattaggctatcattcctttagctgtggtttgatcctatgaggagatcacacttttgtatattgttcatcatttctacctcagtgtgaatgtttccaattcttttctgagcacaggatggggtggggagggcatcttttacctgataaggcaaatgaaagagaggtggtactacccacgcaggggagtggaaaatgaggagcatctgtgaaaataaaagttgactcacagtcttggcttataacagccatataagttcaatacataacgttatactccttatatattttcattctcaaaataaggagaaaaaaataatttgtcaacttctggtttaaaaggtagggttttcatgtggactaagggtaagacactttagtctccaatcctacatttcagggagggaataatagaaatatcatgccccttgaaatgatgctaaagtataagcatcatttcaatcagaaagcagaatttctgtgaagtcatcccaaccctaccacatggcttaacctatctaggaatagtgtactgtttgagagcagactctggagcctgaatgagttcccagatccaccacataccagctgtgtggcattaagcaaactacttaactcctctgtgcctctgtttctgcatgtttaaatggggtaatatataatagtataatctatttcatagagttgttgtgagaattacatgagttaacacatgtaaaacccttgaaatggacctggaacaaaaagtatgtattcaattaaatgttagttatgatgggttttcttacttaaagatggcttaatcaaagtccatatagcagagtttctcaaccttagcaccgttgacatttggggccggataattactggtggtgggggctgtcctgtgcattgtaagacatttaacagctccgctggcttctacccactagataccagtagcactcctctccccaagttgtgacaatgaaaagttgttgccaaacgtctcctgagaggcaaagttgttgcttactgagagacacaggggtagagggtactgtttcccttcctccattctcccagaatagagcaatggtaccttagaaacattttctgaaagaatgtgttgactctagctttcaaagtcacatggccactggcactattttcaacccattggaatatgcttagtctgactcagcaagagaagcagaagattaatcagaacagtaatctgactttgcataccagagagggacactagaaaggtctcaggaaacttagctgattgtcacctgcacctttggaaaggagacatcagaaatagcccttcttgaagtggaaggaaacatgtccctggacttgtgaacacagtttgaaactgttaagcaaagtcatttacatttgagggcaaaacttaatgtctaggcgaaaggtgacctccaactccaatgaagttatctaaaagcccagccctcaaaataactcagtcaggctcataacacacaagtagaaaaactaagaatagaaaccagaatttctttcccttcctttcccctgtgttcaccaatacacagtctcatgacagctgctgattgtctgaagcaaaaggacacagacaagcagtacttctctgaatgttaaaaatgtgcaaacctaagtgaaggaagaaagtgaaattggggttttggccatgcttagaaatgatatcatttgttgtgtgccttgctccaaatcaaaatggaaactatttcctttactttagggggaaaactgtaaaaatcaatgattcctttttccaaatgcaccttattagagctattgacttcttcaaaacataagtggaagaaaaaaatgtgtccgatgcatttggcaacccagatgtatttttcttcttttgcctcaaattgctctgatcactttacatggtgaagtatggacactaagggcctatagcagggttacaatgagtgacaagaatgttcactaattccagtgccttagtgagaggggatttggagttaatttacaatttaccccaacttcaaaaaaagcttggacaagaagcaaaaaatgtttttggaggtgagttgccctctttcatcaaaaaggatattgtcagtgctaaagcaagcaaaagaggctggggttatcacggggaaagatctatctgaaacctttctagttgacttggatagtgtcccagccttgttcctcattagctgtgtgacctaagataagtagttgagtcaatggcaaatctttgaatttctgtattggagactcttcaaggtggagttctggttaggccttatttggaaactgcttagcaagcacacagcttttttcaggcttgatttatactgagggggtagattcatggaaatgagtgagtaggctaaagcccactatggcacctcttggcattgccactgcacttaccctcccttaccctcagttccatcttttataaaatgggaattcattctttcattcaatatatatttatggggcactactgggcacacacactgttctcagtgctggggagtaagcagtgaaaaaacaatagctactgcacccacctcacagggctgctgtggggtttaaatgagatggtgtgtgttaaatcaccctggcacccagaaagctttatggaaatataaagtttaaagatattcagctatctcctgcttctagtcatgacaaatctaaggcctctctgaataagggagtatttgaaaagttgtatggcaggtaattctcaccacaaaaatctcctcttcatgagtctaaaccaagtgcttgagatttccacagttggagtcttaacttaaagaacttaatttctgtagacctgagacttgtgactacattaaagaacttcagaatgggcccaccccagccacaccttacccctcccttatagtcctaccccacccaccctagtaggacatgcaagcacattgtcctcttccaatcccatcaaacattagaagaggcaaagaagaaaggaggaaaagagggggaggtcaggagctctccagagctgtggcatcattggccttctttccttctagcaccttgccttgtaaggatcacctatgcatatcctagtattggtcaattctgtgaggcaacatttgctcctgaatgttagagaaggcacacaaggcacacaggggtcctgtaagtgttccgttcaggcagatggaggcccaaagccacccttttgaatttttaccacctagacacctgagcctttaataaaagcagaaattacagaggacgctaaataattcagaagaaaaagcagattgtagtttataattatattatcttaaagatacaatctaaagaaaaaatggaccaaattgtcaagcaagaagtagtccacaataaacttagagacagcaaaatgagtgaggaaaagtcatttttgtttgaaactcttgccatatttccctttcttagtgtctcatacacaaggcagccttctccagcccttgaaaggcaccttttataatgccaagaagcccactctcctttttggggtatgaatcccctattcaaatcaaaatgaccccttgctcaggggtaacagaagccattatactgttagtgaacacctctatgaggaccatgactgctgataccagaaaaggggtacaagttatatctctgagggaggcagacagtgaaacagggagaaagtggtagaagatgagcaccccaaagtcaaatctagcccctttgacatgtatgtacaaggctagtcctgtacatacaatgatggaaatggacaacataggcatggtggcaacagtgttcaaaaaaataattacatgcataaagctggcccattttcctttgaggaacactggaatacaaagtgcctaaaagtatcttccccgacctctccttcattacatgttggggaatagagatgttacaaacaccaatactgtctttacaaattatgtaatactttgtctgcattctgacagtaaattaatagcataaatgaatagcatattatgcttctgttgataaacatgcttccaatttattagtccattttggtaattcagttaattctgcactatcaacatatgggaaagtggatgttgaaccctgtcaaactgaggaattgtgctcatgtcaagaccacgagaagagatggttccattgtcctttatgttaatgtcactatatcaagcatattgtgctcaatttgggaggccacattttaggagggactttaaaaaaatgaaaaggtatctagaagattgtgaccagaaaaggtgagttgaatggaatttgtgtcataaaagtaacaaatgaaggcccttaaaatgtttagcctgcaaacaaggcaattaacaagtgacactgtggcagtagattccaggctgtacatcgtgtcgggaagagagcatactgattctctattgctacaaagagaaaaattaggaccagtaggtgacacttcaattttaatattcactcattccaccgacacatagtgagagtttactgtgtgccaggcatcatgctacacacccgtggtgcggtgacaaaaaaagacatgatccctactctcaaggggctcagatttggctggggataaccattgcaaagcaaaataatcagtactccctacaatggagaaatggaaacagagaggacgtactgcccaattcaagcaggagacagaagtaggattggagaggagaggctttcattaagaatatcagccaaaccaaaggaactttctatcaacttgaattgtcccaccatggaataagctacttcctatgcctcctctgagctagggagtgcctcttcaccagaagcatttaagcaagaagctatcacttcaccgggtgagaggctcaacaaaatggtttttaaggcgccttctagctctaaaattctgttattctactgactccaagtggatatactattgaccaagtggatatcctattttatctcacaggaaagcagaaaattttattcaccaagtttccccagtagcagtgttctggttaatgaggattttaatgtataagcctcaacttaactgcaaaacataaatgtaaaaggaaaagttgccatcctgcccattctcctacaccaacaaaatttttaaaatccaatttcaaatgatagtaatttttgttgatggcagaccctggtcattcaccaggcatatgtctggagatccaaatatacaaataatacttaagcatgtgatttctcccataaaatgaagtaatgattccgtaaatatggcactgaagtaatttataataccattaaaataaattctgtcagtaaaacaaattatactttctttattataaagatatataatgtttttcccacttcctgtgtttcagggattcttctaagtatgtattaacccatttaatttctcccaataaacctttgaagtatacacttaaaaaatcatcccattttatgggtgaggaaattgagacacatagatgctagataatttatgtacttagcaagtgtgattcaaacccaagcagtctgactacatgttcttaagcactgcactatatagttactttgaacttacataaagaatagttttatcactagagagctactatatgcacaatgactaggagtgaacaacaccgttgcaaagagacacaaggtctaagtggtaggcttctgtgtaccagactcacagggcccaagattcaaatcttcacatcaacaaaaagacagatttcttcatatatttgaccttcatgatgtattacgaatagttagagctacaactgttgaatccattaatgctaaggctctaccatatctgctatttgggattaatctgttccttctccatttatgtatttctcctttggattttggttgctaattatctagcagtgcttgagaatttcttatggcctttctttataaccattgtttgttcctttttaggtacaaaatggtgctctgtgggatgaatgaaatgaatggtggtgggttggagaaaaatgaacttgttattacacatcctgcccataaattgtttaacttctcccagatgacagagctaagattcagtcccttttattgccttctttatttcatccaaaataagacagaatgcaaaaaaaaaaaggaaagaaaaaaagaggaaatgctagttttctttcttctttatggtctgaatgttatactgacacttaaatactagttggaaagataaacgtttcagcttaatttctcctacttatgagtcatttcttttcccccttctaatctttttgagaattcagtcatcaaaaagagtccaatcatttctgccactaactgacttgtcatttaatgcattcattaatatctgccacatgtacaccatgtgcatttaaagggcctgcttcaagcactgctatttattctcctagaaatgcatcattacctaaaggaataaaccttttaacctgtatcagcaatcaaagagctcaagtaaatgatgaagtaaatgagtccaaattatagtgcacttggatcagaattcatggacccctttgcccttggcttataaatttatctttggaagcaatggcctgtttgcaaatagtgtaaaagacaaatatgtctgaagtctccccttcctggacccccactttgtattcaggtctggttgggccaagatgaaaaacacaaaacagctctttataaatgcacaaaaatgcatacccactacagggttttctataatgccaaaaataatggaaattatctaagagcccttcaaaaggggttgggtaaataaaacatagtgtgttcgtagattgaagagctatgcagccattataaaggaaatatgcttattctagtaaaagtataaaaaggtgcaagggaatagtaaaggctaaattcagtatcgtggttacttttggcgagtagagaagaatatgtatttagggaggggtagataagcagactttaactaacttcataatgtttaatttgttaagctttatggcaggtacacaggtgtttttacattatttttatatctttctgtgtatcgaattattgattattttttaattccttgggtaactaactaggaaatgtctactgaaataaagtccttgacaatgtatttcattacaatgcttaaaaattgtcttatgtgtcaaaagaggataatgtaatatggaatgagcataaatgactatgggtgagattttaatcttagaaggccttgattgttagggattatttggggggaagttattgatgtgggcatcaaaggcagactaagtagcatttaaaaagaggattgaaaagcatatatccaaattggtttagcaaggtactcagtgatttttagaaaaatttcagctctagaattctacagtgctataaagatagtgctggtagccatttttacctgaacttctgatatctttgaccagcaatctggtcgtcaccatggtcaagcctaagcttcagttattaagaaaacttatctttagtctgtcatgtatagagtaatttgctggctgccaagagggctagcaaaattaataaggtatggactttgtcctcaagaaacactcaagtaacaggggaagacagacacatagtcaactcaccctactgcaattaagctctatagcaaaggtatgagcaaatggctttgggaggacacccaaagaagcacttcgtgggggcaggaaagggttaggaaagacttcacagaagacatgacatctgctctggatcttgtagatgaataaggtaatttaagcagaagcaaaagcataaccaaaggcataagacatggaagtggcttatttcagtgaccagtgaatagcccagcatgacctaatcacaggagagtgtaaccaagatcataagcactcttgaatatcatacataagagtttggatttttttttcctgtaggtattagggaactagccgaggattttaaagaatgaagtaacttgattaagtttgcattttggaagaatcactagaggataaattgaagagagagatgaagcagggagactagttaggaagcaagatagtctagacaaaacaacgatggagcctgaccaagggagggcaatggtaatgagaatgaaaagaagatgagaggacagattttaaagtcattactatattagaaaaaacatggcagaatgagggagtgagggaaaagtaaaaccaaaccctttagcttggaggttaggtggtttactgatagaatgtagaaggaaacccaggctttacaaggtatataatatagatttagttgggaaaagtttaatctgaaaatgtctacaggaccatcaggtggagatgtccatcatcagggcttgtttgctatcttcccaaaacacatctggaatccagccttttctttctacctccattgctcccaccctagtccaagccacagtcatctcccctctggaatatcagaatagcctcctaactaatttccctttcttccactctgacccaactcatagtctattctccatatggcagtgagagtaatctttaaaaatttaagtaagatcttatcacacccctcctcaaaatcttccaatagtctcctataacaggtagaataaatccaaactttttaccatgacctacagggccctacaagatctggcctctgattatccacctaagctcatttcctacgactctccctttttctcatttaatttcagccacagtggcttcctttgctataatttgtgcaaaccaaatgtgttcccatctcagtgaagagtttcactgactctgtgagggcttccatgagggtctgattgccataaacacaatgcttaatgtccctggtgatccagctgggcgaggtggctcaggccggtaatcccagcactttgccaggtgaaggtgggaggattgcttgaggccagcaatttgagtccatggtgatagttctggaagttccagccccccctggaattatttgggcaggtccaagcaggccccaagaaagatgcaacacagccggccaaagtctagagaagagcaactaaataaataatcaagaaagttggggtgggggccaggaaaccccacaaaaagacatttgaaaacatggtatatgtttatggtttctgccatgctatctcaacctctggtcaagtatcaccttagaatttttttctaggattttcattcctaaggacctagctcccaagtcaattggaagtttttgagtcattgagtctacaattcttttatagtctccagaatgactaacatagggctagaggcacagtaagcatttaatatatgttctagggaccacctgaattgaaatgaaatttaatgggattatatgcaaaattcaaaaaggtaaagatgaaggagacttgacttggcagaaagaactaagttttggtttgacctcaacctgagttgatggaaagactctattgactctattatattcttccagtgcttctcaataaaaaaaaattttgttgaaaggatagaggaatgactaaatatattaatgcaaattcaaacagcattggtagaaaataatgctccaggtcaggtgctcacgcctgtaatcccaacactttgggaggctgaggagggagattcacttgagcccaggagtttgagaccagcctaggaaacatagtgagacctcgtctctacaaaaaaataaacaaaattagctgggcttggtggtgcacacttgtagtcccaggtattcaggaggctgatgcaggaggatcacttgagcctgggaggtcaaggctgcagtgaactaagatcacagcactgcactccagtctgggtgacagagtgagacgaaagaagcgaaggaaggaaggaaggaaggaaggaagggagggagggagggagggagggagggagggagggaaagaaagaaagaaagaaagaaagaaagaaagaaagaaagaaagaaagaaagaaagaaagaaagaaagaaagagagagaaagaaagaaaaagaaagaaagaaagaaagaaagagaaagaagagagagaaagaaagaaaaagagagaaagaaagaagagaaagaaagaaaaagaaagagaaagaaagaagaaagagagagaaagaaaaagaaagagaaagaaagaaagaaagagagaaaccaaacagaaaagaatgctctaaaataagaagcaaaagtttgttgttgttgttttttcattctgttctggtcatttatttggggtaccgtgtctatttctatacactctaaatagagacagacattaccaactacaatgtgcctacgagtggaaaaccaaagttgtgagagttctggaaacaatatcagtcagagtttcacctgatgaagagatgagaaggggacataataaaggcctttcaataattaaagaaccgttgtacattaaaaaaaagaaccgttgtaaaaagggacagaattattttacatagctctaggggatagtaccgggggtgggggtgtggattaaaatactacctattgaatacaatattcacaaactaggtggcaggatccgtactccataccttagcatcacacaatattcctatgtaacacatctgcaaatgtaccccctgtgtctaaaataaaagttgaaattgtaaaaaggaatgggagttatagaaaaacaaagatcatctcagaataaggaggtactttcttacaataattgatatctcatgctggactgggctgactaaaatagctgtacactaccttataatggtctttgattaggcatatcctgctacgattagataaacatagcaggatattgtagaggagattttttcattgagaggaaggttgaactaacaaagtgtttttcaaataagattgcaaccaattagtggggccatgaaatccatttagtgggtcctgagcaacattatttaaaatgaattagaatagaatagaaaatatcagagagcatcacacatagcaaggatgagtgtggttttgagaacttgttttggaaacaatgtttacgtatgtatgaacgtgcctactaggttgcagtgtaacgtgttttttattactgtggattgcaattaaaaaaaaaaaactactgcactaaccctcctccagactgaatatctggcagctctaagaattcttatctctttggtgcagagatccaaaattgctgtgtacgagaaaatgtggtcttacatgaaatcagcggagccatctgtgtttaccaaaacaacagcagacggagtggcccgagtgcgaaagtccaagggaaagttcgccttcctgctggagtcaaccatgaatgagtacattgagcagagaaaaccatgtgatacgatgaaagttggtggaaatctggattccaaaggctatggtgtggcaacccctaaaggctcagcattaaggtgggtggaataatataacaatatccgtgttgttatagtattccacctaccctgatgcattttgttgtcattttctttcttgtggattttgaggtaacttttaaaagtttaaaatctacaatattccatggagttaaataagacggtaaattatggtttcatctatttaatgcatccattttttttaatgttctctctctgtgttgtcctctctgactgtttgttgctgttttaattttacagttcaacggctttttcaatttaaatggtaaaagccaagttatggtgccatatgtgacgaatgttaattgcatggatgtggtgttcttgttactttttttctcaaagacaatttccccatcccgcacacttcagttttgagcaaatgttatcctccatgccaccttccaatatttaaccctgtatttgctgtacagacatttttatagctccacgttctgtgaaatttagccaatttgtcctcttgtgctcctttttatacgttaacgatttcctaagcatttgtgcattttcttacaagttatgttttatcgtttcaagaaatgctgttaacctggcagtattaaaactgaatgagcaaggcctcttggacaaattgaaaaacaaatggtggtacgacaaaggagagtgcggcagcgggggcggtgactccaaggtcagcctcaatgtcaccacaaccgggtacccttagtgacgagtaatcggcaagactgttatcttattattgaggagagagcacaagactcacacataaagtggaatgaccaggttattcccctgcctggcagctttgggaaccaaaaagactttagggcactgcccacatttttgatctaacttgggtcccttcttcaactcccagacagaggctccaaccacaccctttcccttcctttacccaccagtttggttgccttatgaaagccatgatgtgggtttcaatgccctaggctttcaagagtccaaggctttcctgtgagactgtccccgcctgcctcagttgagtggtatgaaaaatcagatccatctactgaaaaatcagggcatagccttttgttttctaggttgtgatggttgctcacagaggttggttggttgagtaagggtggcttcttcaattatgtgtctgagtgatgagatgttgttctctatatgtgatagcccatttaagcaggccccacttaacttgaaagccaaataacaagctcggtttcaagttaaatggggtctttcttcaataggccaccccatatagagactttgcagagacattttgtgtatttaagcaagtgcgtcgcctaactgtgatactatatgtgtgtatgaatccctgatttagcttctccttagccatgttcttggttcaggtaggtctaattgttatccaggctgccatcatgagaaaacccatcttacttggcattcctttgacttctaatgctctttggagctagaatgaatgaatagccatcatccaagcaacaagaaataggggcaagctcagaagccgcgatacaaagtcatggaaacacacttcgggtaagtacaggagaggacctgaaaatagaatcctccttggcccaaggggcatgagaattatattgaagcatgtaaactcacctcttgtacgaccaagatcccatgggcatcttaaggtgaagaacagtgtttcccaaccacagaccaacagacaggcaagccaaaacttttcttcttcagagacaatggttgcacttctgctcctctctttccctctctatccctcaggatcctgatggaaaagttagtttgccagtctgcaaatataatatgggtttggaaacactgatccagaacactttcaaagaaatcaattttaaaagaactttcttcagcaaataatcttaccaggcattggcatggccttttatcgtaaaaccttgattaaccagaactcacctaaccagtaccccaactaactgaattgccccttcagtacttcacattgatgagaaagcagcaatagtattccaaaaaagaagactgcaaggaattgatttttttaaaaaatacttaccaagagatgacctatggttgggtcacattcggctctttctcctctatcttctctccatctggattgaccctcaaacgttagaggctgcttccctgaggcgagaaagtagatagaagcattttaagaaaaactgttattagccaacaatgaacaaaatggttgttcttattgaaaattccattcatcccttatggattccaattaatcaaggttttactatgtgtcaaaaagcagtaactttctttcccaccaatgtgaactgatgacactgacaatttagccaagcttttggctcatttcatatttacaatggccaacttgatggccaaagtatttagcacctgtctttttctcatgttatttgcacggagaacctaattgtatcattgaagtgagttgcagaatgaaaattgagctggattggatgcattgctctcacgaattcatcattcatactcatcatggttaaaaaggagccatggactgtaacaagatgactctaaaacatccacatgatgccaagtgcccagaagttttcagataaccagacgtttgatgttatataaacaaacaaaaaaatctgcacatatttggctgactttttacttttcacccagatgttttggtacatgaagaccccaaaactttagaccagctattttttcattacaaccagcaatcaagctttttttccctcagctagtactgctgcaaagttttttatcaagtaactttattgacagctcacgatttccagattatctgaattttgatatgcaaatagaaaaatatttcagtagatcctaaatgttttcaacttctctaaccatagtgctacctgccaggcatctttcaaatcgctttccttggtcattcctacagccagtcttttgaaataagtcaacccttttctcaactatggataatagtatgatcgatcagtgctgcatacccaacgattgcttattccatttctggattaccaagaagcttgcctttgtcttcttccttcttgctacctgctgttttctgagagtgagcaagagaaggggcaagagatgaacgtgaatctggttaccactacgtattagtgatgcaaaaaaaaaaaatcaatggagaaggaggtagaaatagcagtaaaacctcattaatttgaagccctctaattaataatttgtgataaactagacagggaccagtctacaagttaactttatattatcaggcatgaggacaagaaaggtttgttaagcaaatgaagagtttagactggaatgtcagttgaattttttcttaagagaacaaacccttttcaaatgttagaagcacttattagatataatcatattcgttacatatctataggctaaagtagctctcacgaggatctccactaaggcaatgttttatagtcagtttgaattacaaaatagacttaaagtaataaaattgtcattctttaaacctattttgtaatgcaggacttgctttactcattcagacaatcctttccctctgttcctccaaatcagtgaggttttactgtattagcaaaatgacttgagatttacatctcttcattgtgtcccatctcgttaacatgaaaattgactgttgaatataccatcatttcacagagaaagtgcgatccagagatggtgatgactttgagaaggtcacacagctaatgctgtcataaatctctgctgactttcagagtcacctcttgtgataatattgcagatggcaatttagcactaccacctatccaatgagcaatgtgaatctgattgcaagcgatatgtttccataagaatcaggttcattcgcaactaccttggttactaggcaaaaggcatatttaagctgttccagccctcagtactgattactaaaaatgacaataatcacaacgcctgacatttataagtgcttttactttttcaaaaacactttcagacctattatctctgaaaccagaagagggagaaatacctgtatcacttatctttctgtctctctctctctctccaacctttaactaatgataaatgggcaattatattaagtcattgactttttcttccctggcatgagacattacacattctgagattagtctagaaaagttaccatactatggaaagaaacagcaaattttcaggctgtcgtaaatgtgcatgagcttaaactaataaaactaatgttttattattttattttatttttatggatacagggaattaaaaacaaggtcagtctctgaggcagcccctgaaccatacctacaagctgaaaccagaatactccttggctttcccaatttcccaaacctgagctaataggacctaaacaaaacagacttgatcatttcttgatgaactgtaaatgcacatgcaaggatcatgtaaattagaactgtgctttgggaatttttaacctgcaaatcacccttttgtgttcatgctttattacaatgtgtgtgcagatgcagtaattaagagccagtaggttgtttcagtgataaacccagatcaccagggatttgtgacatagccagtgaaagtctatcattgtaaatcacagcagaatggaggatttatgtacagaactaccacataggcacatcagcctccttctgcagctgcctgtcccctcaaaagtttatgttcttatccaccctacttcattcccttaatcttgggtaaagggcaccagcttcgctttcccatctagccttaccttacaagatagggtagggtcagtgaaacgagctatttgtgactgaggtggaaagttattaacaaaccctacccaacctcaccacagaattataccagactttagtcctctctagggattaaaatagactcccagtttccatatattccaagatgaaaatcagcacatgtgtgctcttgggaacattgtaacaatatttaaagggaccattctgagccccttgactgcaatgataattgtaggataggtgggtgccttaacttgagaggcatataaggaaatgagggaggaggatgggatgtgcaattgaacctccattatttaaataaatggtaagatgctcattatgacttatagaatattgatagagaaatgcagttttactatatcttcaaaaatatataggaactagaataaactgaccaatgtgatgctaggaaaaaacatagggaatttgtttaaatcgtttcaaaaaatgcctgcaattaaaatcagtggtgtttcctttcacatgggtgctcttaaggtacctaaaaagagtttgttctctgaagaaattaaaacatgttcctcctccctatcactagctatctttgtttttttaaatcccatgcatttgcttagcaagtcttctcttcaaagatagtaaaaagttacactctcggacagcccatttccaaaatccctcagcttcatatttggtggcacatagatgaatgaggttatactgtatttcccattggtatacatgagatcttcagttttgtgtgtatttcttcttcttccatgtatgtctacaattctcctctcctatgccaccgtctcttaaccacttctcttccacacccagaattctttgactttcttgggccgtgggtaatggatatgaatctgcatctgcctttgcctgcaacaaaatggaccttttattggcaggagccatccctaaaggttgacatttcggatactcagggttaagatggatcccaatgactctttattgacactgttatgtgtgtaggcaagaatcattacagatcgatggcacttcctgggtcttagcagaagttcctgtgaatcctcaagactctggtttgggatcgaggagtagggtgagtatattgtgctcttcgttggtttgcatgattctatgctggtactgcctcctggaagtatgaagaacctgacagttttctttcctggtagtcactaaatttgctccttgaacttactcaggtcttcctcccaagagcaaatcctcactttctctcaagtgactgcttcaagcaagggacctgttgccttaagaactgaaccagtccaatggctgccaaaaccattgattttgccaaatgatattaaagaataaattctaccaccggaaaaaaatgtaatccagaaagaaaacacttttaaaaaataattccattctaatgattttttaaaaaatgaactatggccttaacatggtttctatgattaggacattattatttgcctttggtgttatcctgataacatgaatgtgtttcttattgacaaataatgaccaaatgtccaacaccagagctacagaaagagccacaggaatgaaaagcctgaaggtaagaatgctgttatacaattgccaagaggaaagatgccattgcagtggcagacagtgaaatggtgtatgtttattccctttctgccctttgaagaccaaatcatttggtttcctttcatttgaagagaaggttatacacaatctctgaaaggtaggacagccatggaaaagaaacatgaaaaatttgatgcaattgaaatatatttggtgagggtgggagttggggttggtggaacagggtgggggcaaatttcttttacgaacaattgaattccattctcttttgactttctagagagcggtatagcatttggcccttggcacatgaggctgatccccattgatcagaagtggcaaaagtgttgtccaagtgctggattcacctttttgcctaatttcatctagcattgaagcaaatgtttttcaaaatatatacctaaggcaatggcattcatatatatatatatatatatatatatatatatgactatttgtatgtcctgtctaacatcactgctggaagggcagatgtgatgtgtagatgctagaatgtatgctaatagagggtggtatatgccctggcatggcaaacagatctgatttcagatctgatatatagacttcacttgttgcaatctagctaaaactgattatttttctatgagtcatggtcaagggatggctattggagaataaagaggatgttggcacccatcagattgaactctcaatgcatattttgtctaggatcaggggaatgagttaaatgtcttcagaaacatacatcatgtgagtttctggtaccgatctgtttctctcttctcattctatgcttctctaggtgccattggaatgaactaaagaaaacacacttatatatgataaaacccaataaaatttgatagtttgatctttcaaaggatcttaaaccagagttttcaagtgaatcatgccaattatgtatttgagaaagtgtctatggccatattttgttcaaaacttagcattttccctgagccccttctctctgtcagggataaattgagtaagaggtcttcccagactattgggttcaactactagatggagaagttgaacagaggtccagtttggcagtttagtagaaatctatcagtgaaatacacaacctatggaatcaaggggtctactgctctgtatttgagaggttgtaatttagaaatgtcactggctttacccatgtgtgtaagagttgcttctggggctgctgctgcagcatagatgctcatcaataggtttcaatcactagcattgttaggcccttagtgaaatgactcacagctttcaactcttaatgttatatgcacgcattattgaattttctctttgcacttatattaaattattatcccaatagcaaggagttaaataggtttgagctatatttgtgaactacatgaatataaatactctctcagagatggtttctagcagctaagcactgcataactgcaaatcattgtagctgcccttgttaaatgaggattatttaggttgccagagttcagtaatgccagcagccatatatgcacatgctcccacgttgtacagaaagcccaggctgatccaaggatagaaggattgaaataaaatcctcattttcctggaatcctacattcaggaacccctgtgaaaacaaagggatagagatttgttttaaaggacttcagacactggtgtactcaagggcatattctgaactgccatggccttaaacagctgctatatggagagataaatcccttcattatacatatcccaggttaatctacagaaaagaatgtaaagtaccacatagtaaattctttaatacagcaaatattcttcttttgcttgatcatcaattggcttcagctaaataaagcaagaccaacctgggcagagatgtctgtgactgcctgcctgtacatgcctgttatgtcctgggtgatgctggggcttttccagagaatgctagagaagcaagtgagtgattgggaaagatgctttgccatcatgaaaacctgaaacatcttcagtaaaagagttagcaaaagagaggatggctgttctccctccattgggccaaagacatttctaaaaagttgttcccaaaagatcactagataccaagaagcaggtgttagtaacttagagcaagggtttggttaagggatagggtgagggaggggcttccagcttaggccgtgataagtttccattctcgtcatccagataatgtgttatcagagcagatttctaattgactatgcaaatgcaccacccttgctcatacatttcttttacttctctgtgatctctttgtctttctccataacctacatatttacacatatatctatctctcctaagggcaccattgaggatcttctggaataattaattaaacagacatttgctctttaggtgtccctgctctgaaaggagaagtgaagccatttatagtagtatatatcccatagtatttcaggggactaaatcatactacaacctgggttctgatatttttcaggcccagaaccatattgacagtatagattcctctctttacccttccaggatcaccagattatttcacagaatcaacttggtaattaattgacaagacccaattttccttcttttcccctaagctcagcaccctcatatcactctcttcaccatttctttgttcatgataaggaatccaacctggttctaagctactatttgctatttactattttaggtatttcctgaaattaaaactttaaaataaattaagcagttcttttgaaatacatcaaaagttttatttattttgttttttaaaaaaattaagttttggctgggcgtggtggctcacacctgtaatcccagcactttgggaggctgaggtgggcggatcacaaggtcaagagattgagaccatcctggccaacatggtgaaaccccatctctacgaaaaatataaaaaattagctggacatggtggcatgtgcctgtagtctcagctacttgggaggctgaggcaggaggatcacttgaacccgggaggcggaggttgcagtgagccgagatcatgccactgcactccagcctggcaacagagcgagactctgtctcaaaaataaataattaataaaaatttaaaaaaaaaataagtttctactttcacagaaaaaaaaatcaatggcattcttatcctaaagctgtctccatatgtaaggttggccatcactaagataacattgattctttaaaatggctggttggtacaacccaggaactgagcctggaatccaggagaccaccagctggcaggtggaggccttggattgtgagcagtcttagtagctgagttagtggcaggtgtggatggtagagataagcagaaatttttataatccaataatgttttcttcaaaaaatgaactcattatcaaagtattatgaattacattactatcctccatataaaaaacagacagatgtaattccatgactgttccccacactcaggaatcatcactgagacacaattcagcattaacttcacatacttttaaatgactatctaattcccatttctctcactctctccatctgatcagcaatccatatgcatttttatgacttacatgccacaaaatgttttcttaggggaaccttacactcttccaccccacctcaaacatttttttagacaaaatagaacaaagagttgtagtttataaatatttactctttgtttcatttcccatttctcagaaggatttgtattttaacaaatcatgtcacttgaagatgtgaaattctcacagtggaatttcagctgccagtgagataaatatttttggatggagggatgttcccagtccccatgaaattatgtcacaaagcactcctgttttttccctaagcctgctgactcatgtctttgtcttaagacggctctactcagcaaaaagttcatagcaagcccttcagaggggagagtgcctgactaatttccacgataggaatctgacctactttgtttaattctttctgttctctattgaggtgagtacaataaatatttctgacttataattctcttaggtaccagttaagggcctgcagtaattgctgtgaaacattacactggagacattgctgcaccacagtaaaaggccccagctgcaaaatacacccttgctagattgatagttatttggagtatgggggtccctaaaggaaaataaagtcatcacaaatatctaagcttgaagagcaaaaataaagagggatgctacccttttgtgtattccattggagaatgtacagaacacagctcaatgtatattaattggcctcttgacccaccccataagttgctgcacaggtttgtgcaaattgcttaacctatctgtgcctcaatttctttttgtattaaatagacaccataaatctaccttcttagggtgatcattaaacctgaacaataattataatcataataataagtatgtaaatatactagattgaaaaacaaaatactaaaagagttattgatttgacaagtatttattaagaaaaatatcctaaatggagatacaaatacatgagccatattccctgcccttgagaagcacacagtgtagtgggagacataagacataggcataaataataaggcaaggtagaagtcatggaagagacagaaaacattgaagagcaaaaatggcttcatggagaaaatgacattcaaaatgatcaaatgcccacctatttccacttccttcaaaatacctatgtgtaagagtgtgtgtgtgtgttggggagagggtgtcaataccttcagttggttaggattgggctaggtaacacatctaataaggtacagtaagaaagaaaactatgtggacaaaagcagttttcctctgccgtctcagaaatttagtctaccccacagcaacatagagttctaggagatttggattttaaagtactttcttttcttggcatctattgtaaccttgttaagtggtattatctgtgatttctgattacagcttttatgtttgttggctgtgctgctgcttgaaatgtttgtttttctccctcatttttatttagaagttcccaaaagcacattggttccctgccaggtttcataaaccctgtgattatttttccgatccaaggctaaacttctaagagtaggtcatttgtcaaaattctctaaagtcctgtggtatctcacaggaggtctggatactcaaaggcagcatttgttgcctgtagcatctcccggccccgacccaggtgtgacaacaaaaaatgactccagacattgccaaatgtcccctggaggacaaaatggcctctggttgaaaactattgctctaaagtaacctacactgtaatggtttaagccatgggagtgaaaagcagttactagccagttcgtggaagccactagatggcctaaggcagggataagccattgttcagaagtaggatgctaagtcaccgatgtactgagcctgggttttggcaagagtggacagtggcagcccagcatggacccctagcacaagaatagccttccctcctccaaaacctgtttctgaaatgctttgtcccaggacttctctacattcttaaaaatgattaagaatcccaaatagattttctttatgtgtgttacatctattcatatttaccacatcagaaattaaaactgaaaaattgttcatgtattcattgattcattttaaaaaataataaacccaatatatgctaacataaataatatactttcatgaaaaataactatttttctaaaacaataaaaagaatagtgagaagaatggcactgtctatatttctgtaaatctctttggtatctggtataatacagagaatgagattctcatttctgcttcttcaatcaatctattgtaatttcacccatcatatggcctccaggaaactccactgtatatcaagaaggaataatagtgagaagggcacttagcattattataaaaatagttttgacctcacagatcttttgatgaaagggtttcagggatcctccgggggtccctggaccacactttgagaacaactgctctaaactgacatgccacacttttatgaatgtagttcacttaagggttgataaatttcttttgaaactaggatctctaggagcagtgaaatctccctattagaccttagtgtgagtacctttaatcagactgctctgttcctaagatctggtgagcagcagtactgaagaaactgaatgacgtaatttgaagaacatattaccgggagggaggacaggaccgggtaagggcttagtcaggtagcagtgtgaggacactgggccctttgcaataagaaaagaggaagcacagaaaggaggaagaatttgctttgtagtttctcctgtggtcctgatgagcccagtcactcatatgccattggaaagcatcttcccctgtatcctgagctaattgccacattgctgagcctggtgccactgcctgacttaaggcatagcattgcaggagaagtggtagtgatgagacaacaacagggaagaggaagagagagaagagcatcagacggtggagaatagaggagaagacagtgccaacactaaactcagggccatcgatggcctgtctgtcatttgaaagcctgacttaactttcactgccagtaatatcttaaagaggctcaaagttttatttgagtatatttttgttgctttgcattccaagcaactggttagcatttgagaagcctggggttccgagcattggttgaaggaacttgtttaaagtataaaaggatctcaatttcctagtgagatacaaaatccaaatattctggctgccaggtcctacgctaaccaagaaagttacctccctgatattaaagatttatagttattcaaaccgcaagtactctgaaattgcattatttttaaatgattatatctttctcagactatctgaagataagatagcccctctgttttaaacagcaaatgagggaagaaaggaaataggttttgggactttgtatgatagagaccagatctctgtgactatagcaagtcttattagtgactggatatgttagtgggtccaacttatccaaaataggctaagaaatttttacagcatgttcacagttccataaatttttctgctgtcctctttttaagttagtgacattcagaccaacatgcactaatatttggcaatattgctcccatgaatgtgaacagacagtttattgcctcagaattatgccaccctctctacatggtgcattttttatcccaagtcattaaagattcttcatttaaaatctaatagctctagaaagaagacaggataaaggtcattattcccattttacagctgaagaaatttataagggagaaaatctttatcctagaaccagtagggtttcgggcacttgcccagtggctctgaatgcagtccttatgttttaagcagtgaaggactaaggagcagtggcctggcctcctggggatatgtactagcctcttagttgaggaagtcttatcttactagaacaattaaactatttctctacagcgttacccaacagtggcagagtcattttgctggtttaggccctgccatattaataatccattttgaaacaatctggtttgccctctggtgatctaagttgaccacagacatatggccatatcagaaggacagccaatcagtaactcaaaaacaatccatagaccagtttttacattgttgaaaatactccccttatccaaaacagaggtccacaatatacctttaatactaagaccagtatgtgcataagaatttcgactacatgtttgtggagtaagaacatgtacgtggtacagttctttctgagatcattttcagctgggcaacagacttgtgtgataaaggacaattaattagaaggcatgttatttatgtagaatctattttcaattctgttcggatttatccatttgtctcggtccacaatatggaaacacttccccttctgggtctgtccttttcccgactcctccataaaatttgctttctgtctggaagtacaacaagacacccagttagatcaaacttaacacatctccttcacaaagctactgcaagctgccgccgacgattgtcacctgaggggagaccctcctcaccacacacaacctatctgaggagtgcctttttttctatcctcattatttaacagtgtgtgccgattactcaaagcgatatgggcaggccctggtaaatatagcgttgctgtagtgttaactttttataaggtaatgctcaggttgcctgcagtgtctaaaattactctgtggccagggccccctgctttatcgctttctatagttttaaagtagtttgaagcttgaataacataaaataacataatataatgttatttatgttatttcccacgtgaagaacgcctgtaaaccttgcagtattgaaactcagtgaacaaggcatcttagacaagctgaaaaacaaatggtggtacgataagggggaatgtggagccaaggactccgggagtaaggtcagtcgctgaaggtctttttgtactgattagcaatcacattttgacccactgtttattttctaccctaaaacggctttccttcccaacacacactccctgacacagtgggacccctttataacaacagtgctaaaggaataagacaaatgccagcctcagaggcctgccacatgacatcaattgttgactctatagaacagttatgatgattaggaaactcaatctggcctactgcatttccaaagttataaaataatgagctgtgttataagggggttttactgtatttcacatttcaaaagttcaaagagaaaatataataacaataacaacaacaacaaccaaaaaaaagaaagatttatttgtgacagtactttctcttaacctcttacagtgtcagagactttgtagttataaatgcatttggttattaatatattatgtcaatcccatctgaaaacagtcaaacgaataaataacaaagactggtctctgtaagcagaatgattagcctcctgccagctgctgttgtattgagttcagcattaatttggatctcgaatctcattaagtctgtcacacttctctcttccaaaggtgtcatttgaatctctgtacgtaatacttttaaaatttagtcgcatgctccttaaaggtatacatcgttaggataacatcacattgataagcatgaaacactcttccccgcctccttcctgccccccttcgctcccctaagaaagttcttttttagtttcaatttttgcctttcctttttttggactaatatcgtggtatcagttaattcatttcatgaaatgccactcattttccccgtgcaatgaaccattttgctactggttttctacatcccacatcagggaattctataactcttgtgaaacttaaataatacatggaacttgaaactgttcttcttgtcacagcttacatgggttatgtcaaaggacctctccccccattaaatatcatatacatataaaagtctaatggcagaggaagggttaccagaaattggtctatttcccaatggactgtggaacatccttgcagatagcctcaccagtctccttaaagagataatccaatatttcatatgtgacagaaattattactacttgtctagctgtcattcatcctaaaagagtgactatttgcaaggttgttgtgaatatgaggcattcccacaccccgtttctgaatgcaattcaatttcaattggaccttttattaaagtaaacaagtataggactggcttctatgaaaatgggataagaaggacacggccatattgtctttacttttaattatttaaatgataccaagaccagctgaactagagtgttaagtgtcagcaatggccatcatctgtcactgtgttgtcacttaaataagatgctcaaaattcactggcttaacaatttgggtattccattcaattacattcagcagcaaaatggttacataccctctaaaaagactacaaaatgctattttattttatttctttttcaaagaaagactcctggcccttggtgtgtcctacctcaaggtagggctcaagacaccaacttttttctttccattgttcagcagttcagattttgctttttcatacaggcagatagcttagtcagatttgcacagtttgacctgaaagtcactgaccggcttcctcaatttttcccccttgttacaaagaaagcaaataagtgtaatttttaaaaattattctctacattccctggagtaaaagttaaaaatgagctggatttttaaaaaaatcatcagcctcctggaaaagctttctgatttgtatggagccaatctaggacccgatggatcctctgacactctccttaaactctcaggaaaatggaacggagccaattctttgtgctgtgcccttgttccagcaacacaaagacttgctgccctgattttaactaggatgaagatttagcagccaatctccaaagggagcattttctcagccactaggggaaagaggagagttaaccctttttaagcaaacccttgcaaaataactcctcagagaaaaatagcaggaacctctaatattatcatgtcgtatcttaaagactagtcgttcacaaagtttgtcacagggagagcaagggagaaaggggtgttgcggggcagagaggggaaagagtgcttcaagttcccaaatgaaaagagtgttacatttatagagattatgtcaccgctcaactctggcaaatggtgtttatcaaggctggcagaggaataaattatgcttgtgtttactcttttgttcccatggccaagtgctgttttattaattgttgaacaccattttgaggcactaaggaacgtaaggagtcaagatgaaaggacatttaggtgaggatcaagactgttaacagaggcacaatctaccgtcttgctggtcattgcaaaacattagccagttgccagaattgagtcataacacttacatcaatgtttagttattttacaatttagaactcccctgtactgttgtaatatattataatgttccattgcctttgttttccccaagatctaatcacgttgttcatttctcttaggacaagaccagcgctctgagcctgagcaatgtggcaggcgttttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattatgctacatacagagaaggctacaacgtgtatggaacagagagtgttaagatctaggggtacggttaaggtctagtaaactaatcagctttactttactgtatgtcaatctctttttttcttctttttttttttttttagtttggtttattgttcaaagcattgtctctttgcaaccatttgattctttgaaaacaatggttgtgctttcttgtcaggcagtggtgcttttctaatagaatggttgtaattaaattgtggtctgtgacccaaaaggaaatacaattctccagaacatcattgttcaatagaaaatatatgcaagccacatacatgagccacgtgtgcaattttaaatgttctagtagtcatatgttaaaaagtaaaacaagtgaaattaattttaatgatacattttatttaacccaatatatccaaaatatgatcctttcaacatgttatcaatacaaaaaaaagaatgacaaattttacattcttcacgctaatcttgcaaatctggggtatattttatgcttatggtacatcttgactcatactagttacatatcaaatgttcagtagtcacacatggccagtggttattgtattggacaatgcatctctagagaaagcagctgctctggaacagatattaaaattaggggccgggcacggtggctcacgcctgtaatcccagcactttgggaggctgaggcgggtggatcacgcagtcaggagatcgagaccatcttggctaacacggtgaaaccctgtctctactaaaaatacaaaaaattaggcgggcatagtggcaggcgcctgtagtcccagctactcgggaggctgaggcaggagaatggcgtgaacctgggaggtggagcttgcagtgagccgagatagtgccactgcactccagcctgggtgacagtgtgagactccatctcaaaaaaaaaaattaggtacacaggtgaaacactgccacctcaagtaatacagcacttccatagggagaggtggttcttttaagtaaacagtgtataagtctgagataattcacttaagctttgagttcttttgttgtcccttccttggaactggtgcacaggtaagtgtctatcaaaggatagtctaggctcccagctgctagccaagccctaattcatacttcagtgaacctgagtgttgccaccttgactctggcaactacaaacaccaccaataattcagaatgttcaaatgcaagctcgaattagaataatgtctccattctggacgtgtttaaaagaatatagtcttgttactttaaagtgcatctgtcatcactaaaatgcctatctgaagtggaacagaacaataagcaacttcataccccttattttaggcaattttgacctcatgagtaaatgtcaatatgctgggatttctacaagtgcatttgtgttttgttgttgttgttgttgttgttttgttttggggtttttttggggggtgttctgttttgttttgtttttgaggcggaatttcactctatcgcccaggctggagtgcagtgacgcgatctcagctcattgcaacctccacatcccgggttcaagcgattctcccgcctcaccctcccaagtagctgggattacaggcacttgccaccatgcccagctaatttttttctatttttagtagagacagagtttcaccatgttggccaggctggtctccaactcttgacttcaagtgatccgcctgcgtcagcctcccaaagtgctgggattacaggcgtgagccaccatgcccggctgcatttgtgttttggccttcttatagttcacactgtggatttacatttagccaatttttaaataatatttcattcaaataaatcatttgtcttggtcatggaaaacataattttgtccagtgaagttgctggttgttccttcttcctgccttttgccacaacatattcagcacactgcaccaatccgctgacagtgttcccattgcattggtggatgtacaatacatggattcatctgtaattgcattgtttgcatgcaagcatttaatgtttcaatgtgcttaaaatgttttactcttgagtaggtgccataggcccattacaatttggggcatatgtttttataggataatattaatacatgattcataatccattttcaaagtgatccactttctttctgtagcctacacatagacaggcttgctggacatgagcaatttcaatctaacttaattatcccaaattttgaggtgctggcctccaaataaataatacacctgaaatttgtgtagcagtcatccaagtgttctcacatctattggctcatttgagataagatggatcaggcaattatcagtaagacccagcccatgaagtgacttactcaaggcaacacagttaggtagtggcagttctgggactagaacccagcccttcttctgcctatagccatatctttgctaaaccatgctacttctaaccacccatggcctgatgtcccccaggaaacttgaaatcctaatgggatcctgtcaaatggagagcagatcttgagtttctgttccacttgtccacaaaaaaagtcttgagaaacttcaccaagcctccatatgccccattccttatgcactccacacaagattgaatattcaatcactcctactttccccagaaagaatctttctgaaacaggattacatcaaggctcagggtcacatgacctccagactctttatcaacgattccatctgagaatttatgtccctactatccaattactatagcctcagactcttattaaagccccagagcagtattcatcaaacattagtgtgcatgcaactcatgtgggaaccttctaaaaatatagatcctgatccagcaggtctgggatggggcctgagggtctagatttctcacaaactcccaggtcatgcagatgctgctggtcccaggagtagaaagattctagagaaaataaactcagagaatgtaacttaagaaaagaaaggaaggaagaaaagagggatagagatacaggaagaaagaggaagaaaggaaggagggaaggaaggaaggatggaggcagggaggcagggaggggggaaaagaaagaaagagggaaggaaggagggaaggaaggaaggaaagaagaaagggagggagggagggagggaggaactgaaaggaaatgaaaggaaagaaactgggatcagcaaacctttgttaggacataatgttgccatccaaaagtggcggcctggaacatcaaacctgaggggaaagtctcagaaactaatatgccacaacttctggctttcctttactcatctgagttgatccacttttgtgaagcaaaattcaggctacttgaggcaacactcacattttaatagactcccatgccagtgtggttatagcccaattacctagcaccttggcaaccatctccagggtgaaagaaaggttgggaagagcatctgcaaacaaatctgtcctccaagcctgtacaaagtctccagacaagaagcaaaagcctcatacgacgccaggaaaacctcacttgtgttagtcaagaggcataaagcaagctgctttgaaacctctctgttgtcctcagccaatttggtgatgtgattaggggaatgttggttaagtgaagagtgagatcttcacccactcatcttttatttcccaagaaggtctggaatatctcctggtgacttctaatttgttacctagttattaggcttccagttctctgagttggcctaaatctgtcaaggtctatccaggggcaccgacatcaagaggtaccctgagattttacttctattactaattatcagagcccaccttgggagtttatagtaccagtaattgttcaggaaaaatgactcagggcaaatcacctgcaaaaatgtgatctagtgaaatctggttaataaaagggcatccttgaaagatgagggagtcgtttctcattttctatgggtgatagtcacatcaggattactgggcttattgtgggaacatgtgcctcggcctcagatcatgtttagctcccactagggagcagaaagcctcttgactacctggtgcctctctgggttactgaccagccactggaagtgtatcctcccaagcatgccttggcaggtgactgcccatcaagtgctccagattcactgcaccctagggttgactgtgctaattgttttaggaagttatttctcatttcctaattgcagttcagaagtacttctggcttctttggtttcttcaaaaatatttttgaaatctctgtcctttacaagacctcaacatgcctgaagttaggggaaaagattttcatttttcttgtaggagttttctgtttagtcatcctaaaaatattagctttgtggatgcagcccattttcaaagtgatccactttccttctgtagcctatgcataggcatgcttactggagacattttgctgctgaaaagaattcacgttatgttaagtatgaaaaaaaaaagcattctggataaccaaggtgatgatgttctttctcccaagggacttttacatcagtgataatagttcatttgaccccatttaaaagtggaaacagaggcactgagaggttgggttcctttcccaaagtcatgccactagttagtgatgtcccatgcccactggggagacagggggagactttattctttctgccagatacaaaacttctccaagcttctgcgatacatatgactcaggacttaggggtgccaaggaagaggtttgtctactttcatgttagtcttattctaccatccttggatgcttttggccttcaggtgcatatttgacattcttcttacagatacttttactacagggccagtggtagatcataattacgtcattcttttgggataaaattcggtgttagcttagaagaaaaggaagtgtttcattagtgcagaatgaaaggataaagagagggatgtaaacttgaagaggaggtaagaaagtgtcctacagtattcagaatcaggggcaaatgaatcccctgcactagttagtgcctccaaaaagaagacactatcagcatttcaatcaggcctatatgtcagggcaaagaccgcattgatgccaagtccccttcatgggtatcactgctctggcctcttcctagaatctgctgtctctttaaagtcccagagctattttcagactttaataactaaggttgtaggtactaagagaaacaattgctcacttttctagcaataagcaaaatattttcttctcacagttaaaatggatttcaattcagtaagccatagaacactgtttaccctctgtcctgggtgaacaatcctttgtcatagtttctgcaatcagaatacactcttttagttcttgtgaatatctgtattaaaatgccatggaaactttctggtatacctacatcataagtgattaaagccttgaattaaacttcctgcaacacctgcatattccttagtacaatacatatagtagagaatgtaaccagacctgtcacctaaagccagtcaaataaatgaggtgcaaccccagaaatgccaatttcagaaaacagccatagttttgtccaagatagactgagccattataaacttctcaattcctaataggaagccccttcaaatttaaatatccccttgcctttgcagatcccttcccactggaggcatgtgatgagaggaaatcaccgaaaacgtggctgcttcaaggatcctgagccagatttcactctccttggtgtcgggcatgacacgaatattgctgatggtgcaatgacctttcaataggaaaaactgatttttttttccttcagtgccttatggaacactctgagactcgcgacaatgcaaaccatcattgaaatctttttgctttgcttgaaaaaaaataattaaaataaaaaccaacaaaaatggacatgcaagattccagtatgcgaaaaaaaatcttattaagtcaattcaacaaaagccattctttgataccactgcagagtatataaacaccatgttctttaatacacacacacacacacacacacacacacacacacatttaaattccaattcagcaaagaggcccatctaagctaaaaaaattaattcttcctgattaaaaagaaaaaatctgtctcccagtgtttgggaagacggactggcatttcttctaggatctgctgaccagatgtttttggtatttcctgttggtggtgatgttctgtgcactctatttcctttcaatgttgctgaaatgtgtatatctttagaatgtaaatgcaacacttaagaaaattcaaacactttggaaaagggactaaacagtgatttctctgtgttcttgaaatggttttgtgaaaatgctttgataacttcccactcaaagaagagatttacagagctttcgaaattgactttgtgtgtagcaagggacggggcactatcaggatacctcttggtgctttcctaaaatggatcccggggctttccaaggagcctggaatttcagctcacagatctgtttttcttgcttcagtgtgcattttaagtcaatagagctgagtatctagcattgaggtgagggaaatgctgcctatactcccagatgtgtttagaatatctcagaaacaacactgtgtttagctcggctttctctgctaagtatgcctttcaagtgtacaccacggagacaggaccgcgttgcaaggcgggacagcaggttcagaccacagttctcagtctgactttactcttgctaggtctgtcctactagctgttgcctgctaccgcccatggctctccatcggactgcatgtgtccttttctagtttgcaaagactaaaatgcattcccaaacctactgctaatctgagggcctcagcatcacttccagatccttgcttggagcagtctctctattgactctctcagatcgctccactgctccatgggctatcaagtaactaactgcatacctgccgttggcatcatcagaacagtccgaagaaatagtctccactcactaattacctcctatataacgacgtatgcttcctgtagttcagtagtttgctctcatcgataacgtgcattgggaagtttccagactgcaaaaactaggagctcgcattcatttcccaagtgtgacccttagatgcttagttgactcgctgcatatttgctcttgtcttcagaaaagaaaggaagaagtatcgttccaacgaaatgtttccagaaaagtgtactataaactttcattccaaaaatggtgtcataagcaaacaactcacttgtcaaatttcaaatggtattgaacaaaaaaagaaagctgttgtgtttttgttttgttttgttttcatgaaactgtgattttcaacttatgaatgctataatgtcccagcgcgggaagctcacgctgtgtgaacatgaagttgtataaaacaaaccaaccaacctacacacaaatgttttcataggcactgtataaagaaaaatgtatgtttattaactcaaatcagtttttcagagaggaaacgtcactgagatgaagaggcgggtaaattggtttgttattttttaaaaaaaacttgcatgtttaaaaaaaagttgattgcttcaaatttctgctactaacttcaagctatgggagtttggcagtagtcacttgaggattttttttccaattcttttctttttgttgttaaagctgtacttcagtgaacagaaaaattgccaagcaaactaatggctataaaagcgtaatttgcatgtgtgggcataaactacagagcctcattgccatgaggtattgtacaaagttttaatacattttgtaaataaaattgtaaagaaagaa

SEQ ID NO: 436 - DNA, 306671 bp, Homo sapiens; identical to SEQ ID NO: 435

SEQ ID NO: 437 - DNA, 20438 bp, Homo sapiens
agagatcctgggagcgagagggagagagagggagcaagaaaggaagagagagcgagcgagagagagcgagcgaataagagagagagtaagagggagagagaagaagaggaagaagaggaggcggcggcagcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtacatggccaggcagaagaaaatggggcaaagcgtgctccgggcggtcttctttttagtcctggggcttttgggtcattctcacggaggattccccaacaccatcagcataggtaagcgcaagcgagccagccgtcggtccaggctctccctcacccgagaccactgccccggcaaggctttccctgcggtgggtccctgtcctgcgtggcctgggaactgggactggggccgggaccgggcagagatggtgcggggcggggggcggggcggggggaatctgagcctcaacgaggtggctggtctgaagagcctctgggacaagagaggggtctcctggggctagtgggggtgaactgctaggttttccgagccgagaggagcaccggaggcgagcaggaggctgggatgctgcaagggggtgaagagtcgaggcttttcggctcgctgctctggactttgccatggcgtgcgtgcagctcctggaagttgtcccagggtgatgccgactgtctggccgcgccagggcgcataacccgggcccggggtgctcagtccgtggtctccggctgtcgggagacaggctggtgctgggggaggtggagcccactttggatctcccagacccgggcagcagcaggcgttggtggtggatggggtaggaggcgggggtgagactaggagctgagcgggcaagcggcgaagtcacgcagaccacgaattcatgaattgccgctgtgtctgtctggagcccggctcctgggcgcctggagggagttatcttggcttctgtcgtatttacaagtctagaagttagaatttttgccattactgaaccaaccccctgtattgtcacgggggagggtggctatggggaacgggttggggtagcagggggaacaatattgtttttcttcccaacctttcccttcacacaatgaaaagatgaccagctgtgcggatgggcggggggcggagggggggggcgactaaaaaaaaagaaggctgccgactaagaaagaaccaagtctcactcttggttccatcgtcctaacccaaaacggctccctcgtctcttctcccttctctctagcctcttcttttcagtctagaaaagccaggtttctcttggccaaaatctgagttcacaagtcttgaaagacacacaggttgaatatcaatcctcaatcccacaccccagtatcattgagaggtatccggtatctatattgttccccaattcctaactggccctagtgtgggggaacacaagccaaatctccgttccctttgcttataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgcttgtaagtagatctgcttttcctccctttgggacgttggggacctcatttgcatctttcttgtggcacttagggtctgtgtatgtgctgggagatgattgcttcagtagatattttaggggctctaatccatccggtttcatgttgcataaatcaactccaaatgatactgctgaggggcttaagacagtgggaaaaactcaagacagtgggcaaaagtctgctccaaatagtgtttgatgcaaaagtttcattttcctccatgctaacctagtgtgttccttctccaacactctctctcttttttttttaactggggaaaaaaaaagaaagaaagaaaaaaatagcacggttgttcagagaaatttcttcagatgagatttaaaaaagcagcagcagcttcttgattgagtcaattcaggatgtacatcacttgactgttaaagctagtgcctggctctaggaacgagctgaatttgacaattgcctaatgtgtaggaagcaaatatgagaaattctgcaaacaagtgaccttgaggggcagaacaggctgggttccctggcctctttctgtcctcaaatattaccttacttactgagagagctctgataggaactcataagactacaaactgattgcaagtgatgaatgcctagcaaactgaggggaggggagaaaatggtgatcaggtgatgatttagaaagctagttctgcctcccctagtgttgttcacccccatgatcattaaagacaacacagttcttaatttagagcaaagagggggcaggaggagaggaggcttggagcaggaaaactgaatatggaaagagaagaaattcatcaggcccaaagccggttctgaaatccttagttgtaccgggtgattattcctctgaaaaggggacattttgtaaaatacaaccaaaggaacctaaatggctaatagcctgttggacatatggttttacttgaatggaatgtttcgtgagaaagactgagaatacttcatgtaagcttatttcactaaaagttttcacaacaatgaggctgaatatggtataaaatatgctttgcttttatggctgatgtagtttggaatttggggtttttcttcctttctcttccaagggagaaatgatatttatgtttggatgggtgaaactttgtatatgactttctttaaatccttctgcctcaaaggatgcatggtttccagaaaccactgaaagggtctctccaagggcacaggtttcttggctttgaagacttgggccaagaggatgggggtaacatactctgcaagaaatatgacagttgtcagctttaagaaaattttagctgaagatacagatccttatatgaacgtgttctgagatactccatatttgactttctttggctttctgacattgacaaaaataggaatttattaattccagctagtgtgaaagttacgaaatgtctgtctatactttgcatcttattttggtaatcccagcctgtctccacagcatttacaacacgcatctgactcttaatcctgcagcactgtgatcttgtcaagaggctgaatctcaaatgcagcttcctaaatatcaattagaacagatttaaaactaaatacattaaactaccagggtttattaccattagtaacaaataatatttatttcaactcccttcagtgtcttttcactgatgagaactgggataagagaaccatttggtttctcagaaatgattgatttccaaggtttttggtcctgttcttatggtcaaaccagattgacacccaccagccctggactgtcagaaccccactcaagaagcaatcagaaatgattcttgccatgtgaaaatctcaggtttaggaaaaggcaataagtcatccatattggtattgagttgccttattgccttacctctcagggcaataagagaacaaccaggggaaaggaaaagaaattgatcaaaatccctcaccgtaaattcatagcatttccacttacaaggctgggttgtggctaggggcttgagagttcgggagaaggagtgtggctcactgggcaacaagaaaaagaaaatgaaaacgtgaccttgcccttagttatgtcaaatacacatgtatgcatgcacagacatacgcaggaaaaatagctagaaaccagtgttgtgtatccagctgcctgttgctttctctgaagacagaggaggaaagctgtcatcttctctggtccctgaaacagtcatctctgaatgtcacaatcattgaatgggggccagatctcaaagctgtctctaggcagctgctgcttggtagcttagtatgagaaagatgactcgtctaaccatagtcttggaatgcagaaaccaagtatttcaagggaccaaagaagccctggaggtgtttctcatttctacccctggctttaattgttctttttcttgtggaagcggagatcaaatatttccaactgggttgaaattctagttcagtgctggagcctgacaggtgacccccaggttccactcctccaaatgattgccctgattgtgcaaagagaaacctctgtatcctccggcctgtccttctctggagacctagggagaattccagaaaacaacagatgagtctcaatctggccaaccacctctcctatctggttcaatatggaatgggctggcaaaaattaaagaaactttcccttattcctatgcaaaattcctagtttcaacttcccttagcactagaattgatctcttctcatgatctttcctgcaccctcaatcctgaggcaggcacacactttctagggtgtaggtgtgcaggtaaacgaatacacaaagaataaacaaagggtaattctttcatatatgtgtccctgttctctgttctccctccacatcacccacccctacaacctctgacaatgtgtttgaaaggtttccttgcgatgaatcccaggcatcagttatttaaagactcttcttcatcagaaaccaatttttttgcacaacccccaagaggtttgcttaagacagactccaactttattccatgtcctacgaggccaataagagccacactggctttgaaaggtgtttaatttgggatctcaactcagagatggattgaagtttatctaagagacttacctgatttgaagcacatgttcccatttcatgaggattaatagagtttgctgccttacttttcaacttagctagataaccccagaaccaagagtggtgtgaattctttggcttcaggatatatacattcatagacacacaatcaatatatatgaagagagatgtatacacatgtaagttacatgtgtgttttttaaaaaacagattcaatagtcctaaggctttcagggcaggggtgtggaaacaccaagggactgatgtgtcccatcgtgtggctttgctgtcctggttcctcaggaaacatcgccgattcccttgaagtcccctcctgtgtctttctgctgtgcacttgtagtgcactccacactacaccgccccagcctctgcagtgtcagctcattagcacacagatctcatattccctctccgcactgtcattgcaaaaattgctgttgtacacctttacagccaacaaatgtgcttgtggattacgcactgtttgcaagaagcagggaaaaggcaaatgtaaccttaaaggttattcaccacggaattgtactctaaacgcattggcttaaataaaaatctgttgatggaggcacaatggtgatggtgggattgagaataggacttaggagtgcaggctttaatggagccccaggtaaaatcccttttgctggctaaacgtaacccatcagatgcaaaattttattccattaatttttttcaagccatttgaaatataactgctgagaacacactccctttacaactaagcgcatttcactaccaaatatacttagctgagacaggtttctgtctcttgcctacagagtcacaatctaattatctaattattataattgccaaaatcaatttaactatttatgtccatttgggaaggaaatgtctcctttgatcccattctttgcaatttggtgggttttgttttgtcttggtttggctttggtgtctgtcctttccatgtaagatttggaaaccaggtgaagactcctgggatcaagatcaagcctccttcccttaacagattttgccatactacccaacattgactgctctggttccactccctccctcactccccctcttccctgcctttgtgcctttgctgctctccctctctcctctgtctgctggccagccttcagtaagcacgccggcttagctcacttctcggcccctctggcttagtcccctgaagcatgaagaggttgccttagtggtgccagtcaaaaaattaagtcacgttttcacaaggtttattacggtttttaaaatttatttttcatagggcgggggagggaagaagctgatgctgttcatttgggccataaaaatagatggcaatcagcaggctgtaaaggtgagcttcctgcaaagtgtattacctcccctagaaggcagcttcctattgatctactaaatcaggggggacagcagcaagaagggtttgaaggaaaggaataaagggaattattttgttctccatctacatttactgcaaaatgggccatggtttttctccctctctgcaattttaactttttttccctaaaatgaaactagttttccacattttcctacttctgcccctacagaggtaatttccttaattctgcatttccctccctagtccctaagactgagtgataatagtggaggatcgatgagctttttgttatgtttttggctcctgatgtatttttaaatttcattgttatgggtagtcagaggtgattggctggtttcattttaacagattgaaaaataaatgaagctcctgaggcatcgttatttgtcttcctttttacagttaaagagatttgtcatttttatacagttggtttaaggattaaatgatggcatagattttaagacagggccagaattttagacgatagaattccataactttgggggagactaataaacatgcttatccagatgatttccctgtcaacttcttagattgagactgcaaaataaatttgaaggacctttcataaaaccatctatcttcaatgaaggtcaagcaaataatctgtatactttacctgctccattaaaaaatcaagttttgactttattcctttggctttgttactttgggtcttattagataaaatatccacaggagggtgcaattaaaaccccaggtgggggtgataggtattcttcagcagcactgtgggagttgtgcagacacaaaaggaattccctccatcttgggagctgctcagaaactgtctgggctccagatacagagctatagatagcctcagcccgtgtgtgggatgagccttgagctaaggcagcagcccccaaaaagggtcagtccttgacaaaggttaacatggatagaaattgtcttcctcatatttctacctcttctattgccattattttcttctcttgctctatccgtccagctcgtctaactcccttttgctggtctctgcctactcactgaccagcccctgattctagcatcccatccacactaaacttacctagggactattttctaccccggacttttccagacctaattcccagaacttctccttctccaccagaatacctttactcttggtccatgctccaaggatgtagagtgcagtacggcctgcactctactttgggggtgacagctttatatctaatataggtatatatttcatatatatgaaaatgtcagataaatggtaaagggttaatatatgtaacggggagtatctgcttcaaaactagggactatgggaaacatactgcctcaatttcaaggaaagatacttaaataggagtgtttctggatattactctcagagtggctgttcactctacccaaactaaaggtcagctggctttggtcatagaagacttttacaggccaaagtacaagtctaactgcccatagtaggttgggtgtaagtacacccgaggcataggcaggttcaacttcatgttgaatctaaaagcctttgcgggtaatttgggaagctgcaggttcaacttcttcatattgaatctaaatgcctttgggggtgatttgagaagctgctaaagttcataggtatttattttattaaagaggctggtgtggagactgaacctgcctatgtgggcactgtcaggagatgtactggcacaaaaggaaggttataggagaggataagggtgggagagaagctatctctccagctgtaagtttcctttccctgggatggtatgtggaatgccacgtttaagaggtaacatccctctcaccgtcactaaatagtatctctggaggtatttggaagtgtagttaagcagtatctcctcctccctccatccttcccttaccttgtctcaaacatacactctggcctccctcccagtggaaataaccagcatattctcttctggatttccaattgctcattggtcacagaagtgtttacatcccatgctctatctggacctccctgttcctcaattcccaaccgtcactggcttcttaagcaattatcctcaacacaaccatcatttgtccttatttggagggtgcaggggagcaaggataagaataaggagaggaaacacagctgataatgatccctcaaccctatgaggcgcaattcagggtagaacagcacttgttaatttttcatgtgcacaccaatcacctaggaatcttgttaaaacaaagattctgattcactaggtctgtgatggtgcccaagaatttgcatttttagcaagctgccaggtgatgccaatgcttctggtcctggaaccacactttgagtaagaagagcccagagcaaggagactgtgatcattaaaggaaaaggctctcgcagaccagctcttatccatctttgtatcttcttgccctccaaagaaggttctgtaagagacacatttggctcgttcttactcaagtatgtatctgtcacattcccaacaagtccgtgtccatttcagccaggtctgtaggtggcattactagatatctgatgatagcatttagagttgttttattgtagggatgtggagtggggactgaaaggcaggttcagcgaggaagtagctcatgagcccgggtgacactgtcttggcttcttgccataccccaaagtgccccttttagaaacaacctgcccaagagagcgaaggttggcatgcagttccaactgcctttccactttgcttctctgggtcaaggcatgccagaaggaggaatgtaacatctgctcctcagctgtctgacttcccttaaacagggttagaaacaagaagtacaacacaacctgaattctatctggttccctaagagactgaaaaattgactccattttcaaggcctgtgccaggcactcactgatgggagggatgggagggaagggaagtaatgtcactttctagcagacctgagccgagaactgctccagggaagccattaaaagcttacccagtgtcatttgaggatcgcaaaatagcaaaattccccagaaaaattgccccccaacagtgtgccattagtctgaaattccacaaatttgtttatttgtattactgcactgaaagcctgtgccaaaatgcaagcgtgctatctggaagggaataaattaaatccttatcagtcattaatatttcaaccagaattctctgttcagattaccacctgttaccttgcaggatcctcagagggggctttccaagacaggtaaatgacccagaacaagatacctgcccaaggaagtgaggcaccaaatggattgcgggcattcagaggggcgctggtagactcttgaggataaggaagattccctcaaatacacttcacctatttttcaacatttgaccttctccatggataaattctggtactttattcactaagattttagttatctttaactattttagctgcctttgaccgaagtcatacccttctgatggtagtgggcctgctgcctgttctgtgtgtggtgtttgctgcaataggtgatttcagcttcaggattttccacagttactgtggaaaattttcagaggtaaaatcagtttgtgatgaggtatggtgagaatttaagcttttaaaaattgttgtgatcaaaaataattccctctcaattatccatgattggctaatctaccttgccaattactcattgcaaccagggccttcatctttgtagctccccagaaaggggtcaagccacaggcaataaatgagatgggaagggatcaggatgcagctcacagaggggtaagtgtatgggtgtgggtacaggtctttgtgtaggtgaacacctttgcacaattaagattagtaaagccattaatgtccaaagtcagtcagaacctgttaaacattctcaaatatcctagtacctcactgcagtttccaaagctccttgttcattaaacagtgtttcttgaattgggccacttgctttagaatcaccagagatgcttgttaaatattaattcctgggtcataccctagatgtattgaatcagaaactatcaagataagcattttaccaaggtctatgggcgatactaacgcatactcagtttaggaatcacaggtttaaaaagccccagtactacagagatatacagattcagattgaatatttattgaatacccactgagcaccaggtattatgccaggcactttcacatatgttacttctctatgtaactgaggtgctattggcctatgcaagcattagagagtttggctttcaggctggaaatctaagacttggaagaactaagagactagcctcaagtcacagtctctgagggaaataaaacagaatgctctttgagatggtaagtagagacaaaggaattattttcattttgacaatgcttcttcctttctttgcttattagctaatgattcgtcctcagacatgctctgaactagacgtcatggcaaatgccaactcacttattaaaaataaatgtattgcaatcagttcatatagcaatcactgtgccttcctccccatccttgctatcaacaaatttaaaaccagagctaaaataataacagctaccatttattaaagccgtaccacatggaaggcactgtgctaagcattttacatgccttatctcatggaatcatcacaatattgccacaagcgaggaactctcatccccattttctaaaagaggaatgataggtggttcaaaatgcataagcaactagctcaaggtcccacaactagctaagtagtggagccaggattcgacctgagatcttcctgtctctagaggctgaatcaatttcaacttgggttgaaatttcaaatgcatataggggctacgcagaccacataaaagtggtaggtaattggaccaggtgtgttataatagggagtggtggggcctatgacaatccagagagtccatgcttctgcctgaagacattcaaattcaattttcttaaaccactatgggacaaacaaaatgcctgcaacaggacctagaaggactgggagtggaaagtacacatttctgacctctgcactatactatatacctccttttagcagctaggttactggttgagggaagctctattaactggtagttataactactgagaacagcagagagaaaagctcttctcagtaaaaactctattttgactttcttcttatagtgtgccatcaaagtatctcaatatggtagaattttttctcctttgtggaaatacttgtggtgccatgtacatacactctatatctagtagcttttcatgactgagtgccagcttgactctaactaaccttcccccaggcaatgcggaggccctcagcaaggtcagaatgctggcacaaggtcattaataagcgcccagcagatcagaagaggtacatcaccattggtggggggaggctgtgctctgggacaacttcttaggttctagaacatgcaaaccccaggcccacaactgggaggccactgggtcaagtaaggctatgtcaacagccacccagggtaggaacttcccatatactctgagaaagaggctcaccaactttagaccagggtctaaaatagagatgtaatagttgtctggagttgtaaactaacctaacccaatctggtcattgacaatcattacgtactttttgttggatattaatagcctgccatagttaaagtgaggctatagatcttctccccattaacatcactaccagctataacagcaagactcagacaatattctacttcccattaaaataatagcaaatagacataaaataatttgatatccaattctgtagacccagacaaattcagctccctttgcttctaggtgctacaacaacaccttgcatgaaggtttacttgaggcacacaagacaacattctagtagcaggattcagctaaccaaaaatccccatcagtggctgtccacaggacaatttacaaattgaacctacagtaccattttttctaagggataatattatagagcttactagatgcttatgttttctttatgctaatttgggaactcctctaccatatttctagccaatccacatatgttgtacactattaatttcaccaatgagaagtttaatgttaattaacaaagcctctggtgctcattggagataaactcctgaggtgattgttacaatcacttcttgattagaattctttaaatgctaaattactattcctggtctatgtatttccaaatgagggtaactgaccacctctacagtatagattaagactaactgacccatatatacaccacacaatttatgttgaagtcttatgaaataaactataagtaacagaacatttgagatatcatgtttcttatggccttggaaaacagtaaaagttgtaagagcaataggagggtggtggaatgaacaatgggacagaaattaggagatctgggttccagtctcagctctgatatccactgcctggatgaccttggataaatcacacctatctctggctctagtttttatcatgtgtaaactagggaggttcttctggatgatgtttgtgacttctatctttgacattctatccactgggcatggcagctcaggcctgtaatcccagcactttgggagaccaaggccggagatcacctgaggtcaggagttcgagatcagcctggccaacatggtgaaaccccgtgtctactaaaaatacaaaaattagccaggtgtggtggtgtgtgcctgtagtcccagctactcaggagtctgaggcaggagaatcgcttgaacccaggagacggaggttgcagtgagctgagatcgtgtcactgcactccagactgggacagagtgagactccatctcaaaaaaacacaaacaaaaacagcaacaacaacaaagacattctgtcattaactcttgtccaattcttaccatctcatttcatttcttactgagaaaaggccatccaaaatgaagctcctcaaattctatatctagaaattcctcttcatattcatctactctctgcctttatgagagcctgtgataaaaatattgaatccttgaaatcaatggttagtgtttcagccagttgtggcttatccttgcacatcccaactcttccacttactagctgtgagaccttgggcaagttacttaacttcattgtgccgcagattccccagttataaagtggtgatagtaatagttcttacctcataggattgttgagagttttaaataaaataattcacaaatgcatgtaaacacttagagcagtgccagggccatcagtgagctttcttcgtgggccctggagtcaagagcccgagagaggccctccatactgttcattctcctctggagcaggcactgccctggcacacaaatggcacatacctatttctttgttcttttctacttcctagtgaccacttagcagttgataatccttttagtcacttgccattcatatgatgaaagctcaacagagatgcacctctggaacatctctgagtctaggcaattcttccactaatatattacagtctcttacagcattcagtatactttgtgcaagagctactaaatgcattctaatcttggctctcttactagccatatgaccgtgagcaaattacagaacctctgtgagcctcagttccatcatctgttcaatgagaataaatataatagtaactatcttataaagttgttgtgaagattgggatcatccacgtaaaatattgaccataatgtctaacatatgtgttcaatatattaacacagagtagcgaagtggttggtaaggaatagaattagtcagaaccaaactgtggaagatattcttaactatccccaaagcccttcaaactaacctgtatgccctgtgaatttgtagctgaaaagaagctggatgagatcacctttgaatacccacaatgctgccttgggcataagaggtttgcttggggacaaaaaaaaagtggggaaagaaagaatttgcttgatacctcaaaaaagccagggcacacataccactaagcctaatcatgccaccattaagtggaattgtccagaaggacatgatcccttctgatattttttttctctaaactggacatgatttgggtaaagcagcatggatagtaatatgataaccttagcacttgctggctcaaaggaaagaataatctttcttcaaatgtgacctctattttaatgtgtttaaagtgggagcatggaagagtggatcccagatcctggatcctgatcctgcactcagactaggaaaaatgtagttccaactgggctctcccagccatgagttttctgagttttttaattaaggctgatgcgtgagtggaagttaagaacgtattcgtttgagtggatggatttttttcttttgatgttgcttgcctaagtcagattgaaaatagcaaaggaaggagatatggaaaagattaaaagagaaattttgctaatgtgattttccagcattttagtctctctctattctctccagaacaaaggttaactagctgattccataagcatagattcatgagaaaggatcctgctaaggaccaccagactttttagtcttttaaatttttttttttttttttttttgctcccctctcttcttctgtattctgtatctaacagcatggtgtatccagcaggccgaaacctgggttatgaccaaaggcaatttttagccacttcctatcccagtgtacccataatccatgagtatcatctcctcttctcatttcctattcaagcctattcctatattttcatgtggaatcactgatctttttttcagatgaagaaactgaagaggaggaacagagatgctcagtgactagcccaaggtcacacagctaattgataactgagctgaggttgtaatgcaggttttccaacttttggcacttctctaagatgtcttcccaacataatccttattctcttggctttcactgctgcacaatgacatacataaaaatgacaacactgtcagttttaagtaggtggcagagaggaagaataaatccacagcaagttaattagaaatacagtaaaacatgagtttcaggcgccacaattaatcgtatctaccatttagtgcctccaatgttaacctgtcatagtttaccaccctctgatctatagtcaaaaatgagcaaaacaaagtcttgaagtcctattacagatcatagaccgttggagctggatcaagtagttttaatctaattacctcattttgtggatgaggaaaataagaacaagaaaggaaaagagatttgccaaaggtgatgcagctccctagtagcagaagtaagttgagcatctagactaacagattatcagagcggggtcttttccaccatgttttgcagccttatcagcagaaaactgtactaaagtaacaccacagatttattactttactaccttctgttatctctttttctctaattgtctaataagagaatcgtctaattctcttattctctagtaagtcatattacccctacctgatttttttaatgtggaaaacacttgtattattatagaatttaaaatgtaaaattaatttctgctcattgtcaacaaacaaaaaacttcaaaaatatagagaagaaaaattacccaggtaaattaaaaatcacccaaaattaagttttaacatgtgttcagatttgtatcctgcctttttactttatattatattggaagcatttgtccagactctttaaatgttctttaaaattttgatttttaatatttgtgttactgtatcacagttattttatgacacatatgtacatataaaaccattaccttatgtacatatatttatatattttatatatatacatataagtcattatatatgagcccatatatatacatatacacacacacacatacatacacacacacacacacacacacacacacacacacgcaaccattatacaactttatgcattgaggtggattcccaattcactaaggcttactattatacctcaacttcctctaatgcctacattctatcacagatctgaacacacagtaaatatgtaataaatacttgctgacttttagtttttctggtcttttttgggatgatcattattcctccaccgggtagggcaaccaaattgagaacatgactttccatcctctttaaagcacatgttatataactcaacaggcagtatagcaatggtggttatgatcagaagccagactctctgagttcaaatcctggatctatctctttcttgttgtatagccttgggtgaggagcttaacccctctaaatctcagtttttctttctgacaaatgggggaaatattagtatccactgtggtaaaaattgaaagataaaatatgtggaaagtgaatactcaacaaagattagttgccattattattacatttgccaaagggaaatagagtacagatttggagtcaaaaaacttgagttcttgttccatctctgctattatctagccctatgtccttgcatgagttattttagtagtccatgtctcagtttcttcatctacaaaatggagatagcaatacttgagctgtatagcttatagggatgttatgaagattaaatgagagaataaatgtgaaagtcctttgaaaactatgaagttaagtataattgctaagtatataaaggtagatgtaacatgattgtcgtatggtaggactggagatgcagagggtgcaggagactaggctgaatacagtgagcctgggaagatatttttaaaataaaattccttgtattggaaatatagactgttatagacagaagggaccttagagatcatctagtccgtcatcttaatgttatatttaagaaaaaagattcaaagaggagagagctcaaagtcacaaagccagtcacagaaatgaaactagaattcatgtctcttgatttcccaaacacattcctaaagcaatcactgcagatccttgtttgttgaccttcatcaaaaaaaaaaaagtagtaaagaaaaaaatacagttatttgtggcatccatgttggtagtaactgattatttggggttttatcacaaggataagccacatataacatagctttattatatttttaccaactttattccaggtgagaaaagtaaaggcgcaggaaagtgatgggtcgggggaggattcagtcagggcgaatgacctcagacttggccagattcccaagggattgctgtcatccccggcaatgaccactgtagcacatggtctttctttgattgttaatatttactttgcagtcagtccttagttatgtgtttttggaaaactcggtatagtagatgaaattatcagttgcttaaaaatacaattgccaattgtttgattcatgtaaattgattacagtcagaggactattcattttatgctggcatgcatacagcccacgtcaggcaagggctgcatcactgatggcagctcagatatcgtcgcatttcctgaattatatcccgtcaggtactcagtaaatatatgtgttggatactttcatctttacatttttttagctgagatgagagcacataaacatttccatctgacaaccttttcaacttcaacagcacagaaggttattttcaaaagaaacaagaaaggagtttttcaatagcgagctccaaaggtgactaaaaatgccttccaacaaggcagaccattaagaaatgtagtgtgaagtgtgttaatacaataaactcaaatgtggtctcactagtcttagctcctcagaatgttggctgccttccccagctgccactgtggcctggacagtgtacatcaaggttcaccctctttcctcaatcttgaagtgccccctttccacccttccgctgaaggagacctatggccagaagcagcttcccctcaccttgtcacccccacaggtcctgctgaaagggactacctgccttggccaggaagcatcagggaaaacaattggacagctctgccgtgctgcaaagatcatgggctgctgcacctaaaatgttcaccaggtgggcccgccaaaactgggcctattgtatctggggtaagtgcccatagtttgaaatcagcaaggtggaaggaaaggggaaagaatcttgttcaccaattcctgttatgccgcaaagaagatctccccactctggaagcttgaaaggaacaaattccaggcaagtcaaagtcaagcctactttacacagtgggaagtaaacatatggaaccccttagcccagagttggtgccagctgaaaatataaatactgtcagataaggttcaatacatttatgactgttaaggcaatgataggttattaaaggaaacgaggctgtttggggacatgttaaatctctgagctcaaaattagtgaggacaagcggatcctctgacagcctcagtgaatgagtcctgaagatatacatggtctcagaactgtgattgtgttctccaattaagctaggaaaaaataaagatgtggtatttagggctgcttggctcaaactgagatgctaaaatctctggtttgctcagagttaaattcttcaatacatgtaagggaagcaatgcgttatggaagaaaaaaaccctagtatcctccctttgcactgctgctactaactagctatgagactgccccctctttaggcctcaccttttcccatttgtaaaataagggaattagagtaggtgatttccaaggtcctttctagcttcaactaggtttaattcaaatgatatcacgaggttcccttgaagggtttggagcgggggagatcctgcatctttccttgccctcccttgctcaggagctcagagtcttcaagatgtttgaaagatgcccctgattctaccaagacttgactccttcaagtctggcctccacagcagacgtccatgctctgaaatttatatctcatggcctattcccccactcatcaagctcccaattgcctggtaaagaggtagaactggttagatacaggggtttgttttgttcagtgcgatagcaaggttggagaaagtttgggctccaatattagagacagcattgtatgggctttaaagctagagctagcccgggttagaattctggttctgccatttctgtgctcatctatagaacttatctcatctatagaattacagtgataatactgtcatccctctagggtgattgtcaggattaaatgacagaattcatatcaaatccttagcataatgcctgccataaagtaaatgctgccactagtgggcgtcttttcctgttctccactaaatagatgttgagttaaaaattaaaaccaataaatcaataaatattgagctaataatcaaggctcaacttttaagttgtggcaaattatttggagtctcagggcccccatgttttgataactataatggcgtatttgcaatttatcaggggcattctggaaactgcacaagccaatgagagaactaattctggtgggtggcatttaattttgcagtaaccccgcagatcacactacttagatgagtgctactttgaccacctcatggaaccagtgcagcctgtgggcatcctgcagggaggctgacagaaagggaagttccaaaaggtgaccccatgatgtggctcatccattcatagtgctgaacaatattttacctttcctgttcaaggcgttacaggtgaactgtaagatgagaacaagatcacaagtcagcactacctcctcccttcttgagttctcaactgagtgagcatcatggagggagaagaaagaaagaagttcagcctgggtgtgtgaagctgtaaagttgcaggttgaacccaaacccattttagagacagaagaaactaccctctggagataaaataaaaagatgaagctgagatgggacaggatcaaagttgatgaaatatcaagagaggttaataaaggaacattaatttattcctcaa

SEQ ID NO: 438 - DNA, 3059 bp, Homo sapiens
tgggaaagagggaaaggcttccccggccagctgcgcggcgactccggggactccagggcgcccctctgcggccgacgcccggggtgcagcggccgccggggctggggccggcgggagtccgcgggaccctccagaagagcggccggcgccgtgactcagcactggggcggagcggggcgggaccacccttataaggctcggaggccgcgaggccttcgctggagtttcgccgccgcagtcttcgccaccagtgagtacgcgcggcccgcgtccccggggatggggctcagagctcccagcatggggccaacccgcagcatcaggcccgggctcccggcagggctcctcgcccacctcgagacccgggacgggggcctaggggacccaggacgtccccagtgccgttagcggctttcagggggcccggagcgcctcggggagggatgggaccccgggggcggggagggggggcagactgcgctcaccgcgccttggcatcctcccccgggctccagcaaacttttctttgttcgctgcagtgccgccctacaccgtggtctatttcccagttcgaggtaggagcatgtgtctggcagggaagggaggcaggggctggggctgcagcccacagcccctcgcccacccggagagatccgaacccccttatccctccgtcgtgtggcttttaccccgggcctccttcctgttccccgcctctcccgccatgcctgctccccgccccagtgttgtgtgaaatcttcggaggaacctgtttccctgttccctccctgcactcctgacccctccccgggttgctgcgaggcggagtcggcccggtccccacatctcgtacttctccctccccgcaggccgctgcgcggccctgcgcatgctgctggcagatcagggccagagctggaaggaggaggtggtgaccgtggagacgtggcaggagggctcactcaaagcctcctgcgtaagtgaccatgcccgggcaaggggagggggtgctgggccttagggggctgtgactaggatcgggggacgcccaagctcagtgcccctccctgagccatgcctcccccaacagctatacgggcagctccccaagttccaggacggagacctcaccctgtaccagtccaataccatcctgcgtcacctgggccgcacccttggtgagtcttgaacctccaagtccagggcaggcatgggcaagcctctgcccccggagcccttttgtttaaatcagctgccccgcagccctctggagtggaggaaactgagacccactgaggttacgtagtttgcccaaggtcaagcctgggtgcctgcaatccttgccctgtgccaggctgcctcccaggtgtcaggtgagctctgagcacctgctgtgtggcagtctctcatccttccacgcacatcctcttcccctcctcccaggctggggctcacagacagccccctggttggcccatccccagtgactgtgtgttgatcaggcgcccagtcacgcggcctgctcccctccacccaaccccagggctctatgggaaggaccagcaggaggcagccctggtggacatggtgaatgacggcgtggaggacctccgctgcaaatacatctccctcatctacaccaactatgtgagcatctgcaccagggttgggcactgggggctgaacaaagaaaggggcttcttgtgccctcaccccccttacccctcaggtggcttgggctgaccccttcttgggtcagggtgcaggggctgggtcagctctgggccaggggcccaggggcctgggacaagacacaacctgcacccttattgcctgggacatcaaccagccaagtaacgggtcatgggggcgagtgcaaggacagagacctccagcaactggtggtttctgatctcctggggtggcgagggcttcctggagtagccagaggtggaggaggatttgtcgccagtttctggatggaggtgctggcacttttagctgaggaaaatatgcagacacagagcacatttggggacctgggaccagttcagcagaggcagcgtgtgtgcgcgtgcgtgtgcatgtgtgtgcgtgtgtgtgtgtacgcttgcatttgtgtcgggtgggtaaggagatagagatgggcgggcagtaggcccaggtcccgaaggccttgaacccactggtttggagtctcctaagggcaatgggggccattgagaagtctgaacagggctgtgtctgaatgtgaggtctagaaggatcctccagagaagccagctctaaagcttttgcaatcatctggtgagagaacccagcaaggatggacaggcagaatggaatagagatgagttggcagctgaagtggacaggatttggtactagcctggttgtggggagcaagcagaggagaatctgggactctggtgtctggcctggggcagacgggggtgtctcaggggctgggagggatgagagtaggatgatacatggtggtgtctggcaggaggcgggcaaggatgactatgtgaaggcactgcccgggcaactgaagccttttgagaccctgctgtcccagaaccagggaggcaagaccttcattgtgggagaccaggtgagcatctggccccatgctgttccttcctcgccaccctctgcttccagatggacacaggtgtgagccatttgtttagcaaagcagagcagacctaggggatgggcttaggccctctgcccccaattcctccagcctgctcccgctggctgagtccctggcccccctgccctgcagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagcta

SEQ ID NO: 439 - DNA, 5690 bp, Homo sapiens
gaagttgaaggggcgcagcgataccggtgcgcggcgctggcgtcgggcgcgtgacgtctttcctgcgcgccacctagcgtctctatcgcgccagttcctcagcctcagtgctatgaaggtgacagcgtgaggtgacccatctggcccgccgcgatgctggcaacacggcggctgctcggctggtcgcttcccgcgcgggtatctgtgcgtttcagcggcgacacggtgaggcccagcctggctggggccacgggtgtttggggccgggtgtcgcggccgcgcccgtgcacgagcagtccctggggtctgtagtggcctctggagagcccttctccccaggccaggcgggaaggcccccgctccggcctggttgaagtaggggaacgggtcccaacgcggggccgactcccttgaccctctgacttgctggcttcccttgttttacagtcctcggcctggcggaagttttgcaggttgtgaagacccctagtctttcattctctccttgtcacagccttgtagggcgtgaaggggtcattgccccatttagggatgcgcacctcctgatttcccgtccactgctctgcgccctgaagtggctgaaaagtgctcttaaaaggatgggaatcccgtcgccctcagctggtgcgctctccactgggtcgtggggctcctcatttcatcctaagtgagcccctccatcacctgtgtgttaaggaggcatttctttcccatcagtaaacacatttcgcctcttcggccgaggtaggaatataaaaggcccctggcctacccaagttttggtccagcaggggagccaggccgggaaagggccaagctgccacactcggcttgtggggctgtgtggtgccgtgatgcagctgtgggtttggccaccgacagacctgggctcaaattggacctgctgcttttgactgtgagaccttccataagctccttttgctccaagcctcagttttctcctctgtgaaacagagaaaatcgttcctatcagagttcttatgaggatgaaatgggattttggatgtaaaatgcttccatccagtacctgctaaacaaaatgcttactaatggccgggcgcggtggctcacgcctgtaatcccagcactttgggaggctgaggcgggcggatcgcttgaggtcaggagttcgagaccagcctggccaatatggtgaaaccctgtctctactaaaagtgcaaaaattacccgggcgtggtggtgagtgcctgtaatcccagctatccagaggctgaggcacaagaattatttgaacctgggaggtggagtttgcagtgagctgagattacgccactgcactccagcctaggcaaaagagcaagagtctgtctcaaaaaaaaaaaaatgcttactaagtggcagtggtatctatgatgctatagatgcttccctagccctagcccagcccctcctaaatagggagacccaagattctgtagcttctggcccaatccctcatggccccagagcactctgggcctcctgaccctttgtctccctagacagcacccaagaaaacctcatttggctcgctgaaggatgaagaccggattttcaccaacctgtacggccgccatgactggaggtgagacagtgcccttagtgtgttgggtcccggagcaaggtgtccccttcattgccttccctattctgtccaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggtgtgtgtgtgggggcggggcagatgtggctgtgggagagaccttgggggtggctggggtttccctgggcctttgggctctttccttagaaacttagcatgaatgaggtgggcacatgttcccaggccttaaatggatgggacttactctgtggacttccacaggggagacttatgtagcagaatcaacacatgattttgactcaggcagacttagttcaaatcctagctctgcctcctaatcatagaggtttgggcaatttcccagcctttgtgaaccttagcttcctttttgtaaataggtacagtgatatcatgcaaggattaaagagataatgttcatacagcttttggcctgtatgctggttggcacataaagcaaatgataaatgtcacctgctttacctccttttgatggtagagcttgaggaatgctctttgtcaccaagagtagaatctggctctcaggggcagacacaaggagagatgtttggatgagctgaatgaagacctttcttgtggtcatagccacccaaagacagaataggcagtgagctccctgtcattggtggtgagcaagcagagcccctgggacatgttgggagggcagtaaaggattggctgtcagaggagacatctttgaggcctccctgggtggagtggggtggcatggagttgaagacccagtcctgatggccctgtagcctgtctgacctgtgggcccctgcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtgggtagggagagatgtagacagatgagaaggtgttcagtgtgcactcacacacccctcacccagcacagttgttctgaggtgttagtacctggtctgtcagtggttgaactgggggagtggtggccagtcctgcatgcatcccaaatgggacttggctcccaaagcctccttccagggctcctaatgctgctggtgtaaattttttttttttgcttcaaaaatatagtattttttataaaacaagtagcaagaagaaaaaacctaagtggaactatgtgtttagcaagagagcggaataattatgaatataaacaattcctatttggagaaaatacattatgttcattgcttggaactatgaataatacttatatctgtaggaaatatagaaaaataaaataggttaaggcaataaggatataggcaattacatttttattttaattttataaggacttttatttttcctttacagactagggtagttaggagacctgatagtagctacttcgtttttattttcctggcagcaaagcagcttacttatgtgttccttcttgcttatctgttccagatcatagtcaagttttccaattcgttttactaagctagcaaaattttttataccaggagcattaggagcttcaccgtgggaggccttcaagggcttcatgactcctgaagttataggctgactcctgggctgggggtgggctgggaaactcacacctttgtcctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggtaaggcctggcgtaaccctgggtcagactgtgtcctgtgacacccgggatctggctaggctccctttggattgttcttagggatttctgagtggcttcccggctggggccagatagagagtaggctggcaacaacacacaggctcccccagggccgcctgctgtccctcctcctgcctcggtcccctccgcaccagtgctgctctgtggctccaccttcacagtgcctgttctgaggctaagggcatggggtgaacaaggcaatgggcatctctggagtttggggtccagcagggataagaatgataaggggatattagagcaggggctctgccatgggtgcaggaccctgggacacacctccctgccaggaaacttgccccaccccctagcagccaccagttctcttcccatttccctgaaggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctggtaaggcctggggccagccaggtggtgggggggtgcgcagtgggggcaggtgtccacaaagagagcctgggcgggagggctcaggagacggggctgggtctaggggctgactaagggcctgggctcaggactaggcaggtgtgccggccccagccctgaccatgcatccctttggggaccgacttggggccccagggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcggtaagggttcacacaccagccctggtccctgccctcctggttgctgtctccctccctgggcctcccagaaaaccctcttgccagcactcaggtctcagttcctgcagcctgagataaagcaaggtggaagaggagggaggaaggctgctctgaggagaataccccggagtctgggcagcacagggggcccagggaggctggaggaggccagaacgctgggtgggctgggaagagcttctggaactgggggaggggctgctgctagggggctgaggcccaggcttctgtctggccgtgggtgcctgctaattgcccctcgtcacccagacggacatcgtgaaagccatcgcccgcctcattgagttctataagcacgagagctgtggccagtgtaccccatgccgtgagggtgagcatcgggcaggttgggggcttgcttgctgtggcttcatttaacctcctccccaccacgtggcctgcagccctcaagcgccgccccacatcctggctggggagatcatcaggccctctcttgtggctgtggctgcaggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcaggtattcaccacccttctgcgtagcacggagggtgggtggcatcaagggcccagggtgttgggggatttttggactctgtttcacatggtccccccaccgaccccagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctccagctgcc

SEQ ID NO: 440 - DNA, 5690 bp, Homo sapiens; identical to SEQ ID NO: 439

SEQ ID NO: 441 - DNA, 2141 bp, Homo sapiens
ccagcaagccaccctgctgagagctgtagcacagtgacagtaggacgtgcccacattcctcccaggccacctctgtctccacctcctcctgcaggtgtaggctgaggtcagccccaatccagtccaaagcccaccccctttagcctccgtgctctgggcaggaaagctcaacctggccccaaagaaatcgggggcaacgacttcatttccaatacagccacttgcccagtgccatggaagtggccctatgggtcagctgtaccctccagggcctgaccaaaggcgaggcttgctgaccacatgaccagtcagatacgtctgtcatggaggggaagcgaactggctgacatgccagtagctccctaagtggcctcccatccagtgtgtgtagccacccctgtaggcaagcggctctgagaggatgttcacttcccaaggagaagcagatctcttcaaaaccccaccctcttcaccccctatttccctggggaccagatgctgagtgtcgtttgtcacactctgggccctggtgcttctgaacaggctcagggaggaagcccggggaggatgcactgctctcacccgcagggtaggtttccatttgcggaaagccccaccaccttgctcacaggcggttctcaggaatgcggaagtgctctgtgggcacccaccatgctccgggcgctgttgtgcttgggatctggggcggagggtacacggggctggcgctgggtgaagtggcctgtccatgccaccttggtgggcttcagccacttgggcttagctaatcgacagctgcagcaacttgtggctccaccagggggcggggcacccggcactttggggaggagctggtagagggccccgctctcagcctcccagctgcctcccccaccgaccacaggggttctaactaggtctttggtctctagtggcgtcaaacccctgccagtcaccctcactgcctccggacaagggcctgtctaggacagcctgccccaggagtggcccccacactcccctcaggccagaccccagccagggagccccacccatctgtcctctcttccacctcgcccagcctcccatctcgggccgtggacaaatgccgccagtttcagcctctgcctcaaggcaggtctctgcccagctgcgcccccagggactctgcttgtcccagtgccccacagctcctctgggctgccctggcaagggagtcaccctcactttgtcacctggctgtcccctgtgacaatgagggctcacagggcctatgagagctggcctcaggttcctccaagtcccctacgcccctgccaccaggcctgccccctcatctctgctcagcccagttgtcctacccacctcatagagggacatgccacaggctgtgtccaggctcttgggcctcttggcctgaaagggcagagagcccggtcatcctggccagatgctgcccagatccccctccctgttcctcccctccagctccccccatcacaggttcctggcctctgcagtcccacctgtgctccagccccactcaccagcctccgcttctccagacagatgtcaaagctcctggctcggtttggcaccagcttcctcaggggcacccgcagctcccccagggaaggtgcctgccactgtcgctgtaccatgggtcctcgcacacacacagcctggtggccgcccaggtcagacctggccaggccagccccatccctctgctccacccccaggtggcccaggccagatcctcacctaagggtcttgcactcagcatcctggcgggtgaagccgtgataggtgagtgtctcctcccagacaggtaccctcgtgccccgaacggtgtgtgtccgaagctggctggcctagggcccaagccgggtgggtcagggcctcctagggctaagaccgtcctgtaacccccaaccctacctccctggtaggaccccccactatttgcacatcccagcaactgagacctaggccttgcaggatggggaggagccaagcagagccaagtgggtgccccaggctgggtgttccaccagagggcagcagtgggggcctggggcttgccctcaccttgctggcccctggcagcagattggctttgacataggcatccgcggagc

SEQ ID NO: 442 - DNA, 2000 bp, Homo sapiens
tagagctgtcaaagacctttattcagtcctggagtggagctggcctgacagggtgaagccaggggctgcttagggcgggccagaccctcagcccctgagcaggtcaggccggccaggcggggctggtaggtaccaggtgccagcagctgcagggcaaactcagtgatgacagctgtgaggccccagacccggtgtggtccatgcaggaagacgggtagtgtgtagcggaagtggccaccccggcagaagtgggtatagccctgattctgcgtctgcagcaggtgggccagcggcagtgcaaacacctcatctacctgcaggcaggaggcagagagggtagacagaggactggaacagcccaaccccctcatatcccccagctcacctcctccgagttgggcctgaggctctggggatccagtgggcctacaccagcaagcactggcaccacggtggccttttgctggggaagagggcaggtggtcagggaagcatggccttcgctgggtttgaaggctggggaggggagtgtgagaggaagacccctttgccatgcataggcctttggtagtcatgttcgggtccacctgcctgtgtcctccagccatgctgactgactcaggtcccctcaaatgcactagacctgttccctctgcttaggacaatctcccacttggcattcaagcctgggttcaatccctgcctaccccatgaagcttccctgaccctaatccaccaaactgagtggagctggcccaccccatcgccctgggccacctctactcaggacaccagagcctccccaatcccttcccgagggggtgtgtggggtggtgcatgtgaccaggcaggttaggggcacccttccacactttgtgcccgtgggggtccatgaccactctcctggtccctggtagcccagctccagggcaggcacagagtgagtgaatggggtggggtggcctcagccaagtggcttaccggatcatacacaggccgcagcaggccccacacgtgctcctcgggcactgccaggcccagctcctcccgggtttcccgcagggccgtgtgcaccacatcttggtcagccgggtcgcacttgccgcctgggaaactaaacagacacaaggagtctggtccttggactcttggggccacggagaggtcggggtatcggcagtgcggggggggccactggcccaccgaagtgtcgcctgcctctgcccctagtttactgggaggccccaggcaagccatgcgacctctggaggccagtttacctccctgagcaatggggataaggaagagaggcccgggacagcgcaggataagagggtctgcagcaggggcaagaagatcctggggctcagatacccaaattcggcctatggtggccccagcaacactgacattgtcctcaggatgttcttaattcccgccgggcggggcccgaacctctccgtagtcgccggcagggggcggcgtccgccctctaagcgggaaacagctcaaaggggtgtcccggcccaggcgtgcgcgcaaggacgcgtacgaggggcccacgcggcgaggacgtggcgccccggcaggtgcaccggggccgacggacacggatcgctgacctctcgctgcagcccttgggcggagggactctccccagacccattttacggaggcggaaaccgaggctcgaaggggctaagtgccctgccagaggtccctgccagccccgggctcctgtagcctccggcaaagggcgaggagttcccggccgctgtacctgacgtcgcccttgtgcctcccggtcaggcggctggaccgcagcgtgtacagcagcgccgggaccccacgcactgagcagagcggcacgagcaccgcggccgacgcgggccgcgcgcggagccgggccgtggcccctgccagcagccggcggcagcgcagctcgccctcggccgacaggcagtcgggcagcatgtcaagtcctgcgcggccgggacact

SEQ ID NO: 443 - DNA, 1999 bp, Homo sapiens
agagctgtcaaagacctttattcagtcctggagtggagctggcctgacagggtgaagccaggggctgcttagggcgggccagaccctcagcccctgagcaggtcaggccggccaggcggggctggtaggtaccaggtgccagcagctgcagggcaaactcagtgatgacagctgtgaggccccagacccggtgtggtccatgcaggaagacgggtagtgtgtagcggaagtggccaccccggcagaagtgggtatagccctgattctgcgtctgcagcaggtgggccagcggcagtgcaaacacctcatctacctgcaggcaggaggcagagagggtagacagaggactggaacagcccaaccccctcatatcccccagctcacctcctccgagttgggcctgaggctctggggatccagtgggcctacaccagcaagcactggcaccacggtggccttttgctggggaagagggcaggtggtcagggaagcatggccttcgctgggtttgaaggctggggaggggagtgtgagaggaagacccctttgccatgcataggcctttggtagtcatgttcgggtccacctgcctgtgtcctccagccatgctgactgactcaggtcccctcaaatgcactagacctgttccctctgcttaggacaatctcccacttggcattcaagcctgggttcaatccctgcctaccccatgaagcttccctgaccctaatccaccaaactgagtggagctggcccaccccatcgccctgggccacctctactcaggacaccagagcctccccaatcccttcccgagggggtgtgtggggtggtgcatgtgaccaggcaggttaggggcacccttccacactttgtgcccgtgggggtccatgaccactctcctggtccctggtagcccagctccagggcaggcacagagtgagtgaatggggtggggtggcctcagccaagtggcttaccggatcatacacaggccgcagcaggccccacacgtgctcctcgggcactgccaggcccagctcctcccgggtttcccgcagggccgtgtgcaccacatcttggtcagccgggtcgcacttgccgcctgggaaactaaacagacacaaggagtctggtccttggactcttggggccacggagaggtcggggtatcggcagtgcggggggggccactggcccaccgaagtgtcgcctgcctctgcccctagtttactgggaggccccaggcaagccatgcgacctctggaggccagtttacctccctgagcaatggggataaggaagagaggcccgggacagcgcaggataagagggtctgcagcaggggcaagaagatcctggggctcagatacccaaattcggcctatggtggccccagcaacactgacattgtcctcaggatgttcttaattcccgccgggcggggcccgaacctctccgtagtcgccggcagggggcggcgtccgccctctaagcgggaaacagctcaaaggggtgtcccggcccaggcgtgcgcgcaaggacgcgtacgaggggcccacgcggcgaggacgtggcgccccggcaggtgcaccggggccgacggacacggatcgctgacctctcgctgcagcccttgggcggagggactctccccagacccattttacggaggcggaaaccgaggctcgaaggggctaagtgccctgccagaggtccctgccagccccgggctcctgtagcctccggcaaagggcgaggagttcccggccgctgtacctgacgtcgcccttgtgcctcccggtcaggcggctggaccgcagcgtgtacagcagcgccgggaccccacgcactgagcagagcggcacgagcaccgcggccgacgcgggccgcgcgcggagccgggccgtggcccctgccagcagccggcggcagcgcagctcgccctcggccgacaggcagtcgggcagcatgtcaagtcctgcgcggccgggacact

SEQ ID NO: 444 - DNA, 8258 bp, Homo sapiens
tcatgccaaatagtttaatgttagggggaagggagaggtaaggcagggttttcgggagttacccccaaagcaagagggcacagtattcaggctgctggggttgggagatagaagtcctggttccaagcttgccatggtcccagccttgctgtgaccctgggcaggtagcctctttctctagactttcacctaccctgctctccttgagacagagatggggctggagggggcggggcagaggctgattcccacacccggtgtaaggtccagggtagcagggcttccccccagggcttctggcatcactgggagtcctggccaggccccaggcacaccacagtgggggacaggagccccagcccagctgggagaggcaggcctccttgatccctatcagcccggatgttggggagggggtatggtgctggtcgggtccttgggatccctaggtggctcggggctccagagtacaggctctgatacgtgacaggcctgtaggtggccggggccagcaggacctcaggtgggggcagcagctgatgatggagccaagcaggggtcttggaggtggaagctgaagctttgttggggtctgagggaggaaatgagtggactctgggcctcccatcgcatcctcatccctcatcccaggcctgccctggtcccttcctgctcctccttcccaagttacctacctctcagccttcgcctttgcttttccctctgcctggaatttcttcttcaccttctccctctgtccaaacccttcccagtcctccaaggcccagcttgagagccacctcctgcaggaagcctgcctggcaccccctgcctgtgctctttgccctgagccccatattgtcttaggcatgtctgcttccccctccgtgtgtccacacaggggccctgtgggttcgctgagctgctgaagccccttcctggaggtcctgtccctttgccttccgcccactgtgtacaccttagtcccactatgtctgcaggcctggggccttacctttctccctgtctgtggcacccttcagcacacagggactgaggctgctgtgactccgggctgggacactgagcaggggccgtggggccacaggcctgaaagagcaagcgagaatggggggaggggatcaaggggaagaacccaggccagggatcatggccagcttcagatggtggggccccaggatgggtcagagggtgtgaccctgaaacaagggtcaggaactgaggccttaggatatgcctggggtgggggtgaggggctagggtcagggtcagacagtaccaggagtccaggtcactctctctaaagcctttggcaaaagggttgctggcgattttcagctgggtgatctgcaggagacaaagtgcagttgtgggctggccatgagccaggctcagccaccttgtcctcccgggaaccggcagtcaggaggccctggcacctgggcctcttggcccaggaactctgagctgataggagtgcgggcagggccttgactgatggcagatactcagggcaagttgggagggcagtagtctgtgccagtgagggctgcaagcctcagggctcagtctccacccctgtgaaatgggcctgcagcgggtgctcccgagctggttcacccaccctgtggttctgataggctgtcactgctgtgaactgggtctctgtgaagatgaaggacttgaagttctcctgggcatagcgctcactgtccttgcgtgggtccacgaagaccacgtggaaacggggctggtagcggtgcatagagttgagaatgatctgtggaagggacagagcaggggtacaggggtgaggcggagtacagcggactccctgaggctggagtccttccctccaagccgggagactgccctgggcctgccaccctgttcctttcatggcagcacagggtctgagctggagaggctgcagttccgtgtcaaaggcccctttggatcatggatccttgcctccatgtcctctcacaccccacatcccagctgccacccactgcctgtgtgctggcccgtcactgtcgcgttcaccagtttcctcggttgcctcctggcctgtcccctgtccccgccttacccctctgttccttctccacacagctgcccgggaagccacatcatatgccccctgctcctaaccgtccagcgacttccaccccacacggtaaaagccagagccccccgaagtcagcccgacccctcaggcattcgcctccttggcttcccctcctggctccactccggccccatggatgcgtcttgcaattctgccggcccaggattctctggcctcagggcctttgcacctactgtcccctctgacgggcatgggccgctgcatcctccacctccttcaggtcttcagctccctgcgccccctgagagcagcagcaccctttctccgccccccttccgtacctctgcttcctctttggcatttgtccctatctgagacgctggggacagtgtcttctggaccctgcctttgccccaggaagtgacctctgtgagggcagggatcgttggctgtttgaccaagtgttaatgatgctgtgtccacacataaagcgggcccggcctaggctgggcgttccataccttgtcctccctctccttgcgggggacaacgtatgctggaacattcccccgcccccacccccttttccacctgcctggacagcccttcctgctgtgccacccccagccaggtgagctcgccaccccggctccccgccctgccttgaccatcagcagcaggcagaggtgctgggcaccaaggccattggacaccaaagtccctaccagccctgaccccaggcccttccgtccccaccgtggccccggcctcacgtggccattgtcatccagcaggttgttggtcagcttgagcttgtcaaaggacacaatctggcgcatccactgggcacccttggctggcgagtcggggtggaagtgcacgcggccaggtgtggctgggtctgccttgcccgccaccagccaggccgagctgtggaaggcatacctggggagcacagcgaggtggtgagggcttccccaaccagagtcacgcctgaacaatacaggcggggtgaaggggctgctgccgactccaacactgctcaccccacctggtgggcaccttgctaaggaacccaaggctcaagagaatcctgttgagacctgagttccctgtggctgcacctggctggtggatgacaggataacccctgctgccctgggctagacctctctgcctgcccaaggctagcccactacccatggaagtctgctgggtaccctgagctgggctgcctcctgccctcaggctgttgttgcgtgtctgtcgtcctgcccttaggctggacctccctggcattgtttggacaggcccctgcctcaccttggggtgcaggaagggtctaattcctggtctcagcacctgagacctgagcctttgccccaggccggtccccgcacctgtatctcttgtcgtccagggggatgaagtccatgagcagggcgtagtcggccagggagtccatgcccaggatcttcacctggaagggggggaacatcctcctgcgggagggaggtgctcagcagccggatgcggctccaaccctggcccctgcctcaccccgcccccgctgctcacacctgcctgccttggtgacgatcatctcagtgcccagctggttgaattcctcccacagaggcttcatctccagctgaactgtcactctggacacacgtgggttcttggggccctgcccagtgggctcggccacagcttgggccccagtagagctggtgcaagggcctgatgggaatggtgaccccagccggggctcccagccagagctggttgtaggtagggggtaggtctctgagggtgcaagtatgccgaggccagcagataggaaggctgtggagagaggacggaagtgtgggccccacgcatcacccagccagctcttatccttcaggctgcacctatatgcctcttcctccaggaagccctccctgactgccagggctgtgttctcacaggatcccccactcagcatcactctgtgaggtaaatgctcacttaaagtttattttgccagcaagctccttgacggtagtgtcagggcctgtcttgctccccagagaatgtttgggccatcttgtgtctatgtggcctcaagcaaattgtttcacctcctggagcctcagtttccacatctgtcagaaggggctcttaatacctgcctcacaaggccgatgtgaggattagtgaccatgcacaggggctggtgcacagggggcccttcacaaacagcacctgttctagatgatatgtgtgtggggcgggggagggggcaggggtcttccccagctctgtgggaccctgcctcccggtgctgctgaaggagagctgagccaagaagagccccccattcagcaccaattacccatccctgaccttgacaacccgcccagagcctgcctccagaaacccatcctaccgtctttttctctggtctctgcactcttttctaagcatcttgtcttttgatctgcaatcccggcacaagtcttggccaaatgctttgtcacccttcacccctccaattaaaaaaaatcttagctaaataagataccattttatacccattaagatggctattagaaaagaaaagaaaccagaaaataaaaagtgttggtaaggagatggaaaaattagaactcctttttttttttttttttttttttgaggcagggtctcactctgtttcccaggctggagtgcagcgggagctctgtcatagctcactgcagcctcgacctcctggcctcaagtgatcctcccatatcagccttacaagtagctgggactataggtgcacaccaccacacacggctactttttttttttttttgtagagatgggatctccctatgttgcccaggctggtcttgaattcctgagctcaagtgatcctcccacctcggcctcctaaagtgttgggattacaggtgtgagccactatgcctggcctcaagaaattggaactcttgtgcactgctggtgggaatgtaaaaggtgcagctgctggggaaacagcatggtagctcctcaaaaaattaaaactagaattactatatatgtatatattatttatttatttatttatttatttttttccagagtcttgctctgtcacccaggccggatggatctcggctcactgcaacctctgcctccctggttcaaaagattctcctgcctcagcctcccgagtagctgggattacaggcgtgcatcatcatgcctggctaatttttgtatttttattagagacgggatttcaccatgttgtctaggcttgtctcgaactcctgacctcaggtgatttgcccacctcagcctcccaaagtgctggggttacaggcgtgagccatcatgcccagcctagaattaccatatgatccagcaattccacttctgggtctataccagaaagaattgaaagaaggaactcaaacagatatttgcacacccatgttcttatgagcattattcacaatagctgagaagtggaagcaacccagtgtccattggaaaatgaatggatgaacaaaatggggtccatccgtgcaaggtaatagtatccagccttaacagggaagaacattctgacacatgctgcaacatggatgagtcctgaagatgctgttacacgaaatgagccagacaccaaaggacaaataccatatgattctactcataggccgtacgtggtgaggccaaatcatagaaacagaaagtagaatggtggttgccaggggctggggaggaggagatggagagttgttgtttcataaggacagaatatcagttctgcaagatgcaaaatgttctagagatggatgctaatgatggttgcacaacagtgttgttagaaatgcttgttttccggtgccgtaaagaaatagcacttgaacataaatttaatttcctcagcaaggccatttttttttactttttgcagaaagggtacactcgccagcagctttgccatgagagtacaccgaacaaaggagacagggtcatttataacctgacgtgtccaccctactgctgtgtctggttcccattggccggaacgggacctcacattctgtatttgtcctgattggctagtaacttagaacttttaaaactggcaaaggcagaggagaacaaaggaaggaggaagtaacttatagaatgctgagaaaggtaaaaacaccttcaaataaggaagaggaacaggctatgacctaatgtttgcttggaccaatataagcatgctagggcaaatatttaggctaaattgtgggagctaagaacataaaatatattgatttttttttattattgttagcagatatttaagaatgttagtacaggtctttgaataaattttgcttctaagagaagttattatttattctaattagatggcaggaaagtctatgaagaggaacctctactttactttttacaatgtgaatgtaattaatgacacaaaactgtgtatttaaaaatggttaaggtgggccgggcgcggtggctcatgcctgtaatcccagcactttgggaggccgaggcgggtaggtcacttgaggtcaggagtttgagaccagcctggccatcacggcaaaccctatctctactaaaaatacaaaaattagccagaagtgctggcgggcacctgtaatcccagctattcgggaggctgagacacaagtgtcgcttgaacccaagggggtggaggttgcagtgagacatgttcacaccactgcactccagcctgggtgacagagtgagactctgtctcaaaaaataaataaataaataaataaataaatataaataaataaaaaggttaagatggtaaattgtgttatgtatattttacaattaaaatgttttaaatggaaaaaaatcctgagaaacagaactattattttatagcagccccataaggggctgagaagctggaagggccatggaagccacagtggctgggagtcaggggacaaggttttattcccagctgtgtccccacccgagtggctttgggatatttacacgactgtaagactatgggatgcctggagcagaggggggtgctgggtgttggagagatggatgaactggcagacaggcgggtgacggaggcccccaggtggcatagcatctgctgaggtaccaggtggacggcacctggccagggtgagctcttagtaggtgcctggggagaatgtggagcccagggccatggccacgtcctcagcagccctgagagctgcgtgcaaaggccctgggatttctgcagcctcgcgggggagggggcgtctttgtgacagggatgggtcacatcaggtttgaggaccctgggcaggatggatagatgggctgatgtccccctgcccctgtggccagtccatcagaagggtagctggttgtcgcccggctgccctgctggggcgggtacgtcatccaggtgatgccagcccccctgggtccatggcaatgggtcccaaggtgggggggctcatgatttcactgggcctggaggctttgccggtggtcactggctcccaagtcctctaggggctcacccgctgcccgtcgcagccaatgtgctgcccctcaacactttcagggactctggtggggggagcctgtcctttgctcagtccctctagaagccagcattcctcagggcccagagatgacagcttgccagaagcatcgagtgtcaagtctggaagggaagctaagggcttcttgtccagccccaactttgatgctcaaggagctggggctcagggagaggcccgaggtcacacgtgcccagtgaggcgctcatctcccggaacagcctggtccctggcatctcccataattgcacttgggcagccgtgagccctgtcccgttgggatctcagaccttagcctggggtgcccctgccccaccctcttgtgaaggacctgggttcagcggggctgtcttggttcccaccctgcccacccaccctggaacctgagcctgacccatgaggccacctctgcttcagaacgtagcctacctgccatggagacagagaggctgtccggctcctggagaaacactgcttggctggggctgggaacctgcctgctggaaggggtggtcaccactcgt

SEQ ID NO: 445 - DNA, 8105 bp, Homo sapiens
tctggacatcttccattttatagaaagggaaattgaggccaggggttggggaggcctggcaaggaacatggtgcatggtaggtggcagaagggacctctgtgctcagagctgtgcctcaggacccatcgttcagatgggaagactgaggttggggaggtgtgtcttgggttaggaagctgggctcggggcaggggtcagcgcgggcatggcaggcacggtgaatgtgaacttctcagtctggacaaaggcaacgcccttctcatagtaggcagcctcgttaatgaacacggggtacaccgtggactctccctcatagagcaggtcctccccactgaacatctggaagatgggagcaccaggctgcagtggctggaagtctcggtcctgggaggagagccaaaggccaagattgctggggccacctctgccctggccccagaggggggtgaccccagcttgacacccaaaagatgcccctcattcatggcttttcccacccatgcttcacttccttaatccatatgacagcaggtctggtgagataccagtctgctctgtgtctagaaatgaagacacaggtcaccttggggtggcatgtgcccatgtggaagtggaccctcatggatacgggcacaggtattgaagctggagttcaaattcttgctagctgtgtaactgtgagcaagtcacttaacctctgtttctcagctttcttgtctgtaaaataaggattacaatatctcctcctatcattctgaagtttagactaaacaggttaatagtgcttacagcagtgtctggcacacggtaagtacaatatgattctttattaaataaattttggctgggcgcagtggctcacgcctgtaatcccagcactttgggaggccaaggcgggtggatcatgaggtcaggagttcaagaccagcctggccaacatggtgaaatttcatctctactaaaaatacaaaaattagccaggtgtggtggtgagcgcctgtaatcccagctattcgggaggctgaggcaggagaatcgcttgaactcaggaggcggaggttgcagtaagccaatattatgccactgcactccagcctgggcaacagagcgagactctgtctcaaataaataaataaataaattttaagcctgggcacagtggctcataatctcagtggcctgtaatctcagcactttgggaggctgaggtgggcagatcacttgaggtcaggagttcgagaccagcctggccaacgtggtgaaaccctgtctgtactaaaaagacaaaaattggctgggtgtggtggtgagtgcctataatcccagctactggggaggctgagtcaggagaatcgcttgaacccaggaggcagatgtcacagtgagttgagatcgcaccactgcactctagcctgggcaatgaagcaagattctgtctcaaaaaataataataaaaaataaaataaattttaaaattgtaggaggagccacccaaattgactgttatgactgaacgtctgcaaggtagctgggcacggctggattaagactgtctagccctaaacatggacgggatggtgctgcctccatttgtaagaaggtaactcctcaaaatgaaacttcagggcacaaaaggccacaagattgcaccagaccctattcaacaatgaccccctgtggcagcaagcagagcagcagccagtacgttcttctcaggcacccaagggaaaggtgtggaagcaggattgcctaatcctggaacattcaggaagggaaggcctgcagagagacatactgccaacatgcatggggatgctcgaggaaccaattgaaaatcagaagagagttttgtatttgcacctccaagcaggtgaattgagtcatgcctgctccatgtcccctccctctgccttttacagccagggtagggttgtctccatcatgccctccacaggagctatggggatcactgtggcctcttgtgctaggcctgagtgtggggttccagggaaggcagcagggccaggggaagtgggatggcggagcccagcctcccatcctgctcctcaacccgagatgctggtgagctcgtgggaggcttggctgcaccccctggggctcagttttccttgacaatcctcctccccaaggctgtggccccagaaatcaccccccaccacacacacacacacacacacacacacctgcagctgaggatgcacagtgcctgccaggtgcccggcctcggtgcgggggaagtccacgacgcccacgggtctataggcttccatctcaaaggcaggaaaggccgtacctgtgtgggaggctgggtgtgtgagcccatccctccctccaggctaggggacagactgggccgtgggggtacgtcagggctagatcccagcctgcctgtgagcctggctccccaacccctgagccagacctgctcttccccggacctgtttcccgaaagtcccctggggtctcaccctggttgaagagttcgatgaagtccagaactgtggccaccagggtcctcatccttgagaaaatgtcagcccgcagcacaccctgtggctgggggcccagctccagacctggggaccaggaagcaaggggttaggcaggtgcaggacccatatactccttgaagaggccctgccccttggtgactggacccgcccctccagccctcctggccccgcccacttctcagaaggctgcggcccacccagtccatttttggccacagagtccaggttgtagctctcctccccagaccgctggtacaggaagacctggcaggacagctcggggtactgcagctgggggcgagagaggcaggttaggggcccaggcctacttgggaagggaaactgaggtgggaaggtgttgcatggaggaaacacagggcaccaccctccttggccaggtctccctctaccctctggcagggtaggggagggggtaccgggggcctggagtgctggcgagtggcagaccccagggactggagcccaggggaaactaggcccggggaagaggggctaagcaaaggaggttccagcattgtcccgcctgccctccctccctcccactcccctctggggagctgtgtgcttggggccggggccacctgcagatggcggcacaggtgcatggcaaagacttcgtgggaggacttcgcgattaagcaggtgcccatgttggccgtggtgttgtgcaggtcaaggacaaagtcaaaggcctggcccgaggccttgggccccagcagctggttcagctctcgggctcttgtcacctcatatgggtcgtccggggtgggcctggaactgtggagacgggaatgggggacaccgatcttcacagtctcagtcagtcttcagtggtttaaggggaaaggggcaggggccctgcaggagccactctgagcagctcgagcgagggctttcccttcagacgttgtggctgtgtccacccctgcccgtggccctcttggctctgcacttcccggtaaaatccaagctctcagcctggcccgccctcccacctgcctgcccacttgcctgcctctcatgccctcattccagccacactgcctgagcaccatgctggtctcacccccaggcctgtgctgtgcttggccctccagtggaaactccctctcacctctcttcccctggctagcttttagtcagcctttggggcttggctgagacaccattgcctccaggaagccttccctgactgctctcagccaggttagctgctttgtgtagcctccggccctgcctttagccccctgggttatggttgcccggttcttcctctgtctccccattaagcttgaagccaacaccttggtcctattccccattctctcacctgagctggccagagcctggcctggagataggatgcagtgactattcattggaaggaggcatgaacagtgatcagggcacacgacaagtaaacatggcctgtggggctaatctgagggaagaattaggtctgggatccccagaagaggtcctgaaccaacttgcagtcaggaaggccttcctggaggaggtgacatcaatcttggtttctctaaatgttcggtttgtcccgtggaggaatgggccacataggcagaggggaagcaggagtgaaggcagggagggccctgctggtggcgggagggaagttttgtggtggggactcggtgcccaactgcctgggccaacctggcggcaaaagcactcacttgaggaagctgctggtgaaggtgcggttgaggtcatggtccacgtagcggcggcagccggatgtggctgccgggttggccagcacaggcacagcggagaagctggctctctgcagctctgcgggggcatgcagccagtgccgggccaggtagacgcccgacatctcgttgccatgcgtgcccccagtcacagccacgcgacgcaggggctcccggggcacaggcagtgagcacatgctggtgtggggtgcagaacctgggggtgggcatacttaggagaccctggccccgatgcaagggatctgggctcagggcaaggatggcggtgggaggctccacagggcagccacctgtcaagaggtgtggacagctgggagtgtctcagctgtgtcccacctgcacccccagtggccctttctctgaggagacaattttcctgctcctttggagaaaagaagtttctttttcctaaattgagaagaggggcccaactgttcaggaagatgggttcaccaaggcacactccctataggaagaggactgcgctcctttttatagacagggaaactgaggcacagcgtggggagtggaaagtgtcaccagagttagctgtggagtgtctgggttctaggcaacagcctcgccttcctgcccctcctgcttgctcctcccagctggtgcaggggtctcaggtcagggggtacttaccgctgatgcggatctgggcttcccgggccaccaggactggcgtctaactcgcagacaggctggtattcatgggcctggagatccacagatgggaagttttgtggcaagctggcagacagcagggggtgggtgggacgggctgaggttcatgcagccaaaggtcggagtgctggggtctgctccactgctcctgccccgcccgccccacgctgctacttgtgctgccacggcccaacgagtccaggtcctgcgggcaagttcctgcccctgcccttcgtccttctgctgggccccagaggggccaccttccttaacactactaagaggtacacccgcagtggggtggtgacttggttttggtcaccaccagagcaggctattgaaagttactatagaggtgtcaccttgatggccaccaagatgacaagctgcccctccttcaccacctcggcaacatgcctctgtccttgcagcccggagagggctgtggtcactcctgagtcgcccttacccaaaggtgccatgtggagccccagttttacagctctttgttgctttaagcaaaattttaaaatgtttgatccgggatttcagtcattttcaaggacagtgtaactcagatgactcggtttgccctgttttgggaacaaccctcaggctcattttatagatgtgaaaactgaggctcagaaaattgtctgcaggcacacaagccctagaggcaggctgcaggtggcccacagaaccctaggggcagactgttcagcggcacacagagccctagaggcgggctgcaggtggcgcacagagccctagaggcgggctgtaggtggcactcagtgcgtccaatgtggctccatcccctcctgctgcctctcaagagcaaagtggggaaggatgaaggtgaggtcccctgcactcagccctggggcctctacctcccaccaggctcagctgtctgctgggaggagctgaggccagttccgaagtcactggggagtgaggcaagctgctccgccagggcctgctggatgccaggtgctgggaccctgagctggagcctcccccaggcatcgatcctgggccttctttaccaccacactgggtctccccgggccagtccagccctgctccagatgccaggcccaccagcctggggggctctgggtggccaggaccctctaagttacaccctctcggaagctgccccagatcacactcagctctgtgtggcctgggctctcctgccctccacacccaaggcttcgtgagctcagagcatggcgattgtggggacaggggatttgtcatcctggctcccatcagggcagctgggatcttgacagggtgtcaagaggggtggatggagtgtgaggctgagcccccagtgggccggggctccctatgagccccctccaggggccactcctcctggcacctggagcctcagcaaagggagggcagagactgccattagggggccatgccatgccatcaactcctgtatccggcccagccctgggggcagctgtcaccggctccattttgcaggtgtggactgaagctctaggggttgggtgacttgactgagtccttggcaggtggtgggagagggagtcagcagaggagcctgtcggcctgggtctgttccttccttgcttggggtaggggtctcagggacccccatgctgctttatgagtcccaggccatggtctttgttggaaggcccccccaacccccacagaggctgggatcctgctgactcggtgtggtacctctcaggaaggaagggcctccgtggcagacctagctattttgggggctgctgggggccagggtgcttcctgccacaaggtgctgggcccccaagtttagggagaacagcagtaggggtgctggaaagtttcacttcccttggctggggtccagcttctgcatttcagtgagtgtttatggaacagaacggggtccaggaaccctcagaaacagcagcccccagtcctggcagtgtgtgcgcgtgtgtgcatgtgtgtgcatgcatgtgtgcatctgtacatgtgtgcgtgtgcatgagagcatgtgtgtgcgtgtgtgcactcacatgtgtacgtgacagcatgcgtgtgtgcgtgcgtgtgtacatgtgtgtgcatgtgcatgagtattgtgtgcatgtgtgcatgtatgtgtacatgtgtgcgtgtgtgcatgagagcatgtgtgcgtgtgtgcgcatgtgtgacagcatgcatgtgtgcgtgtgtacgtgtgtgcatgtgcatgagagtattgtgtgcatgtgtgcatgcatgtgtgtgtacatgtgtgcgtgtgtgcatgagagtgtgtgtgcatgtgtgtgcatgtgtgcatgtgcttgagagcgtgtgtgcgtgcatgtgcgtgagcatgtgtgcgtgtgtgtgtgttgtgtgcacacgtgtgacctggctctggccccacctccctgacaggctgtgtgacctggagagattcagtgccctctctgggccttggctccaccctgtgaaagtcctggccaagggcagctgtggggagtgaggaacaaagggcgggcacaagcttgaaaatgggcacatggagaccccagcatgagtgagggcagaggatggtgatgtcatgggcatcatcacgggggccaatttcctcactgcagttggggaaactgagacccagagaggggtcagagctgtggttcccccctgtgtcagcatccaattagatcatgcctcccagcatcacctcattgcaagatgcaatcagatcacgcctcattaccctatgcttataaaacctgccccagccctcagctcggggagacactgctttgggagctgtctaggtgttctccttacttgttgcaagaaataaaatcccctattaaatcctctttagttaacacccgccaagcaactgagcccacccgttgtgtgggtaacaaaactctggcgacccagatggggccgactgggattctgatcctaacttcttgaggctcactaaggtaaagcagtgggccgcggcaccttccccgggcgaactcacccacgtggccccagagggttgagggtgactcccggggatcttctgcttgctgcgtggcccgtggggctgtcactccg

SEQ ID NO: 446 - DNA, 12470 bp, Homo sapiens
tccagaacagatgaatttatttgggaggagcagaggattcctatctgggctatgagtgcttggaaggatcccaggcatacacagagggccacagccaaggggaagcttttaaaggacagaagtccatgtaagcagcttttaaacaaggtttgtaagtcacaagctgatcgcaggagttggcgatggttttctggtggagacggccgtggtaggtaagcatctgcagctcatctggaatactacagtcttgaggacgtgctttccatacgccctgtgtctggtctacatgcaggcgtgtcttgtgataaatcctgttacgggcatgtgtgtgtgagggcttctatgtggccccccgactccattttattagagtttggcataagtgactccattttggttccagcaactttcacataaggaaactgaggctcagagaagtcaagggacttgcccccaggtcccactaacactgtgcagtggagtgatgcaaaccccagttttcccagtggatggagctgctgtgggtgagtgcagggtgcggtgtgaaccagaggggtggtgcagagaccagtgtgggatgtgagaggatccctgggggaggcagtgctggtgcagttgggatggggcagagatggaagtgcgcgtgtgcctagaggggagagcaaaggcctggagggctccacgctctcaaccgttcagggctgatgcccctaagaaggcagggcactgtattttccagggtgacactgcccctgtgactgggtctggccaaccctgaccgagagggcaaagggctggaattggggagggtggggtgagtgaggacacctggcatgttctgcggcctcttggcctctctcgagcagcgtcccccagatagaagcaagaccttgctttgcagccctggcaggcaggatgcagtcatgtgacagctccagcaacctgaggctgggggaacctgcggtctggaggaacaatgtgagttgggagcataagcccctcatggctagactcaggtttctctgtgtgacccgttggaggcgggtgggacgctcacaggagggtgcagctctgggagcccatgccccagcgtaacagctgctggttccagtcggtatagggtgggtagtggatctcctttaatttctccaggccggagggggcgagcaggcaggtgcggtggtgggagaaggtgtcgaaggtgaacttgccgtggtaccggcccatcccactgtggcctgtgtgggcacagagaacaagggcctgagaccaggcagcccatggagccccagcagcagcccactgccccggccagggcacacagctggcagggagctcagagagagccaggccactcacagagccattttacagatagggaaactgaggccttgagaggcccagggtgtggatcaaggttgaacagtgagtgaagggacttcctgggtctggggtaccaaagccaagcttccctaggggtggaaatgggcagggacccaccgactcccccgaatggcacggacagcagagatatgtaggtgaagccctcattgcctccaaagctgccgctgctggtccgctccagcatctggttcacaacctgccagggagtgagaaggtgggtgttgggctctagtcatgagaagagggcttgagccccgcacattccacagcggaggtgagcctcatcctcacctgcccctccaccctctaacgggcaataatctccgctctaagcatcttctggggacagcaccctctcagtgacggtcggggtgccatgggggtgattaccaccatggcgcaaagaccaggaagccctgcaggatcatggggagccggcagccttgagtcgcgacggtgaggttaggatgctgcagtgtggtatgcgggccccaccgcgacccgctgggctctatcaggcccctgctctgctctgtccctgacctccattccgggcctctgcttgcctgtgcagaacctttgcacagtccaagtgcaggctgctctggccaggacagaggatggacccgctaagtgtctggtgggtttggaccctgtcctctctgccaggcatccttgcgccggatgcagtggtaccaggtggcctagatatagtcacccttgaggcatctgctgctctaaagccttgctgggaagggctgtgaaaggaaaggtgccagtctgtgcccctttcagcccctccattgcccccaacccggccgcacccccacctggctgctgttggagaaggcgtacagggccaggggcttctcctgccggttgatgaacttgatggcctcgtccacgctctgcacgttcacgatgggcaggatgggcccgaagatctcctcctgcatcacaggctccgtctcctgcacgtccaccagcaccgtgggggctgcgggcaccagagacggctcagccctggggccacagtcaggactgcccccaggggtagggtagaggtggggacaggggcatgggccagggctccaggccaggatcccaaggtctgacttcccagcgcttcaggctttggagtgtttagggaagaaagtttccccacagccccccagaagggaccctagggcttccccagcctgctcagggcctgtggggcgcagagaatcccccgaccttggtctcacagtcaggggtgatgggatcttagaaccttggagttcatgaggcagcagcgtcccagaatgttggagctgcagtgtcccatgagctgctgagtcatacggcccaggagactgggggctcaggatggggccgtcagagtttagaacctggggatcatgggctcggagaatcagaggttacggcctttcaggacagccggtggtgggatgggaattcaccttagcacgctgggccctggagccctggaatctgagctcagtgaatccagggctgagggaccagagtatggcctcatggggccacaggctcagaagcacagagacggaatcgtggcaccagagccatggctcaaggccgggctctgatagtggggccgggtttcaggtgcgagtccagactcgtggcccagccgtgggccctccattgagaaagggtcttggcccaggtgggctgcggtagggcagcaggactcaccgatgtagcgatcgctctcgttgctctggcccccaatggccacgcggctgcagcccagcaatgcccgcagccgctggaactgtttctggttgatgatgtggcccaggtttggggagctctgggggtcgtcgccatagaaacgggtgatggtgctctgcagggcgggcagcagcctctcctgcatctcggggctgcacaggacgtagtcaggggccacgcaggtctggccggcattgaagtagcagaaccaggccacgcggttggccacggtctgggggtcgcagttgtcgtccacgtagcaggggttcttgccccccagctccagggtgacaggcgtcaggtgcttggtggcagcagtcatgacaatcttgcccacacgagggctccctgggcgtggaaggaaaccagagtggccagtcagtgacctggaccaggcaggatggcccagcccagagcctgctcctccctggagaggtgttggagtcggcgggcttcctagggacatggtgaggagaccccatcctcaactggccttgaccacacactccaggcacctgactcttgcccgctttcttcatagaaagtcctggcccgcctcacccttctcctggccggtctggctcacccactgggacctgcctccagcctggccactcctggatccagttgctgcaatgtgcccagggcgtggcctatgcaggcagacggactctgtgccagctccagctccccacgtgcccccactgctggccccagcctcctccctccacaaccctcccaccctctctcctgatgatcccctccacctactctgggaccctggcctggccccctcacctgtgaagaagatgtagtccaacttgtgctctagcagctgccctgtctcctggggtccgcccagcaccacggcaaagcagctctgcaaggtggaatgagaggctcggggcgggctcggggccagccgggcctcctcagcccacaggggtgatatatggggacgtcgggcactgctggggcagggccaccctcacctggtccaggtactggggcagcacctcagccaggaccttctctgtgccctggctgatttctgacggcttcagcaccacgcaactccctgcaggggcagatggggacgtcgttgggggagcccagggtccccatgcccaaccaggggctgggctcagagggcatgtgaggcccagggtacctcagagcaagattccaggggcctctttgggaggggctactgggcggggagagcatggggttcggaacgccctcctcacctgcggcgagggcgcccaccaggagcaccagggtcaggttcagtgggtagttccagggtgcgatgatgaggaccaggccaaagggttccttccagatgaagaccgagtccagcttcatgaactgaggcacagggtagacagtgaggccctgccaagggccaccccaaagcccacccactgcacacttggggcctcagctccctgtgcgatggaatcccaggagagacgagaaaatcagtgactcgcccggggcctcaggggcagaagggggcctgggccagagctacccggtgccctgccctgccctcctgccgcctgccagcagggctcaccaggttcgtggaccgtggttcatccttcatccaggcctgcaggttcttgagagcgtagtcaacctcgttctggcaaaggatgagctcagatatgtctgcctcgaaagctggctgtggtggaggtggaattcagagtggtcaggcccagacctgggccaggaggggtctagaatttgaggagggcacacgcaggcaccaccaccactggacatataaatacagctcctatgggaggcactgccgtcccctgggaactgcgcatggctgcaattctgatctgtgacttcctggctgtgtggccttgggcaagcgatgttaacccctgagtgcctcagtttcctcatctgcaacatggggacagccatggagcctgcatcacagggtggctgtgagtgttcaggagtgaaggtcaggtgcctgccacactccacatgccagggagggggtctgttaaacaaacaggaataaaactagggacatagccagtcactagggggcacgggccctcctgaaagaggacagggacgctgctccagcccctgccggggcccactctccacggcccaccttatgcaggtcctgggccagcacgtcgcgcagaagctgcttgttttcttgaaggaagtggcccaggccctggagctgcgcagcccggaactcggccggccgcgtgcgccctcagttgaaggcctcacgcagccgccgcagcgtgtcctcgaaggggtccatcctgccggatggggtggcttgaactgggtggccagggctgcccctccttcacgggcaccctccagccaccccagggtctgcacacccttgccccacctgcacccatgggggctcacagacaccccacctcatacacacacagacccactcgaatgaccccacggggctggggctgcctgcaccacccccaactcacctgcctcccaggtgtgcccatgagggagggccctgggcttgacctcccctactccagggaggggatccccctcctggacgcccaccctggaagcccaacacacacacctcgggtgaccctgctgcccaccatcccagctcttccctgcacctcccctccttgcgcagacacacacccacccacgctggcaccttgccacccctacacccagaccactcagatggaacagagctctcccctgggcctccctcccttctgggactaaacgagggactcggagggttctttgcttcagagatcacagagctttgaggtcgcagatggggaaactgaagccataggcatgccctagccctgaggagggtttggcacctgctctggggagggggtggcactctgctggtcgtagaaggaagcagaagcagaggagagagctccggggctggtatgggtgggcacaggtgcaggtgggggtaggttggcagagctgagactgccccagggcatgaacccctctgggctttagcctgagggcccaagggaaccccagtggggtctggagaggaggaaggatcaggaccctgggggtgggggaaggggctcagggggacactcaagaggattgccaggcacctagcaacgggattctgagcatcccagcccaggggctcaagaatggtgcgcaaatcctgtgtctttgtgtatccgtgtgtctgtgtgtgtctttgtgtatccgtgtgtctgtgtgtttctttgtgtctgtgtgtctttgtatagctttgtgtctttgtgtgtctatgtgtgtgtgtgtgtatggctgtctgtctttgtgtgtgtatgggtgtctgtgtgtgtctgtgtatgtatgggtactgtgtgtctttgtgtgtatgggtgtctgtgtgtgtctgtgtatgtatgggtgctgtgtgtctttgtgtgtatgggtgtctgtgtgtgtctgtgtatgtatgggtgctgtgtgtctttgtgtgtatgggtgtctgtgtgtgtctgtgtatgtatgggtgctgtgtgtctttgtgtgtatgggtgtctgtgtgtgtatgggtgctgtgtgtctgtatgtgtatgggagtctgtgtgtatgggtgtgtgtatgtgtgtatgggtgtctgtgtctctttgtgtgtatgggtgtctgtgtgtgtatgtgtatatgggtgtctgtgtctctttgtgtgtatggatgtctgtgtctctgcgtgtatgggtgtctgtgtgtcttcgtgtgtccgtgtgtctttgtgtgtctgtgtgtctttgtgtgggtgtctgtgtttctttgtgtgtctgtgtgtctttgtgttctgtgcatcttcatgtgtatggctatgtgtgtgtctgtgtctttgtgtgcctttctgtgtatgggtgtctgtgtgtgtgtgtctgtgtgtgtatggatgtctgtgtgtgtgtatgggtgtttgtgtatggatgtctgtgtgtctgtgtctgtatgggtgtctgtgtatgtatcagtgtctgtgtgtctatgggtgtctgtgtgtctgtgtgtgtatgggtgctgtgtccatgtgtgtctgtgtatgggtgctgtatgtgtgtgggtgtgtgtgtccatgtgtgtctgtgtgtgtatggatgtctgtgtgtgtatgggtgtttgtgtatggatgtctgtgtgtctgcgtgtgtatgggtgtctgtgtatgtatcagtgcctgtgtgtctatgggtgtctgtgtgtctgtgtgtctgtgtgtgtatgggtgctgtgtccatgtgtatctgtgtatgggtgttatatgtgtatgggtgtgtgtgtccatgtgtgtctatgtgtgtatgggtgtgtctgtatgtgtatgggtgtctgtgtgtgtatgggtgtctgtgtgcgtatgggtgtctgtgtgtgtatgggtgtctgtgtccacgtgtgtctgtgtgtgtatgggtgtctgtgtgtgtatgggtgtgtgtgtccacgtgtgtctgtgtgtgtatgggtgtctgtgtgtgtatgggtgtgtgtgtccacgtgtgtctgtgtgtgtatgggtgtctgcgtatgggtgtgtgtgtccacgtgtgtctgtgtgtgtatgggtgtctgcgtatgggtgtgtgtgtccacgtgtgtctgtgtgtgtatgggtgtctgtatgtgtatgggtgtgtgtgtccacgtgtgtctgtgtgtgtatgggtgtctgtgtgtgtatgggtgtctctatgtgtatgggtgtgtgtgtccacatgtgtctgtgtgtgtatgggtgtctgtgtgtgtatgggtgtctgtgtgtgtgtatgggtgtctgtgtgtgtatgggtgtctgtgtccacgtgtgtctgtgtgtgtatgggtgtctgtgtgtgtatgggtgtgtgtgtccacgtgtgtctgtgtgtgtatgggtgtctgtgtgtgtatgggtgtgtgtgtccacgtgtgtctgtgtgtgtatgggtgtctgtatgcgtatgggtgtgtgtgtccatgtgtgtctgtgtgtgtatgggtgtctgtgtccatgtgtgtcgtgtgtgtgtctgcgtgtggacttgagtaatctcagccctcagctgcaggtcacagggccgtgcccagggctgctgcctcagacccgcattgctgagggcagtgggggtgggtggtgagcagggccttggcatccccagtgagtgtcctggaggccagtggccccatctgcacttgcaccgcaccaggcattcttgtcatatgtgatgcagggacagtgctcgcccatggacagagccagctgaaccaatggcagaagtccgtgtcttgtgaatgacaagatgaggagagcagcccctgcccggctcaggtcccagctgaagaatgtgaggagacaggaagccatgctgggcaccttcctggccacacctgcagatgccgcctccctcccctgggcagcgtgatcacattcctggcacaggacccccacactcagtgtgcggcccccctgcatgagggcctggaggaggacgcagcatacagggctctgcaaatattcatctactgtctttgctcaagcccttgggctagaacctgggtggggcctgggcccttctctggtagcgggcggtattggcctggagcgcttccaggtcccaggttccagggccctgacccaaagctttgcctggcatgcgagcgtcagcagcctccacccggcgctcaagcagctcctggccacatcagctcagctctaacctcttccatggctccctggtgcctttggagggatgaccgcctccggcctgaatcaagacccggattggaggagtctgggatgagctatggcacacaggtgtcctgatgttcatcccaggaacctggcctcagcgtggtcacagctttcccaggtgaggcaggtggggcagaggaacccctgccctttctgggcagtcgtcgcctgtcctcacatgtgcacatctggtgctcggtgaaataatcacggagccagcagcatctgcctgacggatgaggaaacagatgggggctggagctggacccaagccctgcctctcatgcaaggtgctttcttgtctcgcccacctgctgcagggcaggggtccgggcgcttgctggggcagggctgactggtgtgaaaggaaaatatcttggacccccaaaatcagtaagctaaaaggaaaattcaagctggaaactgatcagggccaacctgcctcccccccctttttttttttttttggaacggagtttcgctcttgttgcccaggctggagtgcaatgctgcgatctcagctcaccgcaacctctgcctcccaggttcaagtaattcttctgcctcaacctcccgagtagctgggattacaggcatgcaccaccacgcccaaataattttgtatttttagtagagatggggtttctccatgttgaggctggtcttgaactcctgaccgcaggtgatccgcccaccttggcctcccaaagtgctgggattacaggcatgagccaccgtgcgggcccctgcctctcattttattcacagccacccctctgcccaccgagatagatgcacattctgattgcctcctttggaaaggctcatcagaaactcaaaagaatgcagtctctcacctacctgtgacctggaagctgccccaaccctcacccccaccccctgcttcaagctgtccctgcctttctggatggaaccgatgtacttcatatatatatatatatatatatatatatatatatatatatatatatgtatgtatgtattttgtgtgtgtgtgtgtgtgtgtgtgtgtgtgtgtatatatatatgtattttttttttttttttgagacagactttctctcttgttgcccaggccagagtgcagtggtgggatctcagctcactgcaatctccatctcccggattcaagcgattctcctgcctcagcctcccgaatagctgaatagctgggattataggtgcctgccaccatgcccggctaattttatatttgtagtagagacggggtttcaccatgttggtcaggctggtctcaaactcccgacctcaggtgatccctgccttggcctcccaaagtgctaggattacaggcgtgagccaccgtgcctggccttcttacatatattgattgctgtctcctgtctccctaaagtgtgtaaaccaagctgtgtcccgaccaccttgggcacatgctgtcaggacatccccaggctgtgtcacaggtgcacgtcctcaaccttggcaaaattaacttttttttttttttaagatggagtctcattctgtcacccaggctggagtgcaactggcatgatctcggctcactgcaacctctgcctcccaggttcaaatgattctcctgcctcagcctcccgagtagctggtattataggcatgcgcccccatgcccagctaatttttataatttttagtagggacaggatttcaccatgttggccaggctggtttcaaactcctgtcctcaagtgatgcacctgcctcagcctcctaaagtgctgggattacaggcatgagtcaccacgcctggccacaaaatgaactttctttctttcttttcttttcttttcttttctttttttttttttttgagacggagtctcactctgttgcccaggctggagtgcagtggtgcgatctcagctcactgcaaactccgcctcccgggttcacgtcattctcctgcctcagcctcccgagtagctgggactacaggtgcccgccaccacacccagcttattttttgtgtttttagtagagacggggtttcaccgtgctagccaggatggtctcgatctcctgacatcgtgatccgcccgcctcggcctcccaaagtgctgggattacaggcaaaataaactttataaattaactgagacccgtctcagattttctgggtttacactggggacctctggctgctcaccaggcagttcctgactggacctgggtcccataggtgaccaccccagacttggccagcccccatggagctcacagtctacacacggaacaatgacaccggaaacaatatcattacaaacatgatcggtgggccagggcttcttccagaggtggccagagacccacccctggctctgactgctgcggggaagccgtaggggagggcctcttggagggcaggtgatctggacagagggaccaacgtgtgcaaaagccctgtgggggcagatgctgagaaataagacacacaggaaggtggaggcctgatgggacctgtcatatggagaggggactcattcccttggcagtggccatgcctggtgcagggcccagaaagaagtcagagctggcatctggggccaggtagctggcatgcacatctcatctgagcctcacagctattattattacccagttggaaggacagggaaaccgaggctcccagagacgacttgatttgccctcctcacagcctcagtgcgaggagggaggccccccagcccctctcctcacaccagccttgtgacaccatgtgccaatgtgtgcctcgtgcctttcactgtcttctcaacatcttcctgcagcttccagactttctaaatgcgaatgtagtatttctagaaccagaaacaagcaatgcatgttgcttttaacatctgaaaccaaagatccgactttcgcttcaactgccaagaatctctctgcttccaatccccgattctccggcacctcctgatcacagccctggtgcccccgacccaatccttgtctgtccacagagctgccttctcctctaacctgggagctcctcaaagggaggacggggtctgtccccatccctggggctcctggggaacaggcttcatttctgtggctgcttcccaggagcctgccaaagggcaaagtgaggctcagaagacaccagcacccacctccctctcctgagcaagccccgtacccatggcccctgcagccataggccccttggtgggcttgccccctgacccacgggccatgggcacacatccccttccctccatgcccctggttcccaccagtgtcctttaccctgagctccctctgcccgcccctcacccctgtggccccacataacccagcgtgggctctgcccctgggtccttcgctgcacctccactccctttcttggacatgctgcctccagatgcgcaggctctgctcctacccccaggcctcagccctgctctgctgactgcgatcctcccaggagactggcagctcccaaaccaactcccgtgcccacgcctggcaatggggtaatcaatggggt

SEQ ID NO: 447 - DNA, 19053 bp, Homo sapiens
tccagaacagatgaatttatttgggaggagcagaggattcctatctgggctatgagtgcttggaaggatcccaggcatacacagagggccacagccaaggggaagcttttaaaggacagaagtccatgtaagcagcttttaaacaaggtttgtaagtcacaagctgatcgcaggagttggcgatggttttctggtggagacggccgtggtaggtaagcatctgcagctcatctggaatactacagtcttgaggacgtgctttccatacgccctgtgtctggtctacatgcaggcgtgtcttgtgataaatcctgttacgggcatgtgtgtgtgagggcttctatgtggccccccgactccattttattagagtttggcataagtgactccattttggttccagcaactttcacataaggaaactgaggctcagagaagtcaagggacttgcccccaggtcccactaacactgtgcagtggagtgatgcaaaccccagttttcccagtggatggagctgctgtgggtgagtgcagggtgcggtgtgaaccagaggggtggtgcagagaccagtgtgggatgtgagaggatccctgggggaggcagtgctggtgcagttgggatggggcagagatggaagtgcgcgtgtgcctagaggggagagcaaaggcctggagggctccacgctctcaaccgttcagggctgatgcccctaagaaggcagggcactgtattttccagggtgacactgcccctgtgactgggtctggccaaccctgaccgagagggcaaagggctggaattggggagggtggggtgagtgaggacacctggcatgttctgcggcctcttggcctctctcgagcagcgtcccccagatagaagcaagaccttgctttgcagccctggcaggcaggatgcagtcatgtgacagctccagcaacctgaggctgggggaacctgcggtctggaggaacaatgtgagttgggagcataagcccctcatggctagactcaggtttctctgtgtgacccgttggaggcgggtgggacgctcacaggagggtgcagctctgggagcccatgccccagcgtaacagctgctggttccagtcggtatagggtgggtagtggatctcctttaatttctccaggccggagggggcgagcaggcaggtgcggtggtgggagaaggtgtcgaaggtgaacttgccgtggtaccggcccatcccactgtggcctgtgtgggcacagagaacaagggcctgagaccaggcagcccatggagccccagcagcagcccactgccccggccagggcacacagctggcagggagctcagagagagccaggccactcacagagccattttacagatagggaaactgaggccttgagaggcccagggtgtggatcaaggttgaacagtgagtgaagggacttcctgggtctggggtaccaaagccaagcttccctaggggtggaaatgggcagggacccaccgactcccccgaatggcacggacagcagagatatgtaggtgaagccctcattgcctccaaagctgccgctgctggtccgctccagcatctggttcacaacctgccagggagtgagaaggtgggtgttgggctctagtcatgagaagagggcttgagccccgcacattccacagcggaggtgagcctcatcctcacctgcccctccaccctctaacgggcaataatctccgctctaagcatcttctggggacagcaccctctcagtgacggtcggggtgccatgggggtgattaccaccatggcgcaaagaccaggaagccctgcaggatcatggggagccggcagccttgagtcgcgacggtgaggttaggatgctgcagtgtggtatgcgggccccaccgcgacccgctgggctctatcaggcccctgctctgctctgtccctgacctccattccgggcctctgcttgcctgtgcagaacctttgcacagtccaagtgcaggctgctctggccaggacagaggatggacccgctaagtgtctggtgggtttggaccctgtcctctctgccaggcatccttgcgccggatgcagtggtaccaggtggcctagatatagtcacccttgaggcatctgctgctctaaagccttgctgggaagggctgtgaaaggaaaggtgccagtctgtgcccctttcagcccctccattgcccccaacccggccgcacccccacctggctgctgttggagaaggcgtacagggccaggggcttctcctgccggttgatgaacttgatggcctcgtccacgctctgcacgttcacgatgggcaggatgggcccgaagatctcctcctgcatcacaggctccgtctcctgcacgtccaccagcaccgtgggggctgcgggcaccagagacggctcagccctggggccacagtcaggactgcccccaggggtagggtagaggtggggacaggggcatgggccagggctccaggccaggatcccaaggtctgacttcccagcgcttcaggctttggagtgtttagggaagaaagtttccccacagccccccagaagggaccctagggcttccccagcctgctcagggcctgtggggcgcagagaatcccccgaccttggtctcacagtcaggggtgatgggatcttagaaccttggagttcatgaggcagcagcgtcccagaatgttggagctgcagtgtcccatgagctgctgagtcatacggcccaggagactgggggctcaggatggggccgtcagagtttagaacctggggatcatgggctcggagaatcagaggttacggcctttcaggacagccggtggtgggatgggaattcaccttagcacgctgggccctggagccctggaatctgagctcagtgaatccagggctgagggaccagagtatggcctcatggggccacaggctcagaagcacagagacggaatcgtggcaccagagccatggctcaaggccgggctctgatagtggggccgggtttcaggtgcgagtccagactcgtggcccagccgtgggccctccattgagaaagggtcttggcccaggtgggctgcggtagggcagcaggactcaccgatgtagcgatcgctctcgttgctctggcccccaatggccacgcggctgcagcccagcaatgcccgcagccgctggaactgtttctggttgatgatgtggcccaggtttggggagctctgggggtcgtcgccatagaaacgggtgatggtgctctgcagggcgggcagcagcctctcctgcatctcggggctgcacaggacgtagtcaggggccacgcaggtctggccggcattgaagtagcagaaccaggccacgcggttggccacggtctgggggtcgcagttgtcgtccacgtagcaggggttcttgccccccagctccagggtgacaggcgtcaggtgcttggtggcagcagtcatgacaatcttgcccacacgagggctccctgggcgtggaaggaaaccagagtggccagtcagtgacctggaccaggcaggatggcccagcccagagcctgctcctccctggagaggtgttggagtcggcgggcttcctagggacatggtgaggagaccccatcctcaactggccttgaccacacactccaggcacctgactcttgcccgctttcttcatagaaagtcctggcccgcctcacccttctcctggccggtctggctcacccactgggacctgcctccagcctggccactcctggatccagttgctgcaatgtgcccagggcgtggcctatgcaggcagacggactctgtgccagctccagctccccacgtgcccccactgctggccccagcctcctccctccacaaccctcccaccctctctcctgatgatcccctccacctactctgggaccctggcctggccccctcacctgtgaagaagatgtagtccaacttgtgctctagcagctgccctgtctcctggggtccgcccagcaccacggcaaagcagctctgcaaggtggaatgagaggctcggggcgggctcggggccagccgggcctcctcagcccacaggggtgatatatggggacgtcgggcactgctggggcagggccaccctcacctggtccaggtactggggcagcacctcagccaggaccttctctgtgccctggctgatttctgacggcttcagcaccacgcaactccctgcaggggcagatggggacgtcgttgggggagcccagggtccccatgcccaaccaggggctgggctcagagggcatgtgaggcccagggtacctcagagcaagattccaggggcctctttgggaggggctactgggcggggagagcatggggttcggaacgccctcctcacctgcggcgagggcgcccaccaggagcaccagggtcaggttcagtgggtagttccagggtgcgatgatgaggaccaggccaaagggttccttccagatgaagaccgagtccagcttcatgaactgaggcacagggtagacagtgaggccctgccaagggccaccccaaagcccacccactgcacacttggggcctcagctccctgtgcgatggaatcccaggagagacgagaaaatcagtgactcgcccggggcctcaggggcagaagggggcctgggccagagctacccggtgccctgccctgccctcctgccgcctgccagcagggctcaccaggttcgtggaccgtggttcatccttcatccaggcctgcaggttcttgagagcgtagtcaacctcgttctggcaaaggatgagctcagatatgtctgcctcgaaagctggctgtggtggaggtggaattcagagtggtcaggcccagacctgggccaggaggggtctagaatttgaggagggcacacgcaggcaccaccaccactggacatataaatacagctcctatgggaggcactgccgtcccctgggaactgcgcatggctgcaattctgatctgtgacttcctggctgtgtggccttgggcaagcgatgttaacccctgagtgcctcagtttcctcatctgcaacatggggacagccatggagcctgcatcacagggtggctgtgagtgttcaggagtgaaggtcaggtgcctgccacactccacatgccagggagggggtctgttaaacaaacaggaataaaactagggacatagccagtcactagggggcacgggccctcctgaaagaggacagggacgctgctccagcccctgccggggcccactctccacggcccaccttatgcaggtcctgggccagcacgtcgcgcagaagctgcttgttttcttgaaggaagtggcccaggccctggagctgcgcagcccggaactcggccggccgcgtgcgccctcagttgaaggcctcacgcagccgccgcagcgtgtcctcgaaggggtccatcctgccggatggggtggcttgaactgggtggccagggctgcccctccttcacgggcaccctccagccaccccagggtctgcacacccttgccccacctgcacccatgggggctcacagacaccccacctcatacacacacagacccactcgaatgaccccacggggctggggctgcctgcaccacccccaactcacctgcctcccaggtgtgcccatgagggagggccctgggcttgacctcccctactccagggaggggatccccctcctggacgcccaccctggaagcccaacacacacacctcgggtgaccctgctgcccaccatcccagctcttccctgcacctcccctccttgcgcagacacacacccacccacgctggcaccttgccacccctacacccagaccactcagatggaacagagctctcccctgggcctccctcccttctgggactaaacgagggactcggagggttctttgcttcagagatcacagagctttgaggtcgcagatggggaaactgaagccataggcatgccctagccctgaggagggtttggcacctgctctggggagggggtggcactctgctggtcgtagaaggaagcagaagcagaggagagagctccggggctggtatgggtgggcacaggtgcaggtgggggtaggttggcagagctgagactgccccagggcatgaacccctctgggctttagcctgagggcccaagggaaccccagtggggtctggagaggaggaaggatcaggaccctgggggtgggggaaggggctcagggggacactcaagaggattgccaggcacctagcaacgggattctgagcatcccagcccaggggctcaagaatggtgcgcaaatcctgtgtctttgtgtatccgtgtgtctgtgtgtgtctttgtgtatccgtgtgtctgtgtgtttctttgtgtctgtgtgtctttgtatagctttgtgtctttgtgtgtctatgtgtgtgtgtgtgtatggctgtctgtctttgtgtgtgtatgggtgtctgtgtgtgtctgtgtatgtatgggtactgtgtgtctttgtgtgtatgggtgtctgtgtgtgtctgtgtatgtatgggtgctgtgtgtctttgtgtgtatgggtgtctgtgtgtgtctgtgtatgtatgggtgctgtgtgtctttgtgtgtatgggtgtctgtgtgtgtctgtgtatgtatgggtgctgtgtgtctttgtgtgtatgggtgtctgtgtgtgtatgggtgctgtgtgtctgtatgtgtatgggagtctgtgtgtatgggtgtgtgtatgtgtgtatgggtgtctgtgtctctttgtgtgtatgggtgtctgtgtgtgtatgtgtatatgggtgtctgtgtctctttgtgtgtatggatgtctgtgtctctgcgtgtatgggtgtctgtgtgtcttcgtgtgtccgtgtgtctttgtgtgtctgtgtgtctttgtgtgggtgtctgtgtttctttgtgtgtctgtgtgtctttgtgttctgtgcatcttcatgtgtatggctatgtgtgtgtctgtgtctttgtgtgcctttctgtgtatgggtgtctgtgtgtgtgtgtctgtgtgtgtatggatgtctgtgtgtgtgtatgggtgtttgtgtatggatgtctgtgtgtctgtgtctgtatgggtgtctgtgtatgtatcagtgtctgtgtgtctatgggtgtctgtgtgtctgtgtgtgtatgggtgctgtgtccatgtgtgtctgtgtatgggtgctgtatgtgtgtgggtgtgtgtgtccatgtgtgtctgtgtgtgtatggatgtctgtgtgtgtatgggtgtttgtgtatggatgtctgtgtgtctgcgtgtgtatgggtgtctgtgtatgtatcagtgcctgtgtgtctatgggtgtctgtgtgtctgtgtgtctgtgtgtgtatgggtgctgtgtccatgtgtatctgtgtatgggtgttatatgtgtatgggtgtgtgtgtccatgtgtgtctatgtgtgtatgggtgtgtctgtatgtgtatgggtgtctgtgtgtgtatgggtgtctgtgtgcgtatgggtgtctgtgtgtgtatgggtgtctgtgtccacgtgtgtctgtgtgtgtatgggtgtctgtgtgtgtatgggtgtgtgtgtccacgtgtgtctgtgtgtgtatgggtgtctgtgtgtgtatgggtgtgtgtgtccacgtgtgtctgtgtgtgtatgggtgtctgcgtatgggtgtgtgtgtccacgtgtgtctgtgtgtgtatgggtgtctgcgtatgggtgtgtgtgtccacgtgtgtctgtgtgtgtatgggtgtctgtatgtgtatgggtgtgtgtgtccacgtgtgtctgtgtgtgtatgggtgtctgtgtgtgtatgggtgtctctatgtgtatgggtgtgtgtgtccacatgtgtctgtgtgtgtatgggtgtctgtgtgtgtatgggtgtctgtgtgtgtgtatgggtgtctgtgtgtgtatgggtgtctgtgtccacgtgtgtctgtgtgtgtatgggtgtctgtgtgtgtatgggtgtgtgtgtccacgtgtgtctgtgtgtgtatgggtgtctgtgtgtgtatgggtgtgtgtgtccacgtgtgtctgtgtgtgtatgggtgtctgtatgcgtatgggtgtgtgtgtccatgtgtgtctgtgtgtgtatgggtgtctgtgtccatgtgtgtcgtgtgtgtgtctgcgtgtggacttgagtaatctcagccctcagctgcaggtcacagggccgtgcccagggctgctgcctcagacccgcattgctgagggcagtgggggtgggtggtgagcagggccttggcatccccagtgagtgtcctggaggccagtggccccatctgcacttgcaccgcaccaggcattcttgtcatatgtgatgcagggacagtgctcgcccatggacagagccagctgaaccaatggcagaagtccgtgtcttgtgaatgacaagatgaggagagcagcccctgcccggctcaggtcccagctgaagaatgtgaggagacaggaagccatgctgggcaccttcctggccacacctgcagatgccgcctccctcccctgggcagcgtgatcacattcctggcacaggacccccacactcagtgtgcggcccccctgcatgagggcctggaggaggacgcagcatacagggctctgcaaatattcatctactgtctttgctcaagcccttgggctagaacctgggtggggcctgggcccttctctggtagcgggcggtattggcctggagcgcttccaggtcccaggttccagggccctgacccaaagctttgcctggcatgcgagcgtcagcagcctccacccggcgctcaagcagctcctggccacatcagctcagctctaacctcttccatggctccctggtgcctttggagggatgaccgcctccggcctgaatcaagacccggattggaggagtctgggatgagctatggcacacaggtgtcctgatgttcatcccaggaacctggcctcagcgtggtcacagctttcccaggtgaggcaggtggggcagaggaacccctgccctttctgggcagtcgtcgcctgtcctcacatgtgcacatctggtgctcggtgaaataatcacggagccagcagcatctgcctgacggatgaggaaacagatgggggctggagctggacccaagccctgcctctcatgcaaggtgctttcttgtctcgcccacctgctgcagggcaggggtccgggcgcttgctggggcagggctgactggtgtgaaaggaaaatatcttggacccccaaaatcagtaagctaaaaggaaaattcaagctggaaactgatcagggccaacctgcctcccccccctttttttttttttttggaacggagtttcgctcttgttgcccaggctggagtgcaatgctgcgatctcagctcaccgcaacctctgcctcccaggttcaagtaattcttctgcctcaacctcccgagtagctgggattacaggcatgcaccaccacgcccaaataattttgtatttttagtagagatggggtttctccatgttgaggctggtcttgaactcctgaccgcaggtgatccgcccaccttggcctcccaaagtgctgggattacaggcatgagccaccgtgcgggcccctgcctctcattttattcacagccacccctctgcccaccgagatagatgcacattctgattgcctcctttggaaaggctcatcagaaactcaaaagaatgcagtctctcacctacctgtgacctggaagctgccccaaccctcacccccaccccctgcttcaagctgtccctgcctttctggatggaaccgatgtacttcatatatatatatatatatatatatatatatatatatatatatatatgtatgtatgtattttgtgtgtgtgtgtgtgtgtgtgtgtgtgtgtgtatatatatatgtattttttttttttttttgagacagactttctctcttgttgcccaggccagagtgcagtggtgggatctcagctcactgcaatctccatctcccggattcaagcgattctcctgcctcagcctcccgaatagctgaatagctgggattataggtgcctgccaccatgcccggctaattttatatttgtagtagagacggggtttcaccatgttggtcaggctggtctcaaactcccgacctcaggtgatccctgccttggcctcccaaagtgctaggattacaggcgtgagccaccgtgcctggccttcttacatatattgattgctgtctcctgtctccctaaagtgtgtaaaccaagctgtgtcccgaccaccttgggcacatgctgtcaggacatccccaggctgtgtcacaggtgcacgtcctcaaccttggcaaaattaacttttttttttttttaagatggagtctcattctgtcacccaggctggagtgcaactggcatgatctcggctcactgcaacctctgcctcccaggttcaaatgattctcctgcctcagcctcccgagtagctggtattataggcatgcgcccccatgcccagctaatttttataatttttagtagggacaggatttcaccatgttggccaggctggtttcaaactcctgtcctcaagtgatgcacctgcctcagcctcctaaagtgctgggattacaggcatgagtcaccacgcctggccacaaaatgaactttctttctttcttttcttttcttttcttttctttttttttttttttgagacggagtctcactctgttgcccaggctggagtgcagtggtgcgatctcagctcactgcaaactccgcctcccgggttcacgtcattctcctgcctcagcctcccgagtagctgggactacaggtgcccgccaccacacccagcttattttttgtgtttttagtagagacggggtttcaccgtgctagccaggatggtctcgatctcctgacatcgtgatccgcccgcctcggcctcccaaagtgctgggattacaggcaaaataaactttataaattaactgagacccgtctcagattttctgggtttacactggggacctctggctgctcaccaggcagttcctgactggacctgggtcccataggtgaccaccccagacttggccagcccccatggagctcacagtctacacacggaacaatgacaccggaaacaatatcattacaaacatgatcggtgggccagggcttcttccagaggtggccagagacccacccctggctctgactgctgcggggaagccgtaggggagggcctcttggagggcaggtgatctggacagagggaccaacgtgtgcaaaagccctgtgggggcagatgctgagaaataagacacacaggaaggtggaggcctgatgggacctgtcatatggagaggggactcattcccttggcagtggccatgcctggtgcagggcccagaaagaagtcagagctggcatctggggccaggtagctggcatgcacatctcatctgagcctcacagctattattattacccagttggaaggacagggaaaccgaggctcccagagacgacttgatttgccctcctcacagcctcagtgcgaggagggaggccccccagcccctctcctcacaccagccttgtgacaccatgtgccaatgtgtgcctcgtgcctttcactgtcttctcaacatcttcctgcagcttccagactttctaaatgcgaatgtagtatttctagaaccagaaacaagcaatgcatgttgcttttaacatctgaaaccaaagatccgactttcgcttcaactgccaagaatctctctgcttccaatccccgattctccggcacctcctgatcacagccctggtgcccccgacccaatccttgtctgtccacagagctgccttctcctctaacctgggagctcctcaaagggaggacggggtctgtccccatccctggggctcctggggaacaggcttcatttctgtggctgcttcccaggagcctgccaaagggcaaagtgaggctcagaagacaccagcacccacctccctctcctgagcaagccccgtacccatggcccctgcagccataggccccttggtgggcttgccccctgacccacgggccatgggcacacatccccttccctccatgcccctggttcccaccagtgtcctttaccctgagctccctctgcccgcccctcacccctgtggccccacataacccagcgtgggctctgcccctgggtccttcgctgcacctccactccctttcttggacatgctgcctccagatgcgcaggctctgctcctacccccaggcctcagccctgctctgctgactgcgatcctcccaggagactggcagctcccaaaccaactcccgtgcccacgcctggcaatggggtaatcaatggggtgatgctcagtgttacccaacaggcgtggggcagggctgcacctcccaattcccatgcctacccttgtctcactgccaggacctatagctgctcggtgtctgccctgttcttccagggccctgcccccagggaccacactgcacagccggcttgggaacaggttagacaagtcaaggctgtctgaggctttgctctgtgtttcctggaatgggctagcagggagttacctgatcaggaaaaaagaaccccaggggaaggtcacaggatgaaaatatcagcaggatcctggtggcaaatgctgccttcgccaggaagtcctcccaggccccagccacagtggtcccatgccccccatggcccctcctagggtctctatgctaaatcttcatctccctcctctcctgtcctcactcttcaggcttcacaggtcaagatgagcaactgtggctctatttccactctcagtgtgcccagctggcatactcagggcagaggaaggggctcagatctttgcagagagacccttgatgggcgacggcacctgtagctctaggatggcgcattgttcattggtttatttatttactgtgcaaccgtgggtaggttacttaacgtctctgagcctttcggaagtaacaataacacctaattgccatggttcttgagagggtcacagagggagacgtgagaatggaaaaggcagatcacagctcctggcacaaaatcagtgcccctcaatgttgcccgctaatgtttccacaagtatttgctgagcaccttctaggttccagggagcagaatgagctcaggtcctgccactgtccttcatggatggcctgactctgtccccaccccaccttcccccaagcctgagaccaaggacacgccctgctgagggctgtagagagtctcttggcagagtgtgcagccctgtgggcaggagggacatctgagataacccttggttgtgactggagacagcccagcggaggccacagcctgagaccaagccctggccctggaatcttcggtagctaaagatgtaaatgccaatgtgacaccaggaagggacctcgggatggggaagggaatacagggcagaatgctaaggcccatctaagagcagcagatgggttatggccactggggaggcccactgcctccaaaccactgaattgtacactgtaaatgggtgagttgtatgggatgtgaatgctatctcaataagctgttttgttttgttttgttaaactgaactgacaagaagcctgaatagacgtaaataaattaaaatatgctcaacctcagtagcaattgttaaaatgtaaaataggtcgggtgcggtggctcatgcctgtaatcccagcactttgggaggccgaagctggtggatcacttgaggttaggagttccagaacagcctggccaacatggtgaaaccctgtctctactaaaaatacaaaaaattagccaggcgtggtggcatgtgcctgtaatcccagctactcgggaggctgaggcaggagaattgctggaacctaggaagcagaggttgcagtgagctgagagcacaccattgcactccagcctgggcaacaagagaaaaatgaaattatatcaggcatgttcttagaccacggtggaataaaactggaaatcaactccaaaaagaaccttcaaaaccatgcaaataactggaaattaaataacctgctcttgaatgagcattgggtcaaaaacaaaatcaagatggaaattaaaaaattcttcaaactgaatgacaacagtgacacaacctatcaaaacctctgggatacagctaaggctgtgctaagaggaaagttcatagccctaaatgcctacatcaaaaagtctgaaagagcacagacaatctaagatcacacctcaaggaacagaggaacgagaacaatccaaacccaaaccaagcagaagaaaggaaataaccaagattagagcagaactaaatgaaattgaaacagaaaaaatatacaaaaggtaaatgaaacaaaaacttgttctttgaaaagataaataaaattgatagatcatttgcaagattaaccaagaaaagaagagagaaaatcctaataaactcactgagaaatgaaacaggagatattacaactgacaccactgaaatataaaagagcattcaaggctatggtgaacacctttacacacataaactagaaaacctagaagcaatggttacattcctggaaaaatacaacccccctagtttaaatcaggaagaattagataccctgaacaggccaataacaagcagcgggatggaagtggtaattttaaaattaccaacaaaaaaaaagtccaggaccagaaggattcacagcagaattttaccagacagtcaaagaagaattggtaccaatccttttgacactattccacaagatagagaaagaaggagccctccctaattcattctatgaagccagcatcatcctaataccaaaaccgggaaaggacacaaccaaaaaaggaaatgacagactgatatccttgatgaacatagatgctaaaatccttaacaatatactagctaaccgaattcaacaccatatcaaaaagataatcctccatgatcaagtgggtttcataccagagatgcaggggtggtttaacgtaggagggtcaataaatgtgatgcatcacataaccagaattaaaaatgaaaatcacatgatcatctcaatagatgcagaaaaagcatttgacaaaatccagcatccttttatgattaaaaccctcagcaaaatcagtatacaagggacatatcttaatgtaataaaagccatctatgacaaaaccacagccaacataatactgaacgggaaaaagttgaaaggcttcccgcagagaaccggaacaagacaaggatgcccactctcaccactcctcttcaacatattactggcagtcctagccagagcaatcagatgagaaaaagaaataggggcatctgaatcgataaagaggaagtcaaactgtccctgtttgctgatgatataattgtttaccttgaaaaccctgaggactcctccagaaagatcctaaaactgataaaagaattcagcaaagtttctggatacaaaattaatgtacacaaatcagtagctcttctatccaccaacagcgaccaagcagagaatcaaatcaagaattcaatccctttgacgatagcaaaaaaacaaacaaaaaaacaaaacaaaacaactttagaatatacctaaaaaagaagtcgaaagacctctaaaggaaaactacaaaacactgctaaaagaaatcatagatgacacaaacaaatggaaacacatcccatgctcatggatgggtagaatcagtattgtgaagatggccatactgccaaaagcaatctacaaattcaacacaatctccatcaaaacaccaccatctttcttcacagagttagaaaaaacaattctaaacttcatatggaaccaaaaaagagcccgcacagcaaaagcaagactaagccaaaagaacaaatctggaggcatcatactacctacctgatttcaaactatactctaaggccatagtcaccaaaacagtgacatatcggtgtaaaactaggcacacagaccaatggaacagaatagagaacccagaaataaacccaaatacttacaggcagctgatcttcaacaaataaacaaaaacataaagtggggaaaggacacccttttcaacaaatggtcctgggataattggctagccacatgtaggagaatgcaactggatcctcatctctcaccttacacaaaaatcaactcaggatggattaaggacttaaacccaagagctgaaactatacaaattctaggagatgacattggaaaaacccttctagacattggcttaggcaaggatttcatgaccaaagaaactatgatatatatatacacacacacagtactgtgtatatatatactatggtacatatatatatatatacactatgatatatatatacacacacactatggtgtatatatacacactatggtgtctatatatatatatatacacgctatggcatatatatacatactatgatatatatacacgctatggtatatatatacatactatggtatatatatacactaatggtatatatatatatatgtttgaatactactcagctataaaaagaaatgaattaacagcatttgcaatgatctggatgagattggaggctattattctaagtgaagtaactcaggaatggaaagccaaacatcgtatgttttcactgatatgtgggagctaagctatgaggacgcaaagcataagaatgatacaatggactttggggacttggagggaagagtgggaagggggtgagggataaaagacaacaagtatggtgcagtgtatactgctcaggtgatggctgcaccaggatctcacaaatcaccactaaagaatttactcatgtaaccaaataccacctgtatcccaataacttatggaaaaaaaatcaggggccaggtgcagtggctcacatctgtaattccagcacttcgggaggctgaggtggacggatcacttgaggtcaggagttcaagaccagcctgaccaacatgatgaaaccccgtctctactaaaaatacaaaaaaaattagccatgcattgtggcgtgcacctgtaatcccagttacttgggaggctgaggcaggagaattacttaaatctgggaggtggaggttgcagtgagctgagatctcaccgtagcactccagcctgggtgaaagagcgagactccatctcaaaagaaaaaaaaaagaaaaaaaacaaagccaggcacagtggctcatgcctgtaatcccagcagtttgggaggtggaagtgggaagatcactaggtcaggagatcaagaccatcctagctaacacagtgaaaccctgtctctactaaaaatacaaaaaattagctgggcatggtagcaggcacctgtagtcccagctacttgggaagctgaggcaggagaatggcgtgaaaaaaaaaaaagtaagaacctttaagttacatttcagaaggcacaccattcccatcaaaccaaattaataagagcctatatgaccaatcaaatcttgctgcattttgtgcgaaaaaatcaggccaagtataataagcctaaaacttattttgcacataaattggtcttactataatttctctctggtacaaaaggagggctagaaagagaaattctttcaaaggaaaattataacacttattactagattccagccctgacttttgtttttgagtgcagattgaatcatgaattatctcttggctacaataagcctctaaagaaccagattagaggccaggcatggtgtctcatgcctgtaatcccagcactctgggaggccgaggtgggtgggtcacgaggtcaggagtttgagaccagcctgaccaacatgatgaaaccccatctctactaaagatacaaaaattagccgggcgtggtgatgcgcacctgtaatcccagctactcaggaggctgaggcaggagaatcacttgaaccagggaggtggagcttgcagtaagccgagattgcactaccacactccagcctgggtgacagagtgagactccatctcaagaaaaaagagtaccagattataatttttcttcatattttcagttggtgccctgatggaatagattcctttgtctgttctgacacacaaatactcttaattgtcaaattattatcattatgattgagacagagtatctatcacccaggctggagtgcagtggcaagatcttggctcactgccacctctgcctcctgggctcaagaaatcctccagcctcggcctcctgagtagctgggactacaggcacacaccaccaggctctgctaatttttgtatattttttagagacagggttttgccatgttgccaaggctggtctcaaactcctgggctcaagtgatccacctgcctcggcttcccaaagttctaggattacagatgtgagccaccgcacctggccaattgtcaaattgttaatgttatttatctctccttgttttacctccaaggaaagcagaatcatggcattctgaagactagagatgctaacctctctcatttggcaccccactgggcccaatttgctttttactgcaaatgccctgctgttgaaactatacaagcaccctccctctgggcccagggactgttgtggaagaggtgggcacgtgacattgtaagggcagggtttgagggatattgttagctcagatcctccaaatcaaggatgggtacacaaatgcctaaacagctgggcaaaggacaaagggacttttgacttctgagccaatgtgtggcactgtattagtctgttctcacactgctaataaagacatacctgagactgggtaatttataaaggaaagaggtttaattgactcacagtttagcatggctagggaggtctcaggaaacttacagttatggtggaaggggaagcaaccacatccttcttcac

SEQ ID NO: 448 - DNA, 13570 bp, Homo sapiens
ttaaggggtgtggctttgttccaataaaactttatttacaaacacaggctgtgggctggatttggcctgcaggctgtagtttgtgatccttgattcagacagtttagcaaggctgaaaagaacaccaacacccccttgttacccacagatgggtgggacttggccagaggccaagaggagggtgctcgcaggggaacatacagcgtgtagaggccgggaggtgctccagggcacgaagtgtgggaaagtgggacagaaagcgtgatgtcaagttggaggcggagcgctgctggggcgtgaagagtctcgagtccaagtgagggagttaggaacttgggagggtttgttgttgggtcggggacctggggtcagccaggtggtgacctgggatggggtggggacaggaaatgagttaagctctgctctttatttttttgcagatgcttttctcaaactttcctgatcctgcgggcaagctaaaccagttctggaagaacctgcgggaatcgcagcagctccgatgggatgagagctgggtgcagagtgtgctccatttggttatggacacataactcctgggccagaggctaaaaccccgggacccctgctgtccttcccgcagcttcttctcggagtctcagggcaaaccctttcgagcagcgcctcccagtggccagaaggtgaaatgacggcagtggtgccgcctggtaaatgaattggttctgtgacccgggaagctgtgcttggctctgatttcttttctggaggctcggaaacacttcctatcttcttctgttcttcacgccccatgcccctgctagcggattactgttctgcgacttccgtgtgacctctgcagtactcctcatcctgcgtttgctctccaggtgtcatctttccgccgtgttcctaacattttgattcctgtcttgaaaaaagcacctgctgcactgtaagcccagggatgtggcagctgcagtgggcttggctttgtgaagaaccgagtgtgtccacggatgtggcagctgcagcgggcttggctttgtgaggaaccgaatgtgtccagggatgtggcagctgcagcgggcttggctttgtggggaaccgagtgtgtccacattgggggaacatcatacttgatacacacgtttttatttgcacaaagaaaatgctatttttggagccagagatttcatgtctgattgatggcgattttcttaagaaccagaactgctggcagaaagggagcacccacatgcttagatagctgatgtcttattagagggcagtttgtggttcctgatttggaaattaacattctccaaacattccagtccaatgaaagttttatccgctttcccatataaaaactcttcccactagagtgacttgattctcacaatcccgttggagtcgtatgtgagtcctacagtgtgaggttcagcattgccatctccaagtgctcttcgtagggaaacagtttctggtcatgacgaggttccacttcccatctgatcccagcccggcctggaaacagaggacatgtgtttcaggatggcagtgtttggggacaggacatgagcgtattgtgtggggctgctaggacaggcctggcggggtggggggtgtgtccaagtcagtttacttggttcacaggttcccaggcccacccaggtgcctagaattggcctccaggatgggacaagaaatctggttttgcatagaaatggctagcagcaggcaccgtgccgctgtccactctctgcccgcatctgccccagcacttggcacagcgggacagatgcagagatctgaacccacatctacctggctgctcagtcaacccactattcacaaagcttagaaagcgtccaggcacagtggctcacgcctgtaatcccaacactttgggaggccaaggcgggtggatcacttgagatcaggagttcgaaaccagcctggccaacatggtaaaacctcatctctacaaaaatacaaaaattaggcaggcacgatggtgggtgcctgtaatcccagctacttgggaggctgaggcgggagaattgcttgaacccaggaggcggaggttgcagtgagccgagattgtgccactgcacttgagcctgagtgacagagtgagactccatctcaaaaaaaaaaaaaaaaaaaaaattacacacacacacacacgcacacacacagcttagaaggggctggtgttctcataagcacagatgtctgaagagccgttagccagaatgattctttttttttttttttttgagatacgatcttgttctgtcacccaggctggagtgcagtggcacagtcattgctcactacagcctcgactcctgggctctagcaatcctcccacttcctgagtagctgggatgacaggtgcgtgccaccatgctagtaatttttttattttgtagagatggggtcctgaatgcatggcctcaagtgatggtcctgcctcagcctcatttattatttttttttaaacagagatttactctgttcccaaggctggagtgcagtggtgcaatctcagctcactgcaatgcatcccaggttcaaatgattctcctgcctcagtctcccgagcagctgggattataggcgtgcaccgccactcctggctaatttttgtgtttctagtagagatggggtttcaccgtgttggccaggctggtcttgaactcttgacctcaagtgatccgctcacctcagcctcccaaagcctcagactcttacagtgttggattacaggtgtgaaacactgtgacccgggatgattttcaatcacagctttttgttacgagtggaaaatgcatatttataaaaatgaagtagtacagacatgaacgtgtagaagtctctataatcctgccatccaaggatggcacctgttaacgtgtatatcagggatgtccaatcttttggcctccctgcaccacattggaaggagaagaatctccttgggccacacataaaatacactaatgctagcaatagctgatgagctaaaagaaaaaaaaatcacaaaaaaacctcgtactgtttttaagaaagtttacagatttgtgttgggccgcagcttggacgagcctgctatatatatattctaggttatcccctataggtatacttatgtgaaaatgattattgtgataatttgtttttgagatgaagtcttgctatgttgctcaagggggccacaaactcctgggcttaagccatcctcccacctcagcctcctgagtagttgggaatataggtactcataactatgtgtgggtgattattattattttttaaacaaaaatggggctgggtgcagtagctcacgcctgtaatcctaacactttgggagcctgaggcagcagatcgcttgaggtcaggagttcaagaccagcctggccaacatggcgaaacctcgactctacaaaaaatacaaaaattagccaggcatggtagcacgcacctgtattcccagctactcaggaggctgagatgggaggatagcttgaacctgggaggtgggaggttgcagtgggccgagatggcaccactgcactccagcctgggctatacaaagccagactctgtctcaaaaaaaaaaaaaaaaaaaaaaggtgggtgggggcttatactatgtgtgctgcttggcactgtttttttcacttcaaagatattgcaggtattttttcacataagtatctgaagaaagacttccttttttttttttttttttttttttgcctttttaagacagggtcttgctctgttgcccaggctagagtgcagtggtgagatcagggctcactgcagcctccacctcctgggctcaagccatcctcccacctcagcctcccgagtagctgggactacaggtgcgcacaaccatgcctgactagtttctgtatgttttgtggagatggggtcccactatattgcccaggtaagtcttgaactcctggtgtcaagaagtcctcctgccttagcctcctaaagtgctgggatgacaggcctgagcctcgcgcccggccagcctcctgtgctaggttgtgcgggactctgtcgtggaacccagtgtgtctttgtgtgctggcttgtttgttggctctgtagttaacgggctgctccacgtggacaggcattggacccgtgtctctgtgtgcaggcagaggctgctgcacgtgcatctgtgcacatggctgccaggaggggctgtgctcagggggagctggggcaaaggctggtggcaatgaggggcttgggtgtagtgtggaggcacgagagcctggtggccgggctgcagcctgtgggagctcgggggttgcttggcctctgtgtgtcccagtgtctttgtcggtgggatgggacaatgatagcacactctcacaggtgctgggggctgacaaatgtcaggtctgaggacagtggctggcccactacggggccagttccccttctctatagtcaccctgctcgtcttccatcaactgggtgctcaggacagtggcgtggtggatccgcctgtacagcctgtgctccagtgtcctgcaggccacagctgtgtccagccctgaccccgactgcccctcctgccacctccattttatagatgaggaaaccgaggcccaagggcttagggaaccttgctctgaagcacacagtagggctgctgggctcagatcctccctccctgtgctgagctgccctcctcctgccacaaggcccccacaccccgagcccacatttctcaccggcctctgccctagttccccacatggtgtgggagtgtggggcttcctagcttttccccggcccccagttctttcacttccactggagtcccgcagggacagcttggggaccatgcaggcccgggtgggcgtgggggctcacatagctcagtggtgaacagctggcacgtctctgggttgcagatggtaagggccacatagacttgaggagcccgctggtgctcccggcaggcagccagcctccgcaggaccccgaccagcgacacgatggcttctgggctatacagcacgtctacggtgaaagcttcaggttactgaaagggaccagcggacagttccaggtcatgctgacctcagcagcagggcgaggccagagaggcagcggtcatatgagactagtagatgccatttgaccatttgggccattagatggaaaggcaattacttgggtgaaaaaggagaacccttagtagagaaagctgcaaaagaccgaagcaaaagaaaaaaatctccagactcactggtgttccttaaaaaatgagttctggttctcggcctatctagagggctgtgaatgacacaaagcctgatcctgccatgaacttcgtgtttcaggcgtctgccaatttgtctgctggcttgcaggggtgggcctgtgtccctggccaccgctggacctgtggttttcagggctgggacccaggaccacaggcagagctctgttcgaccagagaggagactgagtgtgctggcaggggcgaggggttttcggtggcccagccaaacaccaccttctctcaagggccctgtcctcatcccagaagtggttgttttcctcctgtggtctctgaaagacacagtcatgactctgggacagagccatgtggtgatgactgtaacgggagtatgcctgtctccaacaaaagggctgtggctggaaggtcaccttaagagacacccctgtcctttgacgtcaccctggaggcccagagtaactcttctggaagccccatcatgtccatgcccgacagtgtccattgttcccttttcccagagccaagagctgggtagagcttcaaggacaccgcctgcacagagtgcccggggctgggcattacctgctgcaatgacaacatctggctggattgcagattgctgacggaccgtcgcgacgtcccagtccagctgggccactgtcaccctggggctgtctaagttggcagagatatctgcctctaatgagaggccactgagaaggacattccctcagagcttctcaaggacccggctgtgacagtcgctgaagatgtatgcccaggggcggcacatcttgcagatggccaggcctgtgaggccggcgccactgccaagctctaggaccatcctggtgggaggaaaggggaccatgtctgcgactgcaccagggtaagcctgcctcggtgccctgccgtgcaccccgaggtcacctatgagagaaggctgccgggttctcgatggcccattctgcaaggtagagggcagcatctcatgtgaccaggcctgtgatgccgtgggagatgatggctgtgttcttgaagagtgtgactgagcctcctgagggctgcaccaagagagggagagagagtcagtccagcgatcagaaggcaagtggcttagaagacaagtagccatccaccacatggctgaataaaccatgacaggaccaatcgccactcagcaaagagaagcagctaactgttgacatgccaacagcttgcacaggcctcaagggtgtcacatggcatgaaagacactcatctcaggccacacaggatttcattcattgaacattcctgaaacaatggaattctggtgatggagcacaggtcagttgtggccaggggccgggtgtggctatgaaggggtggctgccttgtgatgattcaatatgctatgtttttcctttgtggttttctgtatctatgttttatcttattttttttttgagctctgttccccaggctggagtcagtggcacaatcttggctcactgcaacctctgcctcctgggttcaagcaattgtcctgcctcagccgcctaattaggtgcaactacaggcatgtgccaccatgtctggctaatttttctacttttttttgagacagagtttcactcttgttgcccaggcaggagtgcattggcgtgatcttggctcaccacaacctccacctcctgggttcaagagattctcctgcctcagcctcccgagtagctgggattagaggcacccactaccacacccgctaatttttgtatgtttagtaaagacagagtttcaccatgttggccaggctggtctcaaactcctgacctccggtgatccacctgcctcagcctcccaaagtgctgggattacaggcatgagccaccacgcccggcctaatttttgtatttttagtagagacagggtttcaccatattggccaggctggtcttgaactcctgacctcggatccacccgcctcagcctcccaaagtgctgggattacaggtgtgagccaccacacccggacctgtcaagtattctttgaggactggacaccaggtccttgtgaagcaggtagagtgtgtcacctattggacaaatgcccaacaaccccatgagacatgctgttgttgttgaagtgcttgatttacagacagggaaactgaggctaaagaaggttgatggacctcatgtctaagactgcagactgggtgagtcaggatttgaacccacacccacgttttcactttgtctgtgcaggaagggtatctgggctgtgagggggaggagggtgtccttctcataccagcaaatagctccggtggccctgggtggactccttggccatcagggtctccgccagcacctcgtacagctcgtccaaaggctctgtgtggacagcctcgtgctgggggcagacagagtgagagcttgtttgctttcgttctaatctgtaaaaatggtcagatgattttcaccaagtttggaggggagatttgggatggaatggtgtaataccggccagctggcatataaaacattcacttcattgggcttggtggtgtgtgccgaatagtcccagctactctagaggctgacatgggaggactgcttgagcccaggagttcgaggacagcctgggcaagagaccttgtctctaaaaaaaaaaattcacttggtagggaaacctggatgggagggccttcaacgagaggtgttgagagggtagtgttaggtgtagtctaaggcaggagacaaggattccgtgagagctgccacatgaccatgacagagaggaggaaaaccaaaggtgcttttaagtgagcccaggcacaactgtgagggcggcccatgctgcaggctgtggctgtcagcaggctgcttctccacggctggccccatcctaagattcacagggcagcagcaagatacactgggtgactgctgccctctcctggtggcacagggcagacctgctggtgaccacagatgcacccttttggggaggattagggagaaagcaggtattggagaagcaggggattgtttacttgctaaaattgtggccctttcactcagcaggtctgctactgcctactgagcaacagcctctcgacatccttatgtcaaaccctgcatgttcgggcccatctttaaaatccatcctaggccaggtgcggtggctcatgcctctaatcccagcacattgggaggccgaggcaggtggatcacctgaggtcaggagttcgagaccagcctggccaacatggtgaaactctgtctctactaaaaatacaaaaattagccaggcatggtggcgtgtgcctgtagtcccagcttcttaggaggctaggcatgagagttgcttgaacccaggaggcagaggtttcagggagccgagactgtgccacggtaatccagcctgggcaacacagtgagaccctgtctcaaaaaaataaataagtaaaaaataaaatccatcctgtatcagtcaggaaagagcacattccagcaggatcaatgccgagaattcaccagaggaactagttccaaagttatggcaagagctaaaccttccaacaggggcccgtggggcaacccagagacggacaagagcaggaaactccaaacccttcggcaggcaggacagagggtgtgggtgcaggttccagtgctgtgggctgggctagcctggtaggaatgagaatccatatgctaggagctggggccccagagaagcagctgcggcggaaaccccaggaggcagagtgagggagagacgctggcctccccttcttcccgccctgcattgtctcccatgggtcacacgcggctgcagccagttgcctggttaggcccctgccatgctggggtttgcaaagcaggcccagggcctgggaaggatgggggctccagcacgcaggtggctatgctgtccagctactgggcggacactgcccataactgacctttttgatgagttctgagagaaagcaccaggcatacttgactgatggccggtgcttcacacacacaggatgcttcacagtctaccgcaaaggacagaactttggttgctcaagagcctgtcttaagtctcctatgagcttcaagccaacacggcagagggcaaactccaggctacccgatccctcagcaaagatgtagatggacacagcgttctggccccatgcatctgaagtttgtcttatgatataagccatttcctaaaaatgcttccactgcagtgtcacaggctatggcagcatttctaatgcccattctgagcaagaacgcagggcacgtgggcccaaaccacctccctcccaggggagccagtgtgaaccagggtttgcagtaaagacagtcgccaactgtctggctctatggaagaggagggaaggcccacttggcaactgctctcttgcagcgtgtgttcctggggatgggatggaggggaggggacgctctgggtgacactccagctaaagccgagagaaaccaagtgcaggacgagcaagttccagacagtggcaacaggtgatgcaagctctgaggtggccatgtcctggcacttggaaaggagggcagagggactggtgcagcaggagtggggatggtgggaaaacaggagcctggagggagagggaggagacagtctgcagtgcctgctggctgggagggatgcagattctgcccaagggcagcaaagtaccccacgcaatacacaggctcttcatgctcgtgctggtttttcattttttctgacacagtctcgctctgttgcccaggctggagtgcagtggcccgatcttggctcaccacagcctctgcctcctgggttcaagcgattctcctgcctcagcctcctgagtagctggtactataggcgtgcaccactacgcccagctaatttttgtatttttagtagagatgggtttttgccatgttggctaggccggtcttgaactcctgaccttaggtgatccatccacctcagcttcccaaagtcctgggattacaggtgtgagccagtgcgcccagccttctgctgggttttaaagcagctatccctacatttcatgcttcaccacctacgagagtgaggctcagggtgaaactcagagcagggtgcgagataacttcaggtatctccatgctcgaagccctgacctactgcattgccccaaaagtcttccctgctgtggctgcatcttttccacatggataatcttggttcacctctagcacaggaattcttcactggggatcctaggatgggctgggtgggtgggggtggaggatgtctgcctcgagtttgtatggaaaatgtattcttctggtgcacttctttctgggagggagtctattgctttctcttttcagaaggactcatggcccttcgaaggtgaagacccaggatgcagggtgatctgcacttggccctcaaggccaaggtcaggctgtggctgggccgggtggtgatcctgcctctcacctgcatgcagatgctcttgagtccaaaccccaccctgggcaaagtaagggcccatttaggtctagaagagacaggagtgggcaggacaggcctcatgaatgcaaaaaagaaagtctctgaacatctaccaaattctagaagctgttttgcacctgtcatctctgtttttgctgtggatggtttaaaaactttccctagattcccccctctcatgcagatttttgtatattctgatgtctttgtctaagtcttagaaaatgaaagagctggagctgtcggaggtgacgacacccacctgcagtgctgactcaatggttttgttctttgaacaggggtgtttttaaagggtacaagcacacctgtgcttcttctctcaggtcttccggagagattcaggaggcagggtcatgagtcccagggactctggaattcttaccttctgcaaaatatcccgcagcagctcagaatctgatgagtctcttaactttgcttctaagctctgtgtggaggggagagagagaaatctcaagggtgcattcacaggaacattaagcacgcaatagaatgtgttggcaaagcgctgtgtgatctctccccggggacgtggagccagttggaagtggaagccacagcagctgaaagcctgaccttcagatgttgcagggtgcacctggatgagtcacaggaagaaggctagaagactgactcttggccgcattagtcctggctacttagcggccacccgggtcatgggccagctccctggttgcacttgtcagccaggattgcactggttaccagggcagccatggcaccaaggtttgatgggcttgccatctgagtttaagtggaaatgcagaatgttcccataccagcctgggttacattgtcctcttacaggggcctcaagcccagcagcgaactttggctcccgaattaggtagactgtctcggctggtatgtgacacagggcaaggcacttcattgcttcagagctccttccatgccgtaaaaggtcctacaagacctggtcctaatccctctctctggcctgttctccctcgcccctggcccaccctgctcactccactccagccacactggctgccttgctgttgttcctcaacaacagctggcttgtttccaccacaggacgtttgcatatcctgttccccaagcccttcccatggctggctgcttcaccactcaggccccatttcaaatgccacctctttggggaaggcttccctgattccccgactttggtgactcttctccccagttgctccattcaccatttccctgttttattggctttaaagccactctcatctggtcttttcttgtttcttcatttatttgtttattctctggctctcccatgcaagcagagcctcatctgtcataggtactgctgatccatggtgcctggctcacggaaggcatttattaaacattttgagactgaataaaaacactagctaacaccaacatgcatttaccatgagccaggcactgatccacaggcttttgtactcaaccctgacaacaaccctaagaggtaggtatcattatatcccccattttattaataagaaaacaacagcacagagagatgcacttgcccaaggtcacacagggccaggggttgggccaggattcgaagcaggcaggctgtctcctgggtctgaactctcaactactgcacctaatcaaacaatccctctggtcaaatgtgagtgatgataatagtacccacctcgtgggtgttgagggtgagcccaagttagctttcagcgtggcatgtgaacaattatagtcaatattgaatggagacctatgatgcttttatgaaggtttctattttgggttaaaaatgcacaaatttctcctgaccagaaatgatctctgagtgctaaatatttcatgtcaatggaatagcgcaaatgattaagcaacaccccataaaatggggcagacccagggaggaatatatatccaaactgactcatcccagtgagctcaccgcacatggattacaaatggggccgggtgcattaagcccctctactggcagaagggaggctgctgcctgccatgcgcctgtgctgagaatggcaggtccccagggagacgagaggccacccccttctctgtctcttccatcacaggcgtgagagcctcagagcatgagccaattctgtgcagtgctcgacatacagatgagaacactgaggcacgagggacagcctgtgacctggtcaccacgctcaggaggacgtggttacccgcggtcctgagggcgctgactttttagaatgggcgagggcagctctgtcccagtgaccagaacggttactgcctttaaaaagtcgtgaaaatgatagtgaactgtaccccacaacgagtgcgcctctgccccccaagatggtggagaggcccccagcttacgccgccagcacgcggggcaggaggggtgcgagcgactctggccaggccccagggacgggaaacgggtcgcgcggacctgaccggcgggagcccaggcactcacgtggcgtgagcgccgggggcttcagcacagagacccatcccatctgcccctggactcccgcgagccccgcgggcctctccgctcgccccgccgcccacctgccaggggaaggagcgcagtgcacgcgccgccaggaagcggcgctccaaactctgcagcaagagttcggtccccgcgttctcctcgggcgccatgacgtgggcggggccgcagcgtt

SEQ ID NO: 449 - DNA, 4355 bp, Homo sapiens
accgtcaactcagtagccacctccctccctgctcagctgtccagtactctggccagccatatactcccccttccccccataccaaaccttctctggttccctgacctcagtgagacagcagccggcctggggacctgggggagacacggaggaccccctggctggagctgacccacagagtagggaatcatggctggagaattggatagcagagtaatgtttgacctctggaaacagtaagtcaaaatgaaattgcaattcctttaataagcttttatattgaagttagacttttataaaattacaaacacctacttggatgtctctcgtccaaatgctgggatctctccctaccaaggtgccccaatctccatttctctttctgtcttatttctttctggcctctggcctctagctttttgaagtttaattctctgtctctcctctggcagtcttagccctctctttaccttattacctcaagactcctgatgaagttttagaaggagttccctacgtcctctattctgtagttttcttaccaaggccaaatatgacctcagatgatgagtcactgatacccttctatcctgcccccacttagcaatgcccttcacattgagattccaagcatgggggctgctccctgtaaatgatttctccccacaactctagtccctccattctattctccctcttgcaggactcttcccccaatcatatccttacccataagataggggagttaggcaggagggatttagcccctctccaactcctgtcatcataaaagactgagaacttcagaatttgaaaagaagagattaatggaaggagtgatatttgggaaaatacaagaactgttgacttagaaaaaacaaatattgatttgcatgtttggtttgcatcccattattccatgagagagggagattaaaattgcagctctctagagctgatgaaaagagattggtttccttttcatttgaatactgatattctagacgggatgggtatgccacccttaatccttcttgtgttctgacacaaaggaggaaaagaaatgtatgactcctagagggcatctcctcctaatggagagggacaaataagaagtatgtttctgaaatattttcaggtcctaattttactagggtacccactaggattactggtatctgatctagccccatgattcctccatctttgacatacctgctgtttggtagctcagaatggagcaatacagtggactctgcccccttgagttcactcaaccttccctccacccccacctaggggtattgcacaagggccctaaaagtggccacaggaacagggcaaagaggcttaactgccacacttatagtttgaggaactccaatctccccaaattccagtctgttcatccttttcttgatctccccagattcactccacattatccttaccaatcttcaattcttctctctctccatgtccagccaaatttcttttttcagtcacttacagggcttccggtcaaaattcactaggtaggagggtcatcagctgggaagaaccggcgcctgggaaacctggctggataggtatgggggagccaggccagtcccctagtcccaggtcctcccatggcagtcccccaactctaagcactctcactctcctgctgctcctctgtggacatggtaaggaagggccagggaagggtttggggaaatctagagggtaggctgctatgtaggggtgggcatgtgagcctgaatgagtgaggagagataggcgctgagagtcccgatcactcgccctgctctcaaatactaatattttatttcccgttcagtctggggaaggccactggggaagcccttggtcgacaggcagaagagatgtggcaggcttacacacttttagtaagacagccgagagaactagggactagggggttgggggctggggaaggcccttagttaggttttaggaaggctggaaacccctgatgagatttggaagagttatgagcaaactacactccgatagagcagaggtctgaggaccgtctcacaatcctctcccttctgtctttagctcattctcaatgcaagatcctccgctgcaatgctgagtacgtatcgtccactctgagccttagaggtgggggttcatcaggagcacttcgaggaggaggaggaggaggccggggtggaggggtgggctctggcggcctctgtcgagccctccgctcctatgcgctctgcactcggcgcaccgcccgcacctgccgcggggacctcgccttccattcggcggtacatggcatcgaagacctgatgatccagcacaactgctcccgccagggccctacagcccctcccccgccccggggccccgcccttccaggcgcgggctccggcctccctgccccggacccttgtgactatgaaggccggttttcccggctgcatggtcgtcccccggggttcttgcattgcgcttccttcggggacccccatgtgcgcagcttccaccatcactttcacacatgccgtgtccaaggagcttggcctctactggataatgacttcctctttgtccaagccaccagctcccccatggcgttgggggccaacgctaccgccacccggaaggtcaggcactcaatcttccttccgatccacctcatgagattcttccacgggcaccattcctccccatccccactattcaacagcaatgctccctaattcccttttcttcctcaacctctcccccatctcgaatcactcccttctaccaaacacctggagctgtaaatcacttccccttgatgggaatttgactcaaatgcagaaaaccttgaagagacagtcggagagggcggacctgaggagtttcagaagggaaacttttccctctcctaggaagttgccacgattaagtagagagggggttaagtagggatgaggtaatactggaacataaataggagaagggatcaaggattgagggccatagtagtcctgcatctctacttggatcagatctctaactatgtatgaggtctgattggggggaagatgcactgaacccaaaatgaactgttttccctcttgtcctcacagctcaccatcatatttaagaacatgcaggaatgcattgatcagaaggtgtatcaggctgaggtggataatcttcctgtagcctttgaagatggttctatcaatggaggtgaccgacctgggggatccagtttgtcgattcaaactgctaaccctgggaaccatgtggagatccaagctgcctacattggcacaactataatcattcggcagacagctgggcagctctccttctccatcaaggtagcagaggatgtggccatggccttctcagctgaacaggacctgcagctctgtgttggggggtgccctccaagtcagcgactctctcgatcagagcgcaatcgtcggggagctataaccattgatactgccagacggctgtgcaaggaagggcttccagtggaagatgcttacttccattcctgtgtctttgatgttttaatttctggtgatcccaactttaccgtggcagctcaggcagcactggaggatgcccgagccttcctgccagacttagagaagctgcatctcttcccctcagatgctggggttcctctttcctcagcaaccctcttagctccactcctttctgggctctttgttctgtggctttgcattcagtaaggggaccatcagtcccattactagtttggaaatgatttggagatacagattggcatagaagaatgtaaagaatcattaaaggaagcagggcctaggagacacgtgaaacaatgacattatccagagtcagatgaggctgcagtccagggttgaaattatcacagaataaggattctgggcaaggttactgcattccggatctctgtggggctcttcaccaatttttccagcctcatttatagtaaacaaattgttctaatccatttactgcagatttcacccttataagtttagaggtcatgaaggttttaatgatcagtaaagatttaagggttgagatttttaagaggcaagagctgaaagcagaagacatgatcattagccataagaaactcaaaggaggaagacataattagggaaagaagtctatttgatgaatatgtgtgtgtaaggtatgttctgctttcttgattcaaaaatgaagcaggcattgtctagctcttaggtgaagggagtctctgcttttgaagaatggcacaggtaggacagaagtatcatccctaccccctaactaatctgttattaaagctacaaattcttcacaccatc

SEQ ID NO: 450 - DNA, 4355 bp, Homo sapiens; identical to SEQ ID NO: 449

SEQ ID NO: 451 - DNA, 4355 bp, Homo sapiens; identical to SEQ ID NO: 449

SEQ ID NO: 452 - DNA, 4355 bp, Homo sapiens; identical to SEQ ID NO: 449

SEQ ID NO: 453 - DNA, 4167 bp, Homo sapiens
atatagagacgtttccgcctcctgcttgaaactaacccctctttttctccaaaggagtgcttgtggagatcggatcttttctccagcaattgggggaaagaaggctttttctctgacttcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacaggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggtaaatatcagctaaatgcatctttgaacttttctgtctaaaatatcttgccctcctttgatcacttactgttcttggagagcgttttaaaattttcattttcttgacacaggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggtgagatccattttaaagattctattctcctgggtcatgaggatgataaatcagacgtcttgggcattagattgaagcatctcaaaacacctttttatccccttctatataggcacctgtgtctgctaaaaaagaaaagaaagtttcctgcatgttcattcctgatgggcgggtgtctgtctctgctcgaattgacagaaaaggattctgtgaaggtaaaatcctagtgcttatggcagttaaaacaggaactgggtttaggggcaagggcatgggactggggtagaggaagtgtcattaactatactgagtatcagtaagttttcatctttctcattgctaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactggtgggtagatgcagggtggcttcagcagagaaattgttcatctgttaccacagctgtcttgtttctccagacctctggtgtaataaactgccatcttcctttctagatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaaggtgagccagacctaatgtcttttctttgtttctggtctacctgggtttgtaaaattgtgatggtccagcatttcttgggcaggattcttatgtggccatattttcttttctagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtgaggattgtcatctttactgttaaatttgtcctaagctttctataagaagttgacttagacggattgctaaactggtttgttctttttgttcttacctgaactgaaatagtctgtttctttctttaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttatgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttaagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgccgaaccctgtgttcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaa

SEQ ID NO: 454 - DNA, 14152 bp, Homo sapiens
gacagataaaaacactttatttaaaagtataaaaccaggcttactccttcaaactgctcccacccctaattatctccacaaagagctatataaattgggcaggggtatgtgtacagtcatctcagctctaacaaccccagttcttctttcaattctcctttctcccttcatacaattgagatgtttgtcctttgcactttccccaagatagcaaaggtgatacaaatgtggaaggaggggaagtgtagaaaataaactgtcatcatcctctattcccatctccagggaacagacagattatatgaactctgaccaaatgatttgcttgtctgaagaaacaaataataggtacagttactctctgtatcctaaagaaagacacgagggtccagagtccttcttcagtatatagcctcgtccatattgtcatcactgtcaccaccaaagtcctctccattgtcaaaatatgacatgatgtaatcagtttcctgaaatggaaaaaaaaaaaaaagtaaaagtcaatttggcattcaccttccttcctgtgtaccagacccctttcctctcagtcacaccattccaggcctgagacatctcttccagctgtagtttgtagaaggggggcagatgaagtagagagaagcccctaccctggggggcactatctctgttggcatgccaaccctctgaggagagcaaccctagtataaagagggtaaagggagggggactaaggtggaaggagtccccttcacctcttcatgttcttcttcatcatactcttcttcttcctcctcttccttctcttcttcttcttctttctcctcatcctcctctgaagttacttcttcttccttcttctccagggtctcatgtggggatgaataggaatagaaactcaggttcagttcacagaagggaaaaattgaggcacacatgggccaagagagagggaatggatccagggctcaggaggtctctatgcacacttcctcctcacctctagtttctgtattgtttcctccttatcttctgtggtcttagggggcctcttggggagcagaattgtaatccctggtggagggatcaaaaggtaaaccttcagagagcaaattttgccagctttatagcccatcctcatgcaaagaacatgtcactctgctgccctcatgtggccactatgacatctagcaacaacacttggtagattgggtataggaactgggatggaaggtgagaccagcagcagcctcggccctcaggctgatgaaggaaacctctcttctccctccttttttccagatacactcacgttccttctgtagcttccgcactcggatctttagctcccggggtagacgccgccaatctgggaatagtgggaacgtaaatgtcaataggaccctgcctggggtctccagtgaatactgactggttttaaaggggggtgagggttttaaaggagaggaaggaaggggctgggccaaagttgttcagtggcttggatatctcctgagtagtgggaactatttaatagctttttcaggtagaatctgagaatgtgttggaccataactaaggctctagcttgcagatgctggatcggggaatggggtggggtcatgggcgtggtgggaatagcttgaagcatcccatgcatttgaaagaagggcagtcaatgaaagggcccatcacctaccagggttccaatcgatggcattgtcaatcggacctgacatctgatatttgtctgaataacgctccacatctgaggggtggaagggtcaaagttttatcccttcagagacccagaacaggactgttcctgagagtccagccctctcaatactgaggaattatctgtttccttaccccaaacccagagcccagggggtcagcttcagtgaggaccttatcacttttttttttttttttttttgagacagagtctcgctctgtccctcaggctggagtgcagtggtacaatctcagcttactgcaacctccacctcccaggttcaagcgattctcctgcctcagtctcctgagtagctgggactacaggcacacaccaccacgcctagctaatttttgtatttttagtagagacggggtttcaccatgttggccaggatggtctcaatctcctgacctcgtgatccacccacctcggcctcccaaagtgctgggattacaggcgtgaattactgcgcccggccccttatcactcttctaacctgttccttttccacccaaaattacgattttttttttttcagacagaatctcgcactgtcgcctgggctggagtgcagtggcgtgatctcagcccactgcaacctccgcctcccaagttcaagcaattcttgcctcagcctcccaagcagctgggattagaggcatctgccaccaggcctggctaatttttttgtattttttgtagagacggggtttcactatgttggccaagctggtcttgaactcctgacctcgtgatctgcccacctcagcctcccaaagtgctgggattctaggtgtgagccaccacacctggccttttttttttgagacagaggtttgctgtgtcacccaggctagagtgcagtggcaagatctcagctcactgcaacctccacctcccaggttcaagcgattctcatgcctcagcctcagcctcagcctcccgagtagctgagaccacaggcacacaccactgtgcctggctaatttttatatttttagtagagacagggtttcaccgtattggctaggctggcctcaaactcctggcctcaagtgatccacccatgtcagcctcccaaagtgctggccattacaggcgtaagccaccgcacccggccatgatgattttttttttttctgtcccttagttcaaaggcatggctgtattaagaaatagcgtggtgcagtggaaagtatgctagggaataagaaaccaggatttcagtattctcttgttggttggtgcttataatatccagattgttaaaaattttgctgggcgcagtggctcatgcctgtaatcccagcactttgggaggccaaggcaggagaatctcttgagcccagaagttcaagaccagcctggacaacataaggacaccctatctctattttacaaaaaaataaaaaatatataattttttagaaaatacatccccctacttatacacgtgaaatgggattttaatatttaacctcctgctgtcccaagactatcatgagactcaaaacaaaccatgaatactataatgcatttcagatacaggggtaactattatgatctccccagttagatagtatgcttcctgtgcccctctggcccccagtggtgctgagcacagggcactccccatggaaggcactcagaatatgatgctagcattccaactgacctctcttggggacagctggccggatgaagtaggggagctgcctcatggctcctcgtagctcttgcttcagtgccaggacatattccccttcctcgcctgagggcaaaggtactgggcggaactccaagggctaaagaggcaggggcagtggtcagttcagggagaaaatgctagtacaaatttaggaagacccctcctcccaatttagtctaacactcccactgagcagagggccaaatgacaatcgagggagtaacatattattttgaaagctggggagaagtaaaggtggacacttctttgcctgcaaaacatccctgtgcattgggagtatagagagagggccaaagcgaggatggttttatgatggtccaggaggaattcagaatcatgtacagtcagccaggggcacatgagagtctgggaagggagtggagagactcacagggaagagtggagaaggctgcagggtgggtgggggcaaagcatcccctttcccaatgcccacggcctccacgttgaaggtcaactggccccggccacgaccccggcccccaccccggctggccatggtggagggggcctgggtattcagagatccagtgaataaacctaataaagacaaaaacaaagagaaaaagaaatgtagtagaatggacaggaagccaaggaggtacaagacattcaatcttttatctctgggacatgaaaagttaatgtcattcaacaaattttgactgagaaggcacagtgtcagagagagaatttctggaaatataaacatgaatgagacatggtcccccaaacaggtcagataattacaatatagtttagcacaaaggagaaagtgctgacacctttggacaaaactctacatccctaagacaatttgatgtttatctctatctgcatttctttatttttatttttagagatgctctgtcacccaggcttgagtgcaatggtgcaatcacagttcactctagcctcgaacccctgggctcaagatcctcctgcctcagcctcccaaagtgctgggattacaggcatgaaccactatgcccagccacaaactgcatttctacatataacctttgaattctttctatctctggccttccaaacctgaccaggccccaattcaatccaatgcaatgcattcggcgaaacatttattaatcgtctaccatgaaaaagatagtgtgtcaggcactgtgggagcacagggatgagtcatcaatttcattgtaaaccaggggaaaagacacattacaatcaaattgatctttttattttattttatttgagatagggtctctttctgtcatccaggctggagtgccgtggtgtgatcatggctcactgcagcctcaacctcctgggctcaggtgatcctcctgccttagcctcccaagtagctggagctacaggtgtgtgccaccatgcctggctcttttttttttttttttttttttaagagactggatttcattatgtcaagtgatccaactgtctcagcctcccaaagtgctgggattacaggcatgagccaccgcgagaggccaaattgatctttttaaacaccacttggaagcatagaatcttagaattgggaggacccttatagaggtcatctagtctaaacccctcccagtgcaggacttcactctgtaaattgttttgttgttgtttggtgtatgtgtgtgtcttctttttttttttcttgagacagagtctcactttgttgcccaggctggagtgcagcagtgcaatcttggctcactgcaacctctgcctcccaggctcaagtgatcctcctgcctcagcttcctgagtagctgggactacaggcatgtgccaccaagcctggctaatttttgtattttttgtagagacaggatttcgccatgtcacccaggctggtctcgaactcctggactcaaatgatccacctgcttgggcttcccaaagtgctgggattacaggtgtgagtcaccacccctgaccctactttgtgaattgttattcagcttttggtggcatttccctaaagagatggtatccattctccccccaagacagtatattccactgtgatcaacactgatgaatctaaagtttctccttctaccgaattttcactctgtctcttatcatcaatcctgaggaaccagtcagaggcagctaggatgggggaataaaatcaccagatgaaaagaaaacttgagagaaatgatatcccagtagcaatgagcacacctagcacccagatcttggtttctcatacaattttccaataaaaggaaccagggctctctggactactagctgattctaggacagggtaggaaatatacaacatgagtctagagcatcttgaggtgccaaaaagtaaggaggtgctcaaaacaacaaccacactcacatattgatgggttagctgggtgcagcggctcattgctataatcccagcactttgagaggctggagcgggcagatcactcgagccctaggagtttgagaccagtctggacaacagggcaaaacctcgtctttacaaaaaatacaaaaattagccaggcatggtggcatgcacccgtggtcactgggtgatccttccctactgggaaggattgcttgagccggggaggttgatgctgcaatgttatgattgcaccacttgcactccaacctgggtggcagagtaaagactctgtctcaaacaaacgaaaaacaaacaaaaaggagaaaaaacgaaaaaaataaacatattgatgaggctatgtcaaagggacataagagccaactgaaaaagttcccaatggccaaagctgaaacaatttgaggaacaaaataaataaagcagtattagattataaccccaaagtataagataaatatctgtgagtccatagtgatataaataaatgactgaatttatttatatgggggaaaaaagacaaatctctcatgtagaattccaaataaaatatgtagacactccatcctaaaagggagcaggggagcataactccccactttttttttttttttttgagatggagtttcgctcttattgcccaggctggagtacaacggcacgatctcggctcgctgcaacctccacctcccgggttcaagagattctcctgcctcagcctcccaagtagctgggattacaggcatgtgccaccacgcccggctaattttgtatttttagtagagacggggtttctccatgttggtcaggctggtctcaaactcccaacctcaggtgacccacccacctcggcctcccaaagtgctgggattcaggcgtgagccaccgcactggctataacttcccacttcttatgtgtggactgtgtatagggaatttctctctctctctctctctatatatatacacacacacacacacacgtatatatatatatatatattttttttttttttttttttttttttttttgagacagagtctcactctgtcacccaggctggagtgcagtggcgcaatctcagctcactgcaacctctgcctcccgggtgcaagcgactctcctgcctcagcctcctgaatagctgggattacgggcgcacgccactacgcccggctaatttttgtatttttagtagagacggggtttcaccatgttggtcagtctggtcttgaactcctgatctcatgatccgcctgcctcggcctcccaaagtgctgggattacaggcgtgagccactgcacccggccctcattcaataatttaggaaatcaggaggaatatctttacagtggagagaccagaaaaacactacttcaaccagatgaccaaggtcagcatcagtactcataaatcatgttttcggtatgtgcccttaaaattacatgataaaatggtacttcacctctgtgatcatcctcctaaaaacccataaccccacactaataaagagaaaaatatcaaattccagcagaaaggcatcctacaatatacccaactcctcaaaactgtcagtcatcaaaaacagtaaagtctgagaaacccgtcacacttaagaggagcctaaggagacgtgacaactaaatataatgtggaatcctaaatgggattcatgtacagaaaaagagcaataggtaaaaaccaaagaaatgtcaatcaagtatcaaccttagttaataataatgtatcagtattcattcattaattgtaacaaatatacgaatcaattttttttttttttttttttttttgagatggagtttcgctcttgttgcccggctggagtgcaatggcgcgatctcggctcactgcaacttccgcctcccaggttcaagcgattctcctgcctcagcctgctgagtacctgggattacaggcatgcgccaccacgcctggctaattttatactttttttagtacagagggggtttctccatgttggtcaggctggtctccacctcccgaccaggtgatccatccgcctcggcctcccaaagtgctagattacaggcatgagccactgcgcccggcatttttttttttttttttttttttttttttgagatggagtttcgctcttgttgcccggctggagtgcaatggcgcgatctcggctcactgcaacctccgcctcccgggttcaagcgattctcctgcctcagcctcccgagtagttgggattacaggagcccgccaccgtgcccggctaatttgtttttgtatttttagtagagacggggtttcaccatcttggccaggttggtctcgaactcctgacctcgtgatccacccgcctcagcctcccaaagtgctgggattacaggcgtgagtcaccgcggccggccaatctacaatgttaataggggaaactgtgcactgggacaaatgggaactcttggcactatctgctaaatttttccgtaagtcttaaattgttctaaaatatataatctattaattaaaacaaaaacaaaaaacaaaaaaaactcgaggctgggcgtggtggttcacacctgtaatcccagcactctgggaggctggggtgggatgactacttaagtccaggagtttgagaccagccggggcaacatagtgagattccatctctacaaaaaataaaaaaattagccaggcatggtggcacatgccagtagtcccagctacgtgggagactgaggtggaaggatcgcttcagcccgggagataagaggattcagtgagccatgatcatgtcactgcactcaccctgggtgacagagaccttgtctcaaaacaaaaagctaaaacaaaaatcaagtagcaattcaaaattcccaagagattagttggtgaaaaaaatatttaaaaataatatgtagaaggtaatcttctgtcagaaatacatacacacatatgaattaaaaatctgttatagaaggatatgtaccaaaaattaacaacggttaatttgaaggatgagggttttttgaattttttctggtggggagagttgtgtatctttttttttttttttttgagacagagtcttgctctgtcacccaggctggagtggtgcagtggtgcaatctcggctcaccgcagcctccaccttacgggttcaagcaattctcctgcctcagcctcctgagtggctgggattacaggcacccaccaccatgcttagctaatttttgtatttttagtagagagggggttttcccatgttggccaggctggtctcaaactcctgacctcgtgatctgcctgcctcagcctcccaaagtgctgggattacaggcatgagccaccatgcccagccaggttatgtatgctttgtttttttctatactgaatagaatactataacaacattaaaatattaatttaaaaatttttggctgggcatggtggctcatgcctgtaatcccaacactttgggaggccgaggcaggtggatcacaaggtcaagggatcgagaacatcctggtcaacatggcaaaaccccgtctctactaaaatacaaaaattagctgggcatggtggtgtgcgcctgtagtcccagctactcaggaagctgaggcaggagaatcgcttgaacccgggaggtggaggttgcagtgagccgagatggcgccactgcactccagactggcaaaagagcgagactgtgtctcaaaaaaatttttttttaatgggccagttgtggtggttcatggaggtaatttcagcactttgggaggccagggcagaaggatcacttgggcccaggcagtcgaggctgcagtgagctatgatcacaccactgtgcaccagtctgggcaacagagtgagaccgtgtctcaataaatagataaataaaatttaaatgtcgtaacagaatactaaatgagattaataatctgtagctaggagagggtagaaaaatgtatatctgaggaatctgggaagtttcaagcccaactgccataaaaaaaattgaggaaacaatggctgttggttaagatatcaaattgcaatctgtttgaaaagagcatattaagggagagaagatgtctcatggagactagagaaataataagaatttgttggctgggcgtggtggctcatgcttgtaatcccagcactttaggaggctgaggtgggcggatcacgaggtcaggagttcaagaccagcctgaccaacaaagtgaaaccccgtctctactaaaaatacaaaaaattagccaggcgtggtggtgcacgcctgtaatcccagctactcaggaggccgaggcaggagaataacttgaaatcaggaggcagaggttgcagtgagccaagattgtgccactgcactccagcctgggcaacagagcgagactctgtctcaaaaaaaaaaaaaaaagaatttgtcaccgtgtcttcagccccttttaagcgagagaacattctaaccagctggttaagtatctttccacttgacagatatagttctggcagtggagataggagctgctgtgactgcaaagcaatgaagagtcaataaatggccatgagtttgaggttagacaaattccacaccatttctacacattaaatgagtgatcctctaagaatgcaggggaaaaagaagacaaaattttatttaatacaggttgggaaataaaccatccatctgccccattcatcttaggaatctatagggagtctctgctattaaagattgtgatggagttaaaattcttgaggatacttaaggtctcccataatctagtcacaatctgctcctccttaacatcaacctttccagagagtttacccctgtactctgttttactccaaacaacactcatatacactatgctcattcccaattattcatacatatatattgtggtggaagttactgagaggcaggtttcaactaaacatacagaaaaacactaacaattacatcaaatttaaggaaggcagtacatgtagaggttaagaatatggttttgaatcccagttcaatttcctagctacaaaactctggtaatttatttattgtctctaaacctgtttcctcatctgtaaaatgggaataaaaataacaataatagaatcatttcactcaacaaatatttactgagtgcttactaggtgtgccaggcactgttctagattctatggatatagcagtgtgcaaaacagacaaaaacatgctgcacccacggggtttaaatggagctttcattccagtggaggcatcagcaaacaaacaatacttcaagccatgagactaggtgagacccctaaaggagtggatgtggacagagaaaataagaaatccaggcactgaggcctggggcacgctgatgtgtagaatttgctatacatgtaataaataaagcaagaaattaacacccttaaaatcttggaaatccaaattttaaaaaatcatctcaatagaaaaaatgggcaaaggacatgaacaggcaactggcaaagagaatggccatgtctggacatggtggctcactcctgtaatccagggttttgggaggccgaggtggacagatcacttgaggccaggagttcatgaccagcctgggcaacatagagaaaccctgtctctactaaaaatacaaaaaattagccaggcacagtggtacacacctttaattccagctactcaggaggctgaggcatgagactcacttgaacacaggaggtggaggttgcagtgagctgagatctcaccactgcactccagcttgggcaacagagcaagactgtctcaaaaaaaaaaaaaaggagagagaatggccaataaaaccactcttcacctatgaaagtgacaaagatttaaataataagcaggctgtcatgagttttttttcaaatggacactctcatacctcactggaaagactataaacataatatttcaaggggagcaatttgtccagttaaatcaacagcctttgaaatgtttatatccctaatccagcaatcccactttaaaaatatattccaaagacatcaacagatatacagtcacagatataagtaaaaggatattcatcaaagagctatttatggtagcaaaaattctgaaataactgaaacaatctaacaataaatgaatggttaaaaaatacccattttatttatttatgttctttttattttattattttttttttgagacagtttcactcttgtcgtccaggctggagtgcaatggcgcaatctcagctcaccgcaacctccacctcctgggttcaagtgattctcctgcctcagccccccgagtagctgggattacaggcatgcgccaccatgcctggctaattttttttgtagttttagtagagatggggtttctccatgttggtcaggctggtcttgtactcctgacttcgtgatccacccgccttggcctcacaaagtgctgggattacaggcatgagccatcacgcccggcctcttttttttttttttttttttgagacaggttcttgctctgtcgcttaggctgaagtgcagtgcagtggcaattttggctcactgcagcctcgacttctccagctcaagcaaccctccacctcagcctcctgagcagctggaactacaggcctgagacaccatgcttggctattttttttgtagtttttgtagagacagggttttgtcatgttgcctagactggtcttgaactcctgggctaaagtgatctgcctacctcagcctcccaaagtgctggaattacaggcatgagccaccacgcccagccagaaatggcttgcttttaagaatgctaccaattccactgtaaaaggacagatttcctttttttttttttttttttttttttgagagggagttttgctcttgttgcccaggctggagtgcaatggtgcgatctgagctcactgcaacctccgcctcctgggttctaatgattctcctgcctcagcctccccagtagctgggattacaggcatgcgccaacacgcccagctaatttttgtatttttagtagagacagagtttctccacgttggtcaggctggtctccaactcccgacctcaggcgatctgcccgcctcggcctcccaaagtgctgggattacaggcatgagccaccgtgcccagccatatttccctcttttacagtggaagtgtggaatgcatttcctttagctatatatttcttatttagaatatttgtaggatattgactaaagaacaggtatcaaaaaattgaatgatctacaagagagataagagagttcccttactaaagatgtttacatagaagctgggtaaaaatttactacatagggtttgtaagaaggatgcatggctctagtagaggattccctatgatcagcatgatttagcattgtgtctggcatatagtaggtgctcaataaatatttattgaatgaataaatacatcatttctatgggcctttccaaacttgagaaattgtgatccataaagcctcccctcaccattccagttctccttgctttcttccttctctagattgtagaaacaattatgaaacactaatattatgaaccactaatttaatggctcttaattacatactgtattgtcttttattgttccctagttatgttaggagtttaaattctgcctccccaaaaagagtgctagttaccagaaatcaattctatttaactaacgtttattgggcactatatattaactactagcacctgtcctacaaaaccttctattctaaaaggcatagaaacgttaaagagagacagtgcactaagtgtcctaataaaggtatatacaaaacgctatcgtagacgggggaacaattcattttgcaagaaaggcggcccaggaaaactacaggtagcatttcagctagtcttcatagataacaggagtttgtcaggctcttgggataatattaatagattagggggaagttgatgctatagcaaagacagatacaagaggctgtctcgttttctgctttaatgtctctccccatgcgcgatagaaaactgccattctctagtatacaatcaatacagaaatggaagcccaggggagaaacggtagggagccagaagggggctgatccaacaacctgacggaaagcgttgtctatttcgcagcctggccggggtgaacaagtttggcaagtgtcggaccgaaccaggtcaagccttacctgctgcccctccccaaagcggagcccaagccgcgaccaacttgaaatgtactgggcttcctcaag

SEQ ID NO: 455 - DNA, 5140 bp, Homo sapiens
agcgagtacgcccggaaccgaagcttgcgaagcgggtcgcagagagagatgggcgttgcagaatcagctggggtcacttatttccggtctcactccagatgaaggagccactagccggcgagagttcaccgagggaacgtgacactcatatctcatcgagggaccgtgttgagggagcccctacagagaggccaaaggaggagagggcctacggagaaatgaacctctgtaaaagctgctctttagggatcagtctttttgtgactctagcttcatagcttggtctctccattactccagccttcctttcaatcatacactgcctctctccagcaccaccaatggatacttcttttctaaaaatgtttttctgtgggttgctgccgtgtctgtgagaaggtgggcagagggttcaagaaaggaaggatttgggatcagcgtaccagggttggggagacagggcaggagcccagctttttctgcattttccactactttccacttcctgcgagctccttgggaaagccagcagagtggaaggaggagtcctattttcacagaaagcagaaacaagggagaaaggttcagaatggagatgaaatctaggagttagtcaagaagaacatcccagatgtcagagaaaatggcctgtagactgggaggctgtaggtgtagtggcaagcgcccagtctttgccataggacagaaacatagctgtgaagctttggagagcttgcttaaccttattaagtctgtttcctcatctgtaacaagaagatgatagttcctatcttataaagttgtgaggattgaaaatagtgtatgtaaagcacatggcacatagttgacacgtgtccaagaaataactagtaaaaatgggtagcttcctgcaaatatttctctctctctcccatccccgggaacattattttcagtatcttgcatctggggggcctccagcctctgaattagctcaggaccctgagtgaactttttaaatccttaggatttttctttttctcccacttcccttggtgccttacagctggacacaaactcattcctaaaatatgtggatggaagctatggtaaccatggagacagggcaggtggcaaggagaggcagagacagtgtgagagaccaatagacagataggaagagagaagatataaggaatgtttcagacagagatcgtcaagcaagatggaaaaaataagacgtctaagcaagactgagattaaagagatgcaatgtgagagagtgtattacaaggttcgctcttcttcctgcccctgtcctatctccctgcccacaataatacggggtggaggcacctggaatgtcccttgccttatctaaaagtgctcccatatccaccttcctcatacttatctaagaggtctacataagggagctgaggtccaagtttctctgcgatgggtgttccgtttttgagagatggggcgggggtgtatctgtgtctgactccaggctggaccgtgatctccttcacaattaaactacaggaagaaagccacatctcttgcctctctttgcacagtatggacaccggctgtggatccaaaaagcctttctacacctttcttacacagtgtgccatgtgccgtgtatggcaggtcaggtctggcgcacaggagcgcacaaacacaccaagtgcggagaatggggatctgctgaatctcagcgaagaatctggatgatggtccctgtctgggtcgcggaggagtcccctaaggaacacttaggtttgttggggctgaggggaggtcggctgagaaaaggaagtcaggattggagcctctaggtttttgagggtttatgtgtgcatgagtgggggagcagtttggtgcctgacgcccccacccgcagtgactaggctataaatagcacagcagagctccgccccccccccccccccccccgccaagcttctctcctcccgagccggcgctgtgcccggggcgctccgggaggagggaccaggatccggcgccggggcgcagatactgacaccaagggaatccgggtgccccccccccccacgccatgcgggcccccaggaaactggctccgccacctcggctgccccgtggccacggccccaatcctggccaggcggagattctgcggacattcaggtatctatctgggcacacagcctgggaggggaaagagcaaggagtgatggggaacatcgcaggggcaatagaaccccccaattctccctccacccgttttaggtctcaaatgcaggctgcttccctccccccactcaatttttggggttgtggcaagctaaaacaggttaggaatgagaatacatgtgtgactgtagggtgcatgtatgtgggtgggtggcgttcagcatcctagaaagggggatcccaagtgtggataagacaagggggacagaggaaaggtctgataagccatggggtgagggtgggggtgcggacatccctgcgcgtgcacgaacgcatttgcacgcgcgctagtccttcagtgcgggtgcacccttcccacctcctcaggcatgcgctgcgggggaagggccggctcaaaggcatgagttagaggaaggactgtatgccgtgaaggtctcctccaccccacgctgggtccctgcatctgtgcctcagttttcctgccgaatctatcaatgagatgtctctcttgcagggatcggcttcgtcactgagacctcaggcctctgccagccactccccctccccatacccctagtcatcctcggcaggtctcagtcccggctccatctgtgccctcgccccagccgcagctatgttgcacaccgagggccacgctcttcttcgggcggtgggtcagggtaagctacgcttggcccgtttgcttctggagggaggcgcctacgtgaatgagggtgatgcgcagggggagactgcgctaatggcagcctgtcgggcccgctacgacgacccccagaacaaggcacgcatggtacgctacctcctggagcaaggcgcggaccccaatatcgcagaccgattagggcgcacggcgctcatgcacgcttgcgccgggggtgggggcgccgcggtggcctcgctgctccttgcccacggcgcagacccctcagtccgagatcacgcgggcgcctcggctcttgtccacgccctggaccgcggggaccgcgagacccttgccacactgctggacgcctgcaaggccaagggtacggaggtcatcatcatcaccaccgatacctcgccctcaggcaccaagaagacccggcagtatctcaattctccaccatccccaggggtggaggaccctgctcccgcctctcctagcccggggttctgcacgtcgccttcggaaatccaactgcagaccgctggaggaggagggcgtgggatgttatcccctcgcgcccaggaagaagaggagaagcgggacgtatttgaattccctcttcctaagccccccgatgacccatccccttccgagccgctccccaaaccaccacgccatcccccaaaaccactcaaaaggctcaactccgagccctggggcctagtggcccctcctcaaccagtcccacccactgaagggagaccggggatcgagcgcttgactgccgaattcaatggcctgaccctgaccggtcgaccccgtctttcccgacgtcacagcaccgaaggccctgaggacccgcccccatgggcggagaaagtgactagcgggggtcctctctctcgccgaaacacagcaccagaagctcaggagtctggtcccccttcagggctgaggcagaaactgagccgcatggagccagtggagctggacacccctggacacctttgccctgactcgcctgagtccagccgcctgtccctggagcgccgccgatacagcgcctccccgttgaccctccctccagccggctcggctccctctccgcgccagtcccaggagagtctgccaggggcagtatctccgctaagcggaaggaggcggagtccggggctgctggagcggaggggctcggggacgttgctcctggaccacatctcgcaaacgcggccgggtttcctaccccctctcaacgtcagtccccaccctcccatccctgacattcgcccacaacccggaggtcgggcgccttcgttgcctgcccctccttatgccggggcgccaggctctcccaggaccaagcgcaaattggtgagacgccactccatgcagactgagcagatccgcctgctggggggcttccagagtctaggtgggcctggggagccagggcgctgagaggagtgagaggagccaaggagggtggggattaggaccttaatgggataggtgggagaaccagctcacacacacaccacgaacaaagggatctcttgcatgtgctcatgggtgcacagtgcacccacacatggttaaacatgtgtccataagcacagtactcttattagcaagaaagaataagtactctatttactgggtatatacacacatgtattcatgccctggtcatttcacatgcatatgggattacttgtgtacctacaggcacagcatatcaataaacacacagggctagggtcccaaactctcttgcatttgttcagaagcagtagggaacccttacttatgggcagtctccgatgtctttgccctcctgcagaagcaatcccttgctttccatgtatgccctgaaacacagcctatcatgattttgcacactctctccgtggacatcccagcccattctgcaggtcttgcttctttctccaggcctggctccttattcacaccctgcttctaaccccaaccacttttcaggatatctttttcactcttcttgggggttcctgcagcaacccccagcctcagttctgctgctgtctttactgctctcaacttcacttctcaacttcctgctttttattcccaccctgttcctccaacaactacaacagattgtctcattttcccagggggtgggtcatgggctctaagctgctcttctgtctgtctgagcttatgaacacccccacaggtagaagtggggagaaaccctaaatcactcctctctccacttgacatatcaaataaatgtgttcagaagtc

SEQ ID NO: 456 - DNA, 22007 bp, Homo sapiens
gctgactggggtggttgggaccgttagctcggcaggctggcaggctccggggcgctactccattggcggccgggatggagactatgcgagcgcagcggctgcagcctggtgtgggcaccagcgggaggggcactctccgagcgctgcggcccggagtgactggggccgcggctgccaccgccacaccccctgcgggccccccgcctgccccgccgcctcccgcaccgcccccgccgccgctgctcctgtctggggccccaggactacccctgccccccggcgccgccggcagcccggcagtgctgcgagaggccgtggaggccgtggtgaggagcttcgccaagcacacgcagggctatggccgaggtgagtctgcgggtctggcctcctgcgcgacaccctctgtaagggagccttgctcccacagtcctccggatcgcttttcctggcgtggagccctcacatgcatttccttttggggagtttccttctgggctacgcacacgcacagacgcacacactcatacacacgtttaagcctcctacctcctcccctttactgagttattaatatattctccagggactctttttcagatacaatcctcttttcttcctaagcttttctcctttagaaatggaattcctcctccagcttaataccttaacatctctctgcctttgagaaccagtcctcattgtgtgggatcctgtcttttatttcagatccaatttctcatccataccctctcagtctttcctctgtgatctctgcaattcctggactcacctgttaatttgctccagccccttaaccttgactgttaaattctttacttacttaccttcactctgaaatttcagtgcaacttcagatttactggggaactaggtagtgccttcacaagtcactcatagtaattgtgtatttaaatccggacctgtaccactgaactcacagcagcttcctgtggctcagtaccttactttggtatcttttttagtatggagactcacaactccagcctttctgtctggctgtgttttcctggcccttgcccaggaactgaggataaatcccaggccttggctctttcaatgttaaattctgtggaaatgtgccaggttagaaactctatttcagttagaaaacttcgttaatttctggaaagagggatgtgagggttttctttgttgttttcgtttaactagggtagtttcctgtctgagtttgagttccagatttatagtgtaagtaataaggaatatatagtgaagggtgtggaatacagaatttaagcctggaatttacaagacatcccttctgtctgcttggccaggtcctgcctgacctggaagtgactatatctttaactttctgtttaacaataatacagagaaaagttacagggcttttctgtagattttctttttttaagaaagtttagtgaaaagagcacacacaggctttggagatctttgtcacttaccagccaaatctttggggaagggacttaatttcactgagcttcagtttcttcaagggttacaatatggattgactgagacattgcaaatgacatataacctaaaaatgattattatctcaaatttgttggttcatagttccttaagtagaacatgcttcactttttcccactcttaaatcctaataatgtaaacccaaaaattcctatgaaaacagatttttagagccattttgctatatgtgcctaatgattcattcatcatcaatttccctttgttcttcatacaatttgaactcctattataagacaggaactctgctaggtgctggggatacaaatggatgaatctgaaactcatgaggaaatactatttttccaatgtaatcccaagatttaacaaggctatgtgatggaactgctattagctactatcctgctgcttcaagtctctaagtcaagatcaagggaaggtctttgcctctgggcacaggagtagcctagagtggtcacactaaatctgaagccttcctcttggcaacttacaggcatttattaaaattatagaagagtacaccctttttcttgtctgtgttacctggagagcctctgctttggctcccaaactggacatcctgtaaaaacttccatttccttagcaaggatgagggaacaaggggattgtactgacaaagggcaattaatcaggcttcacacttcgtggtgattttctttcctatctccccacctcccatcgcagtctttctcattattcttgagtttctcatttccagtctgagtgtccagccagtactttaggaaagtctggcagatagttcagcttcaggcaagcagaatctctgcccatttggctcagaagtcctttaccacatggaatcacttattctgcttcaattcttaggcaaagctgccactggcatatattcacatacccttgtgactgatggcatgttatttgggggaatggctgtattcccctgaatacaatttactttagcctctgcctagacaattcattccctcatccagcaatgctttaccacatcatcttcaattaacatccttcatcttcttcctgaatgctccaaatccaccttttccaatcagtctttagatctaccttcactcatgtgggctatcagtatgtatgtatatatgtatgtatgtatgtatttacttatttattttaaaaagctttcctgtcctttatctgcctccctcacccacttacccaagatacacacacagctcagtattctgtaggatcttgataagtttgtagtgcatgggatttgtaatcagaggacctagccctgtcaaatagttggctgtgtgatcttggagaagttgcttaatctctctatgcttcatctgttctcttcattcatttaccaaatatttattgatcaccagatgcagtggtggacaaggcagatatttagtccctatcttgatggagctcacagtttacattacagagcatgtataaagattaatggtgtagtaaagcaggccagcccaatacaaagagggttgactttggagccaaacaaacattgtttctaaatcctggttctgccacttctggcctgttccttaacttgcttactttttgtaaaatgggtattataatacttatcctgatagttttgtgtggattaaataagacaacgaatataaagcatgcagcacctggtactcagtatggttgctactattgtgcatttggaaatgctttggaaactgcaaatgataggtactgttctgcattgccatttcctttgcaccctttttttctatggcatatagtctctttctcatgtttgacatctggcaatctctaaactggcaggatcgagtaactcactttccttgctctgtaattgctacatttccctcttcaaacctgttgttttggaagtattgctatccttttatgttacaatatggctgcatgattggagattttgccctgttatttcactaagttgaacaaatgaatcttgtgtagtattttctatttagttgttccttttcctcagaatcacagatagcttcttttctgtaagactgaagttaaatgggttgggctgaatatttccaatttttggaaatgctggattagttcctatattagtttcctgtggctgctgtaacaaattatcacaactttagtggcttaaaccaacagaaatttgttctctcatagttctggaggccagaagtccaaaatcagtattactgggccaaaatcaaggtgttggcagggccgtgctccctccagaagctctaggggagaattcattccttgcctcttccagcttctggtggctgctgacattggtttattacgtggtttattgctgtatcactataatctctgcctccgtgactcctcctcttcatcaaatatgcctcctttttttttttttaagaaatggaatctcgctgtgttgcctaggctggactgcagtggtgcaatcatagctcaccgcagcctggaactgctgggctccagtgatcctcccacccgcctcagcctcccaagtagctagactacaggtgcatgtcaccacacctggctgattttaaaaaatttttttgtagagatgagatcccacagtgttgcccaggctgatcttgaactcctggcctcaagtgatcatcctgctttggcctcccaaagtgctggaattataggcatgagtcagtgtgcccatcctgcctccctcttataaggacacttgtgaatgcacttagggcccacctatataatctaggtcatctccccatctcagatcatttaaactcatctgcaaagtctttgccagataatgtcacattcacaggttccaaggattaagacatggacattttggcaggtggcattattcagtctaccagagtcccctcccaaagtcactgttactttgcagtctctccttccaaagagactgtggatcgtgggctatttaggggcagatgtaccttctaaacattgaaataggaaatagatgaactattgttaactagcttccctatcttccataataatgtgaatagagtcagtctattctcgccatcctctatgatcaaggagaatctttttactcacctcttaacttcattatctctttattcctgcttccccaccacaaagttgtatttattacttttttcttttatttttgttaattaccttcctggcaaggttgtatttatccttatgatataaaatttttactgtagtttcatatattgttttaatatttttatcctggccaggcacaatggctcatgcctgtaatcccagcattttggaggccagcgcaggaggattgcttgaaccttagggtttgagaccagcctgggcaacatagtgagaccccatctctacaaaaaaatttttttgaattatccaggcatggtggcatgcatcttgtagtcccagccactcagggagctgaggtgggaggatcacttgaacccaggaagtcaaggctgcagtgaggtgtgattgtgccactgaattctagcttcagcgatagagcgagaccttgcctcaaaaaaaaaaaatgttttaggttaggtgcggtgactcacacctgtaatcccagcactttgggaggctgaggtgggaggatcatctgaagtcaggagttcaagaccagcctggccaacatggcgaaaccccgtctctactaaaaatacaaaaattagctgggtgtggtggcgtgcgcctgtaatcccagctactcgggaggctgagcaggagaattgcttgaaccttggaggtggaggttgccgtgagccaagatcatgctactgcactccagcctgggcgacagagcaagactttgtctcaaaaaaaaaaaaaagtttttattttggctgaaaatgatcactacctctcattcccatcctgtccacttagacattcgtatattttatctcctaaaggcaaaaactaaattattctcttttttgttattcaacagcagggtataagcactgaaatattcctatcttggtctttcttgtgagagactttgagaaaacaattatcagatgtgtatatctcagttcttcctaccctcccacctcactgttctttagccatccttatgtaaaccattatatccatggttcctcattgaaaatatgatacaaaatttgggtgctccacatatacccatgcacaaatactcatatgcatacagacacacacataattttacttaacagttttaggaagcttgtgaacctccatgaagctcagctgtggactggaccttggagcctgtgttaagattcccaaattggaaagaatattggcccccggaaatctagattcatgccccaactctgccatagctatgtgacctcaaacaagtcttctgttctttcttagccagcattggactagatgatctctaaagttccttccagccctaaaaatgaataagtctagaagcattttcaaatgcggatcacaattagttgcttttttcttgaccactttgcccaattatcatttcatactcacatttctaaaatcaagactccccatgtcccttggccttgagtaatcattaaaaaatgattctctagtctgtgcaaaggaatgtttaactggatagagactgaacatatgctttttaataggaccttcccaattatggtggtctcctcctcttcctctttattccagtattctccctgttgtgtgcatgtcaagagagctgtcacccagtgcattgtgctaaactgtctcaaagagggaactggagctgaaaagatctcacggaaagaacaaagatggctgagctttctggtcagtattgacctttgaagagccctgccaaaaccaatagaaggaaagagagttttcttttcatgctggatctttttttaaattttaattttaattttttttgcccatgacagagcctcaggaggtcctaatgacatgtgccctcatgctgtcttttaatagaagaatgagcattcttaaaagtcagttaaatgtaggttattaaaaagagtttatgctgcttctccaactcaggctagtacatgggtgtttgtttcagtcacagagcaggcgagataatttattattggccactgatttcaaattccttgcttgctgggcgcggtggctcacgcctgtaatcccggcagtttgggaggccgaggcaggtggatcacctaaggtcaggagtttgagaccagcctgaccaatatggtgaaaccgtgtctctactaaaaatacaaaaattagccaggcgtggcggcatgtgcctataatcccagctactcaagaggctgagacagaagaattgcttgaacctgggaggtagaggttgcagtgagccaagattgcgccactgcactccagcctgggaaacagagggagactccaactcaaaaataaaataaattccttgcttgcaggaactgtgagttattcttttcatgctcaatgcttagaatgatgccatgtacctattaagtgctcaaagttttgctaacgtgtatatgacagccatgaaaatgtgcagttctcattgcctgctgcagggagcataactaacagcctcagccactgcccactctgggtcatccataaccacatttgcaccacaaagtcgcacattcgcatccataaccacatttgaaggaaccacgcttcctgtaggctgctcccagccaatgacctagcacatcaggggtattaacacaggcagatcctggtgagatatgggattcctttggcatgaggacttctcactgacttagccaaatctttcttaaaactgtactacagccgggcgtggtggcttgcgcctgtaatcccagcactttgggaggccgaggcgggcggatcatgaggtcaggagatcaagatcatcctggctaacacggtgaaaccctgtctctactaaaaatacaaaaaattagccgggcgtggtggtagtcccagctactcaggaggctgaggcaggagaatgacatgaacccgggaggtggagcttgcagtgagctgagatcacgccactgcactccggtctgggcgacagagtgagaatctgtttagaaaaacaacaacaacaacaacaacaacaacaaaaactgtactacagtctgagattgtcatatctagacctccttctttccctctcttccacaggcatgagatctttgctgtgctcagaaggctctccctgttgtctcctacttcctccctgataaatctcttgcaattgtctatcccatcttggtgtcttcttggcagatctgaactaaggaaatatgaaagaacgaatgagactttgttgcgattaagagtagaagaggagaggccagacgtggtggctcacgcctgtaatcccagcactttggggggccaaggtggaggaggagcactttgggaggccgcttgagctcaggagtttgagaccagcctgggcaatgtagtgaaactctgtctctacaaaaattacaaaaattagacgggcgtggtggcatgcacctgtggtcccagctactcagaggctaaggttggaggatcgcctgggcctgggaggtggaggttgcagtgagctgagatcgctccactgcactccagcctgggcaacagagtgagattctgtctcaaaaaaaaaaaaaaaaggagagtggtcagtatgttgcaagatatttcagagcacctgggataatttattattatgaggctttagctaaaactatttgaaatgtttggaaccctagagccaatgtgatcctttctaaaagcaaactgatctcatccctccttttttttttaattagttatttttccttggagctgagttagaaagactcccttctttttaaagtcctccaattgcttcctattgctctaggataaagccaatactctaacatggcctaaaaggccctacttggtctggtccctgcctcctcttgcaacctcatcttgcattacacttcccctccctcactctttcatagccatatggtcttaattccctttattcatcatgttccctgccgtcatgagcctttgaacatgctgttccttacgcacagaacactgtcctctcacctcttgcctagtgaattcctagtcatacctaaacttagatattgcctcctcagggtagctttctttgaccttcttaactaggtcagatacgccgacatctatcactcctttatagaacttgatcacagctgcaattttacatttgtttgagatttggttaatatctctttccctctttacactgtaggctacataaggaaaacgtagggatgagaggaagttttctagaatacaatgtcaggtctggagtttgattttagcctacctacaactaataaattagccatttactgtttcatgggtgctggcagaagtcaagagactttgagatttagagacaaaggaatttattattcatagcacagcaagtagcatgagcatcatgtttatattagttctccttgcctcctcccaagtccaatgcagaggactcaggtggatacttgcataggccatgggttgcttcacaacagaggaacacttatagaacccacagcttggggaacttgccattttacaacaagctgaagcaagcaagttctttatctgagtgaaggtagtacctcatccctcaatatttcttgctgcaagcacagtcctgaaaaatagcccaagtaaagagcagtcagggatttgcaatcttggtgtacctagcaagatgtgaaggagcatgagagaccgacccatggaggagtgcttctttttaaagtcctccaattgcttcccattgcattgcttcgcatctcaccatatggctcctccaaaaacatttatacccaggtaaagcctcaaaagagttttctctcccacccccatgccctggcttctctcactcgtagtatgtacatagtattctgggttggaaaaggaatctggcaatggatgtgctcactagaagcacaggctcgagaatggttattagggctatatttccttgagccagcagtattgcataaaagaatattcattggaaccaagactacttgagtttgaatactcaaactgctactttctcctggcataaccttgggcaagttatttaacttctctgtacctcatttccctcatctgtaaaatatggatagtaaaaatatctgcttcataaagttgctgtgattaaacacgtaaagcagttacagaaatgggtgacatacagttcaatacatgttagcacttattgtggtggttattatcatcctgggccagctaaccaactgtggaataatctgcttgtatttcatcaggcagtgataatggtctgctgacattgggaactctgccttcaatatttaagttattctaggactaagttaaaatgtgaactattcagattggaggtgggagtgaaaaaaaaatttaaataaaataaaatgtgaaccagaaaagtggtggaggagggcaggcctactctggtctttctaggcaaattaacttaatcacagtctaggtttattaacttaaatgcttttcaatggcgataggtagggagctaaggggcagactcttaatgtaggtacaggttacaggtactgtattgaagtatagcaccacgtggaggtgttctcattcattgctgaacttaagtacttctcttttgtagtgaatgtggtggaggcacttcaggaattctggcagatgaagcagtcccgtggtgctgacttaaagaatggggctctagtggtttatgagatggttccctccaacagccctccttatgtctgctatgtcaccctgcctgggggaagctgctttgggagtttccaggtaagagttgtgaggtggcagtagcaaaggtaaatgcttagatgttagtaacggctttctccaccactttggccattaaactgcctgaaatcatatatttgaggacctaaagcaattctggggaaattattctggcaagcatctgaggccaatttgaccatagtagaacctcagtagcatgctttcctttcaaaaactcaaacccattttgaatttgagcagttatgaatatccccttgctcagtatatccgactaccagcatccaacccatgttccaatctggcttcagttattgcattccaactttcttccatctcttattgaggatatagaacaatattccttgcctccagtactttttcgtaggcaattactaaagaaagcaatgttggagttctctaagaggtcaaatcggagggactatgtatgctggaaacagtactcatctaagagttaggagatccaaatttacattcttctgaatatcaatggggcaaatctctgggcctcacttttcccatctataacatgaaggagataggttagattatttctaaagtcttttctactactaacattctacaattatgtgaaatacctatgatgatgaaaagaatggttgccattatgaggtagtagtgaaaaattatggactagtacgaatattctcatcaaagatggattttttacattgcagacagggaggcagccttctgaaatgtcaacttaaaagtctcaaatggaatttagagaaaataataaacacctttgttctgttttccatatggtttgtgaaacccttagacaaggttaaaggccctactgtgtgtctgcatagcaccttgaacttcccctatcatatcacttattacaacatatcataattgtttgtctctcctagtggactatgttccatagaggcaaagattgtgtttgtcttctttctcgttaaatccctaccacccatcttagtgcctagcagatagtaggcaaataatacgtctgttgcatgaatgagtgccattgcagcttagtttctgcctcaaacagaagcagtcctaaggaagcttcatttcaaatcaggtgatgaaattttttcccttagaacttcagtcatttcaggccgggcacagtgactcacacctgtaatcccagcactctgggaggccgaggcgggtggatcacaaggtcaggagtttgagaccagcctgaccaacatggtgaaaccccgtctctactaaaaatacaaaaattagctgggcatggtggtgcacgcctgtaatcccagctacttaggaggctgaggcaggagaattgcttgaactctggaggcggagattgcagtgatctgagattgcaccacggcactctagcctgggcaacagagtgagactctggctcaaaaaaaaaaaaaaaaagaacttcagtcatttcagagaaataactatatacccaagatgacaaatgtttatgctttcacttgtttttttttgtttttttgtttttttgttttttgagatggagtcttgctctgtcacccaggctggagtgcagtggtatgatcttggctcactgcaacctccgcctcctgggctcaagtgattctcctgcctcaccttccccagtagctaggactagaggcgcatgccaccacgcctagctaattttttttttttttttttttttggtatttttagtagagacagggtttcaccatgttagccaggatggtctcaatctcctgaccttgtaatccacccgccttggcctcccaaagtgctgggattacaggtgtgagccactgcgcccagcctgtgctttcacttctaagagaataagatctttccttcttctttttttttttttttttgagatagagtctcgctctgttgcccaggctggagtgcaacagcccgatctcagctcactgcaacctctgcctcccgggttgaagcgattctccctgcctcagcctcccaagtagctgggagtacaggcacctgccaccacgctcagctaattttttgtatttttagtagagatggggtttcgccatgttggccaggctggtctcgaactcctgacctcaagcaatccgcccacctcggcctcccaaggtgctggaattacaggcgtgagccaccgtgcctggctgatctttccttcttcttcccacctcattacattgttgaatgacttgaaaattttatgacaatgcccataactgaaacattatagtaatttgatttctgttatttttggaaagaggagaattgtctttcttggccttttagcctaaacttttttttttttttttttgagacagagtcttgctctgtcgcccaggctggagtgcagtggtgtgatcttgactcactgtaacctccacctcccaggttcaagcagttctccctgcctctgcctccggccaccacacccagctaatttttgtatttttgtattatttcaccatgttggccaggctggtcttgaactcctgacctcaggtgatctgcctgcctcagcttcccaaagtgctgggattacaggtatgagccacttcacccagcttttttttttttttctttcttgagacagggcctcactcttgtcacccagactgaagtacagtggcacaataatggctcactgcagccttaacttcatgggctcaagtgatcctcccacctcagcctcctgaatagctggggccgcaggcatatgccaccatgcctggctaatttttgtatttttggtagatatggagttttgccatgtttcctaggctggtcacaaactcctgagctcaagcaatcctttcacctcagccttccaaagtgctgggattacaggtgtgagccacctcgcccagccaggggcagggtgcaataactgaagctagattagaacatgggctgggtgttgatagtccgatatactgagcaagggcatatccataactgctcaaattcaagatgggtttgagtttatacctctttatccactttggcaggtgaaatttctccctctggttttcttcacagatgactttttaagcaacagcactatagagcaggccagcaagctagtaacagacaaatagaaacagacaaattgaagcactgggaagacttaggacttacttaccaagcctcatatgctgtctcagagagcctgtcagttaatagaaattaggaattattgatattagggatgcttaagtactaaacacatcctggtctacttatttattgtttttttaagacagagttgtgctctgttgcccaggctggagtgcagtggcacaatcatagctcactgcacccttgactcctaggctcaagtgatccttccacctcaacctcctgactagctgggaccacaggtgtgcaccacaaccatgcccagctaatttttaaattttttgtagagttggcatctcactatgttgcccaggctggtctcaaactcctggcctcaagtgatcctcctgccttagcctcccaaagtgctgggattacaggcatgagccaccatgcccaacccctggtctactttttattttaagttttcttttagagacagagtctcactctgtcacccaggctgcagtgtagtggtgtgatcataactcactgcagcctggaactcctggctcaagtgatccttctgcctcagcctcctgagtagctgggactacaggcacgtgtcaccatgcctggctaattttttcttttttttttttggtagagacaggggtcttgctatgttgcccaggttattcttgaattcctgggctcaaatgatcctcctgccttggcctcccaaagtgctgggattacaggtgtgagccaccaagcccggccttggtctacttttaaaaactgcaacatcactttcttcctttcctctaattactcataaatgacatagggcaaagaggcctttgagacagccaataaagatgaattataaaggaatactatggtggctagagatctgaagttgaataattttgagacttctgcagatcagacttgttctatgatacctatgttggatacaatataaaaacatgaattaatttttatttttttccttcttaagtcagctttccttcccttagttactcctctcctctttgtttccactgtggggaaaaaagaagtctataaattccttcttcagacttaaacccttctcagggatagctcctttggctcactacgttatttgagaaaatgcctgctcacagctaaaaatgaagtccgagattccaagatgggtgcttctgatagagaccagtggcctctgtagaagcagcctagacacagctttggttctaatcttgggttatctagaggaatccaaaaaaccttacctgtccgcagaacaagatacagatttctattaagccggccagaatctgacttttgagtaactaattctgtcgacagtttaaacgggtatttttcatgaccagtgattatatgctgacttaagcagccttcctcgttctgcattcagtttggtatgagctacagccctctcccagttccttaatgacttcaggatgttgaatcaaaattatgtttccaaacatcccaaccactttaccataaaaaccttggaaagtgtgttgaacacaactgatttatccaaagagcgtccaagtgttttctatctgaagtgtttccctcccactgttccttcctctctctcatatgcacaaatacacatattctcactctttctcccctgcctagttttgccccacaaaagctgaggcccggaggagtgctgcaaagattgcgctaatgaattctgtgtttaatgaacatccttcccgaagaatcactgatgagttcatcgagaagagtgtctctgaggccctggcatcttttaatgtaagttgtatggagctggaaggaaggagagtgggagatgggagaactggctgcttgggaagtcgtaaattactgtgaaacagagcatgaattcttgttttctttctggtccacctctctgttcttttgatttattctctgtcagtctattgtgtcatgtgctccacctgtcgcagtctctagttctgtatctgtgtttatgtgttttttgttgttttgtctctttcattgtgtctctttggtatctagaaacctttaattgcagatttatggaattgtagagctattccaaaatgaaaattgagcttcaattttgcttttgctaatttgggttaagaccttagtttctgcagttctttttttatgactgttttttattgtcacttgtctcctgcctccattacttcatcttattgataaagaagacttttataacaaaacgtctttttaggaacaaggaggataatttatttactctctttatttacaactgttctttcaaatgatgatgataagaataaccataattagccagacgcggtgtctcacgcctgtaatcccagcactttgggaggccgaggcgggcagatcacgaggttaggagatcgagaccatcctggctaacacggtgaaaccccgtctctacaaaaaataaaaaaaaaatagccgggcatggtggggggcgtctgtagtcccagctgcttgggaggctgaggcaggagaatggcttgaacccgggagacggagtttgtagtgagccgagattgcgccactgtactccagcctgggcgacagagtgagactccatctcaaaaaagaagaataaccataattaatcctaattgagtatttaccttgtggcagggactgttctaggggatttatatgcattttacctcatttgatcatcacaacaatcttatgaggtgtaagtactattattacccctattttacagatgaggagactaaaaacacagaagtggaatgttgcttaacatgatatagctagtaattggtcacgccaagattagaacccaagttgacttaatttaattacatcttagaaattaacaccgccatcttccttcctctccacaaattcattaatagtcagaccaagtatctgttctatttgcatttaattaagatgtaattacaggccaggtgcagtggctcatgcctgtaatcccagcactttgggaggctgaggcaggcggatcatctgaggccaggagtttgaaaccagcctggctaacatggcaaaaccccatctctactaaaaatacaaaagttagctgggcgcagtggtgggcgcctgtaatcccagctactcgggaggccgaggcaggagaattgcttgaacctgggaggcagaggttgcaatgagctgagattgtgccattgtactccagcctgggtaacagagcaagaatccgcctcaaaaaaaaaaaaaaaaagatgtaattacatatactaaattacttcagttatctgctttgtggattagttgttgaatactttattgaaagttggtttccctctgttatttaggacccagctgtttttctcccattattctttgccccagtcaacagcatctgcagggaatgaaaacatttttatattaatccaaaccaaataaaaaaagaaaaagccagctaaaattttttggaaagtacatttgctacttttaggtcgcctaatggtattataaaatgaaacagggcgaggcgcgatggctcacgcttgtaatctcagcacattgtggggtggatgccagcagatcacttgaggtcaggagttcgagaccagcctggccaacatggcaaaaccccatttctactaaaaatagaaaaattggccaggcacggtggctcatgcctgtaatcccagcactttcggaggccgaggtgggcagatcacgaggtcaagagatcaagaccatctggctgacatggtgaaactccgtctctactaaaaaaaaaaaaaaaattagccaggtgtggtggtgcgcgcctgtagtcccagctacttgggaggctgaggcaggagaatcacttgaacctggaaggcagaggttgcagtgagccgagatcacgccattgcactccagcctggtgacagagcgagactgtgtctcacaaaaaaaaaaaaaaaaagaaagaaaaggaaaaaaaaaaagaaataaaaaatacaaaaattagctgggcattgtggcacatgcctgtaatgccagctactcaggaggctgaagaatgagactcgcttgaacctgggagatggaggtgcagtgagctgagatcattccattgcacgccatcctgggcaacaaagtgacaccctgtctcaaaaaaaaaaaaaaatagaaaaggaaaggaaaaaaaaagaaactgtggattatggaaagtaggatgtgcagtatttatctgatcatgggctctaaattcattgttggcgcggtggctcacgcctgtaatcccagcactttaggaggcggagttgggcggattgcctaaggtcaggagttcaagaccagcctggccaacatggtgaaaccctgcctctactaaaaatataaaaattagctgggtgtggtggcgggcgcctgtaattccagctatttgggaggctgaggcaggagactcacttgaaccaggaggcggaggttgcagtgagccgagattgtgctattgcattccagcttgggtgacaagagcaaaattctgtctcaaaaaataaataactaaattcattgttattgaaattatggttctaggccaggtgtggtggctcacgcctgtaatcctagcactttgcggggctgaggcgggcagatcacttgagctcaggagttggagaccagcctgggcagcatggcgaaactccatctctacaaaaaacacaaacagttatctgggtatgggggcatgcatctgtagtcccagctacttgggggtctgagacaggagtatcacttgagtgaggaggtcaaggctgcagtgagccaagattgcactactgcactccagactcagtgacaaagtgagaccctgtctcaaaaaaaaaaaaaaaaaagaaaaagaaaaaagaaagcaattatggttcctggctgggcgctgaggttcatgcctgtaatcccagcactttggaaggctgaggtgagcagatcacctgaggtcaggagttcgagaccagactggccaatgtgttaaaaccccatctctactaaaaaatacaaaaattagccaggcatggtagtgcacacctgtagtcccagctacgtgggaggctgaggtaggaaaatcgcttgaacccaggaggtggaggttgcggtgaactgagatcgcaccactgcactccagcctgggcgacagagtaagacttcatctcaaaaaaaaaaaaaaaaaaattatggttccatagtcttcctttgggatctgtgtgggattggttctaggatctctcgaggacacctaaacccaaggatgctcaagtccttcatataaaatagcacagtacagcctgggcaacataaagagacttcatctctacaaaaaaataataaaataattagccgggtatggaggcacttgactgtgatcccagctacttgggaggctgaggcaagaggatcacttgatcctggggagattgaggctgcagtgaccatccactgtactctagccagggtgacagacagaatgagacacagtctcaaaaaaaaaaaaaaaagtacagtatttgcatataacctatgcacatcctcctgaataaatgctttaaatcatctctagagtacttataatacctaatacatgtaaatgctgggccaggcacagtggcttacgcctgtaatcccagcactttgggaggccaagacaggcagatcacctgaggtcaggggttcaggaccagcctggccaacatggtgaaaccccgtctccactaaaaataaaaaaattagccgggcgtgatggcgcatgcctatagtcctagctactctgcaggctgaggcaggagaatcacttgaacccaggaggcggaggttgcagtgagccgagatcgcaccactgcactccatcctgggcgacagagcaacagaatgagactccgtctcaaaaaaaaaaaaaggaaatttttatttttaatttaaaattttatttaattctcaaaacaatcatttaaggtagctctatgattattcccatcttacagaagaggaaactgaagaacagagaggttaagtgactttaccaaggccacgctatttgtaggagctccagtccatgctcttaacttctatgctgtattggtttttttacatgctaggcttgaatgcaggacagtgtgtcttaattctaaccctgcagggttacataaccaatagaagacacaataggccaatgtccaggagaccacactgctacccagaatttccacacttataccacatttcagaaagtcagtacaaaaatgtaaaatatttcattaataatgtttatactgactacagttgaaaaataatattttgaacatattgggttaaataagatatattattaaaattaattttacttgtttttttttttttctgagacagagtctcactctgttgtccgggctggagtgcagtagcccgatctctgcaatctccgcctcccaggttgaagtgattctcctgcctcagcctcctgagtagctgggatttacaggcacccactaccatgcccggctaatttttgtatttttagtagagacacggtttcaccatgttggccaggctggtctcaaactcctgacctcaagtgatctgcccaccttggcctcccacagtgctgggattacaggcatgagccactgcacctggacttacctctttatttttactttaatgtggcagagaggaaattttgaattaaatatgtggcttgcattatatttctactggacagtgctgcttgagatgataatcctggttgaaaatctatttgtcttttctgttcctctactaccagggcaacagggaggaagctgacaacccaaatacagggattggtgccttccgattcatgctggaatccaacaagggcaaatcaatgttggagttccaggtactttcccatgtacttccctggttctaataacatgggtcagcctgctactgtaatatataatggctcctactaattcctaactcattgatactggaaaagaaagaaggttgttacactatttttcaaaaataaataccttcctggctgggcatggtggctcaggcctgtaatcccagcactttgggaggctgaggcgggtggatcacttgaggccaggagtttgagacatggcaaagccccgtttctactaaaaatacaaaaattagctatgatggcacatgcctgtaatcccagctacttgggaggctgaagcacgagaattgcttgaacccaggaagcagaggttgcagtgagctgagattgcgccactacactccagcctgggtgacagagcaagactctgtctcaaataagtaagtaagtaagtaaataaataaataaataaataaataaataaataaataaatatttttcttccccaaaggcctatcagagttagtgatgagagatgcttctacaaatccattttgtaaaaggtttcccatgtaattctgatgcaacctcccaatataaaaatcactgtcctggtacttcctatcctcttcccccaggagctaatgacagtttttcaactgctacactggaatggcagccttaaggccatgagggaacgacaatgctctcggcaggtaagagattttatgagtgggggcgaatgaggggagcacaatctgtcagtggactcttttgaggtggttactatgttagaaataaggtctattgtgacctatggttgtgaatattgaaagccttacctaagtaccctcttcattcctataatctttcctgtgtaaatattagctgtgattcttttgtctatcttgcttcccgtagcaggaagtgcctttaagaatctccttgaagaacttaggtgctgacctcagttaggtctctaaagctgagttcttagtcccagttgggtcagtgtggtatgatatgaacctttaccttctcaatgatgttcacattcccctcccctactaggaggtgttggctcattattcgcaccgggccctggatgatgatattcgccaccaaatggccttggactgggtgagccgggagcagagtgtgccgggggcactgtctagagagctggcctctactgagcgggagctggatgaagcccgactggcaggcaaggagctgcgcttccacaaggagaagaaagatattcttgtgctggctgctgggcagttgggcaatatgcattcttccaactgctaggcatccacccacataactccccaggctttccacagcctttttttatgtctcctttctaagatttaggatgattttttgtacatactttctcatttttatactttaaaaaatatatatgtgtataaattctacacctagattcctatttgctaagagatcccttttcttactaccagtttttggatgtagttttatttgaaacatcttcagtccactttacaacaaagagcagcttgtctttgcagctttgttagctcttaaacttccagattaactgtgtagccatttcagtagcactaaaagattaactcta

SEQ ID NO: 457 - DNA, 5979 bp, Homo sapiens
agagttagcctttgattggtcagcttgactggcgacctttcccctctgcgacagtttcccgaggtacctagtgtctgagcggcacagacgagatctcgatcgaaggcgagatggcggacgtgctagatcttcacgaggctgggggcgaagatttcgccatggatgaggatggggacggtgaggacagtggagacggctggtgggaagcggggaaggtgcgagagaaggctataataggaaaatttactcttttttcctcggtcgtaaggatgggaatcgaggaaccgggtcttgggtggattagagattccgcccccttcaggagaagggagggcgtgaccgggaaggcactaagactggaggcggtgtgggtcggcttgctggtagtgtattgggaaagagacgattgttacaaatgactgtcatagttacttattcttttatcttctggggttccagagagcattcacaaactgaaagaaaaagcgaagaaacggaagggtcgcggctttggctccggtgagtgtggggaaaatggggtagagtggcctagtagggcaggagctacgggttttggagtccccacccacctcataggaacaatgggagaaaggaggagttttcggtgatctcgtgtatgtcccttatagaagaggggtcccgagcgcggatgcgtgaggattatgacagcgtggagcaggatggcgatgaacccggaccacaacgctgtgagtaataatggaacctgtgaggtatccgtgtctgtggtagtagttagaaaccaataaaatagttaaacgcagtaggaatgggttcagagatagcttaaacaatctgagtccgcactcactctattcctgtgagcctgcttaaagtgtctctcatgtactcatacaacttccccccgtcccccaacagctgttgaaggctggattctctttgtaactggagtccatgaggaagccaccgaagaagacatacacgacaaattcgcagaatatggggaaattaaaaacattcatctcaacctcgacaggcgaacaggatatctgaaggtatcctaagtgacactttattgcctcctttctttcataagccttaggtagcattcgtagttctgtgtttgctgtggttggccaagagcaaagttgaaataaaatgacattggaaatctatgttttgtcagacacgccaaagagacagaaacggagatgatgtatatatacagtagagatatatgatgtacattcattgtttaaagtgtgtagatttttctgagtttagatttgaggaaaaagatactcagtgatacttggggaaataggagggttttcatatctgtcttttcactttccccaggggtatactctagttgaatatgaaacatacaaggaagcccaggctgctatggagggactcaatggccaggatttgatgggacagcccatcagcgttgactggtgttttgttcggggtccaccaaaaggcaagaggaggtaaaatgaagagggcaaatactgtctgggtgaagggaatacgaacgaaacagaatgaggacttagtattatgtccctctaatggactcctctccctgcttctttttccctagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttctacatttaatgttactttcctgtcctaaaattgaaagttctaaagcatagcaaggctgtatggatcattgtgaagatacttctagggactgaactctatgtatttcttttttttcttttttttgagatagagtcttgctgtgttacccagggtggattgcagctgatcatagctcactgcagcttcaaactcttgggctcaagccatccttctgcctcactgtccctagtagttgggattacaggcacatgccaccatgcccagctaaatttttaatatttttgtagagatggggtcttgctgtgttacctgggctagttatgtgagtttctatattagacatagtctcaagtttcaggtagggtttaaagtagagacactggtcagtatttcttttttggggggaactaggagagcaggagtagaagtgagatgttaagatcttatggcactaaagacttactattctgttcctacatactctgttaggatcagatagatgttatagaaatgccttttgtttctcctgcccttcttgatgtcacagttttttgtacttccagctgtctaaaggcatgaatctcctcttggagcattctcccagacccttctttagaagagtctatactaagttcttggtgccctcttcggcagccaagggtgaaggccccatagaggagaggatccaaaggagcattgaggaggcccaagaggaaaaggatgtggctcaggctgggagggacttcagttagcatggtgggggagaaccagtaccacatacccagtaggtaataaggtgtccagcagaggatgaaggtcagcaagataagcagggccagtctcagggcccggagacgaacacggggacaattgtcaaaggagcgggggagggcaaattcaccagcaggggctaggaatttagaaaatatactgtaattcagacactcagcttctgatctgagtatagggtgaattgatggaggggcatagctagtgagacagagctcacctcctacaaggaggagaatgttgcaaaccgttttccccttcccaacctgggactatatgatttcttacccccagggattatgatagaaatatgaagccaccaagtctagacttgatggtgttcaagaataaataatactgattgcctccctagtccttgtccagctaactcagctgtttataattgaagggattcaacaaaattatctctagcatcaggtgctagacatggttagaatctcaccatggtttagtgactggtagatagctattaggtaggtagataaataaatgatgctagaggcaacaggtctagggttaaggattaaggcctgggaattggagtctcaccatggctccccttccttgtctggggcctggacacactgaggacaatgcggctatagcagatggccatggcagtcagtggcagcagaaagaggcagcagaaggtgaagaggttataggtggtctcttgccattgagccttgaagctgcctttggtgacacactgagtgaaagggactgggccagctcagtggaccgtgtggaacaggaacagctggagtggagttgaggactattagaactggttcccctcaccacccaacctacccacctatgtcatactgtctcctcccaattcatccttaattccaagtgaagcagcacagtgctgagaaacagttcatccatggtgccatgttaaagaagttggaaatatatcttgaaaatcctatcttccttttaggcttgaatatgatgctgaacagtaagtttgttaaatcttggaacttaaaacaatcctgctttctcaagtactattctaacattgcgctttataagggatgatatttctaccacctcactcatatttttagctgaaatgattttcctggtatgtctgttattttgtggaaaaagaaatattgtgtaaaatgggtgctgccaaaattccaggccattttgcagggactctgaagtgacctttagtagtaatagtcttatgtgcagtaactataatggtaaagaatgttaaataataaaatttaacattttccaaatgctattgggctgcccctccccctttttgttaaattgctgggttttccaactgaatcagtaaaaactatttctgtttagagctacaaggttaaagtgcctgctttccagtaatggagattgagtcactattaatttgataaaaggtaagctcagtaggcatcagattcctagatacaaggcatttgggaaagtgattttagcagacatgagggacatttaggaaagatgaatagtttcagcctaagagaattttgtgaactgtttggagttacgatcaggctactctgagctagttgggaaatggtctttcctcttcccatctcttgcattcatatatttctaagttttttttttttttttgtttttgtgctctgcctaagaagtgcttgagaattgtgaggagtataaaaatagtcaaagctggctgggcgcggtggctcacgcctgtaatcccagcactttgggaggctgaggcgggcggatcacgaggttaggagatggagaccatcctggctaacacagtgaaaccctgtctgtactaaagatacaaaaaactagccgggcgtggtggtaggtgcctgtagtcccagctacttgggaactcgggaggctgaggcaggagaatgacctgaacccaggaggcggagcttgcagtgagcagagattgcgccattgcactccagcctgggcgacagagtaagactgtctccaaaaaaaaaaaaaataataatcaaagctcttggatttatagtttggtccacagccttgttttgatctttcctttatcctgttttattgccatttaccacgtactgtagaaacatccctttcaactgctgataacttggaaacaagcctacaaaaataagtaatttctaactactcctaatactacctataactacccctaagcccttaccactctaacgtgacattattaaattttttattttattaacactaatattttaactacaattacagcatatgggcaatacagaatttacctaaaaggatactaatttggaacaaaaaaaatcacctttcgcacatgtatcatgtcacaaccagtttgccattgaaacaaatagaggttgcaaatattgtcagattgtcaggctgtaagaaaggatgaaattcatttcccattgcatcatcttgtggcccatggatttcaagtgccttagccaaaatcatatagctagttagcagtagagccgagactcagaaaaaaacaaagtaaaacaggcagactgaaacaaaaagtcttctaattcccagtccacatgtaaaatttgcttcatataaacaaacctaattgtaaatggcactgtagcaacaggcttctttttaacacttggattggtaaaggtcttgtttgcaacatattagaagtattatttttctctttcccccccaccccacccccaacagagtctggctctgccgcccacgccggagtgcagtggtgcagtcttggctcactgcagcctccacttcccaggttcaagcaattctcgtgcctcagcctcctgagtagttgggattacaggtgctcaccactatacccggctaatttttgtatttttagtagagatggggtttcgtcatgttggccaggttggtcttaaactcctgacctcaagtgatccacccaccttggccttccaaaatgctgggattacaggcttgagccaccaggcctttctttgttcttaggagtatagtcagactaacttctagtagttatatttctaataattgaggatgtaagtaaggatcaaatcttaaatcagtataatgcattgtcattccagagataaatcctagacccttcttggcctccttctgacataattctaatcctacagtctcagagatgctgttgtatcctgccccccaaccccatgatagtgatagtggtttttgccttgaaggaattgctttgtatttagcttttccccctctagatttctagttccttttcagtattggattggatttgagatttgattaacctagtactcaggttcagatgctcgcctctttgcaattttaacactcattcgacaataaagtcagtaaaaaacacaa

SEQ ID NO: 458 - DNA, 6257 bp, Homo sapiens
ctaaagacttactattctgttcctacatactctgttaggatcagatagatgttatagaaatgccttttgtttctcctgcccttcttgatgtcacagttttttgtacttccagctgtctaaaggcatgaatctcctcttggagcattctcccagacccttctttagaagagtctatactaagttcttggtgccctcttcggcagccaagggtgaaggccccatagaggagaggatccaaaggagcattgaggaggcccaagaggaaaaggatgtggctcaggctgggagggacttcagttagcatggtgggggagaaccagtaccacatacccagtaggtaataaggtgtccagcagaggatgaaggtcagcaagataagcagggccagtctcagggcccggagacgaacacggggacaattgtcaaaggagcgggggagggcaaattcaccagcaggggctaggaatttagaaaatatactgtaattcagacactcagcttctgatctgagtatagggtgaattgatggaggggcatagctagtgagacagagctcacctcctacaaggaggagaatgttgcaaaccgttttccccttcccaacctgggactatatgatttcttacccccagggattatgatagaaatatgaagccaccaagtctagacttgatggtgttcaagaataaataatactgattgcctccctagtccttgtccagctaactcagctgtttataattgaagggattcaacaaaattatctctagcatcaggtgctagacatggttagaatctcaccatggtttagtgactggtagatagctattaggtaggtagataaataaatgatgctagaggcaacaggtctagggttaaggattaaggcctgggaattggagtctcaccatggctccccttccttgtctggggcctggacacactgaggacaatgcggctatagcagatggccatggcagtcagtggcagcagaaagaggcagcagaaggtgaagaggttataggtggtctcttgccattgagccttgaagctgcctttggtgacacactgagtgaaagggactgggccagctcagtggaccgtgtggaacaggaacagctggagtggagttgaggactattagaactggttcccctcaccacccaacctacccacctatgtcatactgtctcctcccaattcatccttaattccaagtgaagcagcacagtgctgagaaacagttcatccatggtgccatgttaaagaagttggaaatatatcttgaaaatcctatcttccttttaggcttgaatatgatgctgaacagtaagtttgttaaatcttggaacttaaaacaatcctgctttctcaagtactattctaacattgcgctttataagggatgatatttctaccacctcactcatatttttagctgaaatgattttcctggtatgtctgttattttgtggaaaaagaaatattgtgtaaaatgggtgctgccaaaattccaggccattttgcagggactctgaagtgacctttagtagtaatagtcttatgtgcagtaactataatggtaaagaatgttaaataataaaatttaacattttccaaatgctattgggctgcccctccccctttttgttaaattgctgggttttccaactgaatcagtaaaaactatttctgtttagagctacaaggttaaagtgcctgctttccagtaatggagattgagtcactattaatttgataaaaggtaagctcagtaggcatcagattcctagatacaaggcatttgggaaagtgattttagcagacatgagggacatttaggaaagatgaatagtttcagcctaagagaattttgtgaactgtttggagttacgatcaggctactctgagctagttgggaaatggtctttcctcttcccatctcttgcattcatatatttctaagttttttttttttttttgtttttgtgctctgcctaagaagtgcttgagaattgtgaggagtataaaaatagtcaaagctggctgggcgcggtggctcacgcctgtaatcccagcactttgggaggctgaggcgggcggatcacgaggttaggagatggagaccatcctggctaacacagtgaaaccctgtctgtactaaagatacaaaaaactagccgggcgtggtggtaggtgcctgtagtcccagctacttgggaactcgggaggctgaggcaggagaatgacctgaacccaggaggcggagcttgcagtgagcagagattgcgccattgcactccagcctgggcgacagagtaagactgtctccaaaaaaaaaaaaaataataatcaaagctcttggatttatagtttggtccacagccttgttttgatctttcctttatcctgttttattgccatttaccacgtactgtagaaacatccctttcaactgctgataacttggaaacaagcctacaaaaataagtaatttctaactactcctaatactacctataactacccctaagcccttaccactctaacgtgacattattaaattttttattttattaacactaatattttaactacaattacagcatatgggcaatacagaatttacctaaaaggatactaatttggaacaaaaaaaatcacctttcgcacatgtatcatgtcacaaccagtttgccattgaaacaaatagaggttgcaaatattgtcagattgtcaggctgtaagaaaggatgaaattcatttcccattgcatcatcttgtggcccatggatttcaagtgccttagccaaaatcatatagctagttagcagtagagccgagactcagaaaaaaacaaagtaaaacaggcagactgaaacaaaaagtcttctaattcccagtccacatgtaaaatttgcttcatataaacaaacctaattgtaaatggcactgtagcaacaggcttctttttaacacttggattggtaaaggtcttgtttgcaacatattagaagtattatttttctctttcccccccaccccacccccaacagagtctggctctgccgcccacgccggagtgcagtggtgcagtcttggctcactgcagcctccacttcccaggttcaagcaattctcgtgcctcagcctcctgagtagttgggattacaggtgctcaccactatacccggctaatttttgtatttttagtagagatggggtttcgtcatgttggccaggttggtcttaaactcctgacctcaagtgatccacccaccttggccttccaaaatgctgggattacaggcttgagccaccaggcctttctttgttcttaggagtatagtcagactaacttctagtagttatatttctaataattgaggatgtaagtaaggatcaaatcttaaatcagtataatgcattgtcattccagagataaatcctagacccttcttggcctccttctgacataattctaatcctacagtctcagagatgctgttgtatcctgccccccaaccccatgatagtgatagtggtttttgccttgaaggaattgctttgtatttagcttttccccctctagatttctagttccttttcagtattggattggatttgagatttgattaacctagtactcaggttcagatgctcgcctctttgcaattttaacactcattcgacaataaagtcagtaaaaaacacaaatttggttatgtcactctctttttactttagtgtctctccactgcactcagaataaagtacaattttattatttgtgatctggcttgctcttcccctctcagttcattactcaccattttctagtcctcagctttagtagcattgagatcctctatcctccatcctccctagcatttctcctattttaattggtctaacacctatctctgaagaatcaaattttaacatctggaaagcttttcctgactgcacggctgtgtcagacacccctatccactccccacccccattgtcttctttagctcctttagcataacacttttgaatacactatattgtaattgcctaatttctttgtttcttgcagtagtctatacatttcttgaaggcaggattttgctgccctgtccttagcaaaatttgagtggcgctggagatgcatattactttttgaatggataaatgaaatgtaccacaaagttttacccaaaccactgacttcactctcttaatagatccccatgtatgtttttcttccctgccccaatctgaaggaggtgaaattgggaggatgcaaagaggtagaaaccacgtgtaataaaacagatgtaatggaagaggcacagatagaggatactgtttttacaaggcaggctcttttattattattattattatactttaagttttagggtacatgtgcacaatgtgcaggttagttacatatgtatacctgtgccgtgctggtgtgctgcacccattaactcgtcatttagcattaggtatatctcctaatgctatccctcccccctccccccaccccccaacagtccccagagtgtgatgttccccttcctgtgtccatgtgttctcattgttcaattcccatctatgagtgagaacatgcggtgtttggttttttgtccttgcaatagtttactgagaatgatgatttccaatttcatccatgtccctacaaaggacatgaactcatcattttttacggctgcatagtattccatggtgtatatgtgccacattttcttaatccagtctatcattattagacatttgggttggttccaagtctttgctgttgtgaatagtgccgcaataaacatgtgtgcatgtgtctttatagcagcatgatttatagtcctttgggtatatacccagtaatgggatggctgggtcaaatggtatttctagttctagatccctgaggaatcgaaaaggcaggctcttaacagatgtaaattaacatacaaataatcttacagaagagagagcagaggtagcagggtgcggtggctcacgcctgtaatctcagcactttgggaggctgagacaggtggatcatgaggtcaagagatggagaccacctggccaacatggtgaaacctcgcctctactaaaaatacaaaaattagccgggcatggtagcgggcgcctgtagcttctcgggaggctgagggaggagaattgcttgaacccgggaggcggaggttgcagtgagccggcaaaaaaaaaaaaaagcaagcagaggcttactccctgagaattaatggctaatggcccccaagcgcaccctttaactcatgctatggacccaaatccctgtcctgcccggtcctgagtcctaggtcactcacctgggggaaggcaagcaggaaactaagtccccaggctgcccccagaagtttccttacacctgaacgggatccaagcgggttgagtactgctgcctggcggtccaatccaatgaccacaggcaggaaagctgcagaatacgtggccattagtttcaggaacatcagtgtccgacatgcgatgtccacagccagccattgaacagtgatattccaggtggcatctaggggcataaccacaaaagtgactagtaagtcggcggctgctaaatggatgaagagtctcctgaccggagaggggcggagctggctgggttcccgccgtgtcactgaccacaggactgccaggttccctccagccgaagaaacaaacagcacaatggtcactcccactcggaccttggctgctgccgagaaggtgggcagctctgagccctccacctccactcctgatccagcccagacctcctcccccgctgctgaccccaaggggtgccgttgcctgcagacatggtggcctggagagaaactgaggaggatgaagtgtgggtatgaagcggttagctttggccactgattcttcgccctccttttcaggatctggagctgattattgcgaatttcgttcactaaagcctctgcttctggagactctccatctgttctggaggaggtcacttgttcaactgtcaaggttctgcagggaacgaagatctggtaccaatcacgctcctttttccttggacagaccagcctgggcttcaggcctctactgacctagacctctttagcccctacagccctggattcagtcggggcctgcgtgcatgtgtatttgtgaggttctgccaggcgcacacctatgccggcggcctccaagacgtggagatc

SEQ ID NO: 459 - DNA, 7568 bp, Homo sapiens
gctagggagtaggggtcgtctgataaggggaagctgtgacgcagacacgcacagtaatacacagatggaggctcaaaagacacgagtttcgcgtcctgaaattccgcttccagggccaagctttcttttctgatactgtttgtccctcgcgaggcaccgttgggtcgcgcagtaggcgtgactaggggcgggaagtggggcgggagcagggccgcggagcctgggctgcggctgtcatggacgcctgggtccgcttcagtgctcagagccaagcccgggagcggctgtgtaggtgcggcccgaataggaatgggggtggggcgggggagggatggacagaggaagactctagtgaggcgaagtcagtttaggctacaggggggtcaagaagggtcaactccggctacgggggcccgaacggaccgtgaggcgcagatttgagccgctgttgagatgattcctttccgttcgcggaagagatggggaaactgaggcatgagtgggccagcggggaggccgctcagggttgctgtgtccacataagaccgacagtgtcctcactgggcggtgatggaatgaggagcattcgccccacggtggatagccccagactctgcccccagagctgaggaggcactcccagtttccgtgtccccacaccgtgctgccattcgggaactcccctgcctccgccctggcgtttggtctccattcagctagagggccttgaaatctctcagttcacctattctgaggaataaaatgccctccaactgtctgcctccccctcatcgatcacgtacatgctcacgctgatgtgcttgtgatggacccctgcggcctgcactggccccttcaggcctcatcattgtcaaatctctaatttgctcaacattcagtagtgctccccacccctttctagactcttttttctccttatgcctttcccttcctctggcctggagaaatggtgagatatgggcatggaggaggaaggggagtgttctcaaactgggaaagggggaagtctgtctgtgccttttggaagatagttttgagcggaaggttagggaggtctccaccttaccttgcctgccctctcctctagggccgcccagtatgcttgctctcttcttggccatgcgctgcagaggcatggagccagtcctgagttacagaaacagattcgacaactggagagccacctgagccttggaagaaagcgtaagtaactctgtctttccttttatcccccaacctttcctccatccccagctcaccttcctttgtccctccttcctgtaccctctctgttcttctttctcatttggctctgcacttaccctctgcatgagtccagttgagataagagagcaggggtatggaagtaattaggcggactggagagaatgggtcaagtttgagaaaactaaactggcacaaaaattaaatttgaaattgaaaaatggactgtttctgctctttattttttatttttttgagacagagtctctcgtccaggtcagagtgcagtggcgcaatcttggctcactgcaacctctgcctcccaggttcaagcaattctcctgtctcagcctcctgagcagctgggactacaggtgcccaccaccatgccgggctaatttttgtatttttagtagagatggggttacaccatgttggccaggctggtctcaaactcgtgacctcaggtgatccacccacctcggcctcccaaaatgttgggattacaggcttgagccaccatgcccagcctgtttctgctctttaaaaaaattgtcattattattgctcaacttttgccctcttgctttctctgtttctgtttcttgttatctgcctctccacttacaaatccttgctttccctttctaatctccacaagttctacgcctgggtaactcagcagatgcccttgagtcagccaaaagagctgttcacctatcagatgttgtcctgagattctgcatcactgttagtcacctcaatcgagccttgtacttcgcctgtgacaatgtcctgtgggctggaaagtctggactggctccccgtgtggatcaggagaagtgggcccagcgttcattcaggtttgatatcctgttctcctttaagatttttttttgtagcctctatattgcatagcttgtcttatatgagggaaagatatcttaggatctttccagagtatataagtcttgatcagtcacttggcttccaatcacttagatcttaaactatcggagaatatcaaatggggagagatggaagacagatgctcttccataatgaatgactaatattgtgcaaggtaagatattatatcactttaattgtgcttctataccacaggttattccccctcactacctgcttactcattcattccaaagatatttattagatgcttactgtggcgcaggggataaagcaaagagctaaacagataatgtgcctgctcccatgaagcttctagtttagtgagggagttagatactacaatgaataacttctcatatatatttgtggaaaagtatgcggtattatgaaagaatatcacaaggggagctaatttagattggaaaatcaggaaaaaactctttgagaaagtaatattttagctcagacctgatgtctgagtaggaggagttagacaaagccaacagtagcagaaaagacatttccaaacagagaaaattgcacattctaagtaaggctttgaactaagaaagacttaagggaattagagaaatagaaagaaagccagtgtgattgacagtattgagtccatcagttcaaatttgagagatagacaggcaccagatctttcatacagggccttttaggcaatgttaatgtttgttttattttatcctacaatgggacattattgaaggattctgagcagggaaatgacatgattcaaattgtgtttaaaggacatctctttttgagatgttgaaaatggattgcaggccgggcgcagtggctcacgcctgtaatcccagcactttgggaggccgaggttggggggatcacgaggtcaggacttcaagaccagcctggccaacgtggcaaaaccccgtctctactaaaattacaaaaattagccaggtgtggtggcgggcacctgtaatcccagctactcgggaggctgaggcaggagactcgcttgaacccgggaggcaaaggttgcagtgagccgagatcgtgctattgcactccagcctaggtgacaagagcaagactccatctcaaaaaaaaaaaaaaaagaaaagaaaagaaaagaaaatggattgcagtgggtcaagagaggaggagatgccctaatacgagcaagagatgacgttggcttggacaaaggaggtagctgacaataaaggtagagagaaatatgatgtgggagtaaaattctctaacatattatctgtattgtttttcgttttcctatgattgtactttttcattatattaaccttgcttttcccttcatctttctcagtgatttacaactttaacatggcttatgatgtatgaggggtgggagcagaggcatggctggagcagtatggaaaagcaactccctaaaggagtctatatgttatatttattcatttcatccaacagatacttactgagctcttactatatggtaggcaccagtgtacatacagggatacagtggttaaagataaacaaggccggccaggtgcggtggctcatgcctgtaatcccagcactttgggaggccaaggcgggcggatcacctgaggtcaggagttttgagaccagcctgaccggcatggagaaaccccgtctctactaaaaatacaaaattagccgggtgtggtggcgcatgcctgtaatcccagctactcgggaggttgaggcaggagaatcgcttgaacccgggaggcagagtttgtggtgagccgagatcgtgccattgtactctagcctgggcaacaacagtgaaataccgtctcaaaaaaaaagaaaagacaaacaaggcctctgctcctctggaacttaccttgtaatgggatgagataaacataaataaacaataaattaaaatatcagatactggtaaatgttatgcaggaaattaaaacagtgttatggagtagagagtaactgactcagtgctttagatttagggataagggaaggcgtctccgaagaggtgatacttaagctcatacctgaagagcaagaaagagctagctatgtgagggttttggagggagaatattccaggtggagggagaatattccaggtagagggaataggtagtgcaaaggtcctaaggcaagaacaagcttgatgggattaaaatgtagaaggaaaccaacatggttggagcataatgattgcaggaaagaatgatacaaggtaaagttagaggggtagggaccagatgttgagtctgtaagcctctctaaggtatttatattttattatgaatgtgacaggaagaaaaccatggagagctgtggtttgtttatttgtttttggttttttttttttttgagatggagtcttgctctgtcgcccaggctggagcgcaatggtgcaatctcagctcactgcaacgtccatctcttgggttcaagtgattctgctgcctcagcctcctgagtagctgggattacaggcacgcgccaccacacccagctaatttttgtatttttagtagagacagggtttcaccacgttggtcaggctagtctccaactcctgacctcatgatccacttgcctccacctcccgaagtgctgggattataggcgtgagccaccacgcctggccaaccatggagagttttaagaagggaagtaatgatgtgatttatgtttatgctagctattatatgaaaatagattgttgggggtgggggcaacaatggccacagtgagaccagttaaaacattaaagcagaagtccagacaagagatgttagtggcttagagtatggcagtgcggtgtgatagagagatgtggttggttgggttcaggatatactttgaaggtagtacaagttattgagtacagaccaccattgtcagattggattacaaataaaaaacatggattttttactgaagaaatttataatttaacacatttggcaattacttaaacctctgggcctctaaaggaatagggattggatttagatcacctttaatatgtttgagtctctgagacatctgaaatttgttctttcaaaacaagtttgccttgttataggtcaagttgagagagagatggagagtgtgtgtgtgtgtgtgtgtgtgtgtgtgtgtgttgccaagtggaaaatgaaatttgagattgaccttggaagatttcatgatgctcatggagtttaaaccaggatcttaaggtgcacataaacatgtattagttacagaatgttgggaggactttgtttcttcatttttattgggacataattgacaaatagaaattacatatatttaaggagttatagctcgatgtttgtacatgtacgttgtgacatgatcaccacagtcaagctaattaacatatccatcacctcacataattaccttttttcttttatggtaagaacacttaagatctaccttcctggcagatttcaaatatacaatacagtattgttaactatagtcacaatgtagtacattagatctccagaacttactcatcttgcataactgaaacttatacgctttgaccagtatcttcccatttccctcactccccaacccctggcaacccccattctattctgtgcccctatgagttagccttttttttttttttttgagacagagtcttgctttgttgcccaggccggagtgcagtggtgagatctctgcaacctctgcttcctgggttcaagcaattctcatgcctcagcctcccaagtagctgggattacaggtgctggccaccacaactggccaatttttgtatttttagtagggacggggtttcaccatgttggccaggctggtcttaaactcctgacctcaggtgatccacctgccttggcctcccaaagtgctgggattacaggcatgagccaccacgcccggccttattttagcttccacctataagtgagattatgcagtatttgtctttctgtgtctggcttattttgcttagcatagtgtcctcgatggaggacatttctaataggggtaatagcattcactttacttctgatctaatgtgtaatctctttgctacaggaaaagaaaatgttaaaatgtgatgttggatatgttaagtaggtatacatgcccttactgacccttttgctctgtgtatcaggtactatttgttttccctcatcatgaatttgagccgtgatgcttatgagattcgcctactgatggagcaagagtcttctgcttgtagccggcgactgaaaggttctggaggaggagtcccaggaggaagtgaaactgggggacttgggggaccagggactccaggaggaggtctgccccaactggctctgaaacttcggctgcaagtcctgctcctggctcgagtccttagaggtcatcccccacttctgctagacgtggtcagaaatgcctgtgatctcttcattcctctggacaaactaggcctctggcgctgtggccctgggattgtggggctttgtggcctcgtgtcctccatcctgtctattctcaccctaatctatccctggctacgactcaagccctgaccttccggtacaggataaggaggggacctgaattggtgagatggaatcttagatcgtcccccatgtgccagcctcattcgaattctactctttggttaaagttagaaattcagagatttaggggtggaggaagagctttggggaagatgaggtaaggaaagatgactcgtgaagttaataggatgtctctaatttctagatgtgcctgagcttctgttcttttcctctttctttgtgtctctcttgaatatatttactttgtgtctcttaactctgtttaaggttctgtgtctatgcatctctctctttcttttttcaaccttctcattctcctatccagggatttaatcagcagaattactttttgataggggaggtataaggtttggcctgtaaggttctaactgccttcttttttctcacagaggtggcttatggcagatttttcctccttcaaactccaaacataatttttaagactatgtgccagtggactcttcccttatatctctgcaccacaagttgttggatgtttcctcttcctcccttatgtctacctcaccaacctcgctcatcatttggcccttatccttccttgtacacctaccttcagatttctgcttacactttgatttcagagctttattccccagtctgttcttactcctttgtcgcttatccagaatgatgctatgtgtagcatcttgctgtaaatcctgtacaatgattctgtgtaaatagctgtggcctatgccaataatgaagagcaagcctttcaggtaagcaaattaaagttcagtttgctcatcgaca

SEQ ID NO: 460 - DNA, 7568 bp, Homo sapiens; identical to SEQ ID NO: 459

SEQ ID NO: 461 - DNA, 7568 bp, Homo sapiens; identical to SEQ ID NO: 459

SEQ ID NO: 462 - DNA, 7173 bp, Homo sapiens
aactccggctacgggggcccgaacggaccgtgaggcgcagatttgagccgctgttgagatgattcctttccgttcgcggaagagatggggaaactgaggcatgagtgggccagcggggaggccgctcagggttgctgtgtccacataagaccgacagtgtcctcactgggcggtgatggaatgaggagcattcgccccacggtggatagccccagactctgcccccagagctgaggaggcactcccagtttccgtgtccccacaccgtgctgccattcgggaactcccctgcctccgccctggcgtttggtctccattcagctagagggccttgaaatctctcagttcacctattctgaggaataaaatgccctccaactgtctgcctccccctcatcgatcacgtacatgctcacgctgatgtgcttgtgatggacccctgcggcctgcactggccccttcaggcctcatcattgtcaaatctctaatttgctcaacattcagtagtgctccccacccctttctagactcttttttctccttatgcctttcccttcctctggcctggagaaatggtgagatatgggcatggaggaggaaggggagtgttctcaaactgggaaagggggaagtctgtctgtgccttttggaagatagttttgagcggaaggttagggaggtctccaccttaccttgcctgccctctcctctagggccgcccagtatgcttgctctcttcttggccatgcgctgcagaggcatggagccagtcctgagttacagaaacagattcgacaactggagagccacctgagccttggaagaaagcgtaagtaactctgtctttccttttatcccccaacctttcctccatccccagctcaccttcctttgtccctccttcctgtaccctctctgttcttctttctcatttggctctgcacttaccctctgcatgagtccagttgagataagagagcaggggtatggaagtaattaggcggactggagagaatgggtcaagtttgagaaaactaaactggcacaaaaattaaatttgaaattgaaaaatggactgtttctgctctttattttttatttttttgagacagagtctctcgtccaggtcagagtgcagtggcgcaatcttggctcactgcaacctctgcctcccaggttcaagcaattctcctgtctcagcctcctgagcagctgggactacaggtgcccaccaccatgccgggctaatttttgtatttttagtagagatggggttacaccatgttggccaggctggtctcaaactcgtgacctcaggtgatccacccacctcggcctcccaaaatgttgggattacaggcttgagccaccatgcccagcctgtttctgctctttaaaaaaattgtcattattattgctcaacttttgccctcttgctttctctgtttctgtttcttgttatctgcctctccacttacaaatccttgctttccctttctaatctccacaagttctacgcctgggtaactcagcagatgcccttgagtcagccaaaagagctgttcacctatcagatgttgtcctgagattctgcatcactgttagtcacctcaatcgagccttgtacttcgcctgtgacaatgtcctgtgggctggaaagtctggactggctccccgtgtggatcaggagaagtgggcccagcgttcattcaggtttgatatcctgttctcctttaagatttttttttgtagcctctatattgcatagcttgtcttatatgagggaaagatatcttaggatctttccagagtatataagtcttgatcagtcacttggcttccaatcacttagatcttaaactatcggagaatatcaaatggggagagatggaagacagatgctcttccataatgaatgactaatattgtgcaaggtaagatattatatcactttaattgtgcttctataccacaggttattccccctcactacctgcttactcattcattccaaagatatttattagatgcttactgtggcgcaggggataaagcaaagagctaaacagataatgtgcctgctcccatgaagcttctagtttagtgagggagttagatactacaatgaataacttctcatatatatttgtggaaaagtatgcggtattatgaaagaatatcacaaggggagctaatttagattggaaaatcaggaaaaaactctttgagaaagtaatattttagctcagacctgatgtctgagtaggaggagttagacaaagccaacagtagcagaaaagacatttccaaacagagaaaattgcacattctaagtaaggctttgaactaagaaagacttaagggaattagagaaatagaaagaaagccagtgtgattgacagtattgagtccatcagttcaaatttgagagatagacaggcaccagatctttcatacagggccttttaggcaatgttaatgtttgttttattttatcctacaatgggacattattgaaggattctgagcagggaaatgacatgattcaaattgtgtttaaaggacatctctttttgagatgttgaaaatggattgcaggccgggcgcagtggctcacgcctgtaatcccagcactttgggaggccgaggttggggggatcacgaggtcaggacttcaagaccagcctggccaacgtggcaaaaccccgtctctactaaaattacaaaaattagccaggtgtggtggcgggcacctgtaatcccagctactcgggaggctgaggcaggagactcgcttgaacccgggaggcaaaggttgcagtgagccgagatcgtgctattgcactccagcctaggtgacaagagcaagactccatctcaaaaaaaaaaaaaaaagaaaagaaaagaaaagaaaatggattgcagtgggtcaagagaggaggagatgccctaatacgagcaagagatgacgttggcttggacaaaggaggtagctgacaataaaggtagagagaaatatgatgtgggagtaaaattctctaacatattatctgtattgtttttcgttttcctatgattgtactttttcattatattaaccttgcttttcccttcatctttctcagtgatttacaactttaacatggcttatgatgtatgaggggtgggagcagaggcatggctggagcagtatggaaaagcaactccctaaaggagtctatatgttatatttattcatttcatccaacagatacttactgagctcttactatatggtaggcaccagtgtacatacagggatacagtggttaaagataaacaaggccggccaggtgcggtggctcatgcctgtaatcccagcactttgggaggccaaggcgggcggatcacctgaggtcaggagttttgagaccagcctgaccggcatggagaaaccccgtctctactaaaaatacaaaattagccgggtgtggtggcgcatgcctgtaatcccagctactcgggaggttgaggcaggagaatcgcttgaacccgggaggcagagtttgtggtgagccgagatcgtgccattgtactctagcctgggcaacaacagtgaaataccgtctcaaaaaaaaagaaaagacaaacaaggcctctgctcctctggaacttaccttgtaatgggatgagataaacataaataaacaataaattaaaatatcagatactggtaaatgttatgcaggaaattaaaacagtgttatggagtagagagtaactgactcagtgctttagatttagggataagggaaggcgtctccgaagaggtgatacttaagctcatacctgaagagcaagaaagagctagctatgtgagggttttggagggagaatattccaggtggagggagaatattccaggtagagggaataggtagtgcaaaggtcctaaggcaagaacaagcttgatgggattaaaatgtagaaggaaaccaacatggttggagcataatgattgcaggaaagaatgatacaaggtaaagttagaggggtagggaccagatgttgagtctgtaagcctctctaaggtatttatattttattatgaatgtgacaggaagaaaaccatggagagctgtggtttgtttatttgtttttggttttttttttttttgagatggagtcttgctctgtcgcccaggctggagcgcaatggtgcaatctcagctcactgcaacgtccatctcttgggttcaagtgattctgctgcctcagcctcctgagtagctgggattacaggcacgcgccaccacacccagctaatttttgtatttttagtagagacagggtttcaccacgttggtcaggctagtctccaactcctgacctcatgatccacttgcctccacctcccgaagtgctgggattataggcgtgagccaccacgcctggccaaccatggagagttttaagaagggaagtaatgatgtgatttatgtttatgctagctattatatgaaaatagattgttgggggtgggggcaacaatggccacagtgagaccagttaaaacattaaagcagaagtccagacaagagatgttagtggcttagagtatggcagtgcggtgtgatagagagatgtggttggttgggttcaggatatactttgaaggtagtacaagttattgagtacagaccaccattgtcagattggattacaaataaaaaacatggattttttactgaagaaatttataatttaacacatttggcaattacttaaacctctgggcctctaaaggaatagggattggatttagatcacctttaatatgtttgagtctctgagacatctgaaatttgttctttcaaaacaagtttgccttgttataggtcaagttgagagagagatggagagtgtgtgtgtgtgtgtgtgtgtgtgtgtgtgtgttgccaagtggaaaatgaaatttgagattgaccttggaagatttcatgatgctcatggagtttaaaccaggatcttaaggtgcacataaacatgtattagttacagaatgttgggaggactttgtttcttcatttttattgggacataattgacaaatagaaattacatatatttaaggagttatagctcgatgtttgtacatgtacgttgtgacatgatcaccacagtcaagctaattaacatatccatcacctcacataattaccttttttcttttatggtaagaacacttaagatctaccttcctggcagatttcaaatatacaatacagtattgttaactatagtcacaatgtagtacattagatctccagaacttactcatcttgcataactgaaacttatacgctttgaccagtatcttcccatttccctcactccccaacccctggcaacccccattctattctgtgcccctatgagttagccttttttttttttttttgagacagagtcttgctttgttgcccaggccggagtgcagtggtgagatctctgcaacctctgcttcctgggttcaagcaattctcatgcctcagcctcccaagtagctgggattacaggtgctggccaccacaactggccaatttttgtatttttagtagggacggggtttcaccatgttggccaggctggtcttaaactcctgacctcaggtgatccacctgccttggcctcccaaagtgctgggattacaggcatgagccaccacgcccggccttattttagcttccacctataagtgagattatgcagtatttgtctttctgtgtctggcttattttgcttagcatagtgtcctcgatggaggacatttctaataggggtaatagcattcactttacttctgatctaatgtgtaatctctttgctacaggaaaagaaaatgttaaaatgtgatgttggatatgttaagtaggtatacatgcccttactgacccttttgctctgtgtatcaggtactatttgttttccctcatcatgaatttgagccgtgatgcttatgagattcgcctactgatggagcaagagtcttctgcttgtagccggcgactgaaaggttctggaggaggagtcccaggaggaagtgaaactgggggacttgggggaccagggactccaggaggaggtctgccccaactggctctgaaacttcggctgcaagtcctgctcctggctcgagtccttagaggtcatcccccacttctgctagacgtggtcagaaatgcctgtgatctcttcattcctctggacaaactaggcctctggcgctgtggccctgggattgtggggctttgtggcctcgtgtcctccatcctgtctattctcaccctaatctatccctggctacgactcaagccctgaccttccggtacaggataaggaggggacctgaattggtgagatggaatcttagatcgtcccccatgtgccagcctcattcgaattctactctttggttaaagttagaaattcagagatttaggggtggaggaagagctttggggaagatgaggtaaggaaagatgactcgtgaagttaataggatgtctctaatttctagatgtgcctgagcttctgttcttttcctctttctttgtgtctctcttgaatatatttactttgtgtctcttaactctgtttaaggttctgtgtctatgcatctctctctttcttttttcaaccttctcattctcctatccagggatttaatcagcagaattactttttgataggggaggtataaggtttggcctgtaaggttctaactgccttcttttttctcacagaggtggcttatggcagatttttcctccttcaaactccaaacataatttttaagactatgtgccagtggactcttcccttatatctctgcaccacaagttgttggatgtttcctcttcctcccttatgtctacctcaccaacctcgctcatcatttggcccttatccttccttgtacacctaccttcagatttctgcttacactttgatttcagagctttattccccagtctgttcttactcctttgtcgcttatccagaatgatgctatgtgtagcatcttgctgtaaatcctgtacaatgattctgtgtaaatagctgtggcctatgccaataatgaagagcaagcctttcaggtaagcaaattaaagttcagtttgctcatcgaca

SEQ ID NO: 463 - DNA, 7135 bp, Homo sapiens
agatttgagccgctgttgagatgattcctttccgttcgcggaagagatggggaaactgaggcatgagtgggccagcggggaggccgctcagggttgctgtgtccacataagaccgacagtgtcctcactgggcggtgatggaatgaggagcattcgccccacggtggatagccccagactctgcccccagagctgaggaggcactcccagtttccgtgtccccacaccgtgctgccattcgggaactcccctgcctccgccctggcgtttggtctccattcagctagagggccttgaaatctctcagttcacctattctgaggaataaaatgccctccaactgtctgcctccccctcatcgatcacgtacatgctcacgctgatgtgcttgtgatggacccctgcggcctgcactggccccttcaggcctcatcattgtcaaatctctaatttgctcaacattcagtagtgctccccacccctttctagactcttttttctccttatgcctttcccttcctctggcctggagaaatggtgagatatgggcatggaggaggaaggggagtgttctcaaactgggaaagggggaagtctgtctgtgccttttggaagatagttttgagcggaaggttagggaggtctccaccttaccttgcctgccctctcctctagggccgcccagtatgcttgctctcttcttggccatgcgctgcagaggcatggagccagtcctgagttacagaaacagattcgacaactggagagccacctgagccttggaagaaagcgtaagtaactctgtctttccttttatcccccaacctttcctccatccccagctcaccttcctttgtccctccttcctgtaccctctctgttcttctttctcatttggctctgcacttaccctctgcatgagtccagttgagataagagagcaggggtatggaagtaattaggcggactggagagaatgggtcaagtttgagaaaactaaactggcacaaaaattaaatttgaaattgaaaaatggactgtttctgctctttattttttatttttttgagacagagtctctcgtccaggtcagagtgcagtggcgcaatcttggctcactgcaacctctgcctcccaggttcaagcaattctcctgtctcagcctcctgagcagctgggactacaggtgcccaccaccatgccgggctaatttttgtatttttagtagagatggggttacaccatgttggccaggctggtctcaaactcgtgacctcaggtgatccacccacctcggcctcccaaaatgttgggattacaggcttgagccaccatgcccagcctgtttctgctctttaaaaaaattgtcattattattgctcaacttttgccctcttgctttctctgtttctgtttcttgttatctgcctctccacttacaaatccttgctttccctttctaatctccacaagttctacgcctgggtaactcagcagatgcccttgagtcagccaaaagagctgttcacctatcagatgttgtcctgagattctgcatcactgttagtcacctcaatcgagccttgtacttcgcctgtgacaatgtcctgtgggctggaaagtctggactggctccccgtgtggatcaggagaagtgggcccagcgttcattcaggtttgatatcctgttctcctttaagatttttttttgtagcctctatattgcatagcttgtcttatatgagggaaagatatcttaggatctttccagagtatataagtcttgatcagtcacttggcttccaatcacttagatcttaaactatcggagaatatcaaatggggagagatggaagacagatgctcttccataatgaatgactaatattgtgcaaggtaagatattatatcactttaattgtgcttctataccacaggttattccccctcactacctgcttactcattcattccaaagatatttattagatgcttactgtggcgcaggggataaagcaaagagctaaacagataatgtgcctgctcccatgaagcttctagtttagtgagggagttagatactacaatgaataacttctcatatatatttgtggaaaagtatgcggtattatgaaagaatatcacaaggggagctaatttagattggaaaatcaggaaaaaactctttgagaaagtaatattttagctcagacctgatgtctgagtaggaggagttagacaaagccaacagtagcagaaaagacatttccaaacagagaaaattgcacattctaagtaaggctttgaactaagaaagacttaagggaattagagaaatagaaagaaagccagtgtgattgacagtattgagtccatcagttcaaatttgagagatagacaggcaccagatctttcatacagggccttttaggcaatgttaatgtttgttttattttatcctacaatgggacattattgaaggattctgagcagggaaatgacatgattcaaattgtgtttaaaggacatctctttttgagatgttgaaaatggattgcaggccgggcgcagtggctcacgcctgtaatcccagcactttgggaggccgaggttggggggatcacgaggtcaggacttcaagaccagcctggccaacgtggcaaaaccccgtctctactaaaattacaaaaattagccaggtgtggtggcgggcacctgtaatcccagctactcgggaggctgaggcaggagactcgcttgaacccgggaggcaaaggttgcagtgagccgagatcgtgctattgcactccagcctaggtgacaagagcaagactccatctcaaaaaaaaaaaaaaaagaaaagaaaagaaaagaaaatggattgcagtgggtcaagagaggaggagatgccctaatacgagcaagagatgacgttggcttggacaaaggaggtagctgacaataaaggtagagagaaatatgatgtgggagtaaaattctctaacatattatctgtattgtttttcgttttcctatgattgtactttttcattatattaaccttgcttttcccttcatctttctcagtgatttacaactttaacatggcttatgatgtatgaggggtgggagcagaggcatggctggagcagtatggaaaagcaactccctaaaggagtctatatgttatatttattcatttcatccaacagatacttactgagctcttactatatggtaggcaccagtgtacatacagggatacagtggttaaagataaacaaggccggccaggtgcggtggctcatgcctgtaatcccagcactttgggaggccaaggcgggcggatcacctgaggtcaggagttttgagaccagcctgaccggcatggagaaaccccgtctctactaaaaatacaaaattagccgggtgtggtggcgcatgcctgtaatcccagctactcgggaggttgaggcaggagaatcgcttgaacccgggaggcagagtttgtggtgagccgagatcgtgccattgtactctagcctgggcaacaacagtgaaataccgtctcaaaaaaaaagaaaagacaaacaaggcctctgctcctctggaacttaccttgtaatgggatgagataaacataaataaacaataaattaaaatatcagatactggtaaatgttatgcaggaaattaaaacagtgttatggagtagagagtaactgactcagtgctttagatttagggataagggaaggcgtctccgaagaggtgatacttaagctcatacctgaagagcaagaaagagctagctatgtgagggttttggagggagaatattccaggtggagggagaatattccaggtagagggaataggtagtgcaaaggtcctaaggcaagaacaagcttgatgggattaaaatgtagaaggaaaccaacatggttggagcataatgattgcaggaaagaatgatacaaggtaaagttagaggggtagggaccagatgttgagtctgtaagcctctctaaggtatttatattttattatgaatgtgacaggaagaaaaccatggagagctgtggtttgtttatttgtttttggttttttttttttttgagatggagtcttgctctgtcgcccaggctggagcgcaatggtgcaatctcagctcactgcaacgtccatctcttgggttcaagtgattctgctgcctcagcctcctgagtagctgggattacaggcacgcgccaccacacccagctaatttttgtatttttagtagagacagggtttcaccacgttggtcaggctagtctccaactcctgacctcatgatccacttgcctccacctcccgaagtgctgggattataggcgtgagccaccacgcctggccaaccatggagagttttaagaagggaagtaatgatgtgatttatgtttatgctagctattatatgaaaatagattgttgggggtgggggcaacaatggccacagtgagaccagttaaaacattaaagcagaagtccagacaagagatgttagtggcttagagtatggcagtgcggtgtgatagagagatgtggttggttgggttcaggatatactttgaaggtagtacaagttattgagtacagaccaccattgtcagattggattacaaataaaaaacatggattttttactgaagaaatttataatttaacacatttggcaattacttaaacctctgggcctctaaaggaatagggattggatttagatcacctttaatatgtttgagtctctgagacatctgaaatttgttctttcaaaacaagtttgccttgttataggtcaagttgagagagagatggagagtgtgtgtgtgtgtgtgtgtgtgtgtgtgtgtgttgccaagtggaaaatgaaatttgagattgaccttggaagatttcatgatgctcatggagtttaaaccaggatcttaaggtgcacataaacatgtattagttacagaatgttgggaggactttgtttcttcatttttattgggacataattgacaaatagaaattacatatatttaaggagttatagctcgatgtttgtacatgtacgttgtgacatgatcaccacagtcaagctaattaacatatccatcacctcacataattaccttttttcttttatggtaagaacacttaagatctaccttcctggcagatttcaaatatacaatacagtattgttaactatagtcacaatgtagtacattagatctccagaacttactcatcttgcataactgaaacttatacgctttgaccagtatcttcccatttccctcactccccaacccctggcaacccccattctattctgtgcccctatgagttagccttttttttttttttttgagacagagtcttgctttgttgcccaggccggagtgcagtggtgagatctctgcaacctctgcttcctgggttcaagcaattctcatgcctcagcctcccaagtagctgggattacaggtgctggccaccacaactggccaatttttgtatttttagtagggacggggtttcaccatgttggccaggctggtcttaaactcctgacctcaggtgatccacctgccttggcctcccaaagtgctgggattacaggcatgagccaccacgcccggccttattttagcttccacctataagtgagattatgcagtatttgtctttctgtgtctggcttattttgcttagcatagtgtcctcgatggaggacatttctaataggggtaatagcattcactttacttctgatctaatgtgtaatctctttgctacaggaaaagaaaatgttaaaatgtgatgttggatatgttaagtaggtatacatgcccttactgacccttttgctctgtgtatcaggtactatttgttttccctcatcatgaatttgagccgtgatgcttatgagattcgcctactgatggagcaagagtcttctgcttgtagccggcgactgaaaggttctggaggaggagtcccaggaggaagtgaaactgggggacttgggggaccagggactccaggaggaggtctgccccaactggctctgaaacttcggctgcaagtcctgctcctggctcgagtccttagaggtcatcccccacttctgctagacgtggtcagaaatgcctgtgatctcttcattcctctggacaaactaggcctctggcgctgtggccctgggattgtggggctttgtggcctcgtgtcctccatcctgtctattctcaccctaatctatccctggctacgactcaagccctgaccttccggtacaggataaggaggggacctgaattggtgagatggaatcttagatcgtcccccatgtgccagcctcattcgaattctactctttggttaaagttagaaattcagagatttaggggtggaggaagagctttggggaagatgaggtaaggaaagatgactcgtgaagttaataggatgtctctaatttctagatgtgcctgagcttctgttcttttcctctttctttgtgtctctcttgaatatatttactttgtgtctcttaactctgtttaaggttctgtgtctatgcatctctctctttcttttttcaaccttctcattctcctatccagggatttaatcagcagaattactttttgataggggaggtataaggtttggcctgtaaggttctaactgccttcttttttctcacagaggtggcttatggcagatttttcctccttcaaactccaaacataatttttaagactatgtgccagtggactcttcccttatatctctgcaccacaagttgttggatgtttcctcttcctcccttatgtctacctcaccaacctcgctcatcatttggcccttatccttccttgtacacctaccttcagatttctgcttacactttgatttcagagctttattccccagtctgttcttactcctttgtcgcttatccagaatgatgctatgtgtagcatcttgctgtaaatcctgtacaatgattctgtgtaaatagctgtggcctatgccaataatgaagagcaagcctttcaggtaagcaaattaaagttcagtttgctcatcgaca

SEQ ID NO: 464 - DNA, 18879 bp, Homo sapiens
gggaaagtgaagaaaacagaaaaggagagggacagaggccagaggacttctcatactggacagaaaccgatcaggcatggaactccccttcgtcactcacctgttcttgcccctggtgttcctgacaggtgagggaagttaacttcttggtttctggtggggatggaagatacatagattgtttggaattgggaccattatagttaaaattctttgggatttaggttaggaagcgaacactggttgtacatttcttgtatgtgtgtctgtgtccttgtgcatttttatgccctcacatatgactgtttgaatattgagactggcaggggctaaagctgcctaggaccttgtgtaagatttgtatctaataattatataatatataattgtataattatatattatatataatatacatataatatataacaattatatattatatataatatacatataatatataacataattatatattatatataatatacatataatatgtaacataattatatattatatataatatacatataatatataacataattatatattatatataatatacatataatatataacataattattatatataatatacatataatatataacataattatatattatatagttatatattgtatataataattattattattttttaaagatagggtctcactttgttgtctaggctggagtgcagtggtgcaaccacagctcagtagttgggactactaggtacgcgccaccacgcacagctaatttttttttttgaaacagggtctcactctgtcattcaagctggagtgcagtggcatgatcatggctcactctagcctcaacctcccaggctgaggtgatccttccaccttagcctcccgagtagctgggactataggcgtgtgctaccacgcctggctaatttttttttttttagagacagagttttgctatgttggccaggctggtctttaactcctggactcaagcaatccgcccccgacagccacccaaagtgccgggattataggcatgagccaccatgcttggctgagatttgtatctaaatatataaaatcttcatcctaagccctataggggtaaggagacaaaaaagaaatgtgatgtgaccttccacgtggctagtctgattcctattatcccctccctaacttcttacccttggtggtccctggggcctgaggcataactgactaactatgtggtcagaactctgggtttatctaaccaatgagctgcagtttctggtcatacagccctgccagttttctggatgcaaaactgctcacatactaaacacctttctgaaaatgagcatggtttgggataaagctatagccattggtaatggtgagggggtagcctgagagggggttgcttagaagtacagagcaagacatagttggggaaaggaccatgggaaggacaagaggcctggaatttttccttggcagtgccctgtaatcattgtttcctaaaataccagctctgattttaaaggcattggggtcaaaagggaagattagctagggtcgggcacctttagaatgggctgaaggctgaggaaaccatggaggtaggtaggggaccagttgggagagtagattagttaaaaaggaagcaggttgtgggaaacttcaggatgatgggacccttggaaaggatggatggcaaactatgtgtgtgggcaggcgagtggccccacccagttaattaccactgagatttccaaggctggaatcaaccagggacctagacattggaaaaagacagtgagagtgtgacaatgacactggaagtcaggaagagatagagaaggagagagccagacatgcagtgctccttagcttcctttcattccccctattttggggagaattggaagcaatggttgttctggggatacagaaaggccctctccctcttttgaccctcacagtttgttgaggagagtgtgtggaaggaatgttgtggaaaagagtagccaggcgcggtggctcacgcctgtaatcccagcactttgggaggccgaggcgggcggatcatgaggtcaggagatcgagaccatcctggctaacacggtgaaactccgtctctactaaaaataagaaaaattagccgggcgaggtggcaggcgcctgtagtgccagctacacgggaggctgaggcaggagaatggcgtgaacccaggggggcggagcctgcagtaagccgagatcacgccactgcactccagcctgggcgacagagagactccgtctcaaaaaaaaaaaaaaaaaaaaaaaaaaaaaaagtaacttgaccttttcagacatgtctgtgaatgaaatttcaggggtgggaatggaaatacagctgtacatcagcatggcagagggccacagtttaggcatctggacacaaacacaggaagggaatcatctttgcctggagctctgagtacatgacactgagagaggccagaaaagcttatgagtgaaaaagcaggcaggcagactgagattaagacgcttcctcacagcttctctcgggctgtgcctctagccattcactacctcatactaacattatgatcctgaccccacaggtctctgctccccctttaacctggatgaacatcacccacgcctattcccagggccaccagaagctgaatttggatacagtgtcttacaacatgttgggggtggacagcgatggtgaggaagaaaccggagtgccaggggattgggactgcagtagtgctaacaaaggggaggcaagatagatgggactctaaactaatctggtcttttgaaagtggctggggctctaaacttaccacctccatgctctttccctttggcctatgtcaagggtcatgtttgccctgtgcttacttacattcacatcctcttcccaggatgctggtgggcgccccctgggatgggccttcaggcgaccggaggggggacgtttatcgctgccctgtagggggggcccacaatgccccatgtgccaagggccacttaggtgagaagatgcctgacccttctcctcctaacccctgactttgatactctagaagcttcaactccctatacctcagctttttcacccctaaaatccgcatactccctgtccccaatctgataccaatccctgctcattctcctccaaaatcacatgaattcaagcaccccatctatgaccccatgatctcattctcttccacctccttccaaccaggtgactaccaactgggaaattcatctcatcctgctgtgaatatgcacctggggatgtctctgttagagacagatggtgatgggggattcatggtgagctaaggagagggtggtggcagtgtctctgaaggtccataaaagaaaaaagagaagtgtggtaagggaaaatggtctgtgtggaggggtcaaggagttaaaaaccctagaaagcaaaaggtaggtaatgtcagggagtagtcttcatgcctccttcaactgggagcatgttctgagggtgccctcccaagcctgggagtaactatttcccccatccccaggcctgtgcccctctctggtctcgtgcttgtggcagctctgtcttcagttctgggatatgtgcccgtgtggatgcttcattccagcctcagggaagcctggcacccactgcccaacgtgagccagaggaaggctgagtacttggttcccagaaggagatactgggtgggaaaaagatggggcaaagcggtatgatgcctggcaaagggcctgcatggctatcctcattgctacctaatgtgcttgcaaaagctccatgtttcctaacagattcagactcctggccaggtgtggtggcccacacctgtaattctagcactttgggaggccaaggtgggcagatcacttgaggtcaggagttcaagaccagcctggccaacatggtgaaactccatctctactaaaaaaaaaaaatacaaaaattagctgggtgcgctagtgcatgcctgtaatctcatctactcgggaggctaagacaggagactctcacttcaacccaggaggtggaggttgcggtgagccaagattgtgcctctgcactctagcgtgggtgacagagtaagcgagactccatctcaaaaataataataataataattcagactccttatcaggagtccatgatctggcctggcacagtaactcatgcctgtaatcccaacattttgggaggccaacgcaggaggattgcttgaggtctggaggtttgagaccagcctgggcaacatagagagaccccatctctacaaaaataaaaaataaaaaaattagctgggtatggtggtgcatgcctgtggtcccagctactcaggaggccaaggtgggaggatcacttgagcccaggtggtccaggctgcagtgagccatgattatgccactacactccagcctgggcgacagagtgagactctgtctcaaaaacaaacaaaatgggccaggcgtggtggctcacgcctgtaatcccagcactttgggaggccgaggccagtggatcacgaggtcaggagatcgagaccatcctggctaacagagtaaaaccctgtctctgctaaaaacacaaaaaattagccgggtgtcgtggcgggcgcctgtagtcccagctactcgggaggctgaggcaggagaatggcgtgaacccaggaggcagagcttgcagtgagccgagattgcgccactgcactccagcctgggcaatagagcgagactctgtctcaaaaaaaaaaaaatgttctctacccacatgcctttcctaatattctcttctccttaaacattttcagtcttcatagttgctaccatgtttcattcctcaccatcagaaccactctgcttttgttcccccaccatacagtcattgctatgttcctacatagcatttaattccttcttgttttttagaacattgtatatataaattatatctatgtatataaatgtgtaggtgtgtgtgtttatatacctatatatacatatatacatatatatacatttatatgtatacttacatacacacaattactaaagattactaaaggaatattttattaatttctacacttacacagagcctggcacagtaccttctttgcatgtaagaagtgccttataaatgtctaaattgaatgtgtcctcctgtgacctctttcccttgttgcccccagctcagtgtcctctacctcagtgttccccttccttctaggctgcccaacatacatggatgttgtcattgtcttggatggctccaacagcatctacccctggtctgaagttcagaccttcctacgaagactggtagggaaactgtttattgacccagaacagatacaggtaagagaaggcaatatgagctgggcacagttgcttgtggcacctacttaagaggtggaggtgggaggatcccctgaggccaggagttcaagactagcctgggcaatacagtgagacctcatctctaaaaatatgaaagaaaaaaaaaatagccaggcatggtggcatgcgcctacagtcccagctactcaggaggctgaggcaagagatcagttgagcccaggagtttgaggctgtagtgagctttgatcacacaactgcactccagcctgggtgaaagagtgagacctcatttcttagagagagagagaaaggcaatatggatgggcttggaaggggagagacagagagagaggggataaatgtaggtgttgtcttcagtagtatccaggtgttcatctctcctctcttatatactttcttcttcctcctctccccccatctcacatacatacatttcatttgaatgcgctttattcccaggtgggactggtacagtatggggagagccctgtacatgagtggtccctgggagatttccgaacgaaggaagaagtggtgagagcagcaaagaacctcagtcggcgggagggacgagaaacaaagactgcccaagcaataatggtggcctggtgaggcattgggaagacaggtgtgggaggctagagcaatgaaggcttagaagagttagggcggggccaggcatggtggctcacgcctgtaatcccagcactttgggaggcaaggcaggcggatcacctgaggtcaggagttcgagaccagcctgaccaacatggagaaaccccatctctactaaaaatacaaaattagccaggcatggtggcgcatgcctgttcagaggcatgctacttcggaggctgaggcaggagaatcacttaatcccgggaggtggaggttgcagtgagtcgagatcacaacattgcactccagcctgggcaacgagagcaaaactccatctaaaataaaataaaataaaatgaaatgaaaatctttcccttaaaaaaaaaaaaagaagaagaagaagagttagggcaggtttggagtgcagtgtgtatatcccaagatgtcttgcatactttctttgtatgtacactaatggtacaaagaggaaggctaagtgggctgtcattgtactccctctcactgcatttctacaaagtatctatgtctgtgtctctccatatttcacagacagaagtctctttctatccctccactccaacaatgatcctggcccacaggttctccactactgatgtcctagcccacgttccaaacatgatccaaaactcatctctaggggcacggtggtaaaattgaaacaaaacaaaacaactcatctctgggaggagtccctgcccagatcattcttttccgttctatatttcatcgatatttcccctcccaagtgcaatatttgttgaatgaatctgagtgtatgaacgttgtacttatttggactgataagctactctgtatgttctatgaccttcaaacatttgagctctcactccatgccatctccatgttaaatactcaggaaatggcctaaaaggcaagatgcttgacctcagggaagtgctgatgttaaatcctgtgtgtgtgtgtgtgtgtgtgtgtgtgtgtgtgtgtgtgtatgtgtgtgtgtgtgtgtgtgtctgcatacatctgatctcacctcactcctttctcttctcagcacagaagggttcagtcagtcccatgggggccgacccgaggctgccaggctactggtggttgtcactgatggagagtcccatgatggagaggagcttcctgcagcactaaaggcctgtgaggctggaagagtgacacgctatgggattgcagtgagaattcaccctggatctggaagagttggggagtggcaggggggcagtgtcttgtgaactgtccaaggactgggaacttgaggaaaacaagggcattaactacttcccagacttcagccacagcatgttagttggctgtgttctgtaccaactctaatgcctcattccttgatcttatgacctcttaggtccttggtcactacctccggcggcagcgagatcccagctctttcctgagagaaattagaactattgccagtgatccagatgagcgattctttttcaatgtcacagatgaggctgctctgactgacattgtggatgcactaggagatcggatttttggccttgaaggtgaggattactctggagaaatggacagggcgggagaagttctggagtgtaggtggggctctggagtgagttcagtaggtcaaaggggaaactgtcttcccctgatattgtctcaatgttttctcatgaccaagggtcccatgcagaaaacgaaagctcctttgggctggaaatgtctcagattggtttctccactcatcggctaaaggttggacagattgaccccttcattacttctcccattctctgactcagataacttcaaccacagggccctccagattcctcctttaaccagcctccatgctcaccttcccatgcctttccaactgagcccagcagaccctcagtgatcttttcactcctggaacgttttttttctctttattccccactgtcttctcagtgaccccatctgcttctgtcccacaggatgggattctttttgggatggtgggggcctatgactggggaggctctgtgctatggcttgaaggaggccaccgccttttccccccacgaatggcactggaagacgagttcccccctgcattgcagaaccatgcagcctacctgggtgagcagcagagagttgcagaggacttacagggtaggggaggaaatacatccctagtgggggcgggtatgaaatactccctcttaactcatgcggtttctcactgacctctggttacttcccttgggacctcctgctatgcctttagggaacccccctactctggaccccatcttcttttcctttacctctgttactttgcccacttctaggttactctgtttcttccatgcttttgcggggtggacgccgcctgtttctctctggggctcctcgatttagacatcgaggaaaagtcatcgccttccagcttaagaaagatggggctgtgagggttgcccagagcctccagggggagcaggtagggcatccaaggaagggtgggacctttggattcccagggacctctgggctgttggggaggagtgtgaagtgggtaagagagaggcctccaaagtctgtgcggaattctggttggcagagtctgtcagggatgtaaggagcagactagcaggctggtgagtgcttcccactgagtccacttgtctacagttaccttcccttttctctggggtcatcatcacccaccattccccagattggttcatactttggcagtgagctctgcccattggatacagatagggatggaacaactgatgtcttacttgtggctgcccccatgttcctgggaccccagaacaaggaaacaggacgtgtttatgtgtatctggtaggccaggtgagacttgctgggaccccctgccctggacttgcattgtgggggtggagggaggaaaggagggaaggtgcacatatttgagggtttgctgagaggttgggtctgccagattagcatcttctatcttctctcctccaccagcagtccttgctgaccctccaaggaacacttcagccagaacccccccaggatgctcggtttggctttgccatgggagctcttcctgatctgaaccaagatggttttgctgatgtggctgtgggggcgcctctggaagatgggcaccagggagcactgtacctgtaccatggaacccagagtggagtcaggccccatcctgcccaggtcaggagtacccaaataaagcaggggcacggttgtaggaagaggaatagggggatgctctttgcttgtcaatagtctccttggcttgagacccaaactgaacaagtgcttttattagtaggcaaaaacataaggcagtggacaggttgctgaactaagaactcctgaacacaggcaagtttctcttattcccaggactgacgggagcattataaagagcaaggcatggccgggtgtggtggttcacgcctgtaatcccagcactttggaaggctgaggcaggcagatcacctgaggtcaggagttcgagaccagcctggccaacatgatgaaactctactaaaaatacaaaaaattagccgggcctggtggcgcacacctataatcccagttactcaggaggctagggcaggagaatcgcttgaacctgggaggcggaggttgcagtgagccaagatcacaccattgcactccagcctgggcaacaagagtgaaactccatctcaaaaataaataaataaataaaaagaaagagcaaggcaggaggcctgagaaactaggtgtatgggtccctgcctcagtattctctctcttcctctcagaggattgctgctgcctccatgccacatgccctcagctactttggccgaagtgtggatggtcggctagatctggatggagatgatctggtcgatgtggctgtgggtgcccagggggcagccatcctgctcaggtgaggggtcccagctcaggtggtggtggacagcatagcatagctgttaaaggcaagggccttaaagtcacagatggagatttggttttcttggtcaacttactctgtgcctccattcttagtttataaaatgacagtagtaatagtacctaccttataggtttattgtgaagattaaatgagataatccatataatgatttgaacacagtgcctagcatgtaagtgcgtattgaagtgaatctagggctgggtacagtggctcacacctgtaatcccagcactttgggaggcgaaggtaggaggatcatttgaggccaggagttcaagaacagcctgaccaacatggtgaaaccccgtctctactaaaaatacaaaaaaattagctgagcatggttgtgggcaccagtaatcccagctactcgggaggctgaggcaggagaatcacttgaacccaggaggcagaggttgcagtgagctgagatcgccccactgcactccagcgtgggccacagagtgaaactccatctcaaaaaaaaaaaaagatcaatgacatgaatctattatcttacttctgtcagagggttcggggtagggtgacatgtgcattcagcccctccttctttgttttgaccatggggaagcaaacactgggcttgcacttctcagagggcttacctcctactgctagaatttcttttccacactgttcccagctcccggcccattgtccatctgaccccatcactggaggtgaccccacaggccatcagtgtggttcagagggactgtaggcggcgaggccaagaggcagtctgtctgactgcagccctttgcttccaagtgacctcccgtactcctggtcgctgggatcaccaattctgtgagtgactaaaatgcattacaggcaactctcaattccttgcatgccttcctcactagacccctttccaccctcactcttgcctccttcattcagacatgaggttcaccgcatcactggatgaatggactgctggggcacgtgcagcatttgatggctctggccagaggttgtcccctcggaggctccggctcagtgtggggaatgtcacttgtgagcagctacacttccatgtgctggtaaggagagggcagtaactgcttagcatcagggcctgagaatgaggagaaagctgggtcagaggaggaattttagctgaatcagcaagaaagccaaagccgggaaaatgagatgattcagactttggagtcagggctgatctgggtttgaatcctagctctgccatttaccacctatgaattctggcaagtccaaccctcagttttcttgtctgcaaaggggtgataataataactgtatcataggagttgtattaaaattaaatttagccgggcgcagtggctcacgcttgtaatcccagcactttgggaggccgaggcaggtggatcacaaggtcaggagatcgagaccatcctggctaacatggtgaaaccccatctgtactaaaaatacaaaaaattagccgggcgtggtggcaggtgcctgtagtcccagctactcgggaggctgaggcaggagaatggcctgaacccaggaggcagagcttgcagtgagccgagatcatgccactgcactccagcctgggcgacagagcgagactctgtctcaaaaataaataaataaataaataaattaactaattaattaaatttagtaatacagttaagatcttaggacagtgcccagcacacagaaaatgcttcataaatgatcactacaattatcacaagatccttgactctgtgactctgtgactctgttttccttcaggatacatcagattacctccggccagtggccttgactgtgacctttgccttggacaatactacaaagccagggcctgtgctgaatgagggctcacccacctctatacaaaagctggtcagcagtgccatgccctgccccttgctcccaacactgccctccttcaagagaaaagggagggagggagaagacatgagatcatggtgaaatctgacctgggctcctctaatcaaaatatacccacttttgtcttttcactttccccctattctattcctttcctccttgctttcctctcaacccttagccccttccctttcttccaggtccccttctcaaaggattgtggccctgacaatgaatgtgtcacagacctggtgcttcaagtgaatatggacatcagaggctccaggttggatggacatgtactaggcaaaccagggtgacctgagacagactggaagggactcgaagggcgggtagggggttgtttcttacccatgataacaaaagtgagacttttggcactcccctccttcaactcctggtctctccctcattcatcattcccaggaaggccccatttgtggttcgaggtggccggcggaaagtgctggtatctacaactctggagaacagaaaggaaaatgcttacaatacgagcctgagtctcatcttctctagaaacctccacctggccagtctcactcctcaggtgcctttggaggagggggtgtgggagaaggaaagaaaggaggaggaagaagattggggtattggcctcagctgtgaggtcctctagagaaaggctcagtgtttagaggctgtgggtaggacagcagttgcagccccagctccagcttctatctccattcccctgccctcagagagagagcccaataaaggtggaatgtgccgccccttctgctcatgcccggctctgcagtgtggggcatcctgtcttccagactggagccaaggtgggttggggtctaggatgaaaagagggctctaggagggcagaggctgggatctgagggtcctgggacttcagggaagggggcgcacaagggctcctgttcctctgtagttgttccatgaggaagactctaccattaccctgtgtcccctgcccctaggtgacctttctgctagagtttgagtttagctgctcctctctcctgagccaggtcttcgtgaagctgactgccagcaggtgagaatgaagggaactttcttccagacctctcctcctactgagtcttgactggaggggtggggaggaacaacattgattcctctattaacagagaagggtgtcttctgaggaggggttgagatgtgagcctctcccctctgaccctacagtgacagcctggagagaaatgggacccttcaagataacacagcccagacctcagcctacatccaatatgagccccacctcctgttctctaggtatgcccagcttctagggtgggacccagttctgacctcagactcatacccttatgctgcttccctccccttccatgtgcctcagtttttccaaaaacccaagcccttgcggctgctcagtctttttgccctcaatcctattcatgctgaatcttcccttttaagcatcttactttcctaggtatagtgttttgccaggccttgggcactggagctgggatgaggggatatgggatgtagccataaagcttgcattgtctgtgtcatgttctacttctgtcttctccatgtacccccacctctttatccatgtgctggccctgcctcctctgaatccacgtctgtgtgctgatcatatgcccctgtgtctgtgttatggctgtgaccatgtacttcctgacttggtgttcacacagtgagtctaccctgcaccgctatgaggttcacccatatgggaccctcccagtgggtcctggcccagaattcaaaaccactctcagggtgagaagctggaggggtcttggcatgaggagaatgtgggggaacaacagctttgtgggaaaaggatgggaagggtctctcttggattttaatggtatctagggtgaaggggaacaaatgaggaagggtcttctgtctcccacttcttcctattcccaaccttcctcttaggttcagaacctaggctgctatgtggtcagtggcctcatcatctcagccctccttccagctgtggcccatgggggcaattacttcctatcactgtctcaagtcatcactaacaatgtgagtctggtctaggagggcatggaatcctgccaccttgagctggtggactcactgaagctggacaccacaccagctccctatctgttgggcctctgctcttggggctcttctctctggggggctttctttttacacatgtggcttattagagagaagaaaaaggtattataaggggaagaactacaagggtgtaggtatgttccaactcagccttgagtggctagcgccaccccatcaggagggtctttcaagttggatcttcctctaggcaagctgcatagtgcagaacctgactgaacccccaggcccacctgtgcatccagaggagcttcaacacacaaacagactggtatgagtcacaaaggggtgtccagagtgggaatgcaagtggagttgggtgacttgggacaagagggtaggaactggagtggggaagaagggatctttccaccccagggtcctgatctggagtgggaatgaaaatggagtcaggtgccttgggacaagactgtgtgaactagaggtggggaaagaggatgtttctaccccagagtcctgatctgtctctctctgtctcttctgttagaatgggagcaatactcagtgtcaggtggtgaggtgccaccttgggcagctggcaaaggggactgaggtctctgttggactattgaggctggttcacaatgaatttttccgaagagtaagcctttccttttctagtactccccacttctgctcctttctggaactttagcataggttttggaggtagacagacccacgttcaagtttcacttttgcctcttactagctatttgaccatgagcaagttatttcatctctctaagcctctttttcctaatctctaaaatgggaagataataccaatttcatggggttgttataaagaataaatgaataatgagctggacatatggtgaacactcagtggaagctagttattatccttgtattttcctccactgaccattacttttttttttcctgaccattccttagtgctgtatcaatcaacatttgcaggatacctaaatttaatcagttaagaatccatcacgttcctattacgtaaaaggccctgtattaggttgacactgagaatatctccaacatttagcctcatgcctaactcattgtaggcgcttaacatatttttgctaaatgaatgaattattgatattacatgcaggatttgtactggggagtggtgggaagtaagattgtataggtgagagggatctagattacgaaaggcctctgaagccagggagaaactgaacttaatatgacaggtagtgaggagtcagtgtgagttcctcctgggcagggaaatggcatcttaattgtaatggctgtttggcactaaggtcaatgttgtgctttcccatatctacctggaataacacaagatccctgggatgtcatcatatgttttagggaagttaagtccaataaaccacccttctccaagtctctgtccttctttggtatctttttttcactagtctattcatgctttcaacaaagatttattaagaaaccactacatggccgggcgcggtggctcacgcctgtaatccctgcactttgggaggccaaggtgggcagatcatgagatcaggagatcgagaccatcctggctaacacggtgaaaccctgtctctattaaaaataaaaaaattagccaggtgtggtggcaggcgcctatagtcccagctacttgggaggttgaggcaggagaatggcattaacccgagagatggagtttgcagtgagccgagatcacgccactgcactccagcctgggtgacagagcgagactccatctcaaaaaaaaaaaaaagaaaccactacatacttggtactctgctatctagtaggcactaaggacacaaaggttagtaaggcacagcctttaacctagaggatcttatagttcaggagtgaaaaacagaagtaaacaccagtgttggtgggggttaggaggaatgatttccctaaatcccagaggggatgacatctaaacttcaatctaaaggaggggtagaggtcagccaaaggaaagaggagtagaatgcatttcaggtaaagcaccagatgtattgattgtccttggaaaacaaacagcagcagcagatgtgaccaggggttttccatctattacccttcctctcttttcccattggtcttcagccttttcttctggtcttgagagccctcaacattatgcctctcagcctcaactttgctgttgggattccaaagaactatatcacctgataatggctcattttaaatgtcttcctatccacttgttccataggccaagttcaagtccctgacggtggtcagcacctttgagctgggaaccgaagagggcagtgtcctacagctgactgaagcctcccgttggagtgaggtagggctggagaccgagtctgagagctgtgaaaataatgatgatgggtatgtggtagggccacccgtgggctttttcagaacgaaggcatctccatcaggcagcaggatcctagtgttccactgccgccattcctgcctcagtttctttcctttaagtagcaggaggttatttattctatttgggggctggctttgatataatgtggggtgaggctagctgggttataggatgcatgtagaaaactactcttctgtccacgcagagcctcttggaggtggttcagacccggcctatcctcatctccctgtggatcctcataggcagtgtcctgggagggttgctcctgcttgctctccttgtcttctgcctgtggaaggtaagcactgctttagtggggagtgtggagcatgatgcccatgagttgagggatccttgattatagcagagagaacaggatttgtgctgggcagctaaccaggctgtggatgtcatgcccagatctccttcactgtaccccacaaatgttggttaaattattctaagccaaataaaataaatttgaattccatttttggaaacagaacaaaagtgaagacctcagataagtctgagagctactggcaaggttcccagtctaggcatttggcagtgacgcttatcttttcttctacagcttggcttctttgcccataagaaaatccctgaggaagaaaaaagagaagagaagttggagcaatgaatgtagaataagggtctagaaagtcctccctggcagcttcttcaagagacttgcataaaagcagaggtttgggggctcagatgggacaagaagccgcctctggactatctccccagaccagcagcctgacttgacttttgagtcctagggatgctgctggctagagatgaggctttacctcagacaagaagagctggcaccaaaactagccatgctcccaccctctgcttccctcctcctcgtgatcctggttccatagccaacactggggcttttgtttggggtccttttatccccaggaatcaataatttttttgcctaggtgcctgactcctttcagattccctctttatcttccctcacagtttggaaaggatgagggttatcttcctcgattcttccaccctctcactttcctgcctgttccccactccacaggagggagctgacgttggcttgaaaggagtaaagtcaacatctgctgctttcctgtggactctggtgattcatagagccggatggggagagtcaacaggaaaaaaggagggaggaggaaaagccacaagagacattctgtacaattccaaggaacagagaagcctttagacaggcaactgccatcccccctgaaacctgagacctgtagtgcactcgaccgccctcaggtgttggtgaaacagagctgcccccaggctcgctgggcataggcttcctgattccaagccttttctgggagcaaagccagggcctggtgcctgattttctgaagccaggagccctcaggtggctggagctggaatagcagggaggactgggtgtacctaggcagtattttctctacttctctcaagtcttatactcactcttgagccctccttggggcctgcttagaaagcagacaggagagagagtactgctacttgatgatgggaaatgctttcactttaccagctttgggaagcagcagccccatgggatctaaaagtgtggagtctgcattaagaaacctacatgggtggcatggggctctggggagcaagcccttacttgctcagcactggttatgtagcacaaatagctcctaggaaaatgtttctggggcaaccctagaaccctggtcatattttgcagggtttctctggtggaatcagtttgccagcccttgcttgatgcttactggaaatctccaggttaatttctatctctgatccctccccaacccactccatatttgggtcatggacagtaaaggcagttggattctcatagacaactgggtaacttatatttctttgtaatcaagacttgagatatcgaagtcagttattggtctccagagtgcagctctgggagccttttgaagaatcagcactcattaagagctgagaagagagaagacctgattgggtggttgactagcagtcacagaacctgtcctcccaggctgttcctgaggcctgaccacagtatttattttggcatgtctctggccttctgcagaggcccaccctcatgggcattgtctctgtttcccagtggggtggacagtatatcagatggtcagaacaaataaagttcagtgtcaaatga

SEQ ID NO: 465 - DNA, 19318 bp, Homo sapiens
gctttttgacagctgtctcttgcacagccgcagccaagtccggtgggttcgggaacctgtggcccggctctctgcgcgtccccatcccccgtggccccgaccccggccatgaagcgtatcttctcctgctccagcacacaggtggcggtaggtgccaaaatgtgtgggaggatggggttgggatcccagctctgtggtgacagaagtctttagtcccgtctcaatgcatcatcgccttttctttttatcagtctttctagctcttctagtcttgcaaggaagcccgccagctttgccttcctcaagaccctgccctgcagcttctgacttgccctgctcacctctgccatccccaaggccctttccccggcccctttcttgtcctcctagcatctacacccccgatttctggttcgttttctgcaactctgtccccttcccatggccctgaccctacttctgctccgtctcccagtaccaaacctcccccaagcatcttcctcagcccctgcctggcctcaagctccattctacaccaccaagtcatgccccagagccccatatttcatccctgccctgtccccgcaatcttgccttccacgtagctctatccttgctgtttcctgttagttcaacaagcactcccagccctgtgccttctgctaaccctttttcacaatctcctctgtcattgcttccctcctgccccatgccactttcactcccatctctcaccagcactgctgttcctcaaacatcactccaaacctttttccaattgatgctcccacaacagcaaccttctgttctcccctccaacctctgccctactctgcccagtggtcgccagtcccacttttcctcctgcctgcttgctgtgagttaatattgcagtctggtcagcctcacaggcactgccagaggatgcacagttgcctgactgctccccagaggactgggtgagttgcctgcagagtccaccccagccagttcactgcagtgtctgatcatcagactggttcttgggccagtcaaggctcaaggcctttctgcctgcttttccccagattattcatttcctgaacccttgcccagttgcttaggaatgatactctctgtttcctttggttgaggtgggggaaagtgatgatgagagaagaggatagagcagactcagagttcccagcagaagtcactctattccccatgttctcccagaaaaaaaaaaacataagattatagaaggtggtggcttagggagggtattgcttcttcttctctagagatctcttacagagagcccccttatttggaaatggaattttctgtagaggttggggttacggctaatttagaagcaaattagccagctacttgtagcaatattgctttgctaacttgacttagtagtatcgttcataagaaaatatcagaaatgttcaattagctcattctgcatgggcaggttacagaatcctggaagcaagctatgaggcaagagtatgaactctgttgaggcctgtccttgtcccacttacatttgcatctctacttagtttccacacattgatcaaccaatcaaaaggtatttactattatatgcaccagaaactgaggctgcccagactcagtcttaactcataatgactttttagaaattcatatggactcttccttagttactgaaagtattcaatgttgcctttcccttacaggtttgtggagtctgcctgcttcttaggaatggggaaactatttcattctttctgatcccccaatccttgggcagtacctcctttccaaggtgctggaatgagtgggctggcttttggaatttggaaccatccctctgtcctccttgattctagctgtacagaggtttgaccataaagaatgaccacccattctaaacttttagtataacaagatcttactataatgagattatgggaagtaagttggatgggtttagaattatctagctggaaagaaaactgtttcttcagacagattggagtcatagaaagcttgcaaatagggcagtttcagctgcagattggttcctcatgaaatttccccacacttctcatgataaattcctccactgttttgggtggcaaactactctggaaccatttgtcagagaagtagtgtggcagtctttatggccactccaaaagcctggcttcccagtcacactggaagactgcctctacccatctccactcacacatttgggtccagggccagagccctgcactgtcagtctgagtaaggactgaaaaagcagtgatcattttaaagctaatctaagttaccagtatataggaaaatccacacacaaaaaaaccccaactcctataatcccattttattttagtcaagtagaggatatccttgagggtatcttacctatgagcttactctgcctaggtagaccagaagtagaccagaagagagctttaaataattggcactggatcatctgggcgcagtggctcacgcctgtaatcccagcactttgggaggctgaagcgggtggatcacctgaggtcaggagtttgggaccagcctggccaacatggcgataccctatctctactaaaaatacaaaaattagccgggtgtggtggcaggcacctgtaatcccagctacttgggaggctgaggcaggagaatcgcttgaacccgggaggcggaggttgcagtgagccgagatggtgccatcgcactccagcctgggcaacaagagcaagactccgtctcaaaaaaaaaaaaaaaaaaaaaaaaattggtactgtctactgcaattacaacgttgagaattaggtcctggttcccctttctgtttccactcacctgacctacagcagaagtcattccttctctctctacttgctggtgtgcttccatgttataggatgcttataggtacacagccagagatataaggagaaggtacaattacttctacaaaagtcctctaatctcagctatggaaatacaaagcttatacttattgagtctgctgattaatttggtgattgctcccttgaggctgtgatggtaatctagtgcctcctttccaaggtgctggggtaagctacagactggatcttgacatttgaaagcatctctctgtcctttacttcagctctgcagaggcttggccatgaaaagtttctacccattctaaactctacttagtataatgagattataggaagtaaattgggtggatttagaactatctagctggaaagaaaagtacccaggccaggcgtggtggctcacacctataatcccagcactttgggaggctgaggtgcggaggatcacttgagcccaggagtttttgagaccagcctgggcaatgcagtgatacctcatctctaaaaaaaaaaattacctgggtgtggtagagcatgcctgtagtcccagctactcagaagactgaggtgggaggatcacctgagcccagaggtcaaggctgcagtgagccatgatcatgccactgcacttcagcctgggcaacaaagcaagactctgtctcaaaaaaaaaaaaaaaaaaggaaagaaagaaaaagaaaaaagaaataaaaagaagtggaaagggccaggcgcggtggctcacgcttgtaatcccagcactttgggaggccgaggagggcagatcacgaggtcaggagattgagaccatcctggctaacatggtgaaaccctgtctctactaaaaatacaaaaaattatccgggtgtggtggcgggcgcctgtagtcccagctactcgggaggctgaggcaggagaatggcgtgaacctgggaggtggaggttgcagtgagccgagaccacgccactgcactccagcctgggcgacagagcaagactctgtctcaaaaaaaaaaaaaaaaaaaaaaagaaggggaaagaaaagtatctatattgctaagaagcatctttaccatctgtacagcttggctgttattcgctggctagtatcagcaagatcccttccactctcctggctggagaattctgagcccaggaacatctaaaatgtgctcaggaaggatggattgtgcatctactatgtggcagacaccgagctagatgccttataggttgttatagtattaggaaactgaggttcagagatgttgttacatgcctaaattcacagaggcagacagtgttagagtcaagacttgaaacatttcgagaactgcaggttgacgtcagctgatggcagcaccctgtcgtggggcatagttctagctctctgctttcctgggggtgacctggtctccaaaggccattagaaaatgcgttcttacatgtcagagtctgttagtatgtgaaggagtcattttgcttattttgtcctttgagagttaacctgtttggagactccatgagacagtagagtctgagggtgggtggctttgccctggaggcaacttgagactgtttatctggaaataagtaaacctgtttctatagcttgtagtagtgtggtctggtggggagagctaggatttggcatcaggtggactgggttctttttttgtttgtttgtttgtttgagatggagtcttgctcttgtcacccagactggagtgcaatggtgcaatctcagctcactgcaacctccacttcccaggttcaagcaattctcctgcctcagtctcctgtagctgggattacaggcaccggccaccacccccagctaattttttgtatttttagtagagacggggtttcaccatgttggccaagctggtcttgaactcctgacctcaggtgatccacccgtcttggcctcccaaagtgctgggattgcaggcgtgaaccaccgcacccagccatggcctggattctaattccaattttgccactctttttcgtgatcttgaatggttatctaatcttggtatacttctgtttcttctgtcaaagagatggaataatagccctagctactttccagggatgttgagagactaattgaaatagcatgtgaaaggactgtgagaagttacaacttctgtacaggagtattacctcagaatccatctaccttagataattttatggtttggatatttagagctttcctgtggttgattaataatttgccctggctacgtaaacagtgtttgaaaatgagttactgggcttccacagaccctatttttcttcacccctttctatagcctcttgttgagattataccttataaaatgctatgtgccaccaccaacaccccactacttcctgttttgttacaaggatgccatatatttgtatggctctttacagtttataaagagattttgtatatattagcttgtttaatagtcacagcatgatgaggtagttgttattagccgtattttatagaagaggaaacaggttaaaggtgtttaatggcttactttaggtcacatagccgagaatgtagctgaactaggtcccaaactcaggccagccagcgaaatatttgtctggcagcctttacatcagaccacagatctttgcatctgtctcttccttttcattcccttctctggacaaaaccaggcttttctgtactttcagccctgggtgtttttacatagctgtctcttttatgccctataacacttcaattattataattaccctaccacccacaaaacccaagctggaatgatagaacaatgcatgcccaggtgtggctgttgtctagacagctgctccctgccagggaaactgggagggaggagaaggggagctacctcttgctgcttcctcaaacataactagaaacctctttgccttttggttgttgttgccatggaaaggagagagacggtcgccaaagggcctagatatgatatgggaaaacagaaactctagtttcctcttttaactgtggggcccaaagccaatgaaaagaggtggaatggttaggtattggaactcctagctgtaacctgaagctcggtcggtgccttaatgtacttctcaaacaactgacaacaaaaagcagagcagcagggtttcaggggtggaggcggtggtgagaggcaacatgagtcctcaaaagtggtcacgttggttccatttgctccagcaagacctagagagcaaaagggaaaggattgctctgaggttgggcactgaacaacaactctaatcatgatgacaaaaggacatttgaaatactgtgcattcagcactcaaatgatttttaattcagtggtccagggtccttctggctcagggctggaaataaccagcaatagttcttggtggcatattagctggttaagatttagctaggcccacctaagaaggactaaatgatctaggatgtgtgacttgtggaagagaaaaagggatgttccttttctctcatttggcatcctaaccatttgcctcttttctttctccacactacccccatgccctatattcacacaacctgtggctctggaccaggtggagagatggaaccgccatgatcagaagctgctggaggcagtgcacaggggggatgtgggacgcgtggctgccctggcctccaggaaatctgcccgacccaccaagcttgactcgaatggccagtccccgtaagtcagtcctcctgcccctgccccttacatgtggctcccttttgaagcccccaaatccaatataacataggaccagggaatgcctacaacttcagagctcttttcattgtcttaattagcaagtatatcaatagttttttgctacatataagttctacacaaagtgaggaaagaaaatattgttcctgagctccatccattgcacaacccagattgacaccactgacttgtaaagtacataaagcccattaaacaaacagaaaatgaatatatacactaagtagagtgtttcttcattgcacaagtaggagggtgtgtatgcatgggaaatttgaaatgaagtggtagcatgggagtcacatggctagagggagtagtgattaagtcaaaggaaatgttatcccttgtctctacccaaagccttcgaatgtccagccttcactctgctctggctgactctttctgtgacacttccacttccgctaaggttctgtgctcagagaggcaggtaattatgtgttccctagacacccctgcaatagtctgagattccttgagacctgtagctcttatttcttccttgcttttagcatcctttgtgattggaggccatatagacttctctttctcagaaattcaagctaggggagcttcttttcctgcttttaggattggctttggggtagggagcatagcaagaagggcttatcaagattctcccattcctcatccctggtccctttatcctttggcctctcggccttgattctggcaggtttcatctggcagcctccaaaggcctgacagaatgtctgactatcctgcttgcaaatggggctgacatcaacagcaagaatgaggatggtgagtgagccggagcactgggccacgctgcttgcttgcccctggtacagcagcagtcgggggcggtgctgggccctgctggacattcctactgtggccccttgcttctctccttagtaagttctggccagcatccttccaggagttcccctccccgtaagctgggcacacctcacccccactcccaccttcatcacaggtaccaggcacttggggaacaggaatttctggccccgtgtggctgaaagcttctctccctaatctcctgattatctgtgcgtctcttgccttccctccctgtgagtcatcagcatgcatggggccacctaccctccttctccccttctttctgttccaggaagcactgccctacacttggccaccatctcctgccagccacagtgtgttaaggttctgcttcaggtaagagcagtcccttgataccactcttatgaagggaagaagtggtcccagagttttctaacttcatttcatacttaaaaggaatagttggccaaatgtactcgcctcatccccaataggagggctgataatcatttgtttgccaacatttatttaactactatgtgcaggcaccatgtttgatagtgcctttgagggcaggttataaagcagagttgccaggcactatcgattttgtcattagcagagccactgcagagacttcctgctatgatgaggggcaagaggaaggaggacagagatgttcaaattaaaccaaagccctactgtctgtttctgaagagtttatagtctagtagtataaagagaaatatacatgtaaaatgacatgtggatcatttataaatgagtctccaaaagcacaaaaggcagttactggccgggtgcggtggctcatgcctgtaatcccagactttgggagatggaggtgggcagatcacaagatcaggagatcgagaccatcctggctaacacagtgaaaccccatctctaataaaaatacaaaagattagctgggtgtggtggcacgtgcctgtagtcccagttactcgggaggctgaggcaggagaatcgcttcaacccaggaggcggaggttgcagtgatccaagatcgcaccactgcactccagtctgggaaacagagagagactctgtctcaaaaaaaaaaaaaaaaaatcagttatcttaaccggccatcaggcaaatggatgttctactttcgttcttcctaatcctttccaaatttcacaattatgtttctaaagtaccagccacggggacattgggtgtcattttccctaacacgtttattaccatctgatttttcttagccccttggtttagaaaccagggctgatattcaaggctgcctatcatcagcaatggatgaactgggcttgcctagtagatagccttctccaaagtggacctcctgcccctcctcatattaccatggaaattggtgacccaatgggggtatgggatgaggatgttaacaccaagctccatgctgcttccctttgtggccatttgcagcatggtgctaatgaagatgctgtggatgcagaaaaccgtagtccattgcactgggcaggtgtgtgcaggggactcatgggaacagggctgcagagactacagggtgggaaaggggaggcgtgaggagggaagggcagccagggccaaccaatgaaatggtcggaggggatgttgggtcatagtctgagtaggctttcttcatgcttccccttaacccaaacatcttctccccagcctcctctggctgtgcctcaagtgtgctcctgctgtgtgaccacgaagccttcctggacgtgttggataatgtgagtgtcagatgggcaagtgggcagtgtcctacacagaagggctgctgctctctctcagcttgactggccaacttccatgacctagggctgtgttagcaccacccttctcttccttctcctcctgcttctcctcttcttcctcacagagaggttaagccttatcttctggagagcttctaaccctccaaaagggagtgttcagacccaagatctgggcttttattttttttggacaggtgtgaggggaggggagccggtaggattgtcaagcctctgcagtccctggctgctcatgaacctcttcctacaatctgtgcaggatggacgtacacccctgatgatcgcatcgctgggtgggcacgcagctatctgctcacagctgctgcagcgaggcgcccgagttaatgttacagacaagaatgacaagtgagcccccctcgtctatgcaccccaattcccatgcctgaccaatttagaaagaagccagtgggcaacgtgtgtgtgtgtgtgtttgtgtgtgttggggaagaagtcaggttggtctttgtgttcttgggaacctcattccttcccagtggaggttctgaagagctctgcctgctgccaccaccatcttcatagatagatgaccccagaagtagaatcgacacttctggacccgttggctgaatttactggttgtcaaattatcttttatgcaagaggatccttttttccaataaaaaatgtatgtagaatccctgtgatcccagcactttgggaggccaaggcgggtggatcacgaggtcaagagattgagaccatcctagctaaaatggtgaaaccccatctctactaaaaatacaaaaaattggtcgggcatggtggtgggtgcctgtagtcccagctactcgggaggctgaggcaggagaatggcatgaatccgggaggtggaggttgcagtgagccgagattgcaccactgcactccagcctgggcgagagaggagcgagactccgtctcaaaaaaaaaagtatgtagaaccttgatatacagagcagataaaaatggagctcatccagttggccccctaatttctgttcctgcagctctaaggaatggcatttgaaaagcctagtcctggcctggtgcagtggctcacacctgtaatcccagcactttgggaggctgtggagggtggatcacctgaggtcaggagttcaagaccagcctgaccaacatggagaaaccctgtctctactaaaaatacaaaattagccgggtgtggtggtgcatgcctgtaatcccagctactcgggaggttgaggcaggagaatcgcatgaacctgggaggcagaggttgcagtgagccgagatcatgccattgcactccagcctgggcaacaagagtgaaactccgtctcaaaaaaaaaaaaagagaagtctagtctggtctaatgttggtctgttgttctcctgaccccactgaatgagagcttaccctgtgagtggaatgtctggaaccaggacttctgggttccatgtggaaagtctgtgctcagatttgtctcaacccacagatcggctttgatcctggcctgtgagaaaggcagtgccgaggtggctgaactgctcctgagccacggagctgacgcgggggctgtggacagcacagggcatgatgctctgcactatgctctgcacacacaagacaaggcactgtggaggcacctacagcaggccctgagccggcggcggcggggcggtaaaggcccttgtgtaacttccacgttctctaagaatcagagaagtttcttagagtcccatttgtttccatggaagtaatctatctgacaaataattgtcacctgggttgagagtttacgtatttattgctgctactgtgagaggaccccaaatccccatcccaaaagtatgatcacaaaattctttaatgcagcctggtctctcactgaggacagctctggctagtgttgtttctggcgtttgtgagttgtaattgtacatctatttgtgtgatttgttggtcactctctctttcctctaccagattgtaacccccttaggtgacaggccatttctgttttgctcaccattgaagttccagtgcttattaaagtgctggacatagtgaccaataaataaatgagcgaacaaaatgaatgaagtggcccatttctgggataggaaaccaaagttgctggatagttagggatccactaaacaagattggcttctggcaccaggaagatgtgcagtgagattgatcacagagaggccactcctctcagaaaaagtctgaagataagaatgtgggctggaagtacatggaacctgtcttctctctcattttcctcatatcttttcttataggtcagaggctagtccagcacccagatctcgcatcccaggtaagaccctaagtgcctcccccttttgcttttgacacaccccaggctatcccactgtgactattcctagtggtccttggggtgtcaagacatttaagagaagaaaggcactcctagggctcagttcgttgcctagtggccacactttactattctgtttccaacataggcctctccatctgagccccaggcaggttctcctcctaagagctcatggagagcagagcctgaagaggagcaagaggagaaggaggatgaagacccgtgctcggaggagtggaggtggaagtatgaagaggagcggaggaaagttgttcggctggagcaggagctggtgcaaaagacagaagagtgtaagactcaagctgcagcctatctggaccttgagaaccagattcgagagcaggcgcaggagctaggggtcctcctatcctgggagcccagagcttcaggaaagcaaggctctagtctccggcctggaggggatggcatggagcagggttgtcctaaggacctgctggctgagagtacacaagagctaaagaagcagcagcaggcagcagccacagtaaatccagtattagctccaaagaaggctgaggactcagccccaggaaagatccagtatgaagtccatggaaggtcccaaccagaagaacaggggccaccccagagcccagcgtctgagaccatcaggaaagccacaggacagcaactgactaccaatggggcacagacctttggccctgatcatgctgaccagctgcctgctggtcagaaggagagttcccaggttctaggagttgaaccaggaggcacagtggctgaaccagtgggcccagcagccatgaaccagcttctgcttcaactaagggaggagcttgctgcagtgtggcgagaaaaggatgctgcccggggggctttgtcaagaccggtcatggagggagccctggggactccccgtgctgaggcagcagcagctgcctgggagaagatggaagcccgactggagcgggtgctggcaaggctggaatgggcaaaggcaggactacaggtgaaacctgaggttccttcccaggagtccagagagggagccctaaaggcagccccagggagcatcaaacaggatgaagagaaggagaaaagggttcctggggctcgaggagagcctctaggggcccttggaggggaaaaggccctaggaggcctggcaaagggacagctggagaaggagatgtcagtactgagactgagcaacagtaacttgctggaggagttaggggagttggggcgggagcggcagaggttgcagagggagctacagtccctgagccagcggctgcagcgggagtttgtgcccaagccagaggcgcaggtccagctacagcagttgcgacagagtgtggggctgctgacaaatgaactggccatggagaaggaggccacagagaagctgcggaagctcctggcctcccagagcagcggtctccgagggctgtgggactgcctgcccgcagacctagtgggcgagaggagtgcacaaagcaaagcagcggagtccctggaggagctgcgggcctgcatcagcaccctggtggatcggcaccgggaggcccagcaggtgctggctcggctgcaagaagaaaaccagcagttgcgggggtccttgtccccgtgtagggagccaggcacctccttaaaggccccagcatccccccaagtggccgctctggagcaagacctggggaagctggaggaagagctgcgggcagttcaggccacgatgagcgggaagagccaggagatcggaaagctgaagcagctgctctaccaagccacagaggaagtggctgagctaagggcccgggaggcagccagcctacggcaacacgagaaaactcggggttcgctggtggcccaggctcaggcttggggccaggagctaaaggctctgttggaaaagtataatacggcctgccgggaagtgggtcggctgcgggaggcggtggccgaggagcgccgccggagcggggacctggccgctcaggcagccgaacaagagcgccaggccagcgagatgcgggggcgctccgagcagtttgagaaaacggcagagctgctgaaagagaagatggagcatctcattggggcttgccgagacaaggaagccaaggtgagcagctgaggtagccctggggagcactggggaaagtttctgtgtatttgggagtttactaacctgaatccagcaacctttattgcagcagtgggtcagattaataccccaaacggagcaccagtcctttgcagggaccacactactatgttctcgtgggtctgagggggttggtgagattggaggtgaggtaaggtataagtggaagagagaagggggcttaggtactaaaatttggcacccagattcagaagcagtgtgctcagggctgccaccagtgcagcaccatcgtttattagcatttggacttgaattgcatattagcctgggaagaggcctaatagcatgatgggttgctgtggttttactgaagttctgaggaggtcactcaagaactaatgagttaagaaaagtagacccagcgagagctgctcttctcgcctccacttcagggtgggttctacaaaacgatgtccattggcaaagagggcaccaatgcaaagaaaaaaatcttgaggccgggcgcggtggctcacgcctgtaatcccagcactttgggatgccgaggcgggtggatcacctgaggtcaggggtttgagaccagcctgaccaacatggtgaaacccggtctccactaaaaatacaaaaattagctgggcgtggtgcgggcacctgtaatcccagctactcaggaggctgaggcaggagaatcgcctgaaccagagaggcagaggtagcagtgagccaagattgcaccattgcactccagcctgggtgacacagcaagactctgtctcaaaaaaaaaaaaaaaaaaaaaaaaaaaagaaaaaagaaaagaaagaaagaaagaaagaaaaaaagcttgaaaaccactattagataccagagtttcctaatgcttgctctaaatgtgagtctacatgtttctatgagacatgttttatgaactctaaatatcaatttacacatggatttagtacttccagacttaaccgtgaaatgaatgatttcagacttcttattaaaacttggatacatggtcaaatttagaatgattaaaaaatataaaaaggccgggcatggtggcaaaaattagatgggtgtggtggcatgtgcctgtaatcccagctcccaagaggctgaggcaggagaatcactggaacctgggaggtggaggttgcagtgagccaagatcgcaccactgcactccagtctgggcaacagagcgagactcctccttctcctcaaaaaacgttatatatatatatataaaagaatgtatgttttctatagtgtggagtacataaaaatagaaggaatgttatccagaataggaatcagtgcgggttgaggttaattaaagaaagtatttttatgttgcattgaaggagaagttgaaagtagacaatcgggtgaaagcaaacatagtgtcatggttaagaatgtgttctctggaccaagattgtctgatcttgggcaagttatttaacatctctagtcctcagttttcttatctataaaatgaggataataaaatggttgtgaagattgcattaaataagaaattatatttatttaaaagatttggggctgggtgcggtggctcatgcctgtaatcccagcactttgggaggctgaggcaggcagatcacgaggtcaggagatcgagaccatcctggctaacacggtgaaaccccgtctccactaaaaatacaaaaaaattatccgggcgtggtggtgggcgcctgtactcccagctactcggagaggctgaggcaggagaatggtgtgagcccgggacgtggagcttgcagtgagctgagatcgcgccactgcactccagcctgggcgacagagccagattctgcctcaaaaaaaaaaaaaaaaaaaaatttggaactcttggcccatggtaagtactcagtaaaaggtagctatcattattcctactaccactattcctattactgctagttaccattaactgcatttgtgcctctgcctcaataagccataaggactcatctccatttcccttagtggtcagtagccaggagtaggttaggatctgataccaagttaagagcatcggccaaggagtcaaagagattgtggttcaaatcatgatttcatcacttattagctgtgtgattttgacaaattacttaatttagtctctttatctacaaaacgtagattataatacttccctcaggcggagcacagtggcttatgcctgtaatcccagcactttgggaggccaaggtggatggatcgcctgagcccacgagtttgagaccagcctggacaacatggcaaaaccccaactctacaaaaaaatacaaaaattagctgagtatggtggcatgtgcctgttcctgtgctactcaggaggctgaggttggcttgagcccaggatttagaggttgcagtgagctgagatcacatcactgcactccagcctgggtggcaggtgagaccctgcctccaaacacaaaacaggctgggcgcagtggctcacacctgtaatcccagcactttaggaggctgaggtgggcggatcacctgaggtcaggagttcgagaccagcctggccaacgtagtgaaaccccgcctctactaaaaatacaaaaattatctgagtgtggtggcgcatgcctgtaatcccagcttcttgggaggctgaggcaggagaatcacttgaacctggaggcggatgttgcagtgagcagatggtgtcactgcactctagcctgggtgacagagcaagactcagtctaaaaaacaaacaaacaaaaaaaaacaaaaaaacaaacttccttcagagaagtattgttcctcccggaagaaaagctgttttttttttaaatttttttaagttttcaatgttttatcatattggatagcagctttttttttaattggttacaaaacctaagcccatatacaaaattaggaacacatttagatgcctcttttgaaagaacattttagtctttttaaactgagttttaaaaaaataaaaacaatgcaatttttaaacactgttttgaaaacttaaaagtgcagcaatatagttagtttcctttatctacgaaatggggcaattccaattcagaactggtaaggtcacaaattgaatcaaggaaatgcatacaaatgtctgcactacttgatgctaatgttcacttaaatgttagtttgcactttaaaacatgagaggaaataggaatcatcacagtagaggcccacttttaatcataatgtgtgcaaattttaaaaggtaactgacaagtaaggaaagtccagaagaaactaaactggaaggggtatagttcacaatatcaaaaagatttggacttttaagggtttcaccgaagtttgtgaccttaattagcttttacgttgttattcctacttttagtgaacaccacacagaagaaaagctgttttgagtgttaaatgagacaatttgtataaaattggcacatattaaatactcagtaaaaggaagctgaccttgacccttgtgggagaaatgacttggagcctcattggttgcctctttcctcttggcctcagatcaaggagttgttgaagaagctggagcagctttcagaagaggttctagcaattcggggagaaaatgctcgccttgccctgcagctgcaggtatgttttggctgtcagggatggtgctggagaagaaggtcagcagtggaagtgatgtatatgtgggagacattctaggaattactgagggagacattctaggaattacagaggcctggctaggcagtggtccaggatgggccagtgatgggccaacgagcccacctggtactgctgaccacttcattgtgttgctcctcatgcttgggtgactgagggtggacatgtgacttcccattgatgttcattcccaggattcccagaagaaccatgaagagatcatctccacctacaggaatcatctactgaatgctgctcgggtgagcatggtggagttttgagggaggtatagacataaagctgagtatagggtattgcatttagggtccctctctcttctccagggtccctgtacacacttgctgtttctcggaaagctggatccagtgctaggtctctgatctcatttggtagatcaagagaggttgtgcatgaatgtgagaaggagaggtgtttccccctctgtttcaattctctggcctatagtaaggacttttcctgtccccaataccctttctcagtctcctcctggagccacttagtcctaaacaaggaagaagaggtaggtgtcttgctcccttgttaggaataataactacaaagaatggaacgaacacctattgtgtacctggtgctttgcttcatattcatggttgtaatcctcagagcaatcctgaaaagtagacatcattatcttccctgtgaagatagggaaaaagccatggagaagttaaatactataagtgaaggtatatagtaaataaatagccttccactgtaccacagaacctctccctcacctctctctctccattttctgttcttcatctccttttcttcctttcctgacatctacagggttacatggaacatgaagtgtacaatatcctgctgcaaatccttagcatggaagaggagtgaggcagcctcactgtgtgccctcagggatacgagattctctgttgtgagttgtgggttaagggtgatgagggaaggagtttgggagaaagggcttgggaaaggtgtatggaatgaaattagtcccttttgcccccgtggtggctgacaatggggagccttttggggcatagagcatttgaggtgactgagaagacagaacatggagaatcactgggtggagtcaggaatcagtgagcaggtggactaagggggctgacttatgagatggagactgaaaagaggggttgggtctggggtagggagatgccagtgaaagatgagtgatggtaggatagtggtagacagttgttccttagggcaggactctacaaaatccagaatctcttcactttgataccattcattcaaagagcagtcatcccccaaacctccccccaccccaatgcagatagtccccttctccagtccagatagatgagggtcccttttagcatgttgatatgagtgggaggagactgaggatatggaagtgggtgcatttcatctttgaatttcttctttcagggaataagaaaccctggttgacagaggcttcatcaggctgtggtgggcgggggtgttggccactaggcaatggtatgggcagggcttcacctgacattatggacctcagacctgagaacctggaccctggaatcagcatggatgagaccagaggaggtatggatggaaacaagctctatggaaaataaagcatgaggcaggacggg

SEQ ID NO: 466 - DNA, 10559 bp, Homo sapiens
ggcatttgcggccggcgccagggtggagagttgtgcgccggtccctgggcctgagctccggctccggctggggcgcctgcgatgtctcaagatggcggagctgggcgaattaaaggtaccggccccctccccccatccccatctggactcagcccggcggtacgccgtgtccgggaagcgaccgagactgggtgccggggctcgggtgggcgccgacgacgtggcaggcacgagctgctgaggatgggagagaagtagctgagagcgaggaaggggctgcggcggggctccgggggcggggctgcggggcagatgtaggggtggggccgaggggaattgcagctgttgggggctgaggcgcagggggcggggacgaggggtagaagtcggatttagtagtaggggcggttgttggggtagggccagggggaaaaggtgctgtagaggcactgggggcgagtcgatcaaggccaagagatgcaacagtagggggcacatgcagggatgggaccgcggggcagacgtaggggaggctccgggggaaaggcagctgagaggatagggtctttggggtactctcgggatccgagctttgggaaataccagtaggctgctgagatgcagggggcggggctgtgcgggccgatacctcgaggggtggggcagaagcatcctggaggctcagaggaaggtcctgccgtagtgaatcgcggtgtttgggaagaggcagaggcatgtgaaactatgggatagaaaggtgggaagttataggggaagctaatggagaaaaaaagacaggacagaggagataaggatggggagaaagaggagcaagtttctcatcacattccataaaaggggtccaagacaaagcctcctatgagaagaattgtgtagggctagcaagccctgcacatgacaggatctcctagagattcacagaagggagtcttctaaggagagcgctcccctcctgctacatagagtttggagggtgaccacatctgaggacatctcatagaacctcaaactaccgagttcatccgcctgcctcctggttttcttctgccctttgaaatgggagctatggtcctgggaaggctggaggtctagccactgggcccagctaccttcaggggatttgcgattctgtgccctgactcagaggcttttccttcatccacccagggtctctgtttagagctctgccctctcctcttccacccctataggggggcgctgtaagttgtagaggagtattaatttctctgtgtaggagagatgccagattatggttcctggcagatagagtaaacaggcaggatacttggactcagtgattcactgttaatctccccgacccaagttttggtcctgtttcccttccagaaaaataggactaagttgtggggagggggtggttatataaacgattccaagaaaggatctggggaagttatgagcattgaaccctgacctgaaaaccctggccacagaagcttcagaggcttgggggaaatagctgaggtgaattaaggtggttgggaggggtgggctgaagggcacaatcctccagccacctagcccctttcttcccctggggctgtctggcttgaatcctcttgtctctccctccttctccctgtctcctatcctgttcccaggaggctgggatgggtttgagagtctgagaaagggcaagagaggagataagcagcttaaagcagagtccagggatggaggcgggaggctgcatggactcggaggtgtgtctgagggtggcttgctgtctgccattccctgccccactctggctgcttccaggcctggggaaatagtgttgctcaagctcgggggtggtggtgatgatgctgacctgatggttgctaaagtgggactgagatgtccctttggataggtcgactacctggcagtaatccactagctgcgaagcatcatctttcccatcagtgctggagagaaaggcactgcccacctggtagctcagcccatgtcttggcagggcaggcctgtgcaagggaggatgctcaagcttctctgtttttctccacagcacatggtgatgagtttccgggtgtctgagctccaggtgcttcttggctttgctggccggaacaagagtggacggaagcacgagctcctggccaaggctctgcacctcctgaagtccagctgtgcccctagtgtccagatgaagatcaaagagctttaccgacgacgctttccccggaagaccctggggccctctgatctctcccttctctctttgccccctggcacctctcctgtaggctcccctggtcctctagctcccattcccccaacgctgttggcccctggcaccctgctgggccccaagcgtgaggtggacatgcacccccctctgccccagcctgtgcaccctgatgtcaccatgaaaccattgcccttctatgaagtctatggggagctcatccggcccaccacccttggtatggctctttgtggtcccttagtcttctggactccctacctgttccccaaacatttcttaggctttagtcctatgggatcagtgacctgggatgggggcgatttctgtggctgcctgtgcatgggcttggaataactgcccctttgtatcctcagcatccacttctagccagcggtttgaggaagcgcactttacctttgccctcacaccccagcaagtgcagcagattcttacatccaggtacatctcttccagtcttcctgcctcatccctggtctctgctttctgactttcttctcttctgccctgtgctcttccctatccctcctcctatacctacttgtctcttgttcttctgtgtgtctcttctctatctcctggacatctgactttcagcctttctgtgcattcacccttgccctctgggggctacatgctgacatctcttcatctccctccctgttacagagaggttctgccaggagccaaatgtgattataccatacaggtgcagctaaggtgagttcatcctccctgcctatcctgggtacccactgggggtaggagtgaagtaggggtatgacagatacccttacgagatgtccctgctctgccactgcctactgcagccctgcgactcttgttggatgctgagggcttcaggcatctatgactgattttctggggttccctgtctctctgccagattcaagttaagaaatttcttcccactctttcttcctttctcatctcttaccaggttctgtctctgtgagaccagctgcccccaggaagattattttccccccaacctctttgtcaaggtcaatgggaaactgtgccccctgccggtaaatgctctccccttcttctgtcagtaatcccttaccgtttcagttcataaatattaactacaaacctattctgaaagagacatgcctagcacagtgcgtggcacatagtaggtgctcagtttactgactgaatcaatagaatctcgagagtattaagatagggctgaacaaaggttttgtgagaactcggaggaggacattagttcaacccgagatgtaagaaagacttcttttttgttttttttttttgagacagagtcactcgctctgtcactcaggctggagtgcaatggtgcaatctctgctcactgcaacctctgcctccctagttcaagcaattctcttgcctcagcctcccaagtagctgggattacaggtgcccaccaccctgcccggctaatttttgtatttttagtagagacggagttttaccatgttagctaggctggtctcgaactcctgacctcaggtgatccacccacctcggcttcctaaagtgctgggattacaggcatgagccagtacacccggccagaaagacttgaccccagagctgagagttagaaaaggtgaggcatccttattcctcctcctcagggactcagtgagttccttttttctcagtcaataaataagctctcctttctccccaggagtgaaccccacacataaccctagacagtgctccagttttgtgagccactgaatgggcctccatccccttggtcagtgagtgagcgagttggccttccctccagggattgaataacccgagacaagatatcttttgttcaaagagcagagccccttcccagagccacttctccactgaccaatccctcccttctccagggttaccttcccccaaccaagaatggggccgagcccaagaggcccagccgccccatcaacatcacacccctggctcgactctcagccactgttcccaacaccattgtggtcaattggtcatctgagttcggacgggtgagcacagctaaagcaggtgcctggaaaagcctgctgagggtgaaggggaaccatccagtgtcctgggttggggaagcattttcctctttatgagtctgtctctggtcctcatggaacaaaagtgggcagtggtggtatgagaagcagaggctaattgtctaccccctgcctccaagtagaattactccttgtctgtgtacctggtgaggcagttgactgcaggaacccttctacaaaaactcagagcaaagggtatccggaacccagaccactcgcgggcactgagtgagtaacatctttcctctcttccccacctgatctggattcaagtcttcctggccctccagccttcataattaaacccatacctcttttttgacaacttactccccttctcacatgaaccccaaccctccccctctacccctgaccagtcttccagtctttatagttgaagttggaccactcccaggcacccttgaatttccaatcatgtatctgctttgcacctcacagtccctaactccagccctgctagaatatgggctctccggactggaaagaatcttaggggtcctctaatctaaccctcacatgatgcttcaactcctccagatcatctctaacatagccagagtgtcacgctatgtttaagcatcttcagggatgggaaaatcccccacacccagccttcatcatccatatcccagaccacttccatgtgacgtcccactggcccccaaagacgctccacccagcagcctctcagccagagccatctgttcctggccttaccaactcctgggcttcctccagccttgctgaccccatggctctggcctcacttttgtttcagtcaaggagaaattgactgctgaccctgacagtgaggtggccactacaagtctccgggtgtcactcatgtgcccggtgggtaaaaggggagaagggaacagggtgggaagggagttgggtttagcctgtggactttgatgagggttcctagggatactggcgtgaagttttctgggatgaaatcagagtagggcctctgacaagagaacttgcttctcctcagctagggaagatgcgcctgactgtcccttgtcgtgccctcacctgcgcccacctgcagagcttcgatgctgccctttatctacagatgaatgagaagaagcctacatggacatgtcctgtgtgtgacaagaaggctccctatgaatctcttatcattgatgggtagggccattttgcttcctcttacctaggacatccactagaacctcttttcttggttatttctttttctttttcttttcttttttttttttttgagatggaatcttactctgttccccaggctggagtgcagtggcacaatcttggctcactgcaacctccacctcccgggttcaggcgatactcctgcctcagcctcctgagtagctgggattacaggcacccaccaccatgcctggctaatttttgtatttttagtaaagactgggtttcaccatgttggccaggctggtcttgaactcctgacctcaggtgatctgcccacttcagcctcctaaagtgctgggattacaggcatgagacaacatgcccagcctataatatttcttttttcttttagccaccacctccttcagggtttttaattcatatggcttacttcccctcacatgaactgcaattctcaccttatctatcccttttaccagtctgtgtgtgtgtgtgtgtatgtgcatgtgtgtggagggggagggcaacattaaggacttagtatatacaaggcatcttgctgagcactttgcatgagttatctcattgaatcctcacaataaccctatggactcggctcctacctgtaattccaacactggaaggctgagatgggaagatcatttgaggctaggagtttgagaccagcctgggcaacatagtagaccctctctctataaaaaattaaaaaaattagccaggcatgttataatagctcatgactgtagtcttagctgctcaggaggctgaggcaggaggatggcttgaacccaggagtttgaggctgcagtgagctatgattgcattactgcaccccagcctgggcaacagattgagaccctgtctcaaaaaaagaaataatcctatgattggctagtgacactcacccagaaaaaaaaaaagaaaaaaaaaaaccctatgagataggtagtatcattacacatgaggaaactgaggccgagagagattgagccttgctcaaggttatattgttaagtggcagagccagtgtactgaactgtcataatatatcacctataacaactacctgacttcccactgagcattgcaataaggttcttttcagggcctggatgttctaatcttttgatcttgctagtcttaacctctttttggaatctacattatggttcctgttcccagtgctcccccactttttgtttgtttgtttgtttttgagacagggtctcgttctgttgcccagactggagtatagtagcacaatcatagctcactgcagcctcgacctcctggcctcaagtgatcctcccaccttggcctcccaaagtgctaggattgcaggcatgagctaccatgcctggcccctagtgcctttatttatttatttttacacaagtgtttagaaagccaaagacccagtgccttttggagatggtttatggacttctgtgtctctgctccttttgttccttatactacacgtaagtgctcagattttttttttttttttttttgagacggtgtttcactctgtcacccaggctggagtggtatggcacagtctcgtgatctcagctcatgcaacctctgcctcctgggttcaagcaattctcctgcctcagcctcctgagtagctgggattacaggcatgtgccgccacatccggctaattttgtatttttggtagagatggggtttcaccatgttggccaggctggtctcgaactcctgacctcaggtgatccacccacctcagtctctgaaagtgtgattataggcgtgagccaccacgccggctttttttttttttttttttttgaggcagagccttgctctgtttcccagggtggagaacagtggtgtggtctaggctcactgcaacctctgcctcctgggttcaagcgattctcgtgcctcagcctcctaagtagctgggattataggcatgtgccaccacacctggctaatttttgtatttttagtagagatgaggtttcaccatgttggccaggctggtcttgaactcccagcctcaagtgattcacctgcctgtacctcccaaagtgctgggattaaaggcgtgagccactgcacccagcctcagattgtatttattttaaaacctattacttactttgcaaagctcttttacataccttgtgttatttgattccaacaactcagagcggtccagtaggatggataatgttcttattttacagatgaggaaactgagatacaggaaggtgagttacagaactctggctactgttctgctcatctcccagccccgtgaattttcatctctctcttcccccagtttatttatggagattcttagttcctgttcagattgtgatgagatccaattcatggaagatggatcctggtgcccaatgaaacccaagaaggaggcatctgaggtttgccccccgccagggtatgggctggatggtgagtgaccccctgttccccagctaagctaaatcttggatggcctcttctctgagacgtagtcttcttaatacccacaggcctccagtacagcccagtccaggggggagatccatcagagaataagaagaaggtcgaagttattgacttgacaatagaaagctcatcagatgaggaggatctgccccctaccaagaagcactgttctgtcacctcagctgccatcccggccctacctggaagcaaagggtatgagaaaataggctgagtctacagcaaaacggacaggggaagaagtcaggattgctttctgatcattggacaaagcctggggcaagagaaatgtggaggggacagagagggaacctggggacctgagctgggtgagggcatctgtggtttgctggctgcctcagctcctctctacccacagagtcctgacatctggccaccagccatcctcggtgctaaggagccctgctatgggcacgttgggtggggatttcctgtccagtctcccactacatgagtacccacctgccttcccactgggagccgacatccaaggtatgacatgggtcataagatggaccctgcactgccacaccctccccagagctacatcagaacccctgttccttctcaaagcctcctgcttctcctgcaaggggccacagtccacagtgctttgtcttttggtggtaaaggggtcagataggaggttaattttgatttttcttttcctgccaggtttagatttattttcatttcttcagacagagagtcaggtaagtggttctttcttcagaaggtctcagatctctgaagcttcctttctagacactgatggggcccctccctctcttatgatctctggggatgtaaatctgctttcccgtgagggcagtggggtgtaggtatcttattatctcctcagccccactggtagttcctgagattcctacttaggcctccttcctagatcccctgttacttttctgccctggcctactcacccctacccccgtgtgcacttagagcaccatgcctgctctaaccggacattccacacatttcagacgcccacaaagccaagaacctaacaagttggaggagctctctcaaggcagggaaaggggaagggtgtagggaagtaggggaaagagggagaggctctcctgcttctcaagagaataccttcggatccacaggggttgattgctctcatacggcatttctgagatgagtgactgggaggtggggaagtcaggattgagatcttaaactatgcccttgattcttcctagcactatggcccctctgtcatcacctcactagatgaacaggatgcccttggccacttcttccagtaccgagggaccccttctcactttctgggcccactggcccccacgctggggagctcccactgcagcgccactccggcgccccctcctggccgtgtcagcagcattgtggcccctgggggggccttgagggaggggcatggaggacccctgccctcaggtccctctttgactggctgtcggtcagacatcatttccctggactgagttccctggattatggaaacttcgctgtcccccaacactgagcaagtatgctgtggagtcccaaccccagctactctgatccctctgggggctctggccaagggccagacagaccttcacagatgcctacttttggcctcatctctgcctgacaaggccagcacccaaagggttaatatttaacctctttttaaggacactggggtctgtttctggaaatgttctttagatggtggcacattcctttgggtatgttaacctaggcagtgggaggcaaatgggatggtatgtgagctaggagaagggctgaaccctcagccttgactatgtctagagcctcttggggaaggggcacctctcttgaaccccaaatgctctctcttcttattacccaaacccatggctctatttcttcttcacatccattgtctcttcatgtctattccattcccttcggccaaacagacaggtggaaaaactgagacaggcagtttcagagatggacagagaactttattttggattgtggatgtggacttttttgtacataaataagaaaaaccaaaatactccaaagatgacttcccctgcctcctactccagtatgacagaggaggatgtaaggccttagccatgatctgcaggggtctgggagtcaggcccggcctattgcttgggtctctctccatttatatatctaagttcacagtgtttcttattcccccctaagcttctagaggctcatggccctgtagttaggcctggctcattctgcaccttgccagggaggtggaaggaccctgtgccctccttcccaatcttctttttcaggctcgccaaggcctaggacctatgttgtaattttactttttatttctaaagttgtagtgaagctctcacccataataaaggttgtgaatgttc

SEQ ID NO: 467 - DNA, 2943 bp, Homo sapiens
ttatttctaaagttgtagtgaagctctcacccataataaaggttgtgaatgttctgtgagtgtcatggagatgggctagggaggggattttacacttcactttccagacccctggtttgggggaagagggtccatgttccattcttcctttgctggccctgggtccaggtaagctgcacttttacacggtgggggtgttctgtggaggaattccaagagaggttgtcctttcctgctttcccccgtgcctgtaaaaactagaccattccagcccagtactgtggagctctccagtcctttttcacttttacctgcccagatgttgcagccagagcttgagggcaaacttggttccagtgctgactctctctttgtcctctgccatggttgggatcatccgcaggagggtggacatgtgcaggaccagaggtcgggctcttccatcctcctctagttccactgcactgcatggtgacaactcctgttggggctgtgccttgtagcttacaaagaacttacatatatgttaggtccccgaatcctcccaactaccacaggaggtgggtgggtgttgacctcatttgcagaaaggaaacaggttcaaggagggttaaatgacttgcccctgtgttagaactgacacttagaccttcaatgctagccagttagagcaagaatctttggggtttgatggtcagtgtcttagatttcatgtaccttcttaattatcagctgacccactctccttaaatctcccccacaacacaaaattccatcctgaggacaggatagacgctgaacttctcaacatgaatatgttggtgtattagaggctgagggagaagctcttacttacaggacagagggtggtaggtcctgggggagaagtccgggtgtctctgtcccatcctctgcggcagccactgcagcagctacatctggtgtcagccacataagggcgctcacctcatttgggtttggttggatccgggcctggggtcagacatggtgacccctcagtcattgcctctccctgggctgcctgttcgtgatcaaaacctacccgcaggtttcatggagaaaggcaggagcaaggggaaagggcattgcatattcttcgttatctctgactacccccgccacccccgcccagctcctaatcacagtcagaaccaggttgcttgggctcccctgagccctgtttccttccctcactgccagccctacctgcaactgctgctgtgattcctgggagatcacgagtagatacagaacaatgtgatggtatttgggtaaaccccagctcagcctaggagggtaggcagactaggaaaagaaaacagcaaaagtgagaactttccgtcactttttttttttttttaagatggagtttcgctcttgtcgcccaggctggcatgcaatggcgtgatcttggctcactgcaacctctgcctcctgggttcaagcaattctccagcctcagcctccagagtagctgggattacaggcgcctgccgccacgcccagctaaaatttttgtatttttagtagagacggggtttcgccatgttgtccaggctggtctcaaacttctgacctcaggtgatccgcccacctcagcctcccaaagtgttgggattacaggcgtgagccaccgcacccggccctttgtgtcactttttgagactttgttaatacagctttagggtgaaacaaaatggtggccaaaagctgagggcgtggatggtacagatgacacagcagggacatgggtgagggttatggatttggggattccagcccacttatgtgctattgtttcccttgtagccaaggcaggtaggggctgatctatggaggagcttctcccagctacttgtctcacctcccataaacccagagggacccaagagaactggccctggggcaggtgtagtccactctcctcccaaagttctcgaagccctccgtccagcagctgggagtcagagaagacacatcagaggggccagtgcctgactcttccaagtccttttgcttgcccctccctcagcccacacccaagatggtcccaggcatgggtctcttggctcaggttggatcagctgactggttacctcctcctcaagttccacgtgcccacctgcaacaacagtggggccagtaggtgaatggtggtggtcttggccagggagcccccactcactgttgacactcctctcccctccagtggacacagagggagttgcagtcccttgtgactatgaacatgccacattttggggcccactttatccttctgagactgggaaaaacattgttgcggggaaagggcaaatttcttctctgtacttggggccttgtccccagaatactcacccgggggtacccagaggttgggggaaacgctcagggtgcgtgcccttcgggttagcaagacagtcttgtcgctggactgcagaatgacggccacacccaggtccacacctcgatctgtgggcagctcagccccagggaccctgggccgctcctccagggccgcaaaagggcagaaagggggtcgctggcagaaggaagccagctgggttaaggcttcagaagggcggcactgggtgggcgtgacttccaaaaatggggctacaccgcgcgttgggggcggggtcctcgccgccagttcccacccgatttcagtccccatctttggcccttcactgcccccgctctggggcccccttctgccgacctggagcggaagcctagcggaggcgcctgggaagggcctgctcgagaggacaagccgtcctcgcttcaagctgcagtgaatgggccacgtcccgagccctggtccggctcccaggaggccacacacactccgtgcgaagctcaccgactccggacgccgggacaggagcagctgcacccgcacctcggccataacgcgac

SEQ ID NO: 468 - DNA, 18280 bp, Homo sapiens
tcccactgcaaataatgcatccaggcacctcctttattttgctttccatccccccagatcttctgaggaagatgcttcttctggatcactgtctcttcatggtgcactcaatgtaagactccagcaggaagatggtttcgtccacctggatctcactggcatccaacctgagtgaaaagtaaaggcatttgcctagactgaatgttcattagcatatttaagattagaggttagggtgggtgtggccatggataactgcttggttacccttgagagtggatggaaagaaagcaggagaaccagtagatcattttgctatttaccgagcatctttatgtgccagacaccatgcaaactgctaagaatacaaaatacagagcctctgtcctgggggaaggtagtcttcatttgcaatcaggaaaacgaacgtaaaggcacaggtataaaaggacctagtgtgttttaaaatagcaagaaactaagagtgtctgaagcttaaagtgagtggtgattaggaagaaatggaagcttcttcagcctgacaaaagccatctaggaaaaacccacagctaacatcatacttaatggtgaaagactaaaagcttttctcctaagatcagaaacaaaacaaagatgtctgcttttgtacttctattcaaccttttactggaggttctagccagggtaatggggcaggaaaaaaaaaaagtaaaggcatctagattgaaaagacagaagtaaaactctctctattcatggatgacataatcctattataaaaaatctcaaagaatctgcaaaaaaactactagaattaataaatgaatttagtaaagttgtgggatacaaaatcacaacacaaaagttggttgtttttgtataacactagcaatgaacaatctaaaactgaaataagcgaccactaaactagtatccaaaaaaatacttaagaaataaatttaatgaaagaggtgcacaaattgtgcactgaaatgtgaaggtctaggaaagaggtgatgaaggcctgcgtgtggaccaagatgaaaggccagatttgagacacatgactcaagtaaaattaagccagcgcagtggcacttgcctgtagtcccagctacttgggaggctgaggcaggaagactgtttgaacctacgagttcaaggccagtctgggcaacacagccaaaaccccgtctcttaaaaaaaatttatcagtacttgatgaacaagagagtgtatatggtgatggagaagaagctcagaacatcttcagaattgctagtttacaaaaataggtggattaaattctgttaagtgagctggaggagacagtgagtttaggtttgctcatgctaagctggagggttacaggaggtcaaaatggattttctggatggtattctgaaatgcaggtctgaagtttatgatgcttacttgttgacattacgtttcagggtctctagctgctgacgttcaggagctgtgatcatctcctctatttcttgtaactgtgcttcctctgcaccagtagcctgcatagatgcaatgatggcttctaccctctgagatttttctagtagacgcctgtcaaacaaacacaactctgagacatcttccctaacctgggagattctcttaccacgtgtgtctgaggcactacccaccaccctttaccattttcctgatcaaagtagataatgtcaccttctaaggacattttctacaaacttatttggaaatataacttcactcctgaaattcttattgcctctcatttgcacttaaaagtttggtgcttttgtacgtttctcacaaatttaatctgaaaaattatttcactgggagcatgttagaaaagtgtagactaatgcatgatttacactaatctaagccaatgattcaatgcaagtagactggttgctatctctactggttcctacttctcaaaaaaaaaatttttttttttgagatggagtctcactttgtcgcccaggctggagtgcagtggcgtgatcttggttcactgcaacctccactcactgggtttaagtgattctcctgccttagcctcccgagtagctgggactataggtgcccgccaccatgcccagctaatttttgtatttttagtgaagacagggtttcaccatgttggccaggttggtctcaaactcctgacctcaagtgatccacccgcctcagcctcccgaagtgctgggattacaggcatgagccaccctgccaggcccagcgtctattgattcctatttctagaggaaatttcccctgaggcccttgatcttgaaagatgtaaataactcaactgaaaatgttacttacttattctctttggtttcaaattgcctcctttctatcaagttggctatgctctgaggaaagagaagacagacaaggaatgcacatagttctatttcagcagctcagggcgaagtgggcacatgaggggtacttgaccgtatggaggaaatggggagaaggtccagattgagttaccttgtagcacctgtgcaacaacattcgggcagctgacaggatgttcacagtatataaatagaaggtcctggatggggcatggtctggtgttttgggaatttcctatttgtccaatagaaagaaaaatagcagaaattatactgttttagaactggcaaagcacacactcattctacctggagttacttagccctcctttttacttacactttcctgtttcctagtcattcagtacctgtgtttattttatttatttattttgagactgggtcttgctctgttacctaggatggagtgcggtggcgtgatatcagctcactgcaacttccacctccggctcaagcaatcctcccacctcagtcccccaagtagccggaactacaggcatgcaccaccatgctccgctaattttttaatcttttgggggtggtggagacatggtctcactatattttccaggctggtcttgaattcctgggctcaagtgatcatcccgccttggtttcccaaagtgctgagaatacaggtgtgcccggcccagtctttgtggtttatgtcataatcagtcaaatggagagctgggcttccctgttttttccatttgactgtcagcatcctgagctggggaagaaagggagggcaactaacatttactgaacaactctatgtgccaggtaaattctatttgatctttacaaaaaatcgtattattattatttttgagacagagtcttgctctgttgcccaggctggagtgcagtggcacaatgttggctcactgcaacctctgcctcccacgttcaagcaattctccttcctcagcctcctgagtagctgggattacagacacacggcaccacgcccagctaatttttgtatttttagtagagacagggtttcaccaggttggccaggctattctcgaattcctgacctcaagtgatccgtccgcctaggcctcccaaagtgctgggattacaggcatgagccaccgcacctggcaaccatattatttttattatcaccatccatcactgttttatagatgggaaacgtggtaacttgcttaatgtaactgggtaaggcagagctgtaatctgactccaaaaatccattctatctatttactcatatgctctactaaatagccctgcaaagactcagttagatgtgttgataaatttaaactataacagaattaaggcttaaggaaggacagaaatgagaagagaaaaaaaggcagggtgggtttggggtgatgtcctggctctgcctcttttttgttttttgttttttttgttttttgagacagagtctcactctgttgctcaggctagagtgcagtggcttgatctcggctcactgcaacctccccctcctgggttcaagagagtctccttcctgcctcagcctcccgagcagctgggactataggcgtgtgccaccaggcccagctaattgttttgtattttattagagacggagtttcaccatgttggccaggctggtctcgaactcctgacctcaagtgatttgcccaccttggcctcccaaagtgctgggactacaggcgcgaaccaccgtgcccggccacctctttctcactagggcagttaaggccccaaattatcctccaagtgctcgctatgtctctgtgaatcatgtttttctgtctcagagctggatatagagtttgcttgggggttcagtatgtttgcctaagaagcttctctcaccctaggccagctttgctggttggcaattattacgcccttggttggttacctggagtgacatgaaattttctgagagcatcttatatagcatatcctttgcctcctttgcaggaatcattgcaaagtcttccacttgcttctgctctatgtgtttcttctgcaaaactagacggaatattctagcacagcgagacccaaatctggaaaggaatgaagaaagcaaatggcatgctaacatagatcagctttagttcccagtcacagatggggtggttgttctattccatgtgtgaagccagtaccagacaggaacagtgatcagaaaattattctacagctccataggttggtgatggtaaggcatcaccaactgctgttaatcataaggcagtcaccaactgctgactcatttgagtgccacagttcctacatttgtaagcaaaggctttagggaggctggttaatttgcatcggtaggaattaaacagtaggttattttaaggtaaagagcagtattacatgagatccataggagtccagtgaaaaaatggggaaaagtatgccaaggtgtggttatattggtggcttacataatgatcaaattacttcactggggataggaagtatgtgatcccaaacccaaccagtgtcccccttacctctcctgtacgacggactccagagtggctgtggctagggatgctaatgccttatggaggtctttatgtagagaattaaggtcactcagtaatgttttggcctagttattgtgatctgagttttattcctaagtttctaatttataattaaattttaaatgctattttgtttttcatgttataatttatggtttcagtcatggtacataaatattccaaaactttaatacaagtgtttaagtaagggttttgcttaactaaaatttggttgattaaaagtcctttttccttttcttttttgagacagggtcacccaggttggagtacagtggcatgatctcagcttactgcaacgtctgtctcctgggctctagcgatcctcccacctcagcctcctgaggagctggactacaagcatgcatcgttacatctggctagtttttgtatttttggtagagatggggttttgccatgttgcttagctgatcttgaactcctgggttcatgcaattcacctgcctcagcctcccaaagtccaccatgcctggcctctttttacttcatcatcaatgcagttcactgaaaattcatagaaaaatttatttaacaattacttcaattttctaatttatttagtataataaacattaccaaatctttctttcctaaggcaccattctgatttataggtcaggctgcctgactctaaggaaataactggtaaggatactgatgacatacattcctccaccactgtcgccagactttccaacaaactctagctattaagaaaaagagagagtgttaactgaacggaaagtccagtgattctgtttccaatggaacaaatctgaccaaaagtctgcagcaggtagccctcctatcaaatgatgtggagaaattgtctgggctggctaggtagagaataactctgcaggaggatgatactaggtatcagtgcagaaataaattatcaacagtacaggctaaagaaaaaagaaaaaaagcaaaaacagacttactggatcatctgccagcagagtgagatactgatcaagaacttgcttagagatgttatagccaacaggtagggatctgaagatctatggagcaaaggacacttaaaatgggtttgggaacttagaactcctgaccttactgaaataaagatgttttaggccgggcacagtggctaaggcctgtaatccgaacactttgggaggctgaggcaggtggatcactttgggtcaagagttggagaccagcctgaccaatatggtgaaaccccgtctctagtaaaaatacagaattagctggacgtggtggcgcatgcctgtaatcccagctatttgggaggctgaggcaggagaactgcttgaacctgggaggcagaggttgcagtgagccgagattgcgccaatggactccagcctgggctacaagggcgaaactccgtctcaaaaaaaaaaaaaaaaaagttttaattttagttaccacaaaactgtccaaaaatattcacagcaggattgtttgtaagagtaaaaaactagaaacacccaaatgaccagtaccgagtacactaaaataaaatatagcacggccattaagtggaatatgatacagtcattatgaagagtgagacaaatctacagaaactaacatgaaaggaagttttacatacactgtcatataaaaaatcaagttatagaacagtatgactaggttgggtgtggtggatcacgactttgtaatgccagcactttgagaggctgaggtgggaggatcacttgatgtcaggagttcgagaccagcctggccaacacagtgaaaccctgtctctactaaaaatacaaaaattagcctggcgtggtggcatgtgcctgtgatctcagctactcggaaggatgagcaggagaatgccttgaacccaggaggcggaggttgcagtgagctgagattgcgctactgcactccagcctgggtgaaagagtacaagactctgtcacaaaaaaacaaaaacaaacaaacaaaacccaaccaaaaagccatatgaatagtcccattttggggttaaaaaatacatatacccacatatatgttagagtatgcaaggtctgaataaagatatataccaaactttttttttttttttgagacagagtctcactctgtttcccaggctagagtgcagtggtgcgatctcagctcactgcaacctcccattcccgggttcaagcgattctcctgcctcagcctcccaagtagctgggattacaggcgcccatcaccatgcctggctaatttctgtaattttagtagagatgaggtttcaccatgttggactatgctggtcttgaactcctcaggtgatctgcctgcctcggccacccaaagtactgggattacgggtgtgagctgctgcgtccggcctttttttttttttttttttttttgaaatagggttttgctctgttgtttaagctggagtgcagtggcatgatcatagttgactgcaacctcaactcttgggctcaagcaatcctcctgcctcagcctctcgaatagctgtgactacaggcatatggcaccacacccaactaattttttaaaaaaattttttgtagagacgggggtcttgtcatgttgcccaggttggtcttcaactcctggcctcaagggatccttctgcctcaacctcccaaagttctaggattacaagtgtgagtcactgcacctggccacagaactttaaaataaacaatataaaaatataggaatatttaaacatagtcatgcaccatataacattttagtcaacaacggaccgtgtgcagctgtggtcccatattatactggagctgaaaaattcctactgctttgtgatgtcatagctgttgtaacatcatagcacaatgccgttgtgaaacacattactcacatgtgtggtgaggctggagtgcagtggtatgatcttggctcactgcaacctctgcctcctgggttcaagcaattctcctgcctcagcctcccgagtagctgggaccacaggcgcatgccaccatgcccggctaattttttttttttttttttgtattttagtagatgggtttcaccatgttgcccaggctggtctcaaacgcctgagctcaggcaacccaccagcctgggcctcccaaagtgctaggattacaggcgtgagccaccccgctcagcctgttactggtttttaataaatacagtgtagcctgagcgtgtagaccatcacattcacattaatctgccattcattcactaactcccacagggcaacttttagtcctgaaagctccattcatgttaagtgcactaaacaggtgtggtttttaatttttcataccatatttttactgtaccttttctgtgattagatgtttagatacacagatgctactgcgttacaactgcctacagtattcagtacagtaacatgctgtacaggtttacagcctagaagccataggctatcccgttcagtctaggtgtgctgtagggctacaccatctaggtttgtgttaagtacaccctatgatgttcacacaatgatgaaatcacctaacgacacatttctcagaatgtatccctgctgttaagtgatgcatgactgtattactatgaaagtaatataaataacacatattggatatattaaatatcgatattttaagtacagggggtcaaataatgtcctgaatgccaaggctctcagagtccaaattgtggattcttaaaataattaggaataggctgtacttgacgaatagatactttgactaagtgaatagtgtagatttttaaaagctggatcctaagagaccaaacatttcagtgctcatcacttgaagataatccctgctccacatcaaatgcccttctctttcaaggctcagacctcaacccaaactcaggatctgtgtataataaacgttgataacacccaagaatctgtcagaaagttagtgcaagaacatgaaactcacctcattggaagacaatggctgggtgaagggagcactagaggaagtggtaatctcactcattcggagcatggttcgcacaatctcgctgcttgtctgtttgaaaagtaaactagaattcagaaatcacagtgctgcccctggctctatgtgccaatggccatatctgacaaataagtaaatgtccctgatgaccaatgacagacccacttaggtattacctggtccatcctgttagcaactgcgctcacaatggcttggtcacggaagtgttggtggaatctgtcaaggttggcctgccaataaatcccatcatctggaatgggctgaggaagagatttagagaaacatttagctatagtgtaaagttttctggtgaggagcttggatttaatggttcaccatttcttttcctacacagtaacaattacattggttggaaaaaaatcattcagtcatgtagactggtgtctagacaaattccgacttcaaacaggttttctaagctcatctccaatctttctctccctattttattatttaacatttattttaatttttttctgagacggagttttgctcgtcacccaggctggagtgcagtggcatgatctcggctcactgcaacctctgcctctcgggttcaagtgattctcctgtctcagcctactgagtagttgggattacaggcaaccaccactgcgctaggctaatttttgtatttttagtagagttggggttttacaatgttggccaggctggtctcgaactcctgacctcaggtgatctgcctgcctcggactccaagtgctgggattataggtgtgagccaccacatccggcctttctctctctattttaactcttctccattactttcaagtctccaacttgacccttcttccttctcactctcggcagatgactttgcctctcatttcacagagaaaatagaagacactaggccagaactcactcagctctgtgcacatcctcaccacatttcttttttgttcttgattcatattttcactcacttttatcacagctgaaaaatgctccttttacctaaggttaatgcccatattggtattccaaatcttactctctcattcattcttggggatccagctctattttaccctgtcctctaacatcttcaggctttccttctctaccgccttcttatcagcctttaccctgtccaagtctctttctactctagaattctctttcaaccctatgccttctcttcttttccttactgtcacagccaagcttctcaaacagttggccatctcagttgtatctctacctagatttacgcaacccatttccactattgtactgaaatgtcaattgtcactcgcattccagtgaaattccacaactgtccttaaggattctatgttgttaagttcaaataataatttccacttctgatcttatttaaccttttggaagcatatgacatggttggacattttttccttcttaaaactttatgtggctccttggttttatgacaccattttttttttccttttaaagacagggtctttgtcacccaggctggagtgcagtggtgtgattgtagctcactgcagccttgacctccctgggctcaggtgatcctctcatctcagcctcccaagcagctgggaccacaggtgcgtgccaccacgcttgggtaatttttgtatttttctgtagagacggtctcaccatgttgctcaggatggtctcaaattcctaggctcaagcgatctgcccgccttggccttccaaagtgttaggattacaagtgtgagccactgggcctggccgacaccattttttcttggcgttactttgaacctttctggctacctttcctcagtatccacagattcctctttcagatcccaactgtaatcctggtgttttgtcagggttctgtccatacctttcctttctttttactctacatgctctacttgggtaattttatctgctctccaggcttcaactattgatgcatttccaaatctgttactctatcctagaactctctcttttttttttttttttttgagatggagttttgctctttcgcccaggctggagtgaagtggcacaatctccgctcactgcaacctctgccccccaggttcaagcgattctcctgcctcagcttcccaagtagctgggattacaggcctgcgccaccatgcatggctaatttttgtatttttagtagagacggggtttcgccatcttggccaggctggtctcgaactcctgacctcaggtgatccacctgcctctgcctcccaaagtgctaggattacaggcattaccgcacccggcctatcctggaactctctattatgctccagatgcatagactcagctgcctatttgacacttccatttgttccccaaactgttctgttttgtaagttttcaggtaactacactataaccaacccaatttttttttttttttgagacagggtcttgctctgttgcccaggctgtagtgcagtggcaccatcatggctcactgaagccttgacttcctgggctcaagtgatcctcccacctcagcccctgagtagctgggactacaaacatgtgccaccaggtctggtgtttttttttttggtacagatggggtctcactatgttgtccaggctggtctcaaactcctgggctcaagtgattcttctacgtcagcctcccaaaatgctgggattacaggcacgagccactgtgcctagacaacccaatttcttttttttttttgagatggagtcttgctctgtcaccaaggatggagtgcagtggcgtgatctcagctcactgcaacccctgcctcccaggttcaggccattatcctgccgcagcctcccaagtagctgtaattacaggcacctaccaccatggccggttaatttttgtatttttagtagagacggggtttcaccatgttgaccaggctcatctcgaactctgacctcaggtgatccacctacctcggcctcccaaagtgctgggattacaggtgtgagccactgtgcttggccagccaacccgatttcttaagctacaaacttgggtatcacccctagtcccttgctctccataatctaccaccccattaccaagttctatctattctttatatttatcagatgtctacttttctttctcctatcattaccttatttcagactctaaatcttggcccatctggattactacaatagcctcctaactgggtttttttttttccctttaaaacatagcagacactataaaaggagtaactgggttttctccttctaattttgttttgcatcattcttcccatttcttagagtagtgcttttttttttttaaactgttttgggtcacagttcctttgaagaatgtaatgaaaggtacggagagcttcactgaaaaatgcacgtaagtataactggactctctgaaatccatccatggagtagaacaagttaggaactgctgtgctataataatctttctaaaatataaatccagtcacttcatttccctgcttaaaatccatcaatggctctcctttgccttcaggataaagcccaaacctcttagacaaacatgtacacaaataataaataattccagttataaatataaatgctgtgaagtatatgaaatgagaaatgtggtaggaactagtgtaggagtgggcaatggtgcttgaagtctatgaaaacagcatttaagatagaaatgataaaaacagagaccactacatgaagatctggggacaaacatttgaagccggagccaaagtctaaagaccagaaagagtttgacatgtttaagagataaagtcagtagagggaacacagtgagtaagatggagacggggcagaggtgaggttgaagagccctgtctccagcagatcatacgaagacctagatcacgtaaggcttcctagcccgtaccttggatttcttctaaaagtaaaggaaagctattaaaggagtctaatcagtggatgtgttgttttgttttgaacaacttagaaagtcattttggctactaagtaggtaagaatgcagctagggagaccattaacgaaagcgtttgcaaagagttgagagatggcagtgaaaagatgagaaatggttggatttgaggtaattttggaaactgggctgatatgttttactgtgagattagagggttccaaggattttggcttaagcagaaatggtggtgtcctaggcggctggcctacgtggtagtgtcttttactaagatgaggaagtttatgagggagcaagatatttgggaggaggaatcaattattctgttttggccacactaaatttgagatgcttactgacatctttataggtacgctaagaaggcatttgaatatgagttcaggcctatgtatagtttttagacccatttttcatcactggcccctgtaggtctttaggttctcgccatattgagcaacctaaactttttctaggcccctttttacataagctgttacctctgttcaatgaaagaattaagttaaggctcagaagggagacagtaatggttcattctttgttagtctattcctaatatttaatgaggttcataatcctactgcttcttagctcaggaagctttaagctctcttggggcttgttatctgagtgctctttctggcctgcttcagggtgaggacttctaatcaagaagccccattacctccttgttatctgtagtatattttggtctcttggccttgggctccccagcagcatcttcatcagatgatctcctccttttacctttccctgccaaacaaacaattaaacacttagactatatctcatatgatgacaggaaatgaccaaacatgagagcaggtgtctttcattccaaagacatctgtagctgcctctagatcagagttgcttagggggctgaagagctataagaaactcaagtaactgatgaaataatctgaaactcaacatgttcaaaaagagtcttatagtctttctcctccaatgctctctttcatggccagtgatatcatcctcccacatgtgcaagtcagacacacagatgtcactcttagtacttgtttccttcaccctctctctttcattttccaccagtctgtcaacatttacctttgccccattctcccatcctttctgtagacaaaaaatcttttgaaagtgcaaattagatcatgtcatttccttaaaaatccttcagtggtcttcctttgctcttagcataaagaacagatgctctataaggtcttacttgattcagcccctgcctgtctcccatccaagtactaagcaggttgatcctgattagcttctgagatcagacccctgcctagctatgtctctaaccttacctcatgcctctcttgctttgcttacaatgctttagctatactgacattctttcatttcctcaaatgctatttttttactacatactattccctctgccaaaaatgcttttcctgttacctcactgttagcttctacttcaaatcttagctcaaatgccaccttctcaaagaaacatgaggcctaaactcccagatgaatcccgtctctcgttatatattttcttttcttttttttttcccgagacagagtctcactctgtcacccaggctggagtacagtggtgcaatcttggctcactgcaatcgctgtctcctgggttcaagcaattctcctgccccagcctcccgagtagctgggattacaggcgtatgccaccatacctggctaatttttttttttttttttttttgagacggagtctggctctgttgcccaggctggagtgcagtggcacgatctcggctcactgcaacctccgcttcccgggttcatgccattttcctgcctcagcctcccaagtagctgggactacagatgcccgccaccacacccagctaattttttgtatttttagtatagacggggtttcccggtattagccaggatggtctcgatctcctgacctcgtgatccgcccaccttggcctcccaaagtgctgggattacaggcgtgaaccaccatgcccggctacctggctaatttttataattttagtagagatggggtttcaacatgttgcccaggctggtctcgaactcctggcctcatgcaattcgcctgcctcagtctcccaaagtctccattatatattttcataacacctcatacttttccttcatggcacttattacagtttaattatatactgatgtgattttctgattaatgcatgtctcataatactatgacagttccttcataggaatatttccttcatagtacttatcaccgtttaatgatatatcgatgtgattttccgattaatgtatgtctcctatactaaagccccatggcagagaccatgattttttcattgttatacaccacgatgtctggcacatagcaaatacttggtaaatacaatcacatttcatacacttgacaatcaagaagaatccacaattaaggcaagtcacagttccaggggttaaaattccttacctatcaagctgagtttaggaaccaggtacatgtccttttcattaatgacaagtgtgggggcaggtggtggtggcccagggtctgaattctcagtggtaggtaccgaagggcagcgttgtacaaagtgtgtgtctgccagtcgcacaaatgtgtttgatacttcagcatagtccatggtcttgccatctgtataacaggaggaaaaaggcagatgagatggcctaagatagctcagggttcactcccatagccagctgatctatgcttttgttaacagctatggataccatactgaccctccatggtctctgtgagccggtctgccactttcttcacaacagctgacattgtcagtttgccgttcaacagaagctcctcaacaatcagctctccagtgtcactgtacagagttttggtagtatagatgtaccggggatatctaagcattcgcaatacccggctgcactgggcttcatactccaccacaccacgtttgtgcacttgataactcaccaggttatgttggacgaggacacacagggctttcttcacctaaatggaacataaagagaagaaagagaggaaagacctgaagatatagctcattactgctggcaattttttgtccaacagcttagtaagcatcagaaaatggctagataatttctgcacttatttcctctctccactggaggagctaataagaatcacacatcaatacaataaatcaggaagattccttgctatatttcctctgatccttatctctcaaaacacaatttactttcatcattctcattccttaaaggcagtactgagattaatagacttattgtgaataaatgaggtacggcatgggaagagcaaagatttgcctaaaagctgtgatgaactaggaacactttgagaaacaaaatgttgatgtctaagtctcatccttttctccccgaaataacattgttctgctccaagggcaggctttcttcatttttccttttctggggtgagaagaacaatattcaaaggtgggtgaaataaattagtgaaagaaatgagagaaaatgaatgtcatttagacatacctgatccagtgatgttcctgtgtcatgggcaattactcttagtggctggctgccggttcttatcagatggactccaattttttctacaatctctccaaaatgctcttgcagcaacaaagaacagagcttaatttctgcttgagtcattgtactggggagtctgagagctagggaaaaaacaccaaaatggtacaatagaaagtctttcacgctggaagcagagctgctgagtgtaaattcatgtattctttctggagggcaatttgacaatacatatcaaaaagccttaaaaatcttgcatatctttgaaacaacaatttctttttggatattgtgtccaaagaaagaaaaagctaataataatgaagtcattagttctctttataataccgacttagtggaaacaatctaacgtctaacaataaatgatgccatacccatacaatggcatactacaccaacatttaaagttatttagtacgatgcgtattcatgtagaaaattattcataataggctggcgcggtggctcaggcctgtaatcctagcactttgggagaccgaggtgggcgtatcatgaggtcaggagtttgagaccagcctggccaatatagtgaaaccccttctctactaaaaacacacaaaaaaattagctgggcgtggtggcgggtgcctgtaatcccagctactagggaggctgagacaggagaatcgcttgaagccgggaggcagaggttgcagtgagccgagatcgcgccactgcactccaacccgggcgacagtgcgagattctgtctccaaaacaaaaaaaaccaaaaaaaattactcataatatattaagtgacagaagcaagctgaaaaaatataaaaattcaattattgtaaaaaaaaaggaaaaatgtatgcataggaaaagactatgcatcaaatttatctctatgggattatgcgtgattctgattttccttaaagattgggagatgattttgcggtctgtcacagaccttagtttctacacttccctgcttggaagaattaaggtcactgttcacagctcggtgggagtgaacaggcagtgttattctcagtccataaaggaaatgataatttcgaaaaagaaatttaggaggtaaaggactgcttctcaacagggtgtgtcaaacaggagatgaggttacgttgtttgcaggacagtattcaattcttaaacttctactccttgacaaagttgacacaatcagaaacggacgtagttaattttatgattacttccttattacaaattgctaccaaacattgtttacttatttcttccaattcctaagaagccaagtctttgcctccccgtccccaccccgcctcagtatcaccagagacctatttcgtccatccacatatctttggagaagcattcccagatcctttgccatcctcggaaagggcttccaaggcgcttggctcctagctctacacttcctttacacaggttcccgtttcggacgtggtctcttggtccagtcagtgccgccacgttcagacagcattttccactaacctcagggtcagcgcaatccgggggctccaactccaattcggctgagcttcccgcgacggcttcctacggctcccgctggccttctaggccgaggtggagcccaccgccctttctaggacgcggatcgccaccgaagaagac

SEQ ID NO: 469 - DNA, 77741 bp, Homo sapiens
tctttggtgctgggaggcgggccgcagggtagctgttggcgccgccgcgtttctgggcctggccaactcacgtgaccgacgcgggctctgaagcggtgggccgcaccgaggcggcggcggcggcgacgactgcagctcgggaggtagcggcctggcgagggacgggccggctgccctctcggacggccgcggcggagggcaaaaatggcggaggcttcggcggccggggcggactcgggcgccgctgtagccgcccaccggtttttctgccacttttgcaagggcgaggtcagccccaaactaccggtaagagcgctgtgttctctatacttgggaacctcatagattcctggccccgatttcccggaactgggtctggagctttctgcacatcattgactcgcccgacatcggtctgccgaatacctgctgcccacttctaagccgccggccctaaaccctgggcatcacggcctcggccccgtacctcctgcccacctcttaattcatcctgggctgctccacctgacctcacctctttacctcccgtgtccttaatttttttttttcttagcaagtttccctctgataactctcccctcaattttcttgcattcttttatacctggtctttttcctacgatgacctccccccacacttcttccactgtgtcttctcaccttcctctgtgttcttttccacttttcaccccccaccgcccccgccacctcccttgtcagtgaagcgaaatagcggattgctgaggattgtcactcttcggttttttctagggaaggaagcacagaaagggggttggaaggtatctgtggggcgaaaagggggattttgctcttcagtggtttccagggtccttgtgacagtgaagacagcagcgtactaatgacttgcagacggtctgcactcctatcactgttgaaggaaatggctttaggaagaaggcaggacgtactgtttcaacttcgtttattttggttgtcatgctgccagtgtctttaatatcattgttccgccccccgccctgtccctttcttcacctaagaaaaagagccgggacagaatgttggggatgcttcctctgacgtgaaattggttttcacgagtttctgccagagtgttagccccttgagaggcagtgctgtggttgggaagaaaacacttttgtaggtcaggcgcggtggcttaggtctgtaatcccagtgctttgggaggacgaggcaggaggattgcttgaggccaggagtttgagaccagcctgggcaacagagtgagacccctctctacaaaaacaaacaacatttatgcagcatactagccagcaccagcatcacaaacccagaagctgttttgggttgggttgtagctactacgaggagctcccccagagtgaatgtcaatcctgtccttggccaactgtctttatggttgttcctttccttacaagtgtccaggttcagtcttgtgatagagtggcaacattatgtttctatttatggtgtctcagatacagtgtaggagaaaaccttctgaagtgagtctgtatatcttatttcttagaaacacaaatggagtccagtgaataagtgcttaaagggtgttttatagtcttctctcactcaaaagttttgtttaaggcattatgatacattctttcctctctacttgccgcaccccctacttcagagtcatagtttcatctaaatgctacttagctgtttttcttttttcttttttttttttgagacagcctctgtctatcacccaggagcatgatttcggctgactgcaacctccacctgccgggttcaagagagtctcctgcctcggcctccgggtagctgggactataggtgcacgaccaccgcaccctggctaatttttgtgtttttagtagagatgcagtttcaccatgttggccaggctggtctcgaactcttgacctcaagtgatccacccgactcgggctcccagagtgctgggattacaggcgtgagccactgctccccgcctaaatgctacttagctttgtttgctgattttgctgtgtgtttatgtttttttttttggccatatttcagtgctgggaagagcaggtgtctagtttttttccagccaacatcagagcctgcagaactcttttaccatagagagggagtctggaattcagccagtatgtgtgtgaccagtggtgtgttgttgaatgtgatgccttgttgaatattccatccttagcttttttgatctttaagttgctgttcactattttgcctttaagagtgagaagttggccaggcgtggtggctcaggcctgtaatcccaatactttgggagtccaaggcaggcagatcgcttgagctcaggagttcgagactagcctgggcaacatggagaaaccccgtctctaccaaaaaataaaaaaatttgccgtgtgtgtggtggcatgcacctgtagtcccagctattcaggaggctgaggtaggaggattgcctgaccccaggaagcagaggttgcagtgagctgagatcgcaccattgcactccagcctgggcaatagagccagaccctgtctcaaaaaaaaaaaaaaaaaaaaaagagtgagaagacagtctaaacttccccaattgattatatcttttcttctcacctttaagtccttacttcaaagggataatttgaaaagctgaataggtgtttttctaagccttagttaatgcctggagaagtttcttgatctttttggtgtgatatattatttgtcatatctgatttgtaaattgaggcctaacacaattgagtataaccggattcttcctaaatatatccaaggttctctgctgagtgtcctggaggtgatagggagtgatatgtggctcctgcccttaaggatcttacagcttttggggaaagacaaggcaaacatagaaaaagtaacagcataaagggaatgaggatatgtgctttaggattcagagaggggaatttcatagcgttggtgtggccagtgggatttaaattgagttttgagggatgggtgcatttcagattgagaattccaaagactgtgaggtagcaaaaggaagagggagttgatgaagaagggagaaatatttaataaatcatgtttttttcacaactaaaagttgtatactatattttttatagtgttcagcatgatttgatatatgtatacactgaatggttaaatcaagctatttaacatgcattacctcacatacttatttttgcgtggtgagaacacttaaaatctgtcttagcaattttcaaatatacagtatattccctttttctttttttgagactgagtctcgctctgtcaccaggctggagtgcagtggtgcgatctcggttcactacaacctccacctcctgggttcaagcagttctcctgcctcggcctcccaagtagtggggactacaggcacgtgccaccatgcccagctaatttttgtatttttagtagagacggggtttcaccatgttggccaggatggtctccatctcgaccttgtgatatgcccaccttggcctcccaaagtggtgggattacaggtgtgagccactgcacccggcctctttctttctttttaaatagagacagaatttattctgtcttgttgcccaggctgttcttgaatttgtgggctcaatgtgtcctcccactatatcctcctgagtagtagtagataggtgtgttccaccatgcctggctaatttttttttcttttttgtagagatgggattttgccatgttgccccggctggtctcaaatttctgggcttaagcaatctgcctgcctcagcctcccaaagtgctggggttacaggcatgagctattgcggctggcctgatatgtggtatttgtttttaattctgtttatgtgatgaatcacatttattgatttgcctatgttgaactaaccttgcatcccaggagtaaagactacttgattgtggtagattagcttttaatttttatttatttatttttttgagatggagtcttgctctttagcccaggctggagtgcagtggaacgagctcagctcactgcaacctctgcctcctgggttcaagcgattctcgtgcctcagcctcccagatacctgggattacaggtttgcaccactagacctggctaatttttgtatttttggtagagatggggtttccccgtgttggccgggttggctttgaaatcctgacctcaagtgatctgcctgccttggccccccaaagtgctgagattacaggtgtgagccaccacactggcctgcattagctttttaatgtgctgctggttcagtttgttagtattttatttagaatttttgtgtctgtgttcattagggatattggcccggagttttcttttttcattgtgtctttgccaggttttggtatcagaatgctgctggcctcatggaatgggttagggaagagtccctcctcgattttttggaataatttcagtaggattggtacaagctcttcttcgtgtctggtggggtttggctgtgagtccgtctggtccagggccttttctgattggtaagttttttatttttcattattttttgagacagggtctcactgtgtcgcccatactggagttcagtggcatgatcacggctcactgctgcagcctcgacttcccagactcaggtgatcctcccaccttagcctcctgagtagctggacctacgggtatgtgctaccacacctggctgttttttttttttttttgagagataaggtttcgtcatgttgcccagcctggtcttgaactcctaggctcaagcgatccgcctgcctttgcctcccaaagtgctgggattgtaggcatgagccatggccctggccaggttttttattactgattcaattttggaactcgtcattggtctgttcagaatttcagtttcttcctggttcagtcttgtgaggttgtatgtttccaggaatttatctggaattttaggttttctagtttgtgtgcataaaggtgtttgtaatagtctctgagggttctttgtatttctgtgggattggtggtaatgtcagttttgtcatttctgatggtgtttatttagatcgtctctctttttttctttattaatctagctagtggtctatcaattttattttttgaaagaaccaacttttggtttcgtttatcatttatttgtatggattttcgcatctcaatttcattcagttcagcactgattttggttatttcttctgctggctttggggttggtttgttcttgtttttctagtttctctaggtgtgatgttaggttgttaatttgagatctttctagctttttgatggaagtgtttagtgctataaactttcctcttaatactgctttaactgtatcctagtgattctggtatgctgtatctttgttttcattagtttcaaagaactttctgatttctcccttaatttcattttttactgaaaagtcattcaggaacaagttgtctcatttccatgtaattgtatagttttgagagacctttttagtattgatttctattttaattgcactataatccgagagtgtggttggtatgattttggtttttttgcctacgcacttctcaaaagaagacatatatgcagcccaataagcatatgaaaaaatgctcaggattactaatcgtcagagaaatgcaaaccaaaaccacagcgagataccatctcacaccagtcagaatagctattattagaaagttaaagaataacagttgttggcaaggttgtggagaaaagggaatgcctatacactgccggtgagaatgtaaattagttcagccactgtggaaggcagtttgatttcccaaagaacttaaaacggaactaccattctgcccagcaatccattactgggtatatacccagaggaatataaatcgttttaccaaaaagacacatgcacttgtatgtttattgtggcactgttcacaagagcaaagacatggaatcaacctagatgcccatcagtggtggacttaataaagaaaatgtggtacatatacatcatgggatactatacagctatttaaaaaaaacaaaaccgaaatcatgtcctttgcagcaacatggatgcagctggaggtcattatcctaagtgaattaaagcaggaacagaaagccaagtaccacgtgttctcacttaaaagtgggagctaaacattgagtacacatgggcataaacatggacacgagggcttacttgaggtggtgagggtaagaggaggatgagggtcaaaaaactgcctatcttgtactatggtcagttgctgggtgacgaaataatcagtacaccaaattccagtgacacagtttatccgtgtaacaaatgtacatatgtgcccccaaacctaaaatcaaaaaaaatatgtgtagaaaacaaagagcaaaatgaaggacctaaaacctaaaaaccatttatagtcaatatataaaaaggcttaataccccagttaaaatcagatatggataaattttataaaaacaaagtaaacaaagagggtactgactcttgtgatagttggataccaagaaccatccctcactggggcatgctgtggctcacacctgttataccaacactttgggaacccaaggcaggagaggattgcttgagcccaggagtttggcactagcctgggcaacaaagtgagaccctatctctacaaaaattaaaaaaattagccaggggtggtggtgtgtgtctgtggtcctagctactcaggaggctgagtcggggaagattgctcaagcccgggaggtcgaggctgcagtgagctgtgattgtgccattacactccagtctgggtgacagagcaagagcttatctcaaaaaagaaaaagactccatgatttaatctaatcaacttcaaaaacccaactcattcctccacacgccctgtgccttggccatagcatttacctcaccattctcctatgcattatctatttttagacctctgtctccctttgtttaaaatgttctcccagcctggataacatagcaagaccctgtctcaacaaaaaaaataaaaattagctgggtatggtggcatgtgcttgtagtcctagctacttgggaggctgaggtggaagaattacttgagcccaggatatttgaggttacagtgagctatggttgtgccactgtactccagcctgggcaacagagacccagtctggatgagagagaagagagaggggagagaggagagaaaaaagaaaagaaaagaaaaagaaaaagaaagaaagaacccatcatctatgagtgctgtcctcactgaacaccagaggctgggtattgagtttacatcagcttttaatgagctctcactaggtttcttcacccattcaatgggaaggtctgcttcagagccataattgtgttcaacgggactaggttgcaaggtttaataactcttctcttctttttaaaatttaattactttattatttcacctttttttttaaagccacatgtaggctgaattcatttaatttgacagaataacactccttactgctaatcctgatcaattttagctttgtgtgtctttgggttggatccactcagataagaggacaaaagagggccgggcatggtgactagtgcctgtaatcctagcactttgggaggccaaggtgggcggatcacctgaggtcaggacttcaaaaccagcctggccaacatggtgaaacccctgtctctactaaaaatacaaaaattagcctggcgtggtggtgggcgcctctaatctaagcaatttagtgatttgagctgggctcgggaggctgaggcaggagaatcgcttgaaaacccaggaggcggagcttgcagtgagctgagatcgtgccattgcactcgcaaaaagagcgagactccatctcaaaaaaaaaaaaaaaccattcaaaaagaggacaaaaggttcatttggaaagaggatattaagaaataaggagaaatcatgaagggaattttaaaatgaaaacatatttagtggcattgttttctgttaggtttcaaaaaagtctccattccaagtgagtattggtttaggaatttctttctccttattaaaagtgttttcctatttacagtgaaaataactttagtaaaattttgtgagtactaaacttggattttaaaatcagagatttcgattatatagtctggagcctcaggattttaagtttctgtaggattgggtaaaatgccattgtagattttttggtcatcagattatagaataaatacttaaagtaacttcagattattattttcaaaaccatagcagaaactcttaccttacctatcttattgagagacaatgtgaagccaagactaatggagttagtgtgctacattgatgatgaatgactgggtagtacaccacagagggctgtgtcatggagtgtaaaggtgttattccattcctacaccctaccatccgtctttccccattaaatcaaggtcagggaatgttaccttatgtgattaaatctggtagagtcatcattaaacaggtgagataaatcatatgcagagtaacctacttttggtattgatgagactagggtggttcttaagtattttatggagatcagggtatcttcctaaatccagatgaagagatcaggttaagaactgctcgctttcaggctccacctgaagaaactatgtagtaggcttctctccctctacttattttatcatcttctttgatctaataaaatgttttccttatcaataagtaatgttatctagtttggctctaccaggtgctagagaaggcattcatcattgtattgtacttgcaataactctaatacaggaaaatgttcaaaccacccataataaaagtagctaaaaagcagatttcttaaagactttgtgaccgtttaagctcagctgacctttctaagttgcatgattcttagaaaggtcccagagagatgtctatctggtgctatatagcagttgctaattaaatattttttaattgaatgattgatatgagttgaacacccagtaattatatttaaaaagtgatgacttcagtgttttgacgcctttaaaaggctacagtggtacaaaatgtaggtgctaccatgtgaaatttgaatgtacagtgaagtacatatattcactgcaatatctagaaataaatatgtattcttataggtagaggctagtttatccttgtaattctactgataaatataaatgtatatattggggaaatttgtgggactttttcagtataaggaagaaaaaaatctgaaaattgaactcactgcagaagaaattttttgtattttcgggggaagtaccaactagatgtgctaacactttgtatttctttatgtttagttgcctcttttttttttttttaaacggagtttccctctttcacccaggctggagtgcagtggcacgatctcggctcactgcatcctctgccttacagtttcaagtgattctcctgcctcagcctcccaagtagctgggattacaggcgcctgccaccacgcctggctaatttttgtatttttagtagagacgagggtttcaccatgttggccaggttggatctcttcacatcctactgagcaataaatgagatagcctagagcagtggttttcaatttcaggtagttttgtttcccggggaacatttggcaaagtctgtagacaattttttatcttttttttggagacagagtctgactttgttgcccaggttggagtgcagtggcatgatcacggctcactgcggcttccacctcctgggctcaagcaatcctcccacctcagcctcccaactagctgtaccaccacacccggctaattttttaattttttgtagagacagagtctcactgtgttgcctaggctggtgtcaaactcctggcctcaagcagtcctgcttcggcctcccaaagtattgggatggtaggtgtgagccaccacacccagcctgtagacatttttgatttttgtaactaggggctggaggagggttgctactgtcatgcagtgggtggaggccagagatgctgctgaacatgctgcagtgcacaggatagacccctcaaaacaaagaattatattgggcccaaaaaggtaagagggctgaggttgagaaaccctgggatagatagagggatagtcagtgtcatcttgtgctaattgtgtttaaggttttgttttggtgtaggtttgatttttaattttgggatcccagtgaattttcagtaagaaaattgagaccgtataattttaggcaaacctctgatgggagagagtgtttagaacaggaactagggctcagttagtggctgcaattccattatagcagtatctattggagttactttctgtctttggagttactgagaccagaggaattggattacccctctcaagttacatactgtaagggcaacttataaaagaaaactatccacatttttttgtcagttgggaattaattgagatagaaacactgcatgtaatttagtaagacagctggaaatcccagtttgaaaacaaaatgaaaagcagacaacaagcctaacttttagttttgctttctgtgtttctcttatacctctcagaagtttcataagctccagaaattttgtgtttaaccttttagtttcttcaaattcttggttgagagggtatattggagttattaatctttgttctaaaattcttcgggtgacttctcgctgagtcatctgaccgtctcagtttacctaagtatatcccattgtaaaatgatacttaggtgcacgtatgggaagcttgaatgaggaatggagctgtataatcctaattgaaaggcagtgtaagaatcatgagcaatccttatttgcagagaaatagggccattaccgtattagaagcattttaggttgttgttatagtttcacatacagaagtttaggtgctgaaaaattattcttttttagaaatttcttttttcaattgtttgctgttcagagtttctcagaggtccccagatgcatgtatatcagttagaagtaggacaggtatggtggctaacacctgtaatcccagcactttgggaggcagaggtgggtggataacttgagctcaggagtttgagaccagcctgggtgatatggcgaaaccccatctcttaaaaaaaaattaaaaaaagatagaagtgagttggcgccagtgatttttaaaccaggcatacttttcttgtatgataagtagactgttggtgactcttttcccaaaacagaccagttagattttgttttttgtttttttttgagacctgaagcctcactctgtcacccaggctggagtgcagtggtgtgatcttggctcactgcaacctccgcctcccacgttcaagcaattcttgtgcctcagcctcccgagtaactgagattatgggtgtgcgccaccacacctggctaatttttgtatttttagtagaggcggggtttcaccatgttggccaggctggtctcaaactcctgaccttgcaagtgatgcacctgcctcggccttccaaagtgctgggattacaggtgttagccaccacgcctggccagaccagttagttttgtcttccttgaaaatctgttaagacagattaatctctctccttgataatttgaacaagtgtcacaggaaacttcttagtagacaaggtaatgtttacctccttgccactcactttgatgttgtacagatttgaatagacttttaacccatagtaccatcttccagaagtttcattttgcttacctttcaccatgcttagaatttacattctcaaaagaaaaaacaattatagttacatgctctttcttaccttttgctggattaactgagacctgcaggtatcctacaatgatgctgatcttctagcccgttaattctcagacctctcagattcagtgccctcttcttataagtattttgaaatactctctttagtgaaatgaaatccacaggtaatacagcttttctacatatatgtgtgtgtgtgtatatatatatatatatatatatttttttttttttttttttgtgagacagaatctctgtcaaccaggctgcagtgcagtggcgtgatcttggctcactgtatcctctgcctcctgggtgcttcaagcgatgctcgtgcctcagccttccaagtagctgagattacaagcgtgcatcaccacacctggctaatttttttgtattattatttattctttgtagagacagggtttcaccatgttggccaggctggtctcgaactcctggcctcaagtgcgcccacctcggcctcccaaagtgctggggttataggcgtgagccaccacacccggccctacatatataattaaaaaaattatcttgcagtaagataaaggataaatagaaaatatttctgacagattagcttgacatgacagctacctgagtagactgctataagggtatttgcaacttaaataccaggagaagcaaaccagtacagtgaacaattctttgcaaatgtacaaataaaactcaagtacaacttctttcttcttcttcttttttcttttttttttttttttttttttggtagtgatggggtctcacttagttgcccaggctggttttgagttaggctcaagctgtcctcctccttggcctcccaaagtgctgagattacaaacgtgagccactgcatctgccccaaagtacagttttctcttactttattcagcagttgcttttctggacatttagtgcatgttaaaattatggactgggcacggtggcttacgcctgtaatcccagcactttgggataccaaggcggttggatcacttgagcccaggagttggagaacagcctgggcaacatggtaaaaccctgtctctacaaaaaatttttttaaaaattagccgggcttggtggcacgtgcctgaagtcccagctacctgggaggctgaggtgggaggattacctgagcccaagaggtcaaggctgtagtgaaccgtgatcacaccgctgcactccagcctgggtgacagagtgagaccctgtctcaaaaaataaataaataaataaataaaattatgcagaaggacttggtgcttatacgtagaatgtaattaggttctaggctttggtaattatacagattttaaaaatccagttaactattcataaggaagtttgagaataaagacattttttctttgtgctggacttgcctatgctttcctggcctctgccaattgaatgtcagtaacacttttttttttttctgcaacttttattttaagtcccggggcacatgtgcaggatgtgcaggttttgttatgtaggcaaacctgtgccatggtggttggctgcacagatcaactcatcacctagctattaagcccagcatccattagatattcttcctgaggctccctcaacaggccccagtgtgtgttgttccccaccatgtgtcctcctcatttagcccctacttacaaatgagaacgtgtgatgtgtggttttctgttcctatgttagtttgctgaggataacggcttccagctccatccacatccctgcaaagtaatcactcgtcctttttatggctgaatggtattccatggtgtatatgtaccacattttctttatctagtctctcactgatgggcatttgggtttattccatgtctttgctattgtgaatagtgagaagcacttcttaactgctgtgacaaccaaagcacttccatagatgtcccaactatcccctagatgattgtgttgtcctcattaagaatgacctctagtcatacaggaaaacatttttctgttttatcattcactcttcttttttttttcttgcttattattcactactttagcacagccttttagtctaaaagacaaagatttacttggcctttagacaattcctatatgtctttaaatttcttatttcctcaccactcttattattgatgttttcttttccataagtgttaggacagtgccttggtacatagtagatactcaattagtatttgttgaatgaaggaaacttaactgtaggctttttcttcttgccactttctgctttttgtacctgttgaaaatgatggaggtaccagtgttcataaaaaccttgaaaacaggctgggtgcagtggctcatgcctgtaatcccagcactttgggaggccgaggcaggcagatcactcgaggtcaggagttcaagaccaacctgatcaacatggtgaaaccccgtctgtactaaaaatacaaaattagccaggtatggtggcgcatgcctgtaatcccagctactcgggaggctgacgcagaagaattgcttgaacctggaaggtggagattgcagtgagccaagatcgcactactgcactccagcctgggcaacaagagtgaaagtcttgtctccaaaaaaaaaaaaaaaaaaaaaaattagctgggtctgggtgcagtggcgcacacctataatctcagcactttgggaggctgaagcgggcagatcacctgaggtcgggagtttgagaccagccagcatagtgaaatctgcatctactaaaagtacaaaaattagctgggtgtggtggcacatgcctgtaatcccagctacttgggaggctgagggaggataaccacttgaacccaggaggtggaggttgcagtgagctgaaattgcaccactgcactccagcctgggcaacagagtgagactctgtctcaaaaaaaaaaaaaaaaaatccttgaaaacaaagcacagacctgtagactaatgactaaagggttggctcaaagcagcagtttgatggaccacttgctattagttagtggccagtagagtggagcctcttgtggaatacggctttatttctgcatatgagagcttataagaagaggagtcatcccataattacatgcctttcagataaacagctgatgggctttgtaggcagagttactttaatgaagtcattaatagctgaatttgttgaatgaaagcttcttctagagaatcttttctaatttaggtactactgtgaggtatttttgctctcaaacttattaaactgttggttccctgattttgaatttatggtgccagttattagatcctgatctcttaatatggtcactgctaaatgtttacaggtattagcatacctagttaagacaagttaggttggggaacagaaatttttatatcttagcctcgttggtttgaaaaaaaattagttatttggattgctgatatagtgcaaaaactatttataatggtacatttactttctgtttaataacatgtaaaaggcaaacagcaaattaattttcactgctagtcttgatttgtatgttttagattaaagggttgttgaaactataataaaaaaccaaataatggttgggcaaaggaggacatgattagacatttctcaaaagaaggcatataaatggccaacaggtatatgaaacagtgcttaacatcactaatcatcagagaaatgcaaaccaaaaccagaatgagataccattataccccagttagaatggccattattaaaaagacaaaaataacagatgctgaccagaatgtggaagaaagggaactcttaaacactgttgatgagaatgtaaattagtatggtcactatggaaaacagaatggatatatttcaaaaaaaactgaaaactaccatacaatccagcaatcccgctactgggtagttatccagaggaaaagaaatcagtatatcaaagggatacttgcacttccatgttcattgtagtactattcacagcagcaaagacggaatcagagtatccatcagtggatgaatggataaagaaaatgtggtatatatatatatgcaagagaatagtgtttggccataagaaagaatgaagtcgtgccatttgtagcaacatggatggaactggaggttattatgttaagtgagataagccaggcacagaaagacaaatattgcatattcccactcatatgtgggagctaaaaaagttgatttcatgcaggtagagaatggaatgatatctgaggctgggaagggtgtgtgaaggcagagggggtgaggtatgtggataaagagaggttgattaatgggtataaacataaaattagatagaaggaataagttctgatgtttgatagcagagtagagtgactaaagttaacaacaatgtatatttcaaaatagctagatgagaggatttcagatattcccagcacatagaaatgataaatatttaaggtgatagatgccctaaatgccctgacttgatatgcatgtaccaaaatatcacatgtaccccatgaatatttacagatatctgtagcaataaaaaagtggttgaaagtaatattaataagtgagaatcataaaaatgtttaatttgctgaatttttcaaccttagtttactaatctttaaaattgttggtttattattctctatcaagtgcaggtgctgattgaatggatagggagaagttgttttaatattatattagcatcctattttaatatgcaatcagtattagatggacagattcagagttcctaaggtttttaataagattagcagtataatataggtctatctcgtcctgtaacactagtactgtaaaaggtttccagaagtatatctatttctattcctgagtgtgattgattctggatattttctttgaggacacacacatatactctatttgtgaagtacagcacttcgaatttagtttgtatttgataataacattaaaataacaggcactagattatgcaacagtaacagcagtccatttttatttattcagtaactgtattggtaccttctatattccaggagctgttctaggtacttgggctgttgtcttagtccattttgtgttgcttataaaggaataactgaagctgggtaacttaaaagaggtttacggctgggcgcagtggcgcgtacctgtaatcccagctgctcaggaggctgaggcaggagaattcttgaacccaggaggtggaggttgcagtgagccgagatcctgccactgcactccagcctgggcgacagaaaaagactctgtctcaacaaaaaataaacaaaagaagtttacttagctcattactctgcagacagtacaagaagcttcgcaccagcatctgcttctggtgggacctcaggaagcttccagtcatagtggaaggccaaggggaagcaggtgttccgcaaggcaagagagaaaggggaggggtaccacactcttttaaacaaccacatcactcattcctgtaaggactgcaccaagacattcatgagggatctgcgtccatgacctaaatacctcccactaggccctacctccaacattggggatcaaatttcaacatgagatttagaggggacacatatccaaactatatcagctatattcaggaagaagtacggagattaataaaatgttgagaaaaatgggtagtaaaatcaggatttaaatattttcttctccttttggctttctttaaatttaatatttatttatttatttatctattttatttttttgagatggagtcttcctctgttgcccaggctggagtgcagtggcacgatctcagctcactgaaacctctgcctcccgggttcaagcgattctcctgcttcagcttcctgagcagctgggattacaggtgtgggccacaatgcccagctaatttttgtatttttagtagagacggggtttcaccctgttggccaggctggtcttgaacacctgacctcaagtgatccacccgcctcagcttcccaaagtgctgggattatagtcgtgagccactgtgcctggacttaaatttaatatctcatttaaacattaaattaatgtagctatctctggattagagcaaatgcctttttgcccatttcaggtctgagatattgttgttgtaagaactaacaactagccctcattttgcaactgttgtcagccctttttatagctgattttatttattttaattaattatatataaattgtattctagtactgtgggaaaaaatgttttattttagctgttaaattattgaacctttcagggtcttcattttccttgtctgtaaaatgagatagttgtgtttattcctgctagctacggtttagtgatttgagctctggggtatttttggattttgtgtaagggaattttcttctgtagtttttccacatagatcatgtggtagccactgacatactaggatttaaattttacccctgaaataatctcctttatgagttacaaactattagtgcatattttatcttataatgatgaacagtcttgaaaatgttaggatggaggacataatgcaaagcaatgtcaaaattttccttttataaatcaaacaaagcaataatgctggtaatgttgactgaataaattaaaacttcattttttttttttttgaagacttgggattcagtaacaggtaaacttggcctggataattttttttttagaactattttataaatattctttgtttgctttgaggttgcatttacattgcttttgtttttaaagttgtattcagttaactgattgttttcttaatccaatggtcagtggctactgttaacaaccagtttgtatgtgatctttcctgacttgaatgttcctgctgtgagttgaattagatcatacttgtgaaattctcctatgtcattgatggcaagtcaatgctagaattccaagtattacttttatttcgatgaagagttctcagtcagaagctctgattgctctgtgggtacatggtaaaatagtactttttaaaatgaaatggtgatggtagatggtttttttttaaatatttatacttggcaaaataaaaaagctggcaatccttgcaggtttccaattttttaatttgaaaattgaactgctttatgggaaccaaaagtatggaaatcagtagtctagatcagtgtttctcaaactgtgtgccaggagatttaataggagttcagaattatggtaaaatattgcataccaaattgttgccctatctccatccctccacttccccttttatgacatggaatggcatattaatggttctgaaaaatcattcattaaagcagcatgtttgatatttagttcaggcttttctaaatctagtttttctccccaccttaaccactggttaatatcctgtgaaacgtggtttgagaaatattccatatccaaatcactcagaataatttattagaacctacagtttgttgagaatttagtatattcccagtactatctcatttagatgaagtgagctacccagtgtcacacaactggttggttattctgtgtttccagtccgattgtgtgtgtgtgtgtgtgtgtgtgtgtgtgcatgcatgcatgcatttaaggtggacaacatgatgttttgaagtgcacatacatagttgaaatgattaccagtccagctttgttttgcttcacattcattactctaaccacttaggctgttctgaagcattgcttagttctcatttcgaggctaagtacctaagactaggatattcagaagttcattttatatgccttttgacttccctaactactagaatgtggttaagggaagtatgattttatcagagcatatactttgtaggtgattttagtgacttttaatcccaggttatttttctttctacacaatgcttggaatgtagagcttagaatttttgctgagtgaatgaatgttgtcactttgtcaaagaagattctgtcagcctaagctaaaagcaagaaagtacattttacttctaaactattgtggtacacatcagagctaaacatctatactttttggctcatttatcattttatatttatgccactgggttgttccctttcttgctgcctttagtgtgagcaagccaaaaacactataaatcttttctgctatattatgttgtctgaggttaattaacattttctctggtaattcttgtagtcctgtgtgtttcttccttagaaaatttggcttcttgaccatctgatcaagcttgtatcaagtaacactttgtcttgtgacctgattttctgccttggtacacaatgagctaaagaagcttggttgattatgcactcctgtttggaatctgtaatgtcagtgttcaatcatggcctgaattaaggaacaaaatgataaaggtggctgggtgcggtggctcacgcctctaatcccagcactttgggaggctgaggcaggtggatcacttgaggtcaggagttcaacaccagcctggccaatgtggtgaaacccatctctactaaaaatacaaaaattagctgggcataatggcgggcacctgtattcccacctactgggaagctgaggtgggagaattgcttcagcctgggaggcagagtttgcagtgagccaagatcacgccactgcattccagcctgggcaacagagtgagactcagtctcaaaataaataaataaataaaggttgtgaatgtgaatgttactattcttagggggatgaaaccataaatcaaggtagttttattggcctggaactgaatcacagcccttcaaacagtatttaaattgtataggtatccttgtgtaacactgaaactgtggcctattgttttcctttttagtaaactgattttctttattaatagccaagtgaacaattgcttacaactccttgagctcagagaactaatttcaaaatgtttagactggaaactttctctttcttgtaatgaatgagaggtatgtcttccttaatttcttgaaggagagttgagagaaagaagtcagtgaggacagtatttgtactctagaaagagattttcacagagaccttgaggataatggtggaactgggaacagaactcagaagttctgttgtctttgttttggggttcacttgatgcttttgaaaagggaggaggatgtataacctggcttgaaaagggaaccagtctctttgacctagtgacgagacttagcatcagagtaaaagtatagtgggtactggcctaggagctgtgatgtgtggcaaacattttgtgttcttaatccttctaattagaaatttctgactgtcttgccatgtgatactcaaagagagtataaacaatagaatgtgactaacttaaaattgtggctgtcagactagacagaaaatgggcttcttttttttgacactttaatcaccattggaacttctgttttagataaaataaacactttaagttgataacgaagaggtagaaaaacatagctgtgaaattaggaaaaaagtagtaagtctttatattacatttgatgtactgaataagtattggatacaaacttgtataggtttcaagagtatttaaatttcacattatgtgacctgatataaataggtctgaatttgtagctccttgtcctctaaggtgtcacgtattgtgataactaatcctttgaaatacgggaggcaaaagaaataatgcattaaaaccacccttttcctttccttcctatatttctagtgctttgtgtcctcttgggctgttcttttaagtgggtaagcatcagggctaagctatgcttagggagttgttctcgattcagaacctgccactgagtatcttcactagagttgtttacagtaatcttttagagcctagggggaaagcagcttagtttggtggaaacagttgggttcctgtttccagtgattctaggtaagtaacttaggttttttgttatgcttttcttttacagatgggatgatagaaatgactcggctgggcgtggtggctcacgcctgtaatcccagcactttgggaggctaacatgagaggattgcttgagctcaggagttcgagactagcttgggcaacatggcaaaactccgtctctacaaaaaatataaaaattagctgggcgtaatggtatacacctgtagtcccagctactcgggaggctgaggtgggagaatctctggagcctgggaggcagaggttgcagtgagccgagatggtgccactgcactccagcctgggcaacagagcgagaccctgtctcagtttaaaaaaaaagagagaaatgagttactgaattagaaatgagttactgaaaaagagagaaatgagttactgaggggtaagatttcgtgactgcatacattggaaatattttggggagaggtttgttgtgaagacttgacgtattaataggtaagcgtaggatagatttccatagtgcctgacatataattggcatttgattattattcttgatttagtgttcctccctttaaaagcatagttattttctttctttctttctttttttttgacatggagtctcactctttcactcactgcaacctctgcctcctgggttcaagcaattctcctgcctcagcctgcacagtagctgggattacaggcatgtgccaccacgcctggctaatttttgtatttttagtagagacggggttttgccatgttgggccaggctcgaactcctggcctcaagtgatcctccctccgtggccttccaaagtgctgagattataggctgagccactgtgcctggcctaaaagcatagttattttcaatcagcatggtataatgaaaagaagatggaattttggattcaagaaagaccaaggtttaaagctccttttctttttctttttttttgagacggagtcttgctgtgcgctctgcgctgtgcccaggctggagtgcggtgtcgtaatcttggctcactgcaagccctgcctcttgggttcatgccattctcctgcctcagcctcttgagtagctgggactacaggctcccaacaccacgcccagctaatttttatgtatttttagtagagatggggtttcaccgtgttagccaggatggtctcgatctcctgactttgtgatctgcccgccttggccctcccaaagtgctgggattacaggcatgagccactgcgcccgtcctaaagctccttttcatcccttgggcaatgttctgattttctattattgcctaacaagtctatccaaaatgtagtggcttaatacaataacttattattatctctcatgtttctgtggattgacagggttcagctggacacttctccccttaaggtctttcatgtggttgtggtcagatagtacctggagatggggccatctgaagactctgccctaggctggatccaagatggtgttttccttttacttgtctgatgtctcagtgctctttgagatggcctctttatccagcagagtagcctaaacttatgtggctgctcagggttccaagagttaggaagtagaagttgccaggcagttaagggctttggaactggcatagtattgtatctattaaagaagtcacagggcctcccagattcaaggggcttgagaaataaactgcatgtctttaaagggagtgggaaggtcacattgcagaagaatatatgggctgagaggtcttattggggctgtctctggaaggccatctgggcacaattttttttcattttcttgtttgtaaaatagcaataacaatatttacctcacagagtggttaagtggaatagcacagtgtcaagcacatcatgtgtttagtaaatataagtagacttccccccttaattctctaatgtaacaaattacttctgatctacttttattttaaatggccgcaagtttgctcagtatatggtttggttaactgtttcttcacccgactatgtttctcagactgttgtaacttaaaacaaactttatcatggaaaatttcaaacacatcaaagtaaagagaataccacattaacagaataagggacaaaaactgcatcatcatctcaattcatgcagaaaaagcatttgatagatccagcatactttcatgataaaaacactcaactaggaatagaaggaaactcagcatatcaaagtgtatttatgaaaagcccacagtggctgggcctgttggctcatgcctgtaattccagcactctgggaggccaaggtgggaggatcacttgagtccaggagtttgagaccagcctgggcaacaaagtgagacctaatctctgcaaaaaataaacacaattagccaggcatggtgatgtacgcctatagtcctagctacttgggacgctttggtgggaggattggttgagtctgcagtgagcaaagatcgtaccatatcacttcagaatgggcaacagagcaagacccttcccaccctcacccaccccctccccccaacaaaaaaaagcccacagtgaacatctcattcagtggtgaaagaccgaaagctttccccctaacatcaggaacatggcaaagatgcccattcttgccactgctatttcaacatagtattaagagtcctggccagagccaatttaggcaagaaaaagaaaagcacccaaattagaaaggaagaagtaaaattatctctgttcacagatgatatgatcttatttgttgaaaacccggaagctggctgcagtggctcatgcctgtaatcccagcactttgggaggccgaggcaggcggatcacgaggtcaagagatcgagaccatcctggccaacatggtgaaaccccgtctttactaaaaatacaaaaattagctgggcatgatggcaggcatttgtagtcccagctactcgggaggctgaggcaggagatttgcttgaacccaggaggcagaggttgcagtgagccgagattgcgccactgcaccccagcctggtgacagagcgacactccatctaaaaaaaaaaagaaagaaaaccctaaacattccacaaaaaaccctgttataactaataaatgaattcagcaaagttgcaggatacaaaatcaacacacaaaaattagttatgtttccatacacagtgaacaacttgaaaaattaagaaaacaattccattaacagtagcatcagaaagaatgaaagttaggaatgaccctaaccaaagaagtgaaaaatttgaatattaaaaaccgtaaaatactgctgaaaagaattaaagagcatacaaataaatagaaagacatcctgtgttcatggattggaagacttaatattgttaagatatgaattcttcccaaagcgatctacagattcaacagaatacctatcaaaatcccaacagcattttttttgcaaatagaagtttcatcccaaaattaatttggaatctcacgttacccctaatagccagaacagttttcaaaaagaaaaacaaagctggaggactcaaactttctgatttcaaaatatattactaagctatggtaataaaactagtgtggtactggcataacaacagacatatagacaatggaatagagactccagaaataaacccttgcatatgtggtcagatgatcttggacagaggtgctaggacccctctgtggagcaaggacagtctcttcagcaaacagtgttgggaaaactggactttcacatacaaaacaaaaatttggactcatattttacactatatataaaaataaactcaaagtggattaaagacctaaatataagacctaaaactgtaaaactcctaaaagaaaacttagaggaaaggcttataacttaaaacttagaggaaaggctttataactttggatttggcagtgatttctggcatatgacaccataagcacaggcaacaaaaggaaaaataggcaaatgggactgcatcaaacttaaaaactttggtgcatcaatgaacacaatcaacttgaaaaggcaacctgtggaatgggagaaaatgtttgtaaattgtgtatctgttaaagtattaatatccagaatgtagaaagaacaacaactcaacaacaaaaaatcaaataaacagattaaaaaataggcaaatgacttgaatagtcatttctccaaagatgataaaccaatggtcaagacacatttgaaaagatgttcaacatcactaatcatcagagagatccaaatcaaaaccacaatgagatatcacctcacatccattaggatggctactattaaaaaacaaacagggaattacgagtgttagtgaagattatgagaaattggaactattcttgtgcactgttgggactgtaaaatggtgcaactgtgatggaaaacagcatggcagttcctcaaaaaattaaaaatagaattactatgtaatccatcaaactcatttctggatatgtatccagaagtattcaatgcaggacctcagagagatatttgcacacctatgctcatagcacattcaggatagctaagaggtgaaaacaacgcagatgtccttgatgaataaataaaatatggtatatacacacaatggaatattatttagctttaaaaaggaaataaatcctgtcatatgcgacagtgtgggtgaaccttgaggatattgtgttaagtgaaataagccagtcaaagacgaatactgtatgctttcacttatattaggtattattactgaaacaccagggatgtgttctaggttatgctgcttgctgcacagaaagccagttgctgagacgatgagttttgccagagaaggaggttttaattgggtgctgtagctgaggagagggtaactcagtctcaaatccatctccctggctgactacaattaagggcttatatagcagggaagaactgtaactacatgcaggaaaataggaattagggagagataaggaagagaagttggtcaacaggaagcaggaggtcacttaggcaatcatgatgggttgaggggtttgaggtttcattgtttagatgcagtgatctggtacgtttcagttccttgatatcatctgggagacctgatggttggtttcctgagaaaggaactcagataagacaaatgtaactttttcaagttttaagactgggagggtcaatttctatctttattcaaaagaaactataatggtcagttctatgggacagttaggttgttggtgtcagtatcaaaaattataaattcatagaaacagaggtagaatggtggttaccagggaatgaaggggagaaatgggttgttgttgtttaatgggtatagagtttcagttttgcaagatgagaaggttctggagatgtttcacagcagtgtgaatatacttaacacttctgaactgtacacttaaaaatggttaatatgggctgagtgtggtggctcatgcctgtaatcctagtattttgggaggctgaggcaggcagattgcttgagcttaggagttcaagaccagcctgggcaacgtggtgaagcctcatgtctacaaaaaatacaaaaattagccaggtgcagtggcatgcacctgtagtctcaggaggcggaagttacaatgagttgagatcatgccactgcgctccagcttgggtgacagagggagaccctgtctcagaaaaaaaaaaaaagttaagatgggaaatttttatgtattttctaccacaaaatgtgtagacagaataatacaacaaatctacatgtatacagcttcaacaattatcaacttataaacaatcttattttatttctgtcctcatctaacaccttgtctcttgattagttggaagcaattgatagagtttttgagctcttagagtgaaggggtggacccttaacatagctggaaatcatgggaaagctagtgacttgtgtgaatccagaagaaaagtggtactagtaagtggagtgatatgaagtctttataaggaaaatctagaaacaggaaatataataactttagagtatcattttggggtttccaagtatctaagaggcagattaaagaaatggaagtgagatagttttttgagaccagactttgttctgaaatcagacttaagatacaaatgtgcattttttactttgataattagagaatgaagatcttgtgtattctaaaaagttctctgtttttcctgtaatgttgattgcaggaggatagtccagggctgtgtggtttgttttataagtagctacttttatcaagaataattagcagagcatttgggaagagttttggcttttcttccctgaaatcaaaatataactatttagaaagcttttattgtcgcttataaatggaaggagtacttgtcacttccaaatgacaggaagaaccatagagcacttctacagtttgatttatatctcttaagtgtcatgttcctgtgcgggagctgtagtggttgacagcctggttcctagaactgagaggtgaagcccgctgagcttctggattgggtggggacttggagaacttttgtgtctagctaaagcattgtaaatgcaccaatcagtgccctgtgtctagctaaaggattgtaaacacactaatcagcactctgtaaaaatgtaccaatcagcactctgtaaaatggaccaatcagcgctctgtaaaatggaccaatcaagcaggacgtgggcggggacaaataagggaataaaagctggccgtaccagccagcagcagcaagcagcttgggtcccttccgcgctgtggaagctttgttcttggctcttctcagtaaaacttgctgctgctcactctttgggtctgcactacttttatgagctgtaacactcacctggagggtctgtggcttcattcctgaagtcagtgagaccgtgaacccaccgggaggatcaaacaattccggacgtgccaactttaagagctgtaacactccctgcgaaggtctgcggcttcactcctgaagtcagcgagaccacgaaccaaccagaatgaagaaaccccagacacatctgaacatctgaaggaacaaactccggacacactatctttttttttttttttttttttgaaatggagtctcgctctgtcacccaggctggagtgcggtggcgcgatctaggctcacggcaagctccgcctcccgggttcacaccattctcctgcttcagccttcccagtagctgggactacaggcgcccgccaccacgcacggctaattttttgtatttttagtagagacagggtttcaccgtgttagccaggatagtctcaatctcctgactttgtgatccaccctcctcggcctcccaaagtgctagaattacaggcgtgagctactgcgcctggtcaggacacaccatctttaagaagtgtaacactcaccgggagggtccgcgcttcatttttgaagtcagtgagaccaagaacccacgggaaggaataaattccggacacagaaccgtgactgggaccatgtgaagtggggacttcacatgatcccaataggagatcgcaccactgcactccagcctgtgtgtcagagtgagactctgtctcaaaaaaaaaaaaaaaaaaaaaaaaaaagaaagagattagatgccccttgccatgcagaaagttagggaaatagtgttctagttacaggaagcttttaggcagtgctgagcttgatgagttcaaagaatcaaaagaagtccagtgtgtggctggaacacactgaaggaggggaggggtgacaatgagattgtcaagttgagcacagaccagccttgtaaatcatgttaaagaatttaactttaagtgtttttgtaaataattgaaatattttaagctgggtaatgacatggtctgttttatgctttaaaaaagatggttcttttttgatttcagattggaaaggactaaaagagaagcaggacacgacttaagagggaagatattcgggctgggcgtggtggctcacgcctgtaattccagcactttgggaggctgaggcaggcggatcactcgaggtcaggagttcgagaccagcctggccatcgtggcgaaacaccgtctctactagaaatacaaaaattagccaggtgtggtggcacatgcctgtaatcccagccactctggaggctgaggtgggagaattgcttgaacccaggaggcagaggttgcagtgagccaagattgtgccattgcactccagcctgagtgacagagcgagacttcgtctcaaaaaaaaaaaaaaaaaaaagaaagagggtaagatatttagtgctcagaaccagtgctggcttgggttaaggtagcagcagcggcacaaggagtatgtagatgtgggaaatgtgtttgtgtttggagtaccaggacttagtggtgggaggtgaaagagaggcgttatgaatgacccctgggtttctagtatgagcaaactgatatgccacctctcgagggtgtgtgtgtgtgtgtgagaaaaagcatgtgagagagcatacatataagagtaattgagtctggaattcagaagactggcctgggatagagatacacatttggggggagttggcatgtagagagatttaaagcaataggaatgagtgagagagggagagagaagaaagagggcctagcactgtgatttcatttttctattgactctgttttttgaatttaattttagacattagaatagataaggttagctttccaaaatcagtctcatttgtattcggcattcagataaactcatatatttgcatatattattgttattattttttgatacagggtctcgctgtgttacccagactgcagtgcagttgcaccatcacagcttactgcagcctcaacttcctgggctcaagtgatcctttggcctcagcctccaagtagctgggactacaggcatgcgccaccatacctggctaatttttaaatttttgtagagacaaggtctcactatgttgcccaggctgatctcaaactcctgagctctagcaatcttcctgcctcagcctcccaaagtattaagattataggcgtgagccaccacgcctgaccagataaattttcagaatgggaaagggatggagttgcagctttctgggagggtaggggatgaaggagtagaggaggactcagggatttatgtggtctccagattacttcatttctggagtagtttacagtatgcccattatgaatgtgtctcatcctttatgtgtgtagtggagaaaaaaggttgagtttctgatcctcaaggtaaagtcgatattaatagttaactaaagtttcctacattctggcccctatctgcctgtctgcatatccacattcataccattcccttccaacctccatgcatgctgttttctatcatcatggtcctagacctagaatttcctttttcattggacaaatattttaggtctctgtttcagtcagagctttccctagttcccccaggcaaactctgtatttgtttctgtttctagtgttcattggttatagcaattattgtattaaatttgctgtttcttggtttgactgtctcctcaagaaactaatctttttgacatgagggattttttttttcttttaaaaaagcacttgagggccaggcatggtgggttttgcctgtaatcccagcactttgggaggatgacttgagcacaggagttcgaggctgccttgagccgtgattgtgccactgcactccagtctaggtgacagaatgagaccccatctctttagaaaaaaagtgtttcagtgtttgaattaccatcctgtctttctttgaagagccaaatacagcttacatcatcttcaggtaaaacaaaatttagggttcagaaactatatggcataagaaaatagttgaactgggcacagtgtttcatgcctgtaattccagcactttgggaggccaaggtgggcagattgcttgagctcaggagttctttcagaccagccagggcaacgtggcaagaccttatctctaccaaaaatacaaatagctggtcatggtatgtgcctgtggtcccagctgaggccggcaggattgcctgagccctggaggtcaaggctacagtgagccaaaactgtgccactgcactccagcctgggcaacagagtgagatcctgtctcaaaaaaataaataaataaaataaaataaaaaataaaaaagaaacaaaatggttgaaaatgtctttcccatgcctttggagtctaggatgaggtttaaaaaaaaatgtgtttctcaggtctattttaataggtagttaaaatatactttaaaaaattattataaggcagtctctaaagtgtattcttatccccaaagcttgatattacttaaaagaaagatgtattactgaaggaaatagaaattgaattaatggaattgttttggttatttgaattgccatttctgtagggtatttgagaattgttaggtcttgtttggaaccattgataaacagaagatagaatagaaatattgtactgcctcattgttcctagtctacaaattgatttatgctgttattcagtttatgtctctctttctctttttttttttttttgagatggagtttcgctcttgttgcccaggctggagtgcaatggcatgatcttggctcactccaaccttgacctcctgggttcaagcgattctcctgccttagcctctcgagtagctgggattacaggcatgtgccaccatggctaatttttttttttttttttaagtagagatggggtttctccatgttggtcaggctgatctcgaattcccgacctcaggtgatctgcctgcctggcctccgaaagtgctgggattacaggcatgagccaccacacctggcccagtttatgtcttttgtatgtacacagtaaaaagtagtagtctctttctttacatagtaaaaagtagcagtttcttactttttttttttgagacagagtctcgatctgtcgcccaggctgaagtgcaatggcactatctgggctcactgcgacctctgcctcctgggttcaagcagttctcctgcctcagcctcccaagtaactgggactacaggcacacgccaccacaccccagctaattttacatttttagtagagatggagtttcaccatgttggcaagggtggtcttgaactcctgacctcaagtgatctgcccaccttggcctcccaaagtgttaggattgcaggcgtgagccaccgcgcccagactaaaaagtagcagtttctatacccatcattattataatgttttactgcgttgatatgtatatagtggagcttttttgttagatttgaagaaaaaattggacgatgaattcattctaattaaaaaaataggccaggcacggtggctcacacctgtaatcccaccactttaggaggccaaggcaggcagatcacctgaggtcaggagttcgagaccagcctgaccaacatggtaaaaccccgtctctactaaaaatacaaaattagctgggcatggtggcaggtgcctataatcccagctacttgggaggctgaggcaggagaatggcttgagcctgggaagcagagattgcagtgagccaagaccgtgccattgcactccagcttgggcagcaagagcgaaactctgtcttaaaaaaaaaaggccgggcgcagtggctcatgcctataatcccagtactttgggaggctgaggcagggggatcacctgaggtcgggagttcaagaccagcctgaccaacatggagaaaccccgtctctaataaaaatacaaaattagccaggcgtggtgttgcatgcctgtaatcccagctactcgggagactgaggcaggagaatctcttgaacctgggaggcagaggttgtggtgagccaagatcgcaccattgcactccagcctgggcaacaagagtgaaactccgtctctaaataaacaaataaataacctaaattttaaaataaaaaaatctttgacactctacctttcagctgtcagtggaaaccacttaggtagctatgaagcaattctgcaaatattttatggaattctatatttgccagagtataatagaaaaaactaggccgggactgggcgtggtggctcgtgcctgtaatcccagcactttcggaggccgaggcgggtggatcgcctgaggtcaggagtttgagaccagcctgaccaacatggtgaaaccctgtctctactaaaaatacaaaaattagccaggggcttgtaatcccacctacctgggaggctgaggcaggagaatcacttaaacccaggaggtggaggttgcagtgagctgagatcacaccattgcactctagctcctgggcaagagagcgagactccatctcaaaaaaaaaaaaaaaaaaaaaaaaagaagtccgggtgtggtggctcacacctgtaatcccagcactttgggaggctgaggcaggtagttcagctgaggtcgggagttcgagactagcctgaccaacatggaaaaacctcgtctctcctaaaaatacaaaattagccaggcgtgttgtcgcatgcctgtaatcctagctacttgggaggctgaggcaggagaatcatttgaacccaggaggtggaggttgccgtgagccgagatcatgccattgcactccagcctgggcaacaaaaagaaaaacaaaaaaaaaagaaaaaaaactaggctgggctcagtggcttatgcctgtaattccagcactttgggaggctgaggcaggaagatcacttcagttcaggagtttgagatcagcttgggcaacatagcaagacctcatcctctacaaaaaataaaaaaaattaggtatgttggcatgtgcctgtggtcctagctactctgaaggctaaggcaggaggatctcttgagcctgggagatggaggctgcagtgagccatgatcataccactgcagtccagcctgggtgacagagtgagaccctgtctcacaaaagaaaaaaaaaaacaaaaactacttgagtcagcgagtacatagaacatttcagagcctcagcttgtatactgcatgttattctgaaactacagataccacgtagctttctaatgaaaaagttttatttgtttcttcctttcttttataggaatatatatgtcccagatgtgaatcaggctttattgaagaagtgacagatgattccaggtattgtacaagctcatgaataaatcagacattctattatcaaaactattttctctcagcatggactgagtaagttgaatttgttttacaacttacactctacagagagagcgagagtgagagagagagagtgagtgcatgagcttgcacaagagagggcagaagaatgggagaggaaaaagaaagaaaaatgggaaaatttggaaagtgatatcatagcagatgtggtgatacgcactgctcctgattgtatgtggcattccatgtacatctgtacgcatgtcagagtaaatctggtaagttttcatttattatctgagacttggggcttctcttagattattagttggtttttagtgaccactctgctgtctgaaggtaaactgctgttatacctctttggcgggttagggagtgacttctgacaaagatacctaatcaggtaaacaggctgttctagccaggaaaaccgattgttactctgctttgaggaggccttgaatctcttgttcttattaaggttatttggccagtgtggtggctcacgcctgtaatcccaacactttgggaggctgaggtgggtggatcacctgaggtcaggagctcaagaccagcgtggtcaacatggtgaaaccccgtctccattaaaaacacaaaaattagctgggtatagtggcgggcgcctgtaattccagttacttgggaggctgaggcaggagaatcacttgaaaccgggaggtggaggttgcagtgagccaagactccagcctgggcaacaagagtgaaactgtgtctcaaaaaaaagaaaaaagaaaagattattgctgtcaaacttaggccatctttccagggtgatattaatatatgggtttgtaatgcttggaatttgttcttattggccttcataaaggtatacagctgataaaaaggggaaatatttctgaaagtgactattacatattccttttttgtttatgtgaacaaaactataaaatcttttttcttttttcttttttttttgagacagagtcttgctctgttgccagattggagtgcagtggttcgatctcggctcactgcaacctctgcctcccaggttcaaatgattcttgggcctcagcttgcccagtagctgggactacaggtgtctgacactatgccctgctaatttttgtgtatttttagtagagatggggttttgccgtgttggccaggctggtcttgaactcctgacctcaagtgatccgcctgccttggcctcccaaagtgctgggattacaggcatgagccaccgtgcccaacctaaaatctttttcttttttttttttttttttgtgacggagtctcactcttttgcccaggctggagtgcaagggcacgatcttggctcactgcaatctctgcctcccaggttcaagtgattctcctgcctcagcctcccaagtagctgagattacaggcatgcaccaccacgcttggctaatttttgtattcttagtagagatggggtttcaccgtgtttgccaggctggtcttgaagtcctgacctcgtgatccgcccatcttggcctcccaaagtgttgggattacaagcgtgagccactgcacctggcctaacttaaaattttaataaattttagaatagcattgataggatggcctcttttggctaaacaaaatggcacatttgttcttttggggctatttggttaaacattcgtctgaaaattgaagaagtaccgactggtcaaaaagaatctgtaatctgaagcctcttaatcttggagtgactttggagattttaatggcagtaggtaattcctttactgttactgttggcagaatctaaagttgaaggtcccttccacaaccaggaaaaactacacattttacagtatgtactattagttttactttactaatgattggtgattatatgtgtaaataagctggagcttctggggcaatatgtggcatgggatctattttgatacagttaaatgtcatcttggttttaaatagtacaataccaacactaaacgtgtaagattagcatgactgcaaaattagcaattttgtgtggatggcatgctaacttgggatagctttttgtttgtgccattataattgcatcaaataacttatttcaggcacttatgctctgcatgtgctaattaaaagatatattggttgtgggagaacaattaatgggcttatcttttgccaacttttcaagtagtaaccctggtttctttaggcagatagtacttttatgcaaatacagttataaatgagaatgattaactgtaggatgaatctttgtctagcagggaactgtggattctgtggtttttgttcttaattcttttatgtgtctttgtagatcaaaggttgtcttatataggtgctattggtagcaatttactcaaatacaaagactctgtggtttgaaagagattagtgttttaaatgaaagaagaaatctttttcttagaatccttgtcttagaggcagtatgatatttccttctataaagttcataaacatttgctgatttaaatacttagcaattgcagtggtaagtagtggagggtaaaaaccagtaagaggagggccttgcatgtaaatattagataatgggctccatctgctcttaaacttccatgtagaggagcaccttgtaagttttcttaagctttgtaacatttctcagaacaatgtggtggtttttattatcccttctctatgattagctctattattctttaaaggaattttaaggaaagggaacggtgaggtagcttcagggagagcagaaccccagaaaataagagttgcggtttcaattaccaaggatgtttgaatccctgaaactgtgtagtaaaggcaggaaggaagagtcttggaagcctgtctgggcttgagcaatcaaatggatacatagccactcaatgtagttttttatggtatgtggtagttcaattagctgtttatttagcatagatgtacaagtacttttgggcttgttatacatttggagtgatttttacaaaagcgtttttctgaaattaatgcaggtattaaatggtttcttatcagggaataaggcttgagaatggttgcataaagagtggcattagctttgctttttcacttttggtttcagactaactagggtgtgtttgtttcctcagtgagctcagcacaatgcctggattggtattgtaatcctacaaatgaaaactatttgtagtagtttgtgaacttaccattggggtgagtgtttgtatgtttgtgtgcttaagtgtgtctcttgaagtaaaagtggtatccagcagttcctgtgattctttccatcccctcttcccggatgtgttaacttgttttctttgttctttgcaaatttcatggggacaatgggatttaatatttctctccactcttcagggtctttgggaatagatagttattttatcattttcacatgtgattaattcaacaacttttgagtgtcaatataggatattgacattgcaggattttaaaaggtgatagtactgtgtaatgtctgacacttaaacactctacatgtatttgaggcattaataaattgcagtctttgccttctgaatttatattaatgaaggagggaaatgggttgaaatggatgtggcaaatcctagatatttataatacaaggtaggttttagaatcaaagtgagagtgcagaagggtgtggaagagtcttatttggttggtgagttcagaagggcttgatggaggaggtagcatttgagatgggtcctgaaaggtgggtagggggagaaatatttattgaatccttttataatgttttaaatacagtaccaggccccttacattactacatttaatcattcctaagaaatattaactattgtagcctcaaatgttgtgttcatctggtggttgaatggttttttagtgaaacattttgttttgttagcgttcttgaggataaatatttgtcttttgataggtcaaatccgaattgcattgctgcctgtgggtcctccttccttctctatggtggcttctccaatttttcactggatttagccttgaaaaccacttgattttgtggtttatgatacttttcatagattaattcacatgccagttattcataatttcctttaataggtgttgtgttgggatgagttatttttccttattgggctttgttctcattatgccattctatatttagcttctgggaggggagcttgttcctgggaatagaatcaccactcattccttttctctttagttttttaggtggtggcggcagtcggatagacaataccacaacaacacattttgcagaggtaagttttcctttagctgtaggaattctttaagaagtggttaggtgttaaaatcatggcagatactaactttccagtgtggcacaacatcagagtttaactgaatgtataagaaaaaatgtgggccgtagtaacccttgggaagatttgtgttttcagtagctggggcttgggcgtgttacctttgataaacccttgattaggagaaagtaatagcctcaaactgtattcttttaaactggtagtgtttttaattcttgttttctactttgttattgtatatacagtgtgagaataagaagcttttgctgtttttgaaataacagtgttgcagactctgctttagtggtgtgacaaccaggtaaagtgcaggccaggataagttgtcgaagtcacaatgaaatagtcttcaaccttgtacagaggtactgatttccagggcttacctctagtcaacacagtagtttggtgtagattaaggatgtttacttgcctttcagatcccaagatggggtctgtaaataatttctatatcttcttataatgtggcgtccatattttttgggaaaaacaaatcttaactgtgatttgaaaacagggcattagtcttcattcttgaataccattttatattgaatccagagtaattttcttttttcacttcgtccattggcctaaagtctctttagttgtgttttttttttttaaaaaaagaaaccattgtaactgttcttaagtgtataattcagtggcattaatactctttgtttttaatcatttagagactacaacccagaaggtaccagtcagcctataaaaaacactgacgtttttcttttgcttgtttgtatgtgtaccctatattgccgtacaacttgttcagctctagaaagctgacagatgctaaaaggaagaaataagttaaatcccataatcaggatttctttatgttttaggatcacattagccttttccagagatagccgaagtgcctagagagatagcaaaatatttcactgttttgtatgtaaattgaaattgtactagtagtatatttgaaaagtgatatttaataagaagcctgtaaaaccctaagcttctctcccttattatttgaaaattattttaagacctgtagcccccacattttgatgttgttagatttatcaacattgtctgggtaatggtcctgttctatttagggtggtttttctgcttatggtctgtgctacttcttaatatacagtattaagagttttggttaactctgaactgcccgggttgattagagtgattccagacagatcgtgttttgaacttgcatttttattttcccattttaatggattgaaaaacattatttaatatgtgttctgggccaggcacagtggctcacgcctgtaatcgcaacactttgggaggccgaggtgagcagatcacctgaggtctggagttcgagaccagcctagccaacatggtgaaaccccatctctactaaaaatacaataaattagctgggcatggtggcatgagcctgtaatcctagctacatggtaggctgagacacgagaatcgcttgaacccgggaggcagaggttgaagtgagtcgagatcgcactactgcactccagcctgggtgacagagcgagactccatctcaaaaaagtaaaatacaataaaatgtattctgtttgccagtcctggaagcctttatgatttcagtattctttcctcttgtgtgtgctatttgtgataacacagattgtcacttactgattaggcatatgcagaagaagaaatttcatttgatttttctttagtgttctcttttaggtaatggaaatagatcggtctgccaattttgtaggtatgactcaccagaaagagatgcattgagtaagaagaaaaacaaatatatgtagtcagtttcctaactttagtaatgctaaatccaacactgatggcatgagttatccttcaggtgttaaagtatttttgctgattcatagcttgtaacttcgtgttctttagatgttgccagggatttttaataaattagctaagaagtgtgtgtgtgtgtgtttttaagagatggggccttattgcccaggctggactcgaacttctgagcttaagtgatcctcccacctcaggttccctagtagctgggattacaggcaggtgtcactgtgcctggctgaaagtatatactgaatgtttcatacatagcactctcctagaaataggggcaggaagtaaatgtcatggttgccttgcctgaaaggaacttaattttgttgtggagcaagtgcaaacacttaagaaaacaaggaaggctgggcgtggtggcttacgcttgtaatcccagcactttgggaggccgaggcaggtggatcacgggaggttgggagttcaagaccagcctggccaacatggtgaaaccccatctctactaaaaaatacaaaaaattagccaggcatggtggtgggcgcctgtaattccagctacttgggaggctgaggcaggagaattgcttgaacccagaaggcggaggttgcagtgagcggagattgcaccactggactccagcctgggcaataagagtgaaactcttatctccaaaaaaaaaaaaaaaaaggaaaagtgtacagagtataataaatttattctggggtatatgtaacaagtatagtagaaggaagagttaaggtgggccagggtcttgaggagaggtcatataacagtgattaagaacacagcctctggaaccagattgcctgagctcaaatcctgtgtctgccacttattggctgtgtaatctgggcaaagttacttagaatctctcagtgcctctcttgtccttgtctgtaaattgggaaataatcatccttccctcatagggatgttacgaggattaaatgagttaatacatgctaggtgtgtagaccgcaatgtgcctaccatctagtgagtgcttgatacattttagccattattaagacttcatagtgaagttagaacttgcactggagccttgaagagtaggtggaatttagataagcaaagatgtgaaaattatctcaaaatagtattcataagctataaggttttatgctcatgtccctgaagaaaaaacttagaaataaaattatatatagaaactaaagttgtttttcttttccctgctttagttggtaatttcggcaaagacttatgctcagttttgctctatttttctttagctggagctgcttgtacaatgaagtggttattttctataagtaacatttactgatagctgaattcttaaaatactgtctatattagaagaggcttattccaagaaaatttctgtcaaaatcagtattgacttttttttaaaaaaatgagactggggtaggagataagagactaatgggatagagagaaggtaggggagggttgccagttacatgggagcagtgtttgaataatgtgtgagggccggtggagagtgaatctgaaaatattgctagcagtttgtagagagaagacattgctatactaagcttcctggtggtaatctagaaagtgagccccatagctacctgaaggtttcattgattacttgcaaacttctgaccacgacctggtgccagtgggtcatctgatcttagagtctcagcttacctgaatggattgcttcagtgcaagagtggctctggctgctgcctcagattgggagaaaataagatacatggctttctggaaaaaagagctctcaggtatgcacaagagggcagggtgctctgagctgatttatatgtatttaaataaaatttgttatttgtttttgttacataagcagcattatagtggcagtaaaaaatttaaaaatatgtatcttgagtttcacttttttttttttttttttttttttagacggagtctcactctgttgcccaggctggggtgcagtggcgcaatctcggctcactgcaacctccgccttctgggttcaagcgattatcctgcctcagcctcctgagtagctgggaccacaggcgcgtgccaccacgcctggctaattttttatatttttagtagagacggggtttcaccgtgttagccaggatggtctcgatctcctgacctcgtgatctgcccgccttggtctcccaaagtgctgggattacaggtgtgagccactgcgcccggccgagtttcactattctaagagctcccttttccatacatttcctttcagattttgtcctaaggcatagttactgaaaaataacaaccttaagctcttttttgtttgtttttttgagacggggtctcgctctgttgcccaggctggagtgcaatggcacgatctcggcttactgcaacctctgcctcctgggttctagtgattctctcacctcagcctcccgagtagcttggattacaggcccccgccgccaaacctggctaatttttgtatttttggtagagatggggttttaccacgttggccaggctggtctggaactcctgacctcaggtcatcctctcgtcttggcctcccagagtgctgggattacgggcttgagtcaccgtgcctgggcctaagcttttttaaaaatgagaaatattggccgggcatgcagatcacttgaggtcaggagttccagaccagcctgtccaatgtgatgaaaccctgtctttactaaaaatacaaaaattagccgggtgtggtggcgggcacctgtaatcccagctattcgggaggctgaggcaggagaatcgcttgaacccaggaggcggaggttgcagtgggctgagattgtgccactgcactctagcctgagcaacagagcgagactccgtttcaaaaaataaagaaatatcccatattgtcattacttgattatagctttatgcattttttagcaaaatacttctcatttctcatgtgcatacctcataactgtttagagttgctgtcataagagtatattgtatttctgcctctaaaaatttacttggtattatgtcataaaccttttacttgtctctctatagttattagaattatagctggacgtggtggctcatgcctgtaatcctagcactttgggagggcggaggcaggcggattgtttgagcccaggagttcaagaccagcctgggcaacatggtaaaaccctgtgtctacaaaaataaaaataaaaagccaggtgtagtggcatatgtgtgtagtcccagctactcgagaagcggaggtgggagaatctcttgagcctgggaggcagaggttgcagtgagctgagctcgtgccactgcaccccagcctgggtgtcagagtgagaccctgtctccaaaaaaaaaaaaaaaattaggacttcatattctttaatggctacattatatttattaaactattatcctgtgttaggcatgtctagttatatatgatggttgatcatcgatcatacttcctttacctgagtctagaacatactgagaaaacatagaacaccagacagatggatataaaaatttaatttttattcagctgaattggaacacaaagttgaactgtggtcaaatggacatcctaagtttatacaggatgacctacctgagaattagaggctgcaaagcaggcacacataatcagaacaatgtactttgcatttgtgcaacttcctaatacatgaactccacttgctggagaaatgcgaaatcactagagattagactttgctattcactaatcagctacatcattcctctgttgaaaagtacatacaatatgatgccctttacataaaattctagaaaatgcaaaccacagaaagatcaggggttgcttggggatgggaaggggcaggagggaaggattacaaaggcacacgaggaaacatttcggggtgatgagtatcttccttactttgctttaatgttttcacaaaatcgcctgtgaactttttcaagattacatttctaaggttaataattataaaattatttacccttaattgactcatctttatacactctaatgttattttttgagatataattcatatactacgtaattcaccctgttaaagtgtacagctaagtggttttagtatattcacagagttatacaactattaccactgatttagaactttttcatcatccccaaaagaatccccatacacattagtagtcactacatatttctccacagttctctcagccctaggcaaccaccaatctattttctgtctctatggatttgcctatataggatatttgttataaatgaaatcatgcaatatgtgaacctttgtgactgactcttttctaattagaatactgttttcaaggttcatccatgctgtagcatgtatcagtacttcatttttatggctggataatactacatggtatggatattccacattttatttattcatcagttgatggacatttaggttgtttacactttttgcctgttatggataataatgctgctgtaaatatttttgtacaagtttttgtgtgatcatatgtttttaattttcttggttatataactaggagtgaaattgctgcgtcatatggtaactgttcaactcattgaggaacagaccataatattttaagaagtgctgatgtgatcatggttagtgtagagcaagttctgccaaatggaagatattgtccatcctgttttttattttgaatgtgtaaatagttcaccccaaatattttcagaaatactgtcattatacttacattcagagtaatgttttcagtttttcaaggcaaaacttgtcaaactgtctctgtgattctttagactgttttagcaaaactctatgatagtgttccctattagtttttacttatgtaagctgtgtcctgaatacccagttttgttgtatgagctattttttttttcttttatgcttatctaagtctactcagagacaaatgacctgaagctatttttatccttagtgctgatttggtataaatttgtgaggtgtgcttttccatcctgtgttctttggtcagggtacactattattttgagattaaaataggccacaaatacattgactgttactattaatttgcactaatttgcactttgtatactagtaggaaaatgcctcatgctgatgttgaagctgtttttaagcatggatcctttagaaattttgtatattattaggtgtggtaacaatttatagtcatctaaagtatgttagtatcaaagcagagtattatgaacttggtgcttgacttttctgccagtcaagattttaaatatttcatttttatattataatgaaactaatggttactttgagagttgtcttctgtgagcaaatgttgtggaattgtatatagtaagggaatcatagatttcttataattcaccttagtgagatagatgattgagaacatggaggagtctgctcgtactttttcacttattgaagacaagtatagttttaggtttttaaatgtcgtgtttactttggaattttgggtcaagagaattcttgtgttctagaccgtttttcagactagaaaccagtgatctctaatagatgaagactataattagaaagtaaagggaaataaggcagatttgataagaagcgcaaatggcagttaaaatgaaaaggtgttttatgtcaccagtatttagagaaatctttttgtttggagacagagtttcactcttgttgcccaggctggagtgcaatggcgcgatcttagatcactgcaacctctgcctcccgggttcaagcaattctcctgcctcagcttcccgagtagctgggattacaggcatgctccaccacgcccagctaactttttgtatttttagtagagacggggtttcaccatgctaggctggtcttgaactcctcacctcaggtgatccacccgcctcagcctcccagagtgctgggattacagatgtgagccactgtgcctggctgagaaatctaattgatgtttttactctgcatattactctttgttcttcagcttatatattagaatttttaaaactttaaaaaaatgttggtcaggctgggtgcagtggctaatgcctgtaattgcagcattctgggaggccgaggcaggtggatctcctgaggtcaggagttcaagaccagtctggccaacatggtgaaaccccatctctactgaaaataaaaaattagtcgggcatggtggcagacacctgtaatcccagctactctggaggctgaggcagcagaatggcttgaacctgggaggcggagtatgcggtgagccaggatggtgccactgcactccagcctgggtgacagagcgagactccttctcaaaaaaaaaaaaaaaaaaaatgttggtcagagtaggggtaaatgtaagcatttatactctggtaggagtctgaattggtacagtagcccccccccttaccctgtggtcaaccatggcctgaaaacaggtgagtatagtacaataagatattttattttatttatttttatttttatttttttgagacagggtcttgctctgttgcccaggctgaagtgccatggagtgatctcggctcactgcaacctctgcctcctgggtttgagtgattctcatgcctcagcctcctgagtagctgggactacaggcatatgccaccatgcccggctaattttttaatttttttagtagagacaaggtttcaccatgttggccaggctgatctcgaacttctggcctcagtgatcccccccaccgccttagcctctcaaagggctgggattataggcttgagctactgcgcccggttacaataagatattttaaagtggggcacagaggctcatggttcaatcccagtactttgggaggccgaggcaggaggattactttaagccagatgtttgagaccagccacaaaattagaccttatctctaaaaagaattttttttttaattagctgagtgtgatggtacatccctgtagtcctagctacttgggagattgaggtgggaggatcacttgagcctaggagattgaggctgcagtgaaccatgatcacggcgttgcactccagcctgagcgaccgagttgagaccttgtctcaaaaaaaaaaaaaaaaggccacattcacaaaacttttattattatatattgttataactgttctattttattattagttattgttgttaatttcttactatgtctaagttataaattaagttataagttataaattaaactttactgtaggtatgtgtgtataggaaaaaacatagcatataattagggttctgtatagctcactgtaaccttgacctcatgagcttgagctcaagatcctgggttcaagtgatcctccccactcagcctcccgagtagctggaacatcaggtgcttgctaccacacttagctaatgtttaaattttttgtagagacaggatctcactctgttgcccagactggtcttgaactcctgggctcaagcgatcctcctgccttggcctcccaaagtgctaggattacaggcataagccactgtgcccagcctgtttttgggttttctaggtacacaaattattaagagttcagcaaattttctgtatactaaggtcaatatacaaaaatcagttgcgtttctgttagcaggaattaactattaaaatatagaattttaaaaaaaagatactaaggcaattagaaagtcagttcaataggaaaatggacaaaagacatgaaacaagataagacataaaagagaaagaatagagatttaaaactgatttaattgaaacaactgatgagtactgaaaaagtaaactcagtgtgatttaacactgagtttaaatttaagaaataaatgtggctgggcgccatggctcacgcctgtaatcccagcactttgggaggccgaggtgggcggatcacttgaggtcaggagtttgagaccagcctggccaacatggtgaaaccccatctctactgcaaatataaaaaattagcggggcgtggtgtcacatgcctgtaatcccagcttctcgggaggctgaggcaggagaatggcttgaacccaggaggtggaggttgcagtgagccgagatcgtgccactgcaccccagcctgggcaacagagcaagactccatctcaaaaaggaaaaaaagaaaaaaaaagaaagaaatgtctggatttctaaaacaccaaaaaaaaaaaaaaaatgttgggggaaagagaagacatatgaatggctggtaaatattacatgacaagatgtttagccttattggtatattcgtatcagggaaagcaaactaaaaccacaatgacagggtgatgtcagcgaaaatggtagagtaggacttctgtgggtcatccctctgcagaaacaccaaacaccttgacagaaaagtcagaatttagcttatcaaaactctggaaaggtaatcaaaggtttacagcagccaagcaaatacttcgccagaagaaagggcactgaaacaaggtaagagatctttgtggcattttagcttaccctagcctcacctcccttcctggtatggctgcagtcttgaagatgacagcctgtgttccccatgctggtgcctgattccagagagtggacactcttcctcctgagggattctgtgttctgttttgtcctttctccaaaggactgccaccaggggcaaaaaacaaacaaaaaaaccaaaaaaagaaaaaaaaaaaaacagggcaaacaataagatattgaaagcctgagaggaaaagctgtagagtgagtttttgtagaggaataggagctttgaaaagctattgtggatgagaaactagaaagccaagtgcacagctcagggcagtatgtgtgctcagaaaagacctgagaaagccattagctttcacctctggcttgtctttaggttcaacacaaacaggaagtgaatattaaggtagatttataaaggccctgggtaagttttgaaggagtgccccaacagctaatcagtagagacctggcgagcattttacttttctttttctttcttttttttttctttttggtttatttgttttgaaatgtggtcttgccttgctcaggctaatcttgaactcgttggttcaagcgatccttccacttcagcttcctgagtagctggaattacaggcacacaccactgtacccatctatttttgtttttattttttacacattataaatgttcagtttttttaaaaaaaattacgaagcatgtgaagaatctagaaaatatgcttcattcacaagaaaaaagaaatgaacagaaactaccccgaggaagcactaatactagaattactagacaaaaactttaaatcagctgtcttaagtatactcaaagagctaaaggacaccatggacaaagaagtaaaggaattcaagataataatgtctcaacaaatagagaatatcaataaagagaaatttttaaaagtaggcaaagagaaattttggagctgaaggttacaataattgaaatgaaaattcactaggggagctcaacaaaagatatgagcagacagaagaatcagcaaacttggagataggtccactgaaattatatagtttgaagagcacacatttaaaagactgaagaaaaatgaacagagtccaggagatgtgtgggataccaacatatatatcatggtaaggagagggagaaaggtgcagaaaacatgtttaagaagtaattgccaaaaccatttcaaatttgacaagacatgaatatacacatcaagaagctcagctaacacccaagaaggataaactcaaagacatccatacaagacacattataattaaaatttccgaagccagagataaagagagaatcttggaagcagcaagagagaagcaacttgtaaaatataagggatcttaaataagatgaatttctgttgatttcttagcggaaaccatggaggctagaaggcagtgggataacatatttaaagtgatgaaagacagacctgccaaccaagaattctaaatctggcaaaactatccttcaggaattaagaagaaatcatgacatacccagataaacaatagctgagggggcttcattgttaatagacctgccctgtaagaaatgctaaaaggagtcttcaggctcaccacagatctattaaattttctttttggcataggaccgaaacatgcattttaattaaacattcgtaatttttcttacacagcaaaaccaaaagccccacaatggaaaatcattttctgttcactgattgttaaaaactttttttaaaaaaagtcctgtgacatcaagtgcttgccaggatgtggcacagtagaaactcttaaacacttggtgggtgtttaaattgctacaaccagtttggaaaacaatttgtcattacccagtaaagttgaagatgtatagatcatgtaatagttttacagaccaaaaatatagaaactctggtacctctgcagaagaagacatacagtaatattcacagtggccatttgtaatataaaaaactgtaaacaatccaggtgtttattgattgatttttctaacatgtgacttatttctggtctttactagctttggggccatttggatcacacgatgttttttcaagattttagaccctttctaagtagcagtccactggaccaagataatagagccaatgaaaggggtcaccagactcacactgacttctggggagcaagacctccacggttgccattgggtcggagatacagatctcgaggaagttctcgtcctgacagatctccagctattgaagggtgagttgttttattttaagttctttttaaggtagtttcaatgaaggacaaattggtataatctaatctttataagggtctcatacttattacctttgtggacaagatggacatatgtagaaaggatgaaagtgaagctaaattgaatgttagtactcacccgatgataaaccagagagtgagaaatgctatgtctctgattaacatttttattaatggctcagattaatttatagatgatatgtgtctcagtccattttgtgcagctatagcagaatacctgagactgggtgatttataaagaacagagattcatttcttatatttctggaggctgggaagtccaaggttgagggatccacatctggcgagggccttcttgctgtgtcattccatgttggaaggcagaagggcaagagagcatgcatgagcaagaaagaaaggtgccaaactcatccttttattaggaactcactcaacaataactaatccacttccaggataaaggcatttaatccactcacaggagattcatctcttaaagtctccacctttcaacactgctccactggggattaagtttccaacacatgaatttttgaggagggcacattcaaactatagcagtatatttatcaaaatttcaaaagggtatcaaatatattaggcattaggattaaatatttcaacagattggaacagtggacttaacatgaaatttaatcaagtatctgctttttgtgaagaaaggaaaaaaatttaataggataaatatgaagtcttgtgactgtaaaaacattcatgtaataaatgtttgttgagtgtcttttgtatgggacactgtactagacactaggaacacaatgatgagtcaaatagatggttttgctcatggatctcatttagttggaataataaacgttaattttaagtgtttaccatatgcagaggactgtgcttcatgctttatctgctttatgttgtttaatttgtgtgaagtaataggtgctattgctgttttcattttataaaataattaactgagtctcagagaaataaagtaacagccattggtggatctaagacttgaatctagggctatatgaatctagtgcgacattgtcttatatggtagctgctagccacatgtagctatatgtttacatttaagttaaccaaaagttaataaaactcaaaattcaaagtacctcaatcccaaatagctatattttgagtgctcattggccacatgtagctaatacttatcatatttgacagaacatattatagaaaatttccattatcttagttctattgaacagtgctgttctagagcctacactccccctttcccccaacacacaccttctaggctttattaacattttactatacttgcgttattacatatctatccattagtgtttctttgttaaacttgtttgcttttggttcctaatatatgcactatcatactaagaaagtttaattttattcataatttattaggggcttttaattaagaatgactaatgattttgtcacatgccctttgcagtcctatcaaaatgaccttagagtttttctcccttaaacagttaatgcattttattaacaagtaggttttctaatgttttctagtgtttttattcaagctgctttgtcaaggagcactaaaacctcttttttaggggtcggggttggggaaacagggtctcactttgtttcccaggctagaatgcagtagcaagatcatgtttcactacaacctcaaactcggtgggctcaagcaatcctcccacttcagcctatgaactaggtaggactacaagcatgtgccaccacgcctggctaatttttcaatttttggtagagactaggttgcccaagctggagtctcttaacacattattggagttgatttgttccttatctttttttttttttttttttaaggatttttacatttattcaaaagaggatgagtctctttatcaagttttggtgtcaggattatattagtttcataaaaggaactgggaaaacttgctgtattcttatgcttggaaatagtttacataacacaggaattacctattatttaaaggtttaatgcaagttacctgtaattccatctggacctggtatctttttgggaactagatctattacagtcttttcagttacttctgtggttgatagtatagggtagtgttttatttatctctgtattctcagcttctagtgcagtatcggttttatagtggctactaaacatgtttgttttgaataagtggataattgtaattatgtctctaaaaagtataaaaaacatatgaattaatagtaataatagctaagagtatgtgccagaaactagtctaaatgctttacaggtattcatttgtttaatcctcactataaccatgtgaagaaggtattgtgaatatctccattttactggagaaactgaggcacagagagtttaggtaaattgtctaagagtataaaggcagttaaatattggagccaggatagtgcaaaaatcaaagtatttgtatttggtgagatttttaactgttcacttatactaaaaaattttagtataactatttagtataagtcaaaaatttaaaattaagtagccttctcacttattttttaaccaaagatttaagcatttccctaattttctcagaaactttccttccaaggcaccagtatatcagtaaatagaacttgaaagtttttaattcagtttcttttctcttttctttcatagaagtataaataaacacagtatatctttggggcctattactatacccagctagcaggcctgcctagattgttccatatggttgttactttacagtaattgtcattatgatgtcactgtatgttttgaaagtacaatttcatgttttatacatttttaaaaattgattgaattttagcatggcttcttcctgataacagttttgtcctcttgctttgagaaggagcatatgggcattccacttatggtttccatgggctgcatctcagattcctgttcattctacgggtttcactgtagacagagtactttgtatttaatggccgggtgcggtggctcacacctgtaatcagcactttgggaggccgaggcaggtggatcacttgaggtcaggagttccagatcagcctggccaacatgatgaaatcccatctctactaaaaatccaaaaattaaccaggcatggtggcggttgcctgttatcgcagctactcaggaagctgaggcaggagaatcacttgaacctgggaggtggaggttgcagtgagccgagattgcgccactgtactccagcctgggcgacagagcaagacctcatttcaagaaaaagagtactttggctggcgccaacagggtccaggtctgtgcctgccattggagaggatgccacagccacaggggtgggcgctggcctggaggcctccaaggggcatctcctgtgagcccaggggatgggcaggatctgagcggagaagagtgaaagtggaggagtgaggccagaacaaaggctttgccgtgaaagaggtggtttcccgcctaggctctgaccttcactcactgtgtggcccaggccaagggcaagcgtctgacctcgctgggcctttgtttctcaggggtaagatgaaacaatggctccctctccctctccctctccctctccccacggtctccctctccctctcttgccatggtctctctctgatgccgagccgaagctggactgtgctgctgccatctcggctcactgcaacctccctgcctgattctcctgcctcagcctgccgagtgcctgcgattgcgggcgcgcgccgccacgcctgactggtttttgtatttttatggtggagacggggtttcgctgtgttggccgggctggtctccagctgctaaccgcgagtgatccgccagcctcggcctcccgaggtgccgggatggcagacggagttgcgttcactcagtgctcaatggtgcccaggctggagtgcagtggcgtgatctcggctcgctacaacctccacctcccagctgcctgccttggccccccaaagtgccgagattgcagcctctgcccggccaccaccccttctgggaagtgaggagcgtctctgcctggccgcccatcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccaccccgtctgggatgtgaggagcgtctctgcccggccgccccgtctgggaagtgaggagaccctctgcctggcaactgccctgtctgagaagtgagaagctcctccgccgggcagccacaccgtctgagaagtgaggagcccctccgcccggcagccaccccgtctgggaagtgaggagcgtctccgcccggcagccaccccgtccgggaggtgaggagcccctccgcccggcagccgccctgtctgagaagtgaggagcccctctgccgggccagccgccccgtccgggaaggaggtgggggggtcagccccctgccctgccagccgccccgtccgggaggtgaggggcgcctctgcccggccacccctactgggaagtgaggagcccctctgcccggccagccaccccgaccgggagggaggtgggggggtcaggtcagccccccgcccggccagccgccccgtccgggaggtgaggggcgcctctgcctggccgcccctactgggaagtgaggagcccctctgcccggacagccgccccgtccgggagggaggtgggggggtcagccccccccggccagccaccctgtccgggaggtgaggggcgcctctgcccggccgcccctactgggaagtgaggagcccctctgcccggacagccgccccgtccgggagggaggtgggggggtcagccccccgcccggccagccgccccatccgggagggaggtgggggggtcagccccccgcccggccagccgccccgtccgggaggtgaggggcgcctctgcccggccgcccctactgggaagtgaggagcccctctgcccggccaccaccccgtctgggaggtgtactcaacagctcattgagaacaggccatgatgacaatggcggttttgtggaatagaaagcggggaaaggtgaggaaaagattgagaaatcagatggttgccgtgtctgtgtagaaagaggtagacatgggagacttttcattttgttctgtactaagaaaaattcttctgctttaggatcctgttgatctgtgaccttacccccaaccctgtgctctctgaaacatgtgctgtgtccactcagggttaaatggattaagggcggtgcaagatgtgctgtgttaaacagatgcttgaaggcagcatgcttgttaagagtcatcgccactccctaatttcaagtacccagggacacaaacactgcggaaggccgcagggtcctctgcctaggaaaaccagagacctttgttcacttatctgctgaccttccctccactattgtcctatgaccctgccaaatctccctctgcgagaaacacccaagaatgatcaattaaaaaaaaaaaaaagaaaaagagtactttgtatttgtatttaagaaatcagatgtcagagattagcctttgtgggattattagtgtgttcctcacaccaacttaataagtttccctgaaatgaggtccattttctttgactttttcattggcatgagtaaaacttttttactaacacagagacagggaactctcacattgttcattcattctgcaaatatttattcagtgtccctaaagtatgtgctttatcctctaatctgcagcttttgaatgatagttaattaggtcttgaatagactagctcatcttatctgactttaagtgcatctgacctgtgccagcagattaatttataaatttataactgagggtattctgtttcagtgactataaaactcatttgtttgttagcatactcttgtctttgaatttctcaagtatcaagaaatcaaaagcaatcagatggttgtttagtacatatagaatcagcaaggaaattgcatgatctttaagagaaattccatccagattgtgataaatgctaaggaattactcatatttcacttcaaataatttttttttaattttttttttttttattgatcattcttgggtgtttctcgcagagggggatttggcagggtcataggacaatagtggagggaaggtcagcagataagcaagtgaacaaaggtctctggttttcctaggcagagggccctgcggccttccacagtgtttgtgtccctgggtacttgagattagggagtggtgatgactcttaacaagcatgctgccttcaagcatctgtttaacaaagcacatcttgcaccgcccttaatccatttaaccctgagtggacacagcacatgtttcagagagcacagggttgggggtaaggtcatagatcaacagcatcccaaggcagaagaatttttcttagtacagaacaaaatgaagtctcccatgtctacttctttctacacagacacaacaacaatccgatttctctatcccttccccacctttcccccttctctgttccacaaaaccgccatcgtcatcatggcccgttctcaatgagctgttgggtacacctcctagacggggtggtggccgggcagaggggctcatcacttcccagaaggggcggccgggcagaggcaccccccacctcccggacggggcggctggccgggcggaggcaccccccatctccctcccggatggggcggctggctgggcgggggctggcccccacctccctcctggatggggcagctggccgggcgggggctgaccccccacctccctcccggaccgagtggctgctgggcagagacgctcctcacttcccagacggggcggctgccgggtggaggggctcctcacttcccagacggggcggctgccgggcggaggggatcctcacttctcagacggggcggctgccgggcggaggggctcctcacttctcagacggggcggctgccgggcggaggggctcctcacctcccagacggggtcgcggccgggcagaggcgctcctcacatcccagacagggcggtggggccgaggcgctccccacatctcagacgatgggcggccggcagagacgctcctcacttcctagatgggatggcggccgggcagagacgctcctcacttcccagacggggtgtcggccaggcagaggctgcaatctcagcactttaggaggccaaggcaggcggctgggaggtggaggttgtagcgagccgagatcaagccactgcactccagcctgggcaacattgagcactgagtgaacaagactccgtctgcaatcccggcacctcgggaggccgaggctggcggatcactcgcggttaggagctggagaccagcccggccaacacagcgaaacccagtctccaccaaaaaaatacgaaaaccagtcaggcgtggtggcgcgcgcctgcaatagcaggcacttggcaggctgaggcaggagaatcaggcagggaggttgcagtgagccgagatggcagcagtacagtccagcttcggctcggcatcagagggagaccatggaaagagagggagagggagaccatggggagagggagagggggagggggagggggagggccaaatatttttttaagacggtaaaatattaatgcttgttaggttttttcctttgtgttaggtcaacaccagcacattcatgttttccagacaagtaatagagattaccacccattagtctgcacttactacattaaaacccatctttattttattttgttgtttttgttttgttttgtttttttgagagggagtctcactctgtcacccaggctgcagtgcagtggtgtgatctcggctcactgcaacctctgcttcccaggttcaagcaattctcctgcctcagcctcccaagtagctgggactacaggcatgagccaccatgcctggaaaattttttgtatttttagtagagatggggttttgccatgttggccaggctggtctcgaactcctgatctcaagtgatctgcctgctttggcctcccaaggtgttgggattacaggcgtgagccactgcgcccagccccatttttattttattgtgctttactcttttgtttttttgttacactttagcttggtagtttagtctccttcctggttatataaaggaagcctctttgattttagcagtaagctgtttctgattcgctttgtagggtacattacttctaagaaggtgtcccacctaaataatacgttcttttaaaaatttattatttttattttagattcgggggtacgtgtacaggtttggtttttattttttaatttttaaaaatttgctttcctggtaactcacaaaacagcaggtttattacacgggtatattgtgtgatgctggggtttgggcttctaatgatcccatggcctaagcagtgaacatagtacctataggtagtttctcaacctttgcccttctccctccctctcccttttgtgatctccagtgtttattattccttactttgtgtccttgtgtacccaatgtttagttcccatgtataagtgagaacatgtggtatttctgttttctgtgttaagttgcttaggctaatgacctccagctatattcatgttgctgcaaaggacatgatttcgttcttttttatggctatgtaaagaatatgttttaagatttcccacctagagaatatgttcttctgaaattaaccctaggttcttggaccatagatttctgaccactgatcacatctcagattttgagaactgactttttttggttaacttttttttttcttattaaaaaaaatttgttttggtatggaataaaaagacagccttatccagaaatagccatagttacaccttgatgtataatcttgtagacctttttaaatacatatatatgataattacatctatataattgaaattgaattgattatactacacatattttataatcttttttatcttaatagattgtatatatctttcaagataacatttgattggggcctgtattagtctgttttcacactactgataaagacatacctgagactgggaagaaaaagaggtttaattggatttaatagttccacatggctgagaaggcctcagaatcatggtgggaggctaaggcacttctaacatggcagcagccaaaccatgtcattctgcccctggcccctccaaatctcatgtcttcacatttcaaaaccagtcatgcattcccagcagtcccccaaagtcttaattcatttaggcattaacccaaaagtctgaagtccaaagtctcatctgagataaggcaagtcccttctgcctgtgagcctgtaaaatcaaaagcaagctagttacttcctagatacaatggaggtacaggtatttcgtaaatacggccattccaaatgggagaaattggccagaacaaaggggttacaggtcccatgcatgtccaaaatccagcaggacagtcaaattttgaagctccaaaatcatctcctttgagtccaagtctcacatccaggtcatgctgatgcaaaaggtgggttcccgtggtcttgggcagctccacccctgtagctttgcggggtccaacctccctcccggctgctttcactggctggtgttgagtgtctgtggcttttccaggcgcattggtgcaagctgtcagtggatctaccattctgggatctggaagatggtggcccacttctcacagatccgctaggcagttccccagtagggactctgtgtgggggctcccaccccacattttccttccgcaccgccctagcagaggttctccatgagggctccgcccctgcagcaaacttttgcctgggcatccgggtgtttccatacatcttctgaaatctaggcggaggttcccaaacctcagttcttgtcttcagtgcactcgcaggctcagcaccacatggacgctgccaaggctttgggcttgcactctctgaagccacaacccaagctctatgttggcccctttcagccatggctggagcaactgggacacagggcaccaagtccctaggctgcacacagcacggggaccctgggcccagcccacaaaaccactttttcctcttgggtctctgggcctgtgatgggaggggctgctgtgaaggtctctaacagggcctggagacattttgcctgtggtcttggggattaacattaggctccttgctacttatgcaaatttctgcagctggcttgaatttcccctcaaaaaatgggtttttcttttttgtcacataggctacaaattttccaaatttttatgctctgcttcccttataaaactggttaacagcacccaagttacctcctgaatgctttgctgcttagaagtttcttccaccagatattctgaatcatctctctcaagttcaaagttccacaaatctgtagggcaggggcaaaatgctgccagtctctttgttaaaacataacaagagtcttctttgctccagttcccaacaagtttcttatctccatctgagaccacctcagcctggaccttattgtccatatcactattagcattttgggcaaagccattgaacaagtctctaggaagttccaaattttcccacattttcttgtcttcttctgagcccttcaaactgttccaacttctgcctgttccttagttccaaagtcaattccacatttttggtatctcttcagcaatgccccactcctggcaccaatttactatattagtccattttcacgctgctgataaagacatacccaagactgggaagaaaaagagctttaattggacttacagttccacatgactggggaggcctcttaatcatggtgggaggtgaaaggcacttcttacatggcggcggcaagagaaatgaggaagaagcaaaagcagaaacccctgataaacccatcagatctcatgagacttactgtcatgagaatagcatgggaaagatcggcctccatgattcaattacctcccccagggtccctctcacagcatgtgggaattctgggagatacaattcaagctgagatttgggtggagacacagccaaaccatatcagagcccatctaggggaggtttcttaattaattttttcctgggctcaagtgatcttcccatctcagcttcctaagcatctaggaccacaggtgtgcagcactaggcccagctaatttttaaattttttttgtagagatggggtctccttatgttgtccaggctagtcttgtattcctgtcttggcctcccaatgtgctgggattacaggtgtgagccactctgcctggccccataagaggtctcttaatttattcagcagacattgtgtattactgtgtgccagatgttgggcatacagtagtcaataaatagtcaagaatgactgccctcgtggagcttaagtactaatggagaaagatagatgatcaaaataaatagaattttaagcagtagtaagtgctatggtggaagaaaagcagggatgggagatagggaatatggttgaagtgaagtttcaaaaagagcatagtcagcaaatgtcttattgagaaagtatctgaatagacaccaaggaagtgtagggatggacaaacaaggagagaccaatgtagggcagagaaggtgaggggaatggtaggagaagttgatgggagtgggaatggggaggtgggtattagattatatgaagcctagttggcaattataagagcttctgttccaatggagagttaggtgtcatttatatcttgaaatgattgctctaactgctgtgctgaaaatagaatggggggctgcgaggtgtgcgaggcaaagacacagcagagaaaccatttaagaggctattgcattaatataagctagagatgccagtggtttgggtgagagcagtgaaaaatggtttggtttcagatgcagtttggcaatattcatgataggagttactgacagattggatgtggggtgtaacagaaagaagagttatgacaccaaggtttttggcctgaaaacaagaagaatggagccaccatccactgacatggggaacattaggaggagtaagtttggaggaaaatatttaagagttcattcagtttgggacataataagtttgaggtgcttattatacaagtggaaatgttgaataggcagaggtcttggctggagataatatttggaagttgtggcctatatatgatatttaaaattataaagctggataaagtggtcaaagaagtcaagataggaaatagcagagctcagagaattgaggcctgggccctcgatggttagaagtttggaagataaggaagaataagcaaaggagactgagaagaaacagccagggaagtacaaggaaaacctagagaggctacagctctggaaactatgtgaagactcttacctggttttagcatgtgacttcccttccagacccagtgggttgatttttctcgtctgtgagtttctaaaattaaatgtatacactatcttccttccctccacatcttccccagacatttagctttaacaagaaaagatttttttttaataaacaaaattcattgtaaatactctgtcaactattgttctccgagcaacagctcttatgcattggggccaccctcagcagtctctgttactgctacaaaaacatgggactaacatctgacttccagagagtaagtagccaagaaagagaaatcatcagctgatcagctgctggtgagttgtccctcgtaattccaagcattcatataggattgacttttacagcttcaagaactaggctatctctcaaacttgattattaccatttacttattggtcagtgtaagcataagataatttgcccttcttgtcactgacaaataggtgggtatatattagttacctattgctgtgtaacactttaccccagaatttaacagcttatgacaatatttattatctcaatatttttgagggtcaggaatttgggagcaatttagctagatggttctggtgaagggcttcatgaggttataatcaacatgtcagctgtggctacagtcaaccgaacacttaactggacctggaacatccacttccaagatggctcactcacatgactgttggcaggaggccttagttcctcaccatctgggcctctccatagggctccttgaatgtccatattacttggcagctagcttctcttggagttagtgatccaagagaatgatagaggaagcaggaaaaaaacccataatatctttttatatcctaattttggaagtcacacactgtcattcctgctacattttgtctgtaagaggtgaatcactaaatctagcctacattcaaggagaagagaattagctccacctctagagaatttatggatgtattttaaaatcaccacagtttgccctctagccacaaattatttacacttcttctatgtgcaaaatgcactcacttcctcccgaaatctatcaaaaaagtctccttcttctatagcatcagcttgaaatataggtagctgtccttttaactaggtccaagtgtgggtgtggctccttgggtatagttcctcaggtatagttccttttgttgtgaagacctgtaaactaaagagacaggttaactacctatcacacacccaacatacagtgatatggacaggcagtgattctgaacaggtatagagatttcctgttccaaaagggaaaatgatggcacaaagaagttgctggttcacagcaattctgatagttgtctagacaaatgtcagaagttccttgactaggacttctacttctgcccaggagttcttctctgtgactctggaatccaccctgttagtcatcctttcttttccattaaaagtagttcatatttgtagctgcatagctttcttagcttgcttcttgccagtagaaatttcagggcccagagaccggttttcattttgtactatttttccacctttcagtttaagctggcagtgtttctttttaaaacttcgagtatcctgtgaatctcactgggattcatgccattaggcaaaagccacatccaccaatctcttctaaataggctttttccaccttgggtttctgctgggattgctgagagataccacttgtaatgggtagaattgtgtcccccaaaaagctgtgttcaagtcctaaccctgataaggtcaccgtgaatatgaccttatttggaaatagggtcattacagatgtagtcaagttatagtaagatcacactggatcaggaagggccctaatccaacggttgatagtcttataaggagagaaatttggctgggtgcggtggcttactcctgtaatctcagcactttgggaggccaaggtgggaggatcacctgaggtcagaagttcgagaccagcctggccaatgtggtaaaaccccgtgtctactaaaaatacaaaaattagccaggcgtggtggcccatgcctgtaatcccagctactcaggaggccgaggcgtgagaattgcttaaacctggaggcagaggttgcagtgagctgagatcgcaccactgcactctggcctgggcgagagtgagactctgcctcaaaaaaaaaaaaaaaaaaaaaaaaaagaagctagaaatttggacatgaacacatgaacacagaagacagaagaaagccatgtgatgacagaggcagaggttgtggggggcatacatctacaaatcaaggaatggcaaagattgctgtcaaacatcaccagaagccagagagaatcatggaattgatctccctcagaacttcctgaaggaactaaccctactgacacccacatcagtgaacgaataaattccttttgttttaagctacccagtttgtggtagtttgttatagcagccctaggaaactaacataacacccttaagcttcttagtccgattttctaattgaatgattctttaggtaccattctagatctttgtgaggttgtgttttttttgtttttttttttgagacagtctcagtctgtcacccaggctggagtgcagtggtgcaatctcggctcagtgcaacgtccgtgtcctgggttcaagtgattctcatgtttcagcctcccgagcagctggcattacaggtgtgtgccaccatgcccggctaatttttgtatttttagtagagacaggtttctccatcttggccaggctggtctcaaattcctggcctcaagtgatcctcctgccttgacctcccaaagtgctgggattataggcgtgagctaccgtgcctggccctttctgaggtcttaacaaagaagtgttatagtctgatccttggcttcatctgaaatcagtcttttggcagtgccttggattcgatctttgcttgaaatctcttaattttagtgtcatttactaatctggagatgctgggaattctcagaattatataattctgtcctttttgtttaactgttcttcctttaattcatccctcttttgcattttaaagtaagcagcaagaagccaggaggtactttcaaaagtgaaatcactttagctagattatcaaccagtttttggaccacaacatctactttccatgttatggtaaggccacagctttgccattatataacaaggatccttttccctccagtttctaatcagattttttctgccttttcttaatctctcacctttaacttcctcaaaggccatagtgcttctgtttttttttaaggctcttcaaacttcactgatgctctcctcaaagtccttttaacttctgccccactgctgggttccaaagatactctcaagttttgggtctttattgtggcggcaccggtatccagatatcgaaatctgtatattatctattgccatataacaaattatctcagagcttagtggcttaaaacaacaaatatttattatctcacagattcactgggtcaggaacaggttcagttgggagtagcatggctgagtggttctggcccaggatttcatgagcttatagtcaagatgttggccattgctgcagtataggattgactaggctttacacatattctggcaggtttgttctggctgttggcagtactcagttcctcatcacatggacctttctataggactgcttgatatggcactctcccagagcaagtgattgatccgacagaagtacaaggagaaagcactgccccccgccccccacctttttttttttgaggcaaagtctctgtcacccaggctggagtgtaatggcacaatcttggctcactgcaacctcctcctcctgggttcaagtgattctcctgccttatcctcctgagtagctgagactataggcacgtgccactaatgcctggttaatttttgtatttttagtagagatggggtcatgttggccaggctggtctcgaactcctgacctcaagtgatccacccacctcagcctcccaaagttctgggattataggcaagagccaccacacccggccatttcccccacttttttttaccttgtcttggaagtcacagattatcaattctgccatattctattgttaagtgagtcactaagtccagcccacactgaagggaagattatcaaataatttttggacatatttttaaaacaacacgaagcattctaaaaaaaagaaaacacaatgaattcatagaagcagagaatagaatggtagttactaggagctgtggggcagagggggtggattagagagatgttgaaggatacaaaattttagttaaaagttcaagagatctgttgtacaacgtgggtgacagtagttaataacaatgttttcagccaggtggggtggctcatgcctataatcccagcactttgggaggccaaggcgggcggattacttgacagcccggccaacatggtgaaaccccatctctactaaaaatacaaaaattagccaggcgtggtggtgtgcatctgtaatcccagctacttgggaggctgaagcacaagaattgcttgaacctgggatatagaggttgcagtgagctgagatggtgcctctgcactccatcctaggtgacagagcaagacttcatctcaaaaaaagaaaaaaaaaaacaaccagtgttttgtacatctgaaaattgctgagagagtagattttaagggttattgttgcaaataagtttgtgaggtaatgcatatgttgatagtttgatgtagtcattccacaatgcatacatatttcaaaatatgttatataccataatatatgcaatttttgtcagttaaaaataaataatgaaaaataatacaaaaaagcaagcaaacaaacggaatagtgtagttagctgctgttgaactttagtagcagggaaagtctaatgttggctattgccattgttatattaattggcctaataagtaaagtgggaaccagggacttaaaattgcatatcattgctgggcgtggtggctcacacctgtaatcccagcactttgggaggctgaggtcaggaggtcaagatcagctttgtcaacatggtgaaaccccatctctactaaatctactaagtatacaaaaaattagccgggtgtggtggcaggtgcctataatcccagctactcgggaggctaaggcaggagaattgcctgaacctgggaggcagaggttgcagtgagccgagatcgctccactgcactccagcctgggcggcagagcgagactctgtctcaaaaaagaaaaaaaattgcatatcatccagaacacagaagatccagtgaaacaatttcttcaggtttttcttttgctgaggcatcactccagtatctctttgggtaacaaagactcattcgtgtaaagaactgtgtacctgtgccatcttaagtattcagagtgacaaatgctaagcatgtgtgtgtttatatgtgtttgtgttataatcatctgaaacaaccttaacatagaattattgcttaaacttttttttaaaggactctttaaatgatatcttattcagaaacccaatgtgtacaacatacaaaaatggaactacccttgttaaagggaggtgggtccagagttccactggctcggcatcccttttaacccttccttatgttgatgtcagatattcagggaacatagtttgaaaaactataccataccatcagatccctttccagcttaattcacaaaaatctattaatctgtaagatagcagagctcaggaagatagccataatagcaaaatagcacaccgctgtgtggcaggctgatttctgatgctgtctcttgtgtactagccaatgaaaagccattttggtttagggaattagttggtgattaggcagccatggatatctgtagagtacttttcattagtctgttgtcttatctaattttttcttctgtaacagaatactacaacacatctttgcaggattctttgcaaattctgccattcctggatctccacaccctttttcctggtaagtaactaattgttttctatcttactctattggagtgacatattttaggtgctgtcatttctgtgcagtagagaaaaagagctgcataggccgggtgcggtggctcatgcctctaatcccagcactttgggaggccgaggctggcggatcacgaggtcaggagatcgaggccatcctggctaacatggtgaaaccccgtctctactaaaaatataaaaaattagccaggcgtggtggcatgcttctgtagtcccagctactcggaggctgaggcaggagaatcacttgaacccgggaggtggaggttgcagtgagccgagatcgcgccactgtactccagcttgggcgacagaaagagaccctgtctcaaaaaaaaaaaaaaaaaaaaaaaaaaaaaaaaaagagctgcataggtgagtatgtagatgtaactggaggctgctacactgccattatctgctaagcccaaacttaatcagaacttttttttttattattattcaggctcaggaaggccgtcctggtcccccaggatgtttgggtgctagaaatgtcttgattccttttatattcaggtctgagagttgtattgaggtagagaatgagatggtccctgccaggcttggtatctgatttgtgggtttccccagtagactacacaggaatattttactccttaagaatttctgaaattgaaaacattatgctgaacttcatttttttcaaagtaagaggatttgtcagaagaaacaataggctgtaattcagtatcagagtgacacttatgtatgatgggattaaagatggaatttcttcttgtctgagaaattatttgctgcttctaactgtggcccagaaggtttctttgctcaaaggaacctcagtccttttaggacctctgtcatccagtagtctggacctctgctggtagtgtaccagcagctctgagggaaaataaaaaaaaacggtgttgccaagtcccttttataattgctctaagttgtgattcagagagactgctatggctgcttctctacttgaaagctcctcattgtccagaactgtgggcggcctcttataatgagggatgtttgctgtagattttgaccagtcatgaagggaaaactctccttaaaaagcagctccatctgtgtttaatatcagtgggcacagaaaacacaaatttttgaaaccaacaggcaatgagtcactctttttgttctggcgtgtcatgtggtactttaggtagcttcacattttatgttctagttaagtaaaattcttagagaatgaggtactatctctggatagtctgtttgatcttgaaaatgtacagaattctttgcctcttgatcctggaggactagtgactttccagctctgagagagaacaggatccctctgccaatttttttctgtggtgtaaggcagagcctggtcactccatctaatgctgtctatctcatctcacgtataggagcgggatgctgcactccaaccctggggactatgcctggggtcagacagggcttgatgccattgtaacccaggtgaggagctgccttttgagggtgtctgttcagtgtgtctcatggttccacaggcttcctgctttccttctgctactttctgaaatggcagtcactctgctttctctaatattttgagctttggggtttccattttactaaagggatgaatgatttatggggttagctcagcatccatgcacttcctaggtctgagggaatttctagaagatggtttcacctccataggaagaaaagacttctataacaaatagtattttgtatttttgtctctcttgctcagttctataaggattctattaacaaatatttcacaaaaaaaggagggtttcctcacatgttgaagcagggatttctgctagatggagcaaagtaggggaaggaagcagagaaaaaagtattcccatgccatgtataattgcttccacttgtttatgttcattttaatttgattggtttttcatttccgttgtggatttctgagactagaaagcatgtcctttatattcagtcgtcttataggcagtaatttacctatttcttggctcacgttatgctacttttcatactctcgcttttttcttcttccagaagatgaagcttttggaccagttacattttactttttattaagctatagttttactcgtgacaccacaacccttttgctgcctctgaagttgctttatgcctagaggtgggccttgcaatcatgggtttgtctgtaggcttatacgaacgtcactctgaaattgtaaagcaattatgagtgttctggcagcaggaaaggggaaacccaagcctctcagagccttgcagaagtaagagtaactaacatacctaatgtctgcactgtttgttctcagctggagcagttccctctccagggatattgcgatgtctgccacttcgtctttttctttctctttttttgtagcttttaggacaactggaaaacacaggccctcccccagctgacaaggaaaagatcacatctcttccaacagtgacagtaactcaggaacaagttggtaggttcatttttatacttattctgtcatcttctgatctcggttcaaaatcccggtatcttctgacaggtgaaaagtttaaaaagtgaacaaaataaaaagacaaaaaaataagaaaaaaaatcccaataccttcctatattaaggacctttaagtgaagctatagccctctaaaattcctatctgggtgccaaatctggaaagttcctacccctttattaggttagtcagttggtatttcctgagcaattatgtctcttttttaggtgccattgggaataaagaggtacaaagatagataagaattgattgtaacaagttgaagaaaaactgatcaaatgattaaaaactgtgttggacacatgatactgacattggggaaaggagaagaaaaaaataggctgggagtttgtttcaaatctactttgtgtcaggtacagttaggtatcttagtcatagatactattttatttgtaagcactggaggaatttagtgacaagggacagcattttggtctgggagtttctgttcccatcagttcgggtttagagttagagattttaaagacaaggtgggccatcttaggtcattctatttaaggaaaagtatgaactaatatacgtggtgtgtgagtcaggtaaagtggtctttagggaagattagtctaggggcagtgtgtgaaacattggaagtgagagagagcagaaacagggattttagagtgttgcagcagtccagatgaggttcagttgatggtgacaatgctaacagaaaggaaaggattcagaagatcattttggagaaatgctttcctcactcattgcataatgggatgaagaaggggaaagagtcaaagagaattctgagatttcacagctttgtaactataaacatggtgctgccatcttaagggacagggaaatagtgaatggaccctggtttgggtaaggagatgaggtgatgttttacattttttaatttgttgatttttgaggtgccagctgagaatccaagtgaagaggagctggggattgctgtggagctggtttgagggaaaactaagttgtagcaaagtataggatatatttggagggttaagaccgtggaatttgggatactagctgggaggctgttgcagcagactaggcatgagaagtaaaagaattagggctaaggtgataggaatggagagtaaggagtgaatctattaagtagtagtactgctccaaatgccttatctgctgttagttcatggagcatatcccagccactaggcgtatagactagctgacagtattagccaaatttgggaaactcaaaacttgctgcttggagctcccagtatagttcatgactgtttcttctcagagaagagggctttctgtctcttgatttcgtgacctgagctagacttcgactttgcagttctgcagcaccacttctggtatagcttttctggtatggcttctggtattttcttcttttctggtatagcttttattaataatttttttttttttttgagacagagtcttgctctgtcatccaggctggagtgcagtggcgcaatcttggctctctgcaacctccgcctcccgggttcaagcaattctctgcctcagcctcctgagtaggtgggtttacaggcgctcaccatcacacccagctaatctttgtatttttagtagagacagggtttttaccatcttggccaggctggtcttgaactcctgacctcgtgatccacccgccttcaccctcattaacagtttttacagaggactttaggacagccacactgaaataggatgcttcatcccatgctgaaaagagcatggtgaaagtggcaagtggcttgagacgctgcactgataagattgctgagatgaatcccttggctatggtggacagattcacagtagcaactgactgccagagggctgtcacacattgggaagatgtttttcctgttttactgagcagatcatctaagccccagtttatttcttccaactctttacatcaaaaaataggccttatatagttcctatataggcctttttggagtaggccccattcatcattccttcttttcatgtctctgtctactaccacctttaccctcattttgaaatacaagtcatgcctcttagctgcctgctacttgggtgtacattttcttttgtctcttgtgtcttttctttatgcattcgtagggttggtagagacattgggttagttttttcttctttccttttgcctgtttactttaaaaggcatttccttcttcaacagatatgggtttagagtgtccagtatgcaaagaagattacacagttgaagaggaagtccggcagttaccttgcaatcacttctttcacagcagttgtattgtgccgtggctagaactggtgagtacagcaagtcatggcttctttgggggatgattcagagtaaaggtatagttaacagttcctcgagatccaagtagatcagattttatcccataaatccctggcttactctgatactgttatttgtttggaacttttctgaccaagggttgcaaactatgttctacaggtcattgtgtcctgccacctgttattgtaaataaaattttattggaacacagctatgttcatttggttatagattgtggctacttttgtgctacgtcagcagagttgattagttgtaacagctgtggtgtggcctgcaaagcctaaaatacttattttctgtcccttatgtatttgttttgagacagagtctcactctgtcacccagactggagtgcagtggcgtgatctcagctcactgaaacctctacctcctggtttcaagtgattcttgtgtctcagtctccagagtagctaggattacaggcgtgcaccaccatgcccagccaatttttgtgtttttagtagagacagggtttcgccatgctgatctcaaactcctgacctcaggtgatccacctgcctcggcctcccaaagtattgggatcacaggtgtgagccactgcactcggccaattttcctgtccctttaaacaaaaagtttgctgacctctgctctagaccatattgggaagtaatgggcagttaccctcctgtcatagatcactcactgtttctggttcgttctgtttggtggtatgtattagctgttattaacttgctggcctagaattattcctgtcagttctgcttaaagttctgtttgggagatatcctggtatcacaccttagagccagtgcatgctctatgaggatgcattctctattgtttttctgttccatgtcataatttttgatgtgacaattctcagggttatttaagtgtacaatactcccagcttctcaggccaggatcttcacatagactaatatttttctgtttcagcatgacacatgtcctgtatgtaggaagagcttaaatggtgaggactctactcggcaaagccagagcactgaggcctctgcaagcaacagatttagcaatgacagtcagctacatgaccgatggactttctgaagctaaagaccacacctgaatcagggctgtggtaatcatcttaccatagctgtaaattgtatcaaaacaaaaaattagtagatggatttaggaatatgtaagaaactcaacacataatataaatgcaatgaatgtttttcttctttaaatttaaagttagtatctacagatggaattgtatctacaaccaaatgcctcttatccctgaattcagagtgataattttataagtgtgaaacttaattatgtagggctccccccgtctgaatagaattaattccttaaagtctagttagggtcctgctgtctgtcatgttgccttgtaacggatgtttccacctccttctccaacctctaccccaccattagtgtattttactataaaaacagtggaaccacagccctaaagtcctgctgatataaagtccttttgtcttaattgtatttaaaaaaaaaaaaaaactactcttgatcacattagctatgaggcgaggtcaaattcaggtatctaagactaatgattttgttttgtcttgatccccagagagcaaatcaa

SEQ ID NO: 470 - DNA, 18426 bp, Homo sapiens
ttggatctcttcattcatttattcatccatttctctaataaacatcagtagaacccattaaatttcagacactgctgagaaacagaggacatagagatgaataaaacacagttcctcccctggagaaactcacaaccaagtagcaaggatagacatatctataaataatgacagccattaaataagggctacatccaaatatatacaagtttatgtgtaagcaaggaaggttggtcacgttgacctgagttatgggtgaggggtgataggtgggaggtgggggctgccaggcagacaccaggggaaggctcaccaggcagaggggaatggagagagagagagaaatgaaacaagaaccagcccattgtctcacctggctgaggagttgggtttccaagggagaggaaggtaaggagagaagaaatctggactcagactcagagggctgtgaatgtccagctatgaggtttggaggcccttggaggatgttggcaggagagggcatgatcatcccaacctgaaaaaggaggcacaggactgtgtggcaggggaggagggcaaaaggtgttgagccaagctggatggttaggacaggagagacctgacaggggagggaaagcagtctcagaaggacctggggcttctctcagtgtttgaaatgaggccaggtgctgatgatgttgtacaaagcctgcccaggagacaaggttcgggccacatcactgtggcccaccagcaggtagttgggagtcaggtaccctttgaccatggcacactggatcaggtcttgggctgcctctagtgctgcagcattgggtggtatacctgcaaaacacagcagcccattgtctacaggattacagggcaccctgcaaaatagaacatatccccagaacccaccctcatcaccaagctaatagattccactgttggcagcctccctagagacaggcaaaaaaaacaaggtcaagacttcagatttcttagtgccaaagttttcctgaatcaaaagagccaagcctgggataataaattcttctgaggatatacaaagcttttatccactgcaaaagtttagcctggtagttctttataagggtgcaatttagccccccaaaggacatttggcagtgtcatgagatatttttggttgtgaaaactgggatgcaggggaatactagtcggtagaagccaaggatactgctaaacatcctaggacgggacagcctctgacaacaatgaattatctgagccaaaatatcaattgtactgaggttgagaaacttgatttaatcacaatgtactgcctgtaccctttcatgtctagctcaatgctcagcccagtatcaagtcacagtcctggttcaccccatcccccgacccaatgcccattttagtatgggccatgtcactgaatcagccccagtgacatgacctcatcttttcagaggtttggtgaaaggcccttgagtctaaacaaactgattaagaactttgagttgttctcactttggtaggacatacattaaaattggaatgatacagagaagattagtgtggcccctgaagtaggatgacatgcaaattcgtgaagcattccatatttgtatggagaaataaagtgtttcctaaaggagcaaatgctaagggaatttgtcaccactaggctggtcctataagaaatgctcaaagaagttctacagatggaaactaaagggcaatacacactatcataaaaacatatgaaagtacaaaactcacaggacttataaagcaattactcaatcgagactgcaaagcaactgggtaaccattaacattatgacaggaataaatcctcacatatcaatattcaccttaaacgaaaatgaactaaaggcttcacttaaaaaatataggctgactaatgaataaaaacacaaaatccaactgtatgctgcttacaagaaaccccctaactggtaaataaatttacagactcaaaatcaagggtagagaaagatatttcatgtaaatggaaaccaaaaaggaggaggagttgctacactatatcaagtaaaacagactttaagtcaaaacagttaaaaaaaaagataaggaagttcattatgtaatgataaaaggatcaattcaataagaagctataacaatcctaaatatatatgcacccaactcatatatatataatgcaacattaattcaagatggattaaaaactgaaatttaagatctcattaccagagcacccacattcataaaacaaatactgctagacctaagaaaagagatgaatggcaatataataatagtggagagcttcaacaccccactgacagcactggacagatcatcaaggcagaaaatcaacaaagaaactctagacttaaattggactctagatcaaatagacctagcagacatttacagaactttctagtcaacaatgttagaatatatattcatctcttctgcacacagaacagtctcaaaaatagaccatatgctaggccacaaagcaagcctcaataaattttttaaaaattaaaatcatatcaagtatcttgttggaccacagtggaagaaaactagaaatcaataccaagagtaactctcaaaactatacaaatacatggaaattaaacaacctgctcctgaatggtcattgggtcgatgataaaattaaggccaaaattaaagattttttgaaataaatgaaaatagagacacaacataccaaagcctctgggatacaacaaaaaacagtgataagatggaatgttacagcatcaaatgcctctatcagaaagatagaaaggtctcaaattaacaacctatgtcacaactcaagaaaatagaaaatctagaacaaaaaaaacccaaaactagcagaagaaataataaagatcacagcagaactaaatggtattgtgtagaacttctttgagcatttggtctctatatgagaccaaaaaaaaagaaatagaaaggatcaatgaaacaaaaagttggttatttgaaaagataaacagaacagaactcacagaccactagctagattaaccaagaaaaaaagagataatattagaacacccacaatcagaaataataaaggttgcattacagttgataccacagaaataacaaaagattgtcagagattactatgagcatctctatgcatataaactaaaaaacctagaggaaatggataaattcctggaaacatacaacatcccaagactgaaccaggaagaaatagaaatcattaatagaccaataacaaataattaaattgaatcagtaattaaaaaaagattctcccaacaacaaaaagcccaggaccagatggattcacagccgaattctaccagatgtaaaaggaagaataccaaccctactaaaattgttcccaaaaactgaggaggagggaatcctccccaactcatctacaaagccactcttataccaacgccaggtaaggacacaacaacaacaaccaaaactacaggccaatagccctgattaatatcgatgcaaaagttcacaacaaaaatctagcgaactaaatccaacaacatatcaaaaagttaattcccacaatcaagtgggctttattcctgggaagcagagatggttcaacatatgcaaataaataaatgtgattcaccacataagcagaattaaaacaaaaactatataatagttttgatgcagaaaaagcattcaattaaatccaacattacttcatgataaaaactctcaacaaactaggcatcaaaagaacatacctcagaataaaaaatccgtatatgacaaaatcacaatcaacatcatactgaatggtaagaagttgaaaacattccccctaagaactagaaaaagacaaagatgcccactttcaccactcctattcaacacagtattgaagaaaacaatcatgcaagagagagaaataaaaggcacccaaattggaaaagaggaagtcaaatcatctctgttcactgatgatataatcttatacctacaaaaccctcaagactccttcaaaagactcctatatttaataaataatttcagtagtttcaagatacaaaatcaatgtacaaaaatcagtagcatttctatacaccaataacaatcagctaagaaccaaatcaagaactcaattccatatacaatagctacatatagatagatatagatagataaatacacctgttatatataggtgtgtatatgtttgtatgtatatatatgtattcctagtgtgtatatatatgtattcctgatatatatatatgtattcctagtatgtgtatgtgtgtgtataaatatatatatatttatttatatatatttatatatatatacaccaaggaggtgaaagatctctacaagaagaactacaaaacactgatgaaaaaaattgtagatgacacaaacaaatgagaagacatcccatgctcatggatttgaaggatcagtgtcattaaagtgaccatactgcctaaagcaatctacagattcaacgcagttcctatcaaattacaaacatcatttttcacagaatttgaaaaaactattctataattcatatggaactaagaaagaacccaaatagccaaagcaattctaagtaaaaagaataaagctggaggtatcatattacctgacttcaaattatactacaagactatagtaaccaaattagcatcgtactggtataaaaacagatacatagatcaatggaacacaatagagaacccagaagtaaagccacatagctacacacaactgatctttgacaaagttgacgaaaacatacaccagggaaaggacaccctattgaataaatggtgctgagaaagttggatagtcacatgcagaagaatgaaactagacccactgcatataaacattaactcaagatggattaaagacttaaatttaagatctcaaactataaaaatcttagaagaaaacccagggaaaaactcttctggacatgggcctaggcaaagcatttatgactaagtcctcaaaagcaaatgcaacaaaaacaaaaaagacaaatgggacttaattaaactaaaatatttcttcacagcaaaagaaataatcaacagagtaaacagacaacctacagaatggagaaaatgtttgcaaactatgcatctgacaaagagctaatacccggaatctacaaggaactcaaacaacttttaaggaaaaaagtcagctcattaaaaagtgagcaaaggatgtagacagacatttttcaaaagaagacatgctagcagccaaaaaccatgaaaaaatgctcaacattactaatcatcagagaaatgcaaattaaaatcacaatgagatagcatcttacaccagtcagattgacagagactgagaccatcctagccaacatggtgaaaccctgtctctactaaaaattaaaaaattagctgggtgtggtggcatgcacctgtagtcctagctactcgggaggctgaggcaggagaattgcttgaacccgggtggcggaggttgcagtgagccgaggtcacaccactgcactccagcctggcgacagagcaagactctgtctaaataaataaataaataaataaataaataagtcaaaaaataacagatgttgctgaggatgcagagaaaagggaatgcttacacactattgatgagaatgtaaattagtacaacctctatggagatttatcaaagagctaaaaataaaatagccatttgattcagcaatccaaatagtatcaacccaaagaaaaagaaatcattatatcaaaaagacatttgcactcatatgtttatctcaacactattcataatagcaaaggcgttgaatcacttcaatgtccatcaatggatgactgaataaagaaaaggtagggtgcgtgcgtgtgtgtgtgtgtgtgtgtgtgtgtacaccatagaatactattcagccatcaaaaaatgaaatcgtggcatggtggctcactttgggaggccgagacgggaggatcatgaggtcaggagttcgagacaagtctggccaacatgatgaaagcctgtctctactaaaaatgcaaaaattagccaggtgtggtggcatatgcctgtagtcctagctactcgggaggttgaggccagagaatcgcttgaacccaggaggcggaggtttcagtaagccaaaactgcacattgtgttccagcctgggtgacagagcgagactccatctcaaaaaaaaaaaaaaaaaaaaaaacaaagaaagaaaagaaaagaaatcatgtcttttacagcaacataagtggaaatggaggccatattcctaagtgaaatgactcaaaaacagaaaatgaaaaactacatgttctcacttataagtgaaagctaaacaatgggtacatattggcacacagagtacaataatagacatcagagacttcaaaaggtgggaaggtgagagcaggattagggataagacgttatttaatgggtaccatgtacactactcaggtgatgggtacactgaaagcccagacttcaccactgtgtagtatatccatgtaacacaatagatttgtagcccctaaatctataaaaatgaaaaaaaaagtaaaatagagctctgagccatgacaattctcagtgtgcactctcagtgcaaagactggggctcactgtggctttggcatataaggaaaagtgtctctacattgttgtcatggtaaccaagagaagatgcatctgctgaccaagatgagctaaaaataagcacaaagatcttttccccttactttgcatgttccttacatattggaagaaagagacatttggctgggtgtaaaggagggtagatatagggtgagcattatgtctgggggtcacctctggtcacactcagctgagtcaaatgttggattggaagctgggtcaatcaagcatatgcaggcactaaaatgacgcttgagactgagactttgtcttccatgtcagatgctctctttcaaataccatgcaatgaccctactgaccaaagcatccacttacctgtgaaggtgcccatgaaggtaatgcccagggcaatgtcatcgtagccaggggtggaggagccttggacattccagcccaccccttcataaatggcgccatcctggcccaccaggaagctagaggaccacaaggggagatggagaccagcatgaaattctggaattgtttctctctttcatgtattaatttattcatgtctttactacttcagactttgattatctattggattctaagcactgggttacagaaacaagacagagtccttgccaatggagtgctggtaaactagctcagggggaatgagggaggcagggtagggagagggaatcccaatttacagcatatgctgatttctgtggtgtaaacctctcactatagcagatttcaggtgaccaacaatttaacaaccagctctcaaaattccagaatctctaacaatcagctctcatgagctggcacaagcccattcggctccagcacaccactgcggcccccaggtagctcacagtcaatgaagataaaagagaatgacagctttcaatccctaggccttttctccttctcaccaagaaaacggtttcccccaaggtgacccaggatctccttaccattaaatacaaagtaaacttccccagtctttcctgacttgatctctctgtacatttgactctgccacacctcttgacttctccaaacactctcttcccttagcttccatcacaccacactctcttggctttcttctccagctgctctccctccacacctcatcttcctgcaccctttccttaaatgtgaggttcctcaggatgctatcctcagctctcttctccccatactccacacaggactaacccatccacttccttggcttcagttgctatccatgaaagtccgcacgttcacaactggacccatcttcttcgtcacctgttcccctttctgggatccccatcttggtgaaaggcatggtcacccacccacccattggccccagccaggaatacaggcatcagcccacccacttcatccactcgttaacccaggcttgtcaatgatgtctcccaactacactccctgatctgccctgcaccctggtcattaaccattaacctccactgacctctgaaattcttccacttatctctgtaacctctgctaccatcacagggatgtcaccactcagtcctgcctggattgctgcacagtcctcagatctcacggcctccagttccaccctttcccatccagtccattcctaaagggtagccagactggtctttctaaaatacaaatcttactatgtcaaaaccctgttttcagtccctcagcactgagtgcacacaccccagcttaagttacaaaatccttctgacatggactgtgtctgcctccccagcatcagctctaccacactcctctttgacatctatatttatcccaatgaacttctctcagctccccacaggcgcctctctcaggctggaattcagtcctttccacagaggccatttccctcttcctgaatcactcttcctgcttcctcctcccactcaactgtaaggcctcagctaatctgatgttcccacagggattgcttccttcacgcctattttcctggcatcctaaacctcccgtctaccctccatgtgtcccctataataatgtttaacctaccctactagaacttatttgtttgaattacttttcttcctcactaaagcattggctccatgcaggcaagaaccatatctgtgaggcacatccgatggcatccccagagtagccttgtgccacgcagagtacacattcaattacatgttcagtgaattgtaatctatgaaggagggagtgtgtcatcctgactacagaccacctcaatgaaagaaaatgacacagtcataatgctataatagaagaggatacagtacaaggtccaagtcaagggacaggcaactaccctctgagacctgaatggaaaaagggaaagggcctcccctcagcctccaccactttccagtttaggctttccaaatttacagtccattttcaggtatccactcttattaaagacagcaacgctgcaagtaatcctgtatggcaggacctagcaaagcacttggtaggttctgatacgtcataggtgttggagggaaggttttctcctatcttgaaaagggtgctactaaaatggggacagagagcaaggggccagagaggggagagacagtcagcccagaatcgtgtaccaagcaatggtaaattcatcgctaagccataaatggccctagagttaaaggttccttctatgaatgtgcatgaatatgccaaatggtctaccagtagctttttctgagatttaaaatttagtgtgaattttcctgatgggatgttacatggggtctaacgccggatgtcttatctgcaaactctgaaagcatccttcaagaaatttctacttgttttgtggactattcattttgtgtgtttgtgtagcagtttttaaaatcaatactttttaatggaaacatcttgatcaaaaatgtgtcacagaattttgagaccctttaagataatgcttaatggggaaaaaaaaaagaaatgtttactcttccacttaggtctgtgtcttccttattaaagaatcacagaccttagcattagagaaatcaaaagatagtatttggtctctcccccgccttcagacaggaaggatatccttcccaaggaagttggtggtttctagaagcagagaagcagcacgggtctaccatgagggggaaccacttcaggttgtggccaaagtgagcagcagagccccagcctctgagtaggaggcggtggttacacaaacaaagcacaatctttcgattatcttttctacaggtgtcacaatcttgcatgcgtactgcttcctccagtgactttttggcagagttgtagcatccgtcatgccagtgtactacctttagtaggtacacatcttgagaacatgtttgggcaaatgactacccccttggctatctcctaagaaagacccaggcagggtcgtgtgatgaattcatttggttatccatacagtgcctctcctatggtgactacccagtaaatattagttccctttccccttcctttcaaaggctcagtttctgcccccaagggaaaagaagcccagtgtacccagacccactcacttataaccaatgtcgcatgacttgagcctgtctatgtagaaagactggatgtcccggaccagcaggcggcactcatcagaaatgttgcaggtcctcccggcagtgtggataatgatgccatacttcgctgggagagtcatcctgggacagtgggtctccctggctccccacacagaccgtgggacaacgccggggcaagctgaggtggggcgagaaaccacagagggttcatcttccccatctatgccagccacttctccaccgtaggctgatataatgctcaggaccctcaacttcccaaacccctctgggtctcccaccctgcccccaaccaccctgcccccaacagtgggacttgagagcagacagtgtcccgcagtgggacatggacattttattctaagaatatgtatttgagtcatttgtaatccatgaaactctctgtcaatgtaagcgatcatttatgttaacagatggcaccagagatcaaatttactcaaggctttaatataatagagatgaatcttctttcaatcttgattaagcccaagaaaaggctgaaagtgcttattaaatttactgtttttgatgttgctgcttgttaaacccaaaatggtatccaccttttattatctgaattatgttgagctctttctttaaagtctgtgtaagtggtggtctaagttttctgcagcacttcagtctattcgtgttgttttggtttttgtattcagaaatgtgtgtttgtgtgtgttcatgtgtaaacatatgagtgtataaatatgtgtataaatgtgtccagtccctttccattgtttcctcccttgcacttttctccatataacatcccaatatgtcacttatttatttgcttattgtctttctctgccctctagactgaaacttcatgaggccagggacttttgcttttcattcctgagtatattttcagggtctagaaggtgttcagtaattgcttgttgagtgatggaagaaaggagtgtgcatatatgacaccagggataatgctatggctctttcatatgaggaatctgagggacaaagaggtggcctggaggtttcctctcaagatttgccagccccaagagttcagagagttgggtggccagttgccttccagaaggaatctaatgggccctactgaaaaggtcactcccaatggtatttgcgagttagttggggtgagcccagtggcaggcccagtagggctgaagaaaggtcttacccttcttcaggcttgtcttctgccgaggggccaggcagttctcgcctttcccaagaagtggctgaacataactggatgacaggtggcccttctggacagcataggtgattaggttttccatggccgacagggcagcagggctgggactgtggcctagaagagagaaatctgtgggaaacctccacccagcctgagtttcaggggatcttttggggaaggagaagatgctctgccagcccctgcacagctgatggagaggaagaaaagggaacaggttatgcccccagttggagaggctgagaattaaggatcttcctggaaagatctctcagtggctcaaaatgaagtcctttctcatcccaaatacctgccaaacttcacctcctctctccatgaaagagctcagaagcagcaccaagcccagcagcacccgccaggccaggccagggtttcccatcagaaggggcccctccaggcatgtgtcaggctctttgcctacaataactcatttaatcagcagcacaaacctctgagagatgctattattaactgcattatttgtgaagaggaacttgaggctctgagaagtaatgtgctcaagatcccaagctaacgacaaatggaaatgagtagtcatgaaaacaaaagcaaaaacaagataaacacagagtcctctggagtgctggggaaaccacccaggagctggagataaaagatatggaccatgttctgattcctctccttctagctgtgtcacttggggtcatcgacctctctgaaacccagactgcacctctgcacaacaggggtcatgaaatctacctggactctctcaaaaggtactggaaggggaaaatgagaaactaggtatgtaagatctctgttaacgggaaagggtacacaaattcaaaggaatggtcctggagtacatatgttaagatgcatgtggcaaggggccttggagcaacagtccagaaagaagtagaagagagtcagagattaggggacccagagtggtttttttttagaaatatatagaaaatctaggagtaagagatgaaaggaagaggtgcctggcaggaacttggaaagcatggcccacagccacagaatggtcagagctcaagaggaagatgtgttagtcattgacatagaggagagagctgaagcccagataagcttgcagagagatgactggtcagcatctccacataaaagatggctagagaaagaggagcctgtttacaggggttgagaaggaagccagggcagtaggaagagacccttcacaaagtcatttcctggaaatcaaggaagaagaaaattccaagagagagtgggtcttcagagaagtatgagaaggataagacagcagagtagcagatagctagttcccatgaagtggcccctgagacaaaggattagagaactctttggagaaggtcagctgtgataactgttacctttcttagtgccaaagaaggcaaagcccagggagatgttgttgtagccttgggtgtgcactccttggatattccagccaacaccttcatacaccctgccatcatccccaaccaggaagctatggagcaagataatacaggtttcatggctggcactgtaggacattcctgagaggtgaaaccacttacccagcctcaaaatggagaaggactgaagctatgttcactaaaaggaatttgcatgaactcttcccagacattgaaaagagcaagtcatttatactagtccttagaattcagaaggacccactctcacactccctacccccttcccttttcagaggctgcagttttaccataaatcattctacatgctcaggagaagaggtcctagaggttccatggtaactgaccacacaatggaaggctcttctgtcttccacgcttccttaaaccgggctctcctacctcctccaaagtgtgtgctgcctgtgtgatccacgcagagctgttcatttgatttctccctgtcacgtaactgtcctacatagacttcccaagaaatagctcctgagacagggacgaggatgcaggcacttcatctgcaaagagatctaacagagcaggagcaccatcatctcagacaaacaccaccactttaaattccagctccctttctagcctcatgtatttcaaggaaatcacttctcttctaaaaaacaagcagccagaaagagcagacagtaaaacacagataagacagctcaggcgcagagaggggtgggaggaaagtcccttgagtaactgccaaacttcaccctcatacaattggccccagtaaaacagtgggccttaataagcacattcctttcccttcaggtgcactaagataaggaagctaaaagcagactggggggcggtggggatatgcctgcagctgcagaaagatgtatgggaacagacacacaactgtccctcccagataagcacgacaaagacacagaagcagtccaagcctctgataaactctcccaccctgaaaccttaaaaactcttagtctgtaagagagtaggctctgacctaacttggccaaaagcctctctcagttttgttttttctaaaataaaccagtcctcgactgtcgagccacctttcatggttctttcctctttaattcttacaggatcccagaagccagggtgaggagagtgagacagaaggaagaaagccagcaaagtatgtgaaattgggctggctcacagtggctacctgtgactccaccccaccctgtggccttcccaggagctgtgtacatgcgctttagaactgcctctcataagggctggggttgaggaggctacacaccaagccctgtcccccaggaaggcattcactcccttttgtcgtcaggggctgggggaaggtctgaagcaggaaagcagagagatgtgttgggcacttgaggcaggaagccatcactgcactcaggaactgtccacagctagccaaagtcagaggtgagccaagggcatgtggtatgggcaccagtacgacctactagagcgatcattacaggaacagatggacatttgcctcactgaggctggagcccatgtgtgtggtgtggaggagcacgccagggatgaagagagccagtttaggctccatgggtccatagatatgtgacctcaaattaatcagcctccctcccttgggcccctcttcccagggcaaagagatggtgacacctgcctaccagtcgggagagctaaagccctcatgtatgaggaagtcgtttgcaatctgtagtgtgctgtgcaagccagggttgggggagggtagagaatacagttattacttaaccttccttgcttcctcctgggagctctcagagacaggcacctcacagaaaaatccaaaggattgggagtttcatgggggttttaaatattttattcattataaaacatataggaccacaacccagaaaatgaggaaaagggatgagaagggacaggagaagcatcccagggaagcaacactgaccatgtgccgtgggacccagacccagctcttacttgtaggccacatcacacccactgttgttgtggacatgatgggcctgcagttcccgcagtctctggctgcagactgtctggtcgtgacactccagtccagggacatggtgtataacaaggacattcactggcgtggtcagctgaatactgcagccaacagcttctgccccccatgccttgcgagagaccgtggtggagacatctgtgggaaggccttggggacgtcactcagcgcacctgccccatcactaccgcattagcccgccaagctgaacatgcaggcatgggctgtgtcggccccttggtagtggaagagccttcagcaggcaggtgcacctgccctgcccacctctacatacccatctctccaacactcaccccgaacacagactctgcacctggccagggagcctaatgctttgctcccccatcccataatgtcccctactcatctcctcccctgctgtggtccaggctctgcacttcaggaagcatcacctgcttatccctggggaaagccctgagcagcctggcttggtgtcacctcagcattcaatgtgtgctctctgatcatttcctctgcggttctgagtgttccctgaggggactgcatcttctccccccagcaggggctatgtctccccctcagtctgaggacttcctgagggcaaggtttgggtctccctccacagggagtccctgtctgcagaggctgtttcccctcttcctgggtttctagccctccagcaccagccttccatcccaaggacctgggtaattaatgcaggtggtttactggtactgctctctgcacttcaaccccattttccccctcccagtcacatgtggctttgcagacctcagaaacatttccgatcacatgaaaaaccccagctcgtcccaaaacccccttactatccagatccagtttacctttttcagtgagctgggagatgttctcaaataggtactggagcccctctgatacctgtttagcttgtgttttgttccaggaggaatcacctgcaaaggaatatcccattttgcatcagagagcaccaataccagccatcatggtggcaccagctctgaacagaaacagccatcccctctccactgcccctctgcctcctcaaatcccagagcctcctctaagaaatctctctgggctgaccagagggccacctctaatagcagcaggtggcataacttccttccatgccaactctgggaaatcccctgggataggcaaggagttggaaatgttatccttttctcatgagctgtatctacacacacaattggcggggaaaaaaaaaaaactagaaatgtattcagacacttcaaaaccacaaagtcctctcttgtgtgcattttaccgaagcaatggggaagcgtgtgtgaagaaggggttagaattacctgcacggctcagaccagttcccccgggattgattttagggacgtgtgctatgcccattctcctgtctgaaggcccatgggggatgggcagggtgttgattgagacccttacccacaaggagctttctcttattgacaagcacaaacccaagccataggctggactctgattgacatcataataacacaaatgtaatccttgctcctgtttatttgcttttactgcccacgtattgctatatcttcaggtgcattatctcatttaatcctcacagtgagtttaggaagtcataactatctcaattttcagatgggaaaataagggtttatagagcttaattgcttgtttaaaatcattcctagaggcagagcgaggacttgaatccaggtctataggctccaagttctgtgctctatgtacaatctattctttctccttaagagagagtaggttttgggggattttttcgttttgttttgttttttgtttgtttgtttgtttgagacggactctcactctgtcaccaggctggagtgcagtggctcaatctcggctcactacaacctctgcctcccgggttcaagcagttctctcatgcctccctcccgagtagttgggactacaggagcgcgccagatggagtttcaccatgttggccaggatggtctcgatctcttgacctccttatctgcatgcctcggcttcccaaagtgctgggattagaggcgtgagcaactgcgcccggccaagagagaatgggtttgtttttgtttgtttgttggtttgtttgttttttgagacaagttctcgctctgtcacccaggttggagtgcagtggcacgatctcatctcactacaacctccatctcctggcttcaagcaattctcctacctcagcctccctcctgagtagctggaactagaggcatgtgccaccacacccagctaatttttgtatttttagtagagacgtggtttcaccatgttggccaggatggtctcgatctcttaacctcgtgatctgcccacctaggcctcccaaagtgctgggattacaagcataagccaccacccctggccaagagagagtagttttttttgttgttgtttgtttgtttttgagacaagttcttcctctgtcactcaggctggagtgcagtggtgggatctcggctcactgcagccttgaactcctcaggctcagatggacagtaggtattttttaattcctattatgagactttaggatcacccttctcggttgctttttggcccagggaaagaaaacttaccccaggcctggatacccagagcagagaagacaagaagccacggcagcatccccacgtggtcccaggacaccaatctggagagtgtggatggcagcctgagagagacgctgacagttgttaacatgaccattctcaatctgcagagcatcccaaaccctgactgcagtgggtgccatctgcctcctctaccatcctgtggcctcctgagggccagcacctgcttcagtcttctcagggcccccagcatacagcaggtgctcagcatccctgtcctattattacccgaggaactcaatttcatcacgtgcccacggcgtgcaaggctgtgtacacacttgcacatgcagtcttatttaattagtcctcacactaatcctgtcatgtaagactgttaacccccatttttacagacaaaggaagtaagatccaagaatggtacaaccgagaaatccagactcatatggatgggtcttatgcagagaatcccttcccagctgggaatatgccagatgagggagatataggagtaggaggggttcctagttctagggcagaggaaatccaatccttaacactctttctggtggattccagtccctttgctggaagagggcttctgaagaagaaacacatactcaactcacagatatctgtgggtcctgt

SEQ ID NO: 471 - DNA, 3174 bp, Homo sapiens
aaacactctgtgtggctcctcggctttggtaagtgagctgccagcttccccaggcagaagcctgcctgccgattccttctttccttccctgacccaacttccttccaaatcctcctcctagaagccctccttggttggccctgcctactttaaagcttctttcacattttcttaggtcatgttcccctggggcctcctgccctcaaatgctttgctttttggcactctgtagatattctaaaaaatcattttgtacatgtgtgtgacaggccatctcccagttaagttgcagcctgtgctttctttttattttgcacttcccccactatttctgtgagtgcttagtaggaagtgtcaaagaagcttgacagcattttcttctaagtgtcccaactcttggttttccattacacagacagagtgcaagacgatgacttgcaaaatgtcgcagctggaacgcaacatagagaccatcatcaacaccttccaccaatactctgtgaagctggggcacccagacaccctgaaccagggggaattcaaagagctggtgcgaaaagatctgcaaaattttctcaaggtagggctggactctggcaggtctgacccagcctcaccgcagtttgggttgacaagggaggatgggagtatgggctacagcaatcaaggggaagatttgagctcctggagcccagccccaagacgcagcgagtgtcctgttatacagggcaggtgctcacagttacacaggacgacagggtcaagaaattgctcaattgaacacctgctatttgtcgggccctgttctgggcagagggatgtagtggtaaatggggagcccactattccagtggagggagacacacagtaaagttgttggccaataaagagcacagataaagccaaatgccaataagtgcctggaagaaaatgagatagagtgcgctgtgggcaatggggctgggtggggtggaggtgaccagttagggtacatgagaagggcctctttgaggaggtaacatttgagctgagccccgaatgttggggagggaagcccctgaggatgacacttggcacaaagctgaggagaccctaagcctcaggcgggaacttggggtggaagacttgggggcttttctaatcctaagggtctgcggtggaaaatgaatgcataaagagcacatggagagcacctgcacagcactcagggaactgggaggtttttcccccgctccaaaaatgattaggcagttctaagaaaaaggctgagcacttccaacagcctttttgttttcttttcaaatttggggaaagtcgggaaacagaggcctgcattaagaagggtggaacacatgggtctcagtctcagttccagtcccggagccagacatcctggggtaggtccccagccctcccagtgcccctccctccgccttggtaaggtggagaattgcagccttcagagttaggggccctgacagctctccataggtggaggcctcaggcaggcaggatgctgggtggggtaggcaagaaagggcccagcagagaggccgcatggcaaaactatcctccatgtgaccccctatgcccgcttcaccccccacctgacatcccccaccagaagcaaagcgatgctgtgggaaaggaagcagagcctcatggatgggctgcacaggagagtgctcgcattggctgggtaccccacaggttctgggaggggacttagcgaggtgactcagccagagggtggcagagctggaaccaaccagtgctctcttggaccccgcctgggtctgggtcttccacctcccctgatgtctctcctttttttttttttttttttttttttgagacagagtttcgctcttattgcccaggctggagtgcaacggcacaatctcggctcaccacaacctccacctcctgggttcaagcgattctcctgcttcagcctccagaatagctgggattacaggcatgcaccaccatgcctggctaattttgttattttttgtagagacaaggtttctccatgttggtcaggctggtctcgaactcttgaccttaggtgatctgcctgcctcggcctcccaaagtgctgggattacaagcatgagccaccctgtccgaccatctccccttttatactttatcacacccttgaggtcagcggagcacatactctgctctctgaccctccatctcccctgcccacacctagtttttctaggtgtttccccgttgtattggttgaaataagtttcactaattggtaacctccagagggaagggaagggagggcaggggaaggagtgaagtgcagaggggtagcagagtggaactggcctctaagtcagatctgaatttgcatgccctcaatagtcaagctgtgaaaactaatgaccctctctaggactggtttcaagtcttcctccaggaagataccattcctagctgttaaagttgttataaggaccaaatgaggtgacatttccaggcttactcatgccatgaccagggcaagaccctggaactcagcttcctcttctataaatagagaatcagcacccaagtcacagggtcatggagggaataaactggagagcgtttggtatgtgctcagtgtctgctccattgtgcgcactcagcctatggtcatttttaatttttaaatccagccccagggtgaggcttcccttgtacatttgccagctggtcatttactgtgctcccagtccccacctctggccacacccagctctcacagccttctctccccacccgcagaaggagaataagaatgaaaaggtcatagaacacatcatggaggacctggacacaaatgcagacaagcagctgagcttcgaggagttcatcatgctgatggcgaggctaacctgggcctcccacgagaagatgcacgagggtgacgagggccctggccaccaccataagccaggcctcggggagggcaccccctaagaccacagtggccaagatcacagtggccacggccacggccacagtcatggtggccacggccacagccactaatcaggaggccaggccaccctgcctctacccaaccagggccccggggcctgttatgtcaaactgtcttggctgtggggctaggggctggggccaaataaagtctcttcctccaagtca

SEQ ID NO: 472 - DNA, 1892 bp, Homo sapiens
aacttttcgtgagtgtgtttattaactcttactccccacgggcaaggctgggttttggtgagggaaagaaaagaccctcattgaggacattgctgggtaaaaagccttcagagagctacctactctttgtgggtgtggtaatgggcagccttcagcgcaatggctaccagggatatgaattcttgaaagtcgacctgttcatcttgattagcatccaggccttggaatatttcatcaatgacagctttatctttgatattctaggaaaaaaggacaacagagaccttgagttcagaacctccacacaagaccctttcttaggcctcttatccctcagagctcgggttgtgaaggcccaggcacattaactcattagccaacactgtgttggagaatccagtgtaacaaaacagagaacacaatggtcatgaaccaccctggaattaacaaggcttgacctggaaggtactcttctgctcactcattcaacccctcccgtgccctgcctctctccattttacatatgaggaaacagactcagagagaggaactgagtagagccttaagtgagttattgagagagggaagcaaaggacctctcccacagcagcggggagagcatcctttgggagctcaaactggggccaaccccaccccagtccttgtcccaccatcctctgccaggccttgccactcccctcagtgcagggtcatgggcaagtttgcagtgagaggggcatcacctaccttgatggtgtttgcaagctcctttgtaagcagctgcttcagctcacccttagagagggtgtcaaaatgccccttccgaactgagtattggtggaagatattgacaattccctccagatgctcttcaagttttgtcatcttcccagcctaatgttaaccttcaaggaaacaagggaagtctagaggcagtttctcccccacccctcaacctccactctcccctctctttctgaatcaagggcctaaagaaaacataacatcctccatatctattttgtggtctctgctctgtttgatccatggtgaacttctcatgtgtggataggatggggaggagaaaacatataatactgtctaacgtctaaaaaaatcagcctcagttgcccatgttccataccacctcatccaccggggtgcataacttggagggtattgcttactcaaggtcccttgggaagggttctgtgattggccaggctgtttgctttcctcaggtgatggcactatggccacatatcccccacaaatggtccataacccacccctgcttagccattctttttttgttgttgttgttttgggttttttgtttgtttgtttgtttgtttttgagacggagtctcactctgccgcccaggctggagtgcagtagggcgatctcggctcactgcaagttctgcctcccgggttcacgccattctcctgccccagcctcccgagtagctgggactacaggcacccgccaccacgcccggctaattttttgtatttttttagtagagacggggtttcaccatgttagccaggatggtctcgatctcctcacctcatgatccgcccgcctcggcctcccaaagtgctgggattacaggcgtgagccaccgtacccggcctgcttagccattcttaaatcatgggactgagtctacatagcacaacaagagctgatctacttgggtccaaaatgcaatatcaccccagaggtgctcaggcaagtggagggttgtggtttccaacaccttgtgatttcaaagtggtcacctgcagtcactaccctgtggaccacctaagaacccatccaaggaaaatgcacttacccctcaatgcacaggaatgtggagctacagcaaaaagccagcagtggt

SEQ ID NO: 473 - DNA, 1157 bp, Homo sapiens
tgaggtattgatgactttattattctgcaggtacatgtccaggggcccagcctctgggcccagtaactcagctactctttgtggctttcttcatggctttttttgtgggctgccacgcccatctttatcaccagaatgaggaactcctggaagttaactgcaccatcagtgttgatatccaactctttgaaccagacgtctgcaccctttttctgtcaagattgaggaggaagaagccagagtttaaagatctcagagagagccgaggcatagccatctatgaagggtggcagggaggaccgctggcccagggcagccccaggaccaggcagagagcccccgccacacccagcccctcctcaccctgatatactgaggacactcggtctctagcaatttcttcaggtcatccctgtagacggcatggaaattcccctttatcagggagtacttgtggtagacgtcgatgatagagttcaaggctttctccagctcggtcaacatgatgcccacggacttgccccacctgaaaaacagaaccttctggggaatcccatggcagggaatttgcatctggccagggcagtacgcagaggattcatgccccaagcgatggccttgtcctggcctgcactctccaaataaccaaaccagcagatggctatggctctggtgggaagggtgggatgatagggatacacgtgtgggaaggggaagggtccattcacacagagacatgtgcacacacacggggcccgtagactttccttaccaccccaccctctgctcaagaaaagtccagcctaggagacaatgtgcccttacccactggaaggtgctggaggatactctccttccttatccctgcctcactccccacctccaggagtatctttgctccagacctccctgagctttctctctcctctctcaggaaggctgctccacttccctgaccctccccaagagaagcccaaagtgcggggccaacccagacagtcccacttaccaggtcttctgaaagacagctgacaagagacatgcagggctgagaggcagctcctttttatagcggttaggcttggccagctgcccacagcttcaggccatcagagacagcttctccctgccagagttgctacagtctctggtttctc

SEQ ID NO: 474 - DNA, 6702 bp, Homo sapiens
atctcactcatccttctactcgtgacacttcccagttctggtaagtctcacctgcctctttgcattttctagaagtgcccagtgcccagcctgccatgctgcctgtaggaagggaaagggctgtggacaaagtctcagaagcctgggtctaggccagctctgccattagctgggctgtgtgaccttcacttgaccccaaaagcccacgtctgtacaaccaggtggctgaaccagacctgtccattgctcctttgggatctcctgagacaactcctgtggaaatgtccccagtgggacctgagcacaggaccctccctttccttcctgtcttcttcctccctggattcattctccttttgggatcccagttgctgaatcccctccccagctctgcccccacagagggaggagggataaggatcccctgtgaatgctttggaggctctccaaacccccaggccttggacctgtaaattctcagtcaatctctgggcacagggcttggcctctggccttggccttggcctcagattcagaaagctttgagtggcttctcttagtcagttgctggcacggagctttctcctgcgttgagaggtgttgggggtttattgtcagatgcccacatgcgttagccaaggtccttttctggttctttggaaagtgtagaaatgagagctgcactgtcttatttttcaggcttggggtgcagggcagcccaggctggctactggctggaagatctgctttggaaagtcagacatttttatttaaacagggtcaacccttggtgattcagagggtgcagatatttcccaagagcagacatgaagcgactcccacctcactcccaccccatccagcagcttaagaaccagggagttatttctgttccttgtaacagaggcaattcttgtttctcattcccaagggaatgtaggaagggccccctgtcctcgggagagggctgtgtttcctgctcacactcatgtccacgctcacatgtgcacctggagcctgcacgcactgtgtcatgcagggcttgcacttgagtcaaggtggggcccacggtgtctggttcctgaagcagccgaggagggtcagacaccagatcaccaaggccattgtcctgcccccgtgactctcaccccgactgtgaagctggaggagatggatttggtgctgtttcaagagtggggtccgccatgtgctggttgaggctggggggtcccagcttagttcttctatgtgttgctggcctccgactctccctgcttctccttctctgaagcactgtccacagctggacttctgccatccacctgcatctcttcttggccctggccaggatgggccgggtctcagacttggtcctaccctctcatttttgaacaacttatcccatcacatttaaaaaaatcaagttccttctgctccatcttagggctgtttttactctgtcctcagccctccttctaacacccccacatagagaccttaattcaaactaaggtaagaaatgattgtctttatttcctgaaggctttttgaaagcaaagatgagcaacactcaagctgagaggtccataataggcatgatcgacatgtttcacaaatacaccggacgtgatggcaagattgagaagccaagcctgctgacgatgatgaaggagaacttccccaatttcctcagtgcctgtgtgagttggggtctagcttctcaatgttggttggaccctggcatggctgaggatacattttgctatgtggccttggacaggtcaccctcatcctctgattaaaaagtttcccatttgcaaatagggctttattgcttggatcatatgtgaatctaaggatggtaggcgaaaaagtatgaaaatgggaaagagttatacagatataaaggaggttattagatggtcagcaaagtgtgcagcttgaggacagtgcacagtcccctcccagcgctcactgaccctctctctgtgagactgaaactcacatgctcaggtcctgcttcccaaaggccccacatcaacatccctgagattactgggaaagcactagaagttccattgctagtagaaatcaatagccctctttgcaataaagaaaactcattggcaaatctgaaaaaacctgtgggctactaggtaccaaagggtctagatgaccaagagtagggaacccagaagatgagtttggtggaaaaggagaagaaaggagaggaggtcagagaaagaagagaacaaagcatgagggccaattttgaggccctggggtagaactaaggtaggcagtgcccttaaatgctgggaacaggcaagattgaggctggggcaggggactgctctccccaaggtcacttaacagagtgcctcgggacaggacctgcctcccatcctgaggtgtgagacaaaaagtctccttagagaactccagggataacactcacgtcctcaccccaacttcacccactcaccctgtgctctcagccccacgaccatgcctgtgcagatctaggtacttgtctgtatctctgcctcctcctctcccctcccagcccaaaacttgtttgtgattgaatttttctattttgtatgtttttctcttcacaggacaaaaagggcatacattacctcgccactgtctttgagaaaaaggacaagaatgaggataagaagattgatttttctgagtttctgtccttgctgggagacatagccgcagactaccacaagcagagccatggagcggcgccctgttctgggggaagccagtgatccagccccaccaaggggcctccagagaccccaggaacaataagtgtctcctcccaccagacacttgccttatttcttcttctctttggtgacctacattgtcaaaactaccaattccaggttaactttgttggagaatttcccccacccccatccagtgggtcacccaggagtaatgtccctccagcaacgttccccctatggcctccagcagagctgatctgcctctcacacaggtcctggtgtctgcctctgcaccgttccctaaatgcagccaccttggcaggttccaggtggaagttggtagaaggcccctgccaggtcacagcaatgctctccttgtcaaggcatggaccagggtcattcagacacattcagatactgcactgagaaggagctggcatctctcagtgtgctcctgccctcccactcctgccccagctgttctccagggcttggggaaacagaaaccactcacatagggattcctggatggcttcaggttcagcgcccttggggctatgaatgggaggctcagcagtgccctgaggatgggcttccttgtcctgtggcctctgctccaggggcagtgtcctttccctgtgctgtgtgcttgtgtgcatgtgcctatgtgggtgaccctgtggaagtgagaaggagtcactgtgatgcttagctgtcctaaatgatggtttgctcaatgccaggactgggtttctggtgatgaatgaatattccagattttgaggagctctaagtggtccaggagtccaagtaagcagtctggctggaataaggcagcatcacggaaattctgtaaggactgacacagagagctcatgctgactgtgatgagaaattgcagcacctctatctcgcaggtaatggagtagtttgttattggtagtctactccaggccaggcagtgtgttatgggctgaggatgcagaaacaggcaggacacagtgctgtcctagcagtgcactggcgggtctctccatgcaggccacaacacagggtcagtgttcacctggtgtcacttccaggcaatgttctgtgcagccgctcttagtattcttccttgaggctcacatcatgtgtccctatcactcttactactctggtcagtctccagctaacctctcaatcaggcaaacattcttcttggaggaatcaggcaaacatctcaaaaattctctttccatcctaccagcagcagtgtgtaagatgggctatttgttctttggaatgactgctccactccacactcacacctctattcacagaccagcatctcctctccttatcaggaacattccttcctgaacatattctgcacctcgtcagccttcaggactgatctgccattttcacctctaaatccccatgtctgaccattagttttcttctctttccttctctccctttctcattctcattccacctgttcttggaactcacggagacctacagtccctgggctttcattttctcctcccagccccctgctgccttctctatgcagcctgccctccatcatccaccccagaattgctctctttcctctcttagctctgttgcccactttccttgggccataccttccctgcagatctccagcccagaaccatcttcccctgttgtcctcctctctcctccaccgggactgctggtcactgcttagaaccgtcatgccagggtcccaaaagtgtgggtgcctgacttcctctctgtgcagcactctctgaatccctcctattcaccttgctgctgttattccccgaatgcgcaacataccccccatcaatatatctcagtatttcatgtctcaataccaatcttttaaactactgcctctaccagaaatgtcttttaatacttcttctgtctcattaacattacatttcaaggctgagctttaatgtcagtgtctcttagacattcagagggtgaaccaccatcccttcaccccaaagaaatgatctctgcttcatttgtgcctccctcaccatgaccccactcttaccatagtggctacattacttcagattcccctaatgtctttccagccagacttggaatcatggagggaaaacattgttacctcggatctcctggttacccagcacatagtagtactggattccagctcataataagtactctatatcatttttcaatataaaatgtatttgtgcaaattctagtcaatactactttatgtaaacagcagtgtaaaatccaaaaacttccagtcctggaggcaggttgtgcagcttaggggaggaccccagaatctggaccccagagtctggaagcaggccagaaaggataaggcaaatgactgaacagttccctcaggactcacgtactgatctcccaaaagaagagagggtctccctggggtggggttgctggaccttcaatccatcgctacagtccagaaggcaattggccactcctaatgtgggcctgccctccctttatttttccagttcttatttcacctgataatattccgtccaattggcaatggcacataaaaattaggatggagtgtgtggacaaatacttcttcatcttcttgtctaggttttagaaatcaccttctcaagggagccttgtctaatgttcctgagactatttcacactctccatgcttatgtcaatgcaggactcatcacatctattcggatattctgtttacacacccatgtcatcccagagaggtgatcacagggcagggacacatgtgtggcatacagttcctagttaagatcccaaatcctgagatattgctgatttgctatggcaggtcgtcaagagaactgtgtcattccaaactcaccaaggtggcttatagaacagaagcagatggatatgaagaggagaggggaccagaccatctccgcaaccacagcccagagctccagtcaccagatagaaaattgatttgatttcatccaatattccttcgaaagagtgtcaaggaatagggtggggcaatgtgtcattctgcattggaaggaggacattttagagcaaggcctaagggcacaggtattagtgtcatattgatcagaattcaacctttgttctaacacatactagagcaagaatttacttgatttggaataattaatagctactggacattatattggtactaaagagaaagaatacttgacagctctatgcccacactcacattacagctgatgtgaaagagattctggaaatccaaatgttccccagaaattctgatatcaaaacattccaataacttttttttttcaggcgcagtctcactctgtcgcccgggctggagtgctgtgagctgtccgtggtgctgaattcactgtgacgtcactcctgtctctctttgctttcttctgactgacatttattcagccttctctacaggaatctcttatgttcccccacatgcaggtggtttttcagtaggctcctgaagagtgatctcaactttccaggaagaaaagagggcaaagggaacaatgtgaaaagaagcagaaaatcataaaagaccatgtgtttgataaacaaccagattgtttctggttccctgccactataaaaacaccatgagagcatactcatacatgttcccttataaatctgcgaggtagtttctttggtattcttgcccaggaaatgggttgattcatcacagattttatatatatacttttttttaactaagtgtgagataatatcttattgtttttgtaacttgcattttacaagagttctgaccagcaccagataagcttcagtgctctcctttctttggccttaatattattggattaaagaattactgcctctcactaggagcatcatttatttaccattattttcaatttcatattaaaactcaatttctagtagagtc

SEQ ID NO: 475 - DNA, 3033 bp, Homo sapiens
tcttgtgggagtagatgctttattgtccatgggggtctccagaggcccctgggtagggtgggatcactggcttcccccggaacagggtgccactccatgcattatcttgtggtggtctatggttatatcccccagcaaggaaagaaactcagaataattaaccttcttatccttattatcatcttttttctcaagggcattggacaagtaatccatgtcgcttttttcctgcatggagagaaacacgcaagaaagaaaaatgatatttgaattggaaaaagaggaaagaggtatcctgtggtgtgaacatgacaagtgggtaagtgggacaggagtgggtggaagagagagagcagcattgctgggttgttcctgaggagttctccattgagtgactccatgaggaaaacacagagattggtgtcaggctccgccaggaaccacactggtaaggagtgaggggccttcattggccacagacccacagacccacccacctacccacctgtacaggcgctgtctcctttctccccaggggcccagcacaggctgaccgccttccttctcttacatgttgactcttctcccattccatttctttcccattcaaactgttaagtgccaggttccctttctttaggacccagtgctctattctctcttgttatattttactaataagagtgatgcattctaacagtgaaataaaacccagtatatgaataagctctgccaaatataaagggtggtgctcatgttatcaatattctgatttccattgagttccatcttgacaagcctccacttgaacctagaggagtgactctcacagagggacaaggttacgttgggcagaagaaacaaatggccagagcgtgtgtgtaacctctccaggtaacgtggcagggggcccagtggcaggacaggagcccagcatgtctgattctcagttccagtctccatctcttgaatggttagtctctccacggggctggtcctgcctaaggctgggacagatggatcagtgaggcataccaggctcagaattacccaataaaaatagtgaattcagctcccagagatgagtcctcagacatgtcacaatgcacaggacctgtccaagaatcactactccattgccccgcacaaatataaaagctctcccagccaagggcgggcagagtccccactcacacagccactgaggaagttggggaagttctccttcatcaagttcaccagacctggcatgtccatcctaccatcatctccactgtattggcgaaacatcgcgactatgtccaacatgactttctcacctagagggatattcatctttgctttcaaaaagccttcaggaaataaaaacaatgattgttttccttctctagtgaatgactgatattaagaagatgagaagggattgaggagcaaatgaggacgaggctaaggtggaccagagaaacctgtgtttctctgtgtggtgggataaattgcttccaaagaggagggtagagccatacctgggatctgggctcacacaggccggggagcaacaggagaagaggagacaagcagaagcccagctatgggccgtgcttgtgagagggagaagtagggagagatagaggccaacaacacgtggaagaactaaaccctgagcagggacccccagccacagtcagcacatggcagactccactcctcaaacagcaccaaatccatctcctccagcttcacagccagggtgagagtcacaggggcaggacaacggccttggtgatctggtgtctgaccctcctgggctgcttcaagaaccagacaccgtgggccccaccttgactcaagtgcaagccctgcatgacacggtgcatgcaggctccaggtgcacatatgagcgtggacatgagtgttagcaggaaacacagccctgtcccgaacacagggggcccttcctagaccctcacaggaatgtgaaagaggcacgggtgaccatagctagcctctgttaaaaagaacagaaataactctctggttcttaagctgctggatggggtgggaatgaggtgggggtcccttcatgtctgctcttgggaattatctgcaccctttaaatcaccaaggctggatgttatttaaataaaaagttctgatttcccaaagcagatcctccagccaatactcagtctgggctggcctgcaccccaagcctgaaaaataggacagtgcagttcccacttcccacactttccaaagaaccagaaaatgacatttgctcatgcctgtgggcatctgacaataaacccctatcacctcccaaagcaggagaaagctctgtgctggcaactcactaaaaggagccatctaaagcctttttgagtctgaggccaaggccaggggctgagccctgtgcccagagggtgactgagagtttgcaggttgtagtagggagtgagggagctttggttgctcaataccttacccaggtaggggcagatcatctcaccagggctatgctgtgtggaggtcccaggcctgggggttcagcaagcctccaaagtattcttaggggactcttagccctctgtgggggcagacttggggaagggattcagtaccccagaccccaacaggaggatgaatccaggaagaagacagggagggtcctgtgctcaggtcccactggggacatttccacaggagttgtctcaggagatcccaaaggagcaatggacaggtctggttcagccacctggttgtacagatgtgggctctcgggctcgagtgaaggtcactcagcccggctggtggcagagccgggcctagacccaggctcctgagtcatcatccacagccctctttcctcctataggagaaagtgaatggtaggccagacactgggcactgctagaaaaggcaaataggcaggtgagacttaccagagctgggaagcatcacgagaagaaggatgagtgagatgtgtgtgtttggacaaagagcagtccctttataaggctcggcctggctcttccc

SEQ ID NO: 476 - DNA, 2918 bp, Homo sapiens
tctggtgggagaagacattttattgttcctggggtctctggaggcccattggtggggctgggtcactggctgcccccggaacagggcgctgctccatggctctgcttgtggtagtctgtggctatgtctcccagcaaggacagaaactcagaaaaatcaatcttcttatcctcattcttgtcctttttctcaaagacatcggcgaggtaatttgtgccctttttgtcctgtgaagagaaaaacatacaaaatagaaaaattcaatcacaaacaagttttgggctgggagggagaggaggaggcagagatacagacaagtacctagatctgcacaggcatggtggcggggctgagagcacagggtgagtgggtgaagttggggtgaggacgtgagtgttatccctggagttctctagggagtctttttgtctcacacctcaggatgggaggcaggtcctgtcccaaggtgctctgttaagtgaccttggggagagcagtcccctgccccagcctcactctttcccgtcccagcctctaagggcactgcctaccttagttctaccccagggcctcaaaattggccctcatgcttttgttctcttctttctctggcctcctctcctttcttctccttttccaccaaactcatcttctgggtatcctactcttggtcatctagaccctttggtacctagtagcccacagttttttttcagatttgctaatgagtcttgtttattgcaaagagggctattgatttctactaacaatggaacttctagtgctttcccagtaatctcagggatgttgatgtggggcctttgggaaacaggacctgagcatgtgagtttcagtctcacagagagagggtcagtgagtgctgggaggggactgtgcactgccctcaagctgcacactttgctgaccatctaataacctcctttatatctgtataactctttcccattttcatacttttttgcctaccatccttagattcacatatgatccaagtaataaagccctatttgcaaatgggaaattttttaatcagagggtgagggtgatctgtccaaggccacatagcaaaatgtatcctccaacattgagaagctagacaccgactcacacaggcactaaggaagttggggaagttctccttcatcatcgtcagcaggcttggcttctcaatcttgtcatcacgtctggtgtatttgtgaaacatgtcgatcatgcctattatggacctctcagcttgagtgttgctcatctttgctttcaaaaagccttcaggaaataaagacaatcatttttttcccttcatttaagttagggtctctatttgggagtgctggaaggagggctgaggacagagtaaaaacacggataaggtgtagcagaacgaactcaatttttttttaatgtgatgggataagttgctcaaaaatgagagggtaggaccaagtctgagacctggcccatcctggccagggccaagaggagatgcaggtggatggcggaagtccagctgtggacagtgcttcagagagggagaagcagggagagtcgggcgccagcaacacatggaagaactaagctgggacaccccagcctcagccagcacatggcagaccccactcttaaaagagcaccaaatccatctcctccagcttcacagtcggggtgacagtcatgggggcaggacaatggccttggtgatctggtgtctgaccctcctcggctgcttcaggaaccagacaccgtgggccccaccttgactcaagtgcaagccctgcatgacacggtgtgtgcaggctccaggtgcacatgtgagcgtggacgtgagtgttagcaggaaacacagtcctgtcccgagcacagggggcccttcttgtattcccttgggaacgagaaacaggaatggcctctgttacaaggaacagaaataactctctggttcttaagctgctggacggggtgggagtgaggtgggagtcacttcatgtctgctcttgggaattatctgcaccctctgaatcaccaagccttgactgtttaaataaaaatgtctgacttcccaaagcagatctttcagccagtagtcagtctgggctggcctgcaccccaagcctgaaaaataggacagtgcagttctcacttcccacactttccaaagaaccaggaaaggaccttggctaatgcatatgggtgtctgacaataaacccccaacacctctcaatgcaggagaaagctccatgccggcaactgactaagaggagccacccagagcttttttgaatctgaggccaaggccagagggcaagccctgtgcccagagggtgactgacaatttgcaggttgtggtagggagtgacggagcgttggtttctcaataccttacccaggtaggggcaagccatctggccagggctatgctgtgtcggggtcccaggcctgggggtttggagagcctccaaagcattcacaggggacccctagccctccaccctctgtggagctggagctggggaggggatttagcaaccgggaccccaacaggaggatgaatccagggaggaagaggacagggagggtcctgtgctcaggtcccactggggacatttccacaggagttgcctcaggagatcccaaaggagcaatggacaggtctggttcagccacctggttatacagacgtgggcttttggggtcaagtgaaggtcacacagcccagctaatggcagagctggcctagacccaggcttctgagtctttgtccacagccctttcccttcctacaggcagcatggcaggccaggcactgggcacttctagaaaacgcaaagaggcaggtgagacttaccagagctgggaagcgtcacgagtagaaggatgagtgagatgtgtgtgtttggac

SEQ ID NO: 477 - DNA, 80424 bp, Homo sapiens
cagctgacagtttcatttattagtgacatcaagcaccagtccaactatatcatttccactatcctccctccatggccagaaccacagattctctctggcagaaggttggatttatacagtgaaggcatgtgacagtgacacattgtccacccagcaccatgtagggattaaatcaccatttggagcaataaaagggatgtttgttcttcccttgttctctttaccaaccgcagaaacttgaggtgatctcagcagagttcattagacccaggtatcatatgacagtaagaaaaccaagccttagatagctgcagatcctttatgtaactggagttttcaggtcatatatttataggcttttaaagcagaagacgtgagacaaccctttactgcaacccttatgtttgcagtaaaatggatcacaggaaggggaattgacagtccaagatcacaaagatagagacagaagagacagagctaggatgagaacccaggcttcttggctcttctacctctggttgggcttgattttgatagcagcatttttatttctttttttttcttcagagacaagatcttgctcagtcgctcaggcaggagtgcagtggcgcaatcatagctcactgcagcctcaacctcctgagctcaaatgatctctccacctcagcctttcaagtagttgggactacaggcatgcactatcaagaccaactaattaaaaaaattttttttaaagacaggagctctctatgttgcccaggctggtctcaaactgctgggctcaagcaattctcctgccttagcctcccaaagtgctgggattataggggtgagccaccatgccaggactgatagcatcatttctaggtggaaattactttggcttcaaatgtaaagattaaacataatcttttttgtaaatactcaaagagtatttggaatacaaatattctcttcaaagaggaagggaaagaaatctagaacattgtacgtgctcaataattgagttggttggatttttgtattatagagtaatcttgctttatgcagcttcacaaaatcagatccaattaaccttgaatttgtttcattctttattctttccaatgattcaaagatggttagaggatttaaccttaccccactgcctcattgcaaaatttgagtatagattcaaggttatgctttgctgttcattggtttgaaggccaggctttcacaggaaggcacacgatttaaagtaacttcggtttaagcttctagaggtttgtgggaatcctcttcaaaggacagacaccatcagaacttgaggttatacaggctgtccagtaagtggggaatagcacaaacccttcccgaccctattccagatacatgattaaaacagacagaaaatgatcctaattgcatattcaccatttaggcataacagttttgaatttgcttatcattgtgtttacaaattacatttttgatcaaaatcttccattgcattcacttgtcttccaaatcccatcttgacaaatcacaggtctgtcattctgtgactttaatagatccatgttctgtggtatgttcctcctgctccatggaagcccaaaggcagcacaagaagactctgctgaggactctctctttagaccctcacagaccagggtttgcagttttctgggacaccagtgacacactaggaaggaatgatagtgttctcattgccagggtctgctgatcatgctcctcccactctcttgcatacctcacctcccaccactgccaaccatcattccaaggccaagcaccactctgcaggcctagctgttgagaatgcctcagggcaggactccttaatttcctaagccattcatttattttcactgagcactttccacatggcaggcgttctattaggttttggagatatggtgacaaacaatacagatgtgatcccttttgaaactcacagtccttaaaaagttcatagaatcagctgctcatgcaaatccatggcaagaatttttaaatcgctggtatgttgtaacatagaaacggatctttgtttcaggtctggggccacagagagcttacgaaaatgactgagttctgcatcagactgttggcaaagagctcgccttgcaaactgtggcagcttattgggagccatgccacccactcctctcagggaaatgggtttgggtgattgtcagcattgggagccatagtgggaaggttctgggctgtgggtaggttgctgcacagatgtgggcatctttactgcctgggagtgccacacggtctgtgtagttctcactccatagctaaagctcttggtagacccaaggaagacctgaatggggacccatatgcctccttcacccactgtgttgaggtctgcggatggtggatttgtctgcccctggggttcctctgtgccctccccacttgggaccacatgtacccactttacctataaatccaaaaagcatatcgaattttaaaaagagaaagccccacctgagtatcaggaagaacccagtcctgctaactccacacaggttgcagttgcaaaggcaattaaagccactgtacagagcccacttcagcaccactcagaggctgggctggttctgagatccccaaagcggaagcaaccgtcctagcaaagtcttcttttgttaggcattgccaactacaagtatcacataggtgcttcttaaagtgattccaatgactacggaattcttctactactttctgccacatacacctccaaggcagtaatcaatcaccctataatggaatcatctggtttcccaaggttgcaaagtcctcaaggacatctatgtgtccccagtatcagaatggcacatgatcatcacaggacaaatgtggttgatctaattaattatttcctctttttccctccatccccccaatattcatacagtgtccttaacataaattaaaaaaaaaaatgctagcgactgactcatactaaagattaggctctctggagtttcatccatcatccttatctagatggaaaataataaaatctgtgagttatgactgtgcaccacacattcctcccatctctaaggaggcccagctacaagctatagctttaaggaggtttctcattattctcttgcaagttcgagtgtgtgcttcataccatgcacaatgaagggtggccattgatgcaaggctgcccggttaggagagagcccaacacctctcctctgtgcagaaccttccctgcagtttgccagcctatccctggcctcccctggactgagtggatgcttgaggggcatcataccagggtggtgaacttgtccacgcaggcattgcggatcttctccggggtggcagggctgtctagccggaagagttccttcacgttattacctgtgtgctgagctcgagctgcacggatggcatctttgatggcaaagaagatagaagcagccaggaagaggggcggctctccaacagcctgaacacagacagggcacagggcaggggctcaggcaggtggtcctgcctccacatcatcaagtggacctaggaggccaggcagcaaactctgcacgaggagggctggtggcaccaggaaagcactgatgggagccacaccaaatacagcaggaaggcacagtcagaaatgatcaggggctaagaacaatcaagctagtacatgactggaccgcatggacatatttctttgaacactcatgtaattttctctgatgacatcatgcacatataatgtaccatttaaagttatactcggtaattgtattttacagaccacaaaatctgacgtgagttttaaccttttcctcagtcactagccgaggggaagagtctacctgcaactctgacaccaacatttacaggcaccatagtcatattacagcatccgcaggaattataggcataagaacaaacaggaattaaaacattttctagcataggttggtttttctccccctcaaagtatagatcagagaccacctatatcagaatcactaaagatacttgctgaaaatgcatgttccagggccctaagccacacctattggagcaaaatttctaggcgtgggccccagaaaggcacatttttatcatgggcctcagtaattcccaagcatggtaaagtatgacagtcaatggcaagggtcacaatatgtcccagcttccccacccactatggtaaagtaaaccacgagatgagcaaatggatgtttctttggttaccaaggattagttgccttccttcttcaaactaggattatatgcatcagctaaatcaattttcaaccattttttcatacttactgcagataaggaagaaatagaagacacaatcctccaggcatctgaccaagtctttttttttttttttttttttttttttgagacagagtctcgctctgtcgcccaggctggggtgcaatggtccagtcacggctcactgcagcctctgcctcccaggttcaaaagattctcgtgcctaagcctcctgagtagctgggattacaggcatgtcccaccatgcccagctaattttttttatttttagtagagatggggttttgccatgttgcccaggctggtctcgaacttctgagctcaggcaatccacccacctaggcctcccaaagtgctaggattacaggcatgagccaccgcacccagcctgatcaagtcttaaggtcgagtattggcaactgaaggaggtaaaagggtgtgtacaaaggtgctatcccattggcagtgaatgtgctgattgtcattggaccatactaatgctgtacctgtaaaatcatctcttaggatcaagcaccagtgacgtacgcctgagatatgggtgtgggccaggatttaaatgagaagatttgatgaaggaatccctctaaattcacccaaagaagtgggcttcagaccatactaaggtgctctcctcaacccaatttaactggttctcaagcaggactgcccaactatcccactgcccctaccaaggtcagtgtcaaaccatcttccctcctcaagatatgccctttgaagtcccaccaggtgggtcactgaggcctctcatcacccgctggggcctcccccagggcagatcagaagagacagcacagagccagagcaatggtaccttcgatgcatagatggccttcttgttggggcagtcgcggagcagggacaccctgaactcaatggggatgctgccaaatgccgggatcttgtaggtgctagggccacgggtgtgcaggctcccctcgggggaatagtgtagctcctctagggtgaagaggccaaggccctggacaaatgccccttccacctgcaggatggatggagagcacagttagcctgccaccttcttccctgaggacagataccacttgccacaatggacacaaagcgccaactgcagcgcggcctggaatgtagctaaaactgccctctattgcttacctggctcccgcctcagccctgggataacccatccggacttctgccaggctttggctcaggcagagcaaagacattaacacggaaggtcagtgattctaggtgggcatgtttcccactacaacctgccgcagtgcagatggagatgttccttccatgttgctactggggaaatggtgagccaaagctaagaagcaagctcacaggaggatttattcgatagtagattctttgagacttacctccagcctttttgaacgcccacccctgcctgtcctctgggagaaagtgcccccactgcagttcagcttacaggtctctcctagggtaactgccatgatagacaggcccacacatctgctctctcagccccctgctcagaagcgtgacatggggcactaccatacctcaacgagcattcagaaaagaaaccgactggcaatcatctttgggtctgcagtactggcttggtgcctggccacagtaggggaccataaatggttgttcaatgaattaatgaacagattgactaatggccagattttcgtatactcagtagttgtccattttttagaagtacaatttgtattttctaccagatgctcagtcttgaattcttgattcctcctctgttttttcctatctcacctattctttattttattttatttatttttttgagactgagtcttgctctatcgcccaggctggagtacagtggtgggatcttggctccctgcaaactccacctcccaggttcaagcaattctcctacctcagcctcctgagtagctgggattacaggtgcatgccaccacacccagctaatttttgtatttttaatagagacggagtttcgccatgttgtccaagctggtctcgaactcctgatctcaggtgatctgcctgcctcggcctcccagagtgctgggattacaggtgtgagccacaggtcccagccctatttcacctattcttcatagtaatcccatattctcctaaagcgattttctctgggacctccctttactacttctgcttaagcctttgtgttttgctcccagggccttccaccactccatgtttggcagcatctgcttcctggggtacaaaagctgtcctaggtggaggaggaatgagaagacagaaaactcttctgacctcagaccccactgtctgggcattgatcccaaactcaatccccattctacgttgtgctcacactcaaattgggtgtgtgtgcatgttcacatgtgcatgccatgtttcctcatttctcatcttgtttttgagttgtgagtgcccttcccaagttgacccatattaatttgctttctgccttgagggttggttggactatcaccaatctaaattctactttgggggaaactccctaggttccatgtttcagcctgtttgaagacaaccttggacaacatgttgtggcaggtggccccaggaggggaatggggtgcatcggtggccaagtctgtcaccaccctggtcccactgagcctcacctgtccaatatcaatggcagggtttagactggagccaacatccatgacaatatctgtgcggaggttctagagtagacagcaaaattacaagaagttagaggaggaaaagatgtttggaatatgacagatgactcatagtgaccctcagactacaagtgccaaccaaagagtacgttcccaagcagaaagccctgggtgtgctcaggcagaagtgttgatgttcccaccaaatctctgctgccaccatccccgctggagtctgagtttgtagcagccgggtaggaagtggggagcagcaatgatctctcagtaactgggaataacacacattcatacgtgagtagtcagatagggtcccagaaacctggggctttgaatctgagtctgggtagatcatgtacaaaagagtcaatatactacgttccatgggctaaatccaacttgcccctgttttcgtggggcctgtaggctaataattacattattaaataactggaaaaataaaaagaagaatattttgtgacaagtaaaaattgtatgagattcaattcaaattcaaatttcagtgtctataaatcatattttattggaacagagtcacacttatctgtttacaagctgtctatgactgctgtcacacttcaatggtagagttcagtagctgaggcagagactgtatggcccacgaagtctaaaacacttactctgtggccctttataggatgtttgcctatccttaatggaaggcattatttttccaaccagaaatcttgtctctatcagctctaggtattacaactcagttgtttctcttctctttcccactaagtactaaagttttgcaaacttcttaccttatgatctcctgttaggcagtcgatttctacttcagagcaagccaccccatagctgaagtagtggaaggggttccctgagttagtctcaaagctgtagcccagattgggtgttctgggagaggaaagagaaggtactgcacatgtattaacatgaacacacccccttccctatgcacgtacagcttgacccacaacatctttaaaccccacaagtttttgcattcagctgttctccaaaaaagtccatggtttgaacaatttgaacctgttaacgaaacccagatattccagaacattttgtctctgggccctcctctattttgccagtagcccttctgtactcattctgtacagcctagcagtgtttagtaccatgctagcctctgcacagtagaaagagaggtaacagatccatctgggctcacgaaggacatgaaagtcacactccaaaggatgtactgaattagaatccaaggtcttcaggactgaaggttctgcctgtggtggctcttagactgttcacacagttctcctgcttaccttctcaaggtgagaaagttaataagatcagcatctcatgctaacctgggtgcatctttaagcggccactccccacctgctggtccctttgaaagttcaacaaatgatttgagggaaatgatacgaatagaaacaaatgctcccttatacatttttaaaattttcaatctggagtaccttatacaattccacttttgcctgagtcatataaatatatgtgtatatctatgcatttgtgcatgtgtattcacacacctagagtttacagtacactgactctgtgttattctatacactacacaggaataacatgagctgatatgaccagatctgcacaaaaacaaaaccaatatggggctgagggaaaaggcttctcccagaaaaaaccaccaccaattcctttgacctctgctttcaccatgctcctctgctttgacctttataaaaccttagtttcatgaactccagaaatgtaataggaatttatgagaaaatgtgtttatgtatgtgtaggtcagatattaaaaacctagaaagcattggcaaaacatttcttcaccatatatatatatatatatatatatatatatatatatatatatgcatgtttatacatatatatgccttatacatatatattcaatgtaatatctatacatatatatgagccacatatatgttcatatatggcatagaaatgtttttttgtgtatatatgtttatacatatatgccttatacatatatgtataatacatatatatgccttatatacttatatatatgtatataaagcatacatatatgtataaggcatatatatatgccttatataaggcatatatatattcagtgtaatatctatacatatattagccatatgtatgttcatatatatggcatagaaatgttttgtgtgtgtacatatgtttatacagatatatgtcttatacatatatgtataaggcatatatattcagtgtaatatctatacatatatattagccatatatatgttcatatatagggcatataaatgttttttgtgtgtatatatgtttatgccttatatgtataaacatatatatgcctaacatatatatgttcatatatatattcatatacatacggaaaataaatgtttcatacaaagaaatgtttatacatatatatatttatgcatctatatattcatacattcagacatgatattttaaagaaacattgaattattttccaaatatattgaaagaaaatattccaaatatctgtgaaagaaaaggtcctagctaaacttcccagagacggctaaaatatgatgactgacagtaaatatgatcatatctttttacagctgctaagtcagatgggcagggtctctagctattcacgctgctactaaatttaaagttgcagaagtcatacgctctcttgaaaatctccctgtattaataagtttccactgtattctgcattttgtaataagaccacgtgctctaaatcctcctctcattctataaaaaagtcccacacacagtacaaagaaggatgcatagctaacagcaatgcctaactcataacactacacagcctggtttctgcaggagaacactgagggaggaatggttaggtactggccccaatacgtcacccatgaggaaacaggggaacaggttcagcaggaccactgacttcctctggtgaaattgtgcaccctgagaccagaactagaagtcgggtcttctgacacacagctggtgcttttaccccttggcacacagtgtggccattccacatattttagagcatctttagactgaaattagcggaagtctgttgaagagataagtggagctgctctctcctgaccacagcctggcaggattcggtgctggagtggaccagtgaggttaggacgacatcacactatgagctgggcaaggacaacaccatacttacctataaaacccagtggcagacaagctcactgtgtccatgtaggcagctgtgacctgaggagaggagatggccatcaggcaggtgaagtgaggttttcaggaaccctgacctgccactaagctttcaggagctcacctcctctggaagccaatcaactcattttactagtgactcccatttccataccttaccttacattgtcactggcaccacctgcaccaggtcctcattatctgaagcctggaacactgtagtcacctcttaactggtcttcctcccttgagttgtctccccagcccagccagagtggccatcttaacataccacactgtgcatgtcactaccctactctagagctttccacggctccttattgcctgtagagcaaatgcctgatgttaaggaccacagtctctctggcattttgcagcacacgagggccaccccagccacactcaagagctaaatctctctcaattcttccatctcccacacctctgcacctttatttatgtggttcctcttctatatatgtgcaaatccttttcttccctcaacaactactcaaacttgccctccattctcccctccttggtgaactctccctaactggccattataaaagcaacacgctatagcgctcatgtggtacttcacatgttcaccttgtgcttttacatatgctttcctgttgatcaaactatccctccatcctatcccttggactatataatgtgcttttttggtatccccaaacactagcacagactcagatttaagttgtacttgatataatttatgccttcttcattagcagccaccaaacgatttactgtgtcacacgcgctatttagcactttgcatacattatcttacttatactcacaaccccagaaaacctatactattattagcctcattttacagatgaggaaactaaggcttggaaagacttggtcctaaaacctgcactagtcatttaacataatgtgcgtgtgcatgtgtgtgtgtgcacgcatgcttgtgtgcgtttgtgtgtgcgtgcacatgcgcatgtgtatgtatgtgttggtgactgtggttcatttattggggttatctgtttcccaggcacactggtctacatggctggtggttgaagacaaagctcagatccacaggtcagatgatagaacattgttgtcgggactgttgttaaaaacatttaaactgcctgataaatccatgctaaaacccaactaccaaaatcaggctactttcatgtgctattggtacacgtggtatggagaggtcatagaaggcatagtaagatgagtgggtctgagaaaaatggcatgttttctttaaatctattgaggaagatttctagtgagccggtttatgtgcagtcacatttgatgtgttactcttctgcccagttctaccactccaatactggggaaggatgcagagctgccattaatatttccacttgctggaggagccacagcctcccgcctgcaagagactcccttgccccttccctctgagatttctgacattcaggccactggtctagaagtcagagaattgggctcattcttatcataagtgcttgttctgtcattccccaaatcacaggaatgatagaagtccttgggtgatgttttctccccacgctgtcacagagggaatctcagtagactcagactcaagagatggagatttgaggaaaaccaggctcatctgggacaagcggggtgtgggagcagacccactgagtcaagacaatccgatgaggcatgttcagcaggcacccatcctctcaggctcaggcaaagaaaaccctgattcccacaaggctgtcaagatcctggatcaaaaacttccctcaaatgacctccctcaatgatgaaagctatagagaaagggacccagccagaatgagcatttattcatcctgtaaaatcacacaaaccacctcaacttctctctgctgttctgactaaaatattgtctcctattacttgttcggattcggaacggaggccctgctgtcaatttccctctcctttgcaaacgtgacttggatcagctcagacttacccagtcttcccaggagccactgggattcttcttcttgtagggttccagccttttcaagatggtctgacaagccgcctaaagtaaacaccccccacaccccagacacatcagtcctctgcattctgtagcccaggcaaaacccgagggccccagcaaggctacctccaagcaatgctgtacccagggtgccactcaaacagcctggccacccactccagaatgatcaaggcccagggtagaatcgacaggacctggccaatagggccaccactagtccctgcttggagagcacttcctgactcaattcttaggctgacagagggcgaaatgtttgagggatccccagagaggtgtcttcttccctcaaactgcttgtttgattatatcccccatatggcagaggagccagtgtggccaacctgcctctataatcaaatttcagcttcagcccattgtcctattgctagctccagcaccagggagtaattccagaagcctctgctttccctcggtatcctcatctccccatcctgcactcatccttcccagctttgagggcagtgattatgattcttgggcctctcttttagcttgaggtttggagaaacagcatcctcctggataagggagccagaggcctggccagagccaaagagcctgcaaggaacccttctagctcccacccagggagactctccaggcccacagctctgggctggccctctgctctgcgggatcccatgggctccttacatagacggcctgtccattgaggtcagcgctgacagaggcagccgtgggagaggtgttgggcacagtgttagtgcttgtctcgctgatataaatcttagaggtggggattttcagagctctactggccacctgcgaaaagagaagacattgccctctagggaaggggttatcatggggcttggctgccttctccccaagacaggattcacattcactgttacaggcaagaaaacaatttcgtaaactctaatctcattgtctgggatgtccttacatctggctgaatttgaaggagcacttggtggagttcggttggataaaaaattcataaactgacaaacagtgcctttttacactaacactcacttttcaaaagatccaatctggccagtctccatgcgccaagcagatgtgctgactctaatccagctcattgtcctcactccactccgaggagtcttggaatgtgggaaactcgcgacctttacacacagagcatgcccgcctcacacactgagaatgttggtaatagcaatgtcctcagaggtcacctggccaactcctttgcacagatgaggaaactgagttcaagtgggggaaaagacttgcccgaggctacacggacataagcaacagggccagggccagaccccgggcctgcttctgctctgataggtcccactgctcaatttcttataccacttcctctaacaacggacacaacactgccagagagggctgctcacctggaccattttggtatgaaggccttggcccatctcagtccccccgtgggtcagcagcacagagccatctgtgtacacatgaagtagggctcctgcctagggaaagagaaggatgccagacacaaaattcagtaaaatccaactcattaaggtttgggaccaaaggtatggagcccaggaacaagagaaccagcagcattttggatgtaaacctcagacaaaaattatggcagtatgaatctcatgatttaattatatagcacttcagtagtttgcagaaggttttcatatgtttctctctgtttctcttgttctcaaagggaaataggtcaaatatctgtcctcactctgtaagtgaagaaacagaacaagaaaaatagagtagctctctccagtccgatagttaaggaaaggtaagaactagaggttgatcccagatctctgagtctcactgcccatgacctactggacaaataggactgtgcaagttcgactttcatttaaagagcaaagagttcctccagtaagccctgttaccagtgacaacgaaatttcccttgcaatactgtaaacaacagggaaatggggtcccagtccagcggagatggacacaattctataaagcaattacctgattcagaaaaggaactgtaaagcttattccaaacttggtgggaattatgcacaatcctctctttttccaacaattctccctagagaaaaaggaatattcttatagaaccttcgctatcatattgaggacatgaatatctttggatgttcacatcaaaacaggacatccttggggttgcccacaaagatgagaacagtcagctggtgcacagcccacaccagggggtcttgtcaacactcttcttccctgagtgcaacccgtactgggtcagagtgccctggtaatcttgggctgtcatcatctccaggaggcactgtgcctcactgacaataataaagccttctctgtgctttatatttaattatctgagtaactctgtgaggaagacagagccagcccaattatgcccacttttcacatgatgaaactgaggcccagggactcccaaattcatatttatagatcagtgtcagaggcaggtgcataactgtgacgtgttagtcctaggccagtgttctttatcatacggtgtgcccaaaggtttacaaacgcgtaaagatgaaccacaactgacaggctatgacaccgattgcaggctgtgagcccacctgccccgggctgaagatcattataagatcttaaagagatggctgtgaatgagttggcaaactcagcagtctcataagttatccattgaattattagcttcctatatggggtcagcagaaaggctgtaggatatgaaacccagaagagcaactggacttctactcctagtgcttacttgttgaacttgtcaacctcactcttccgagcatgatactgagagcttgctaggcattcttcccagcatctgggcaaggtgaaaccctcaagcttctggttgaagtgtgtcaggtccccttctttgtacaggttttttctccgcaccttcccaaggagagagacacagaggccttgttggcggcaagagactgtgggggcagggcacaacctaaagttaagcttccaaccccctcagcagcccctgcctgtcatctgcccccatgggagatgcccaagatacaaagccgctgtcccccgaagtagtctaaagcactctgacttgtgctaccaaattctcagcttacctcctctgcaggcatcccacaggtcactgcaacttcactcatccagcactcggcaatgagcatcccctggggccccccaaagccccggaaggccgtgttggagggaaggttggttttgcacagccgcccagtgccccggatgttggggattttatagcagttgtccatgtggaataaagctcgttccataatctgaagcagaggaaacaaaaatgggagagaacagtgtactgattgcattggttcctcaaagtaggaactttgagggctgtatccattgcctgcctttcccctctgcacccaagttatttctcccccaggatattgcagcagcatctttttttttttttttttttttttttttgagatggagtctcgctctgtcaccaggctggagtgcagtggagcgatcttggctcactgcaaactcctactccctggttcaagcaattctcctgcctcagcctcctgagtagctgggattacaggcacgcaccacacgcccagctaatttttgtatttttagtagagatggggtttcaccatgttggcctggaaggtctcgatctcctgacctcgtgatccgcccgccttggcctcccaaagtgctgggattacaggcatgagcccagcctgcggcagcatctttactgcaccttatccacccactagtcccctcattcagcaactctgtggagaaattcattccagagcctctagttggaactaatcacttgcctctttttgaaaacagttaacttttaaaaattcattgtaaattagttaatgaaaactatgaaacagccatgaaagttgtactgcaaatagtttgaagtgtcccatacttctgtaagtcatggtatgaaaaacagtagcctcttccactttccttccttctagtctccagaagcaactacttacaattctcatagcttatcatctatcagctatttagataaacttatacgtctctagataatgtggctacattgctatgtcttgactttttcagttttagacttttaggttgtctttcttttatggaaaaggagaatttagttttggcttagccccctccctccagccctcacccctaccagcttcctatttcccagtatagttgtattttgatcagatcaacagtcaatttaatattataactctgtaaacattacttacagctgaaccatgtagttacattacaatttcttctctcttgataatatttttttcaccctggagttaataattgtctttattttttcatctgcttcattttgtatgtacttattactaagccaacttaaagttttccccaattctaaaaatctgctcctaatatattttctcttttccctcctgagctctgcttccaacatgttcaagcacatcagattttctatcctagagccatctggcctactccaatttaaattcgctgcccactagatctgctattcagctgttacctaaggatttaaatcttaaatcccccagtgggatccaaaggggtaaagggattcatcccagggattcccttcacctctctccatattgaatcccctgttcctagattccatgcctttccctttttaaattttactccctcattttgttggagtacatcctttaatatcttcataagaaagggtacacaaagaggaacatctttgacaccttgcatgtctgaaatgtctttattctactttcacctttaattaatgattcagctgtatatagaatcctaatttggaagtaggctttccagtttttctcagcaatgtgaaggcattttactagtacattctagcttcctgctattgagaagtccaatcaatgcctttccaattcttggagagttctgttttttcttcctgaaaattgtgaaatcttctctttgtcctcaggtttctaaatttcataacattataacctggcataggtctattttctttcattgtgctggttattatatgggctgttttaatcccaaagtgtatgcccatcagttttggaaaattttttgaattattgatagcttccccttctctgttttttccattctttctttctgaaatgtctatgatttggacctcttgaactgatcctcaaaatttttttgtattttctctattttttcacattgttttccatttttgggagatttgtcaagtttctttgaacccctctgctttcatagtgtcaagtcatgagagctcatttttattctttgactgctccattttagtaacattctgttccttctttaagttgtaatatctcatctctctggaaagatcaatggcagctttctttttttgttgtttgttttattttggttttggtttatttccctatgggtactctctctctcccacaagttgctttatgtgtctttgataatttcagtcttactcatcctaaatgatttttctatgtctcaattaattctacttttgctttccctagtactttatcaacttgtatttctgtttcttttatcatctacttcccctgccatattgtgaatttcttgagggcagaaacaatgtcatagccttccttatgtagccaccctaggcacttaatatatttgctggattgaattgaaaatcttgtaggatgtctagggacaaagactgtatgtttttcaacgtgattttttcccataccagaaagcatgtcttatacttgaagagaacaagaaataagaataattctttttttgaacaattttaaccctagatctgaagtgtgaagtttcctaactgagccaattaggcagcccctagcagagaggagtgtgatccaaaagggtaaaggggaatgtcggcttttcctgaaaactttaacctttttttttttttttcaaagagacaggcttttgccatgttggccaggctggtcttgaactcctgacctcaagtgatctgtctatctcggcctcccaaagtactgggattataagcatgagccaccgcacccagccacctctttttttttttttttcaaacaagaatctatacatacgtaactactatggttacaaaattaagatttaaaaaactgtaaaaagtggtaccaccaaaataaatttgttaattctcacaattgactttatttcatccaagccctctagttatttttctaaacaactcaatattccaagttcatctcccaaagctgtgaccacaataatgaggagtacgtagctcccacttctggtcttaccctggtcatttacaatgtgactggaggagcatcaactgagactaaatataaaagcacacgataattactgacacattactcaggattctatcttgtgagaaactcaacattgaagtatatacagagactttcacttccatacttccattaagtaccactaaaaactctggaattctatatatttatttaaaatcaaccacaacaacaatgtaagaatactctgaaaagtggaggaaaaaaaaaggcagtcccagtagggactttgcaacccaaggaatgacatgatggtgagttccaggggtttcctttttgcctcatctatatatcccagacttggggcaggagctggcaatccagaaatgccaatgatgacagagaccaaaaagctcactatatattccaaatccttttatctctagccaaaagaccaagaaaagggcagtctagcaaaactaaacacttttagacaataagtaccccagccaaacatcacagaaaaagaaaacgtagtctcattcctactcacacctgcaaaagctcagtaggagcccagacttccacattcatgaggctgttatgagataccccaacattcctgctgggatggtgccagaggagaccagatcgggagtcaagactttcattgctgatggccagtcataaggctgtacctacaccttatgatggagtcactggagaacacattgacttccccacccacataacaaagacacaccactcttcccttcctttctggttgtgtcagaaaaagtctagtgaagagtcaaggcttttagcacaagccagtggtaaagaggccacccacaccatgatgtccatggacaacacgtggaatgtagatctcccatctctgcccagaagtaagaaggagttgttcctaacctgggtatcaacaaaggccaagtggaagatcaagatttctacctctacctagcagtgatgaggtggcatccaccactgctagagcaaggtcagaaggagccaattaaaatagaaggcttaaatagatccaagctctcagaacatcgtcatcaccaccatcatctgtacattaatgacgggtttctccaagtttcagtgaaaaatcacttgtcataccaagtgataggaagatctcaaacttcctgaataataaaagataaccaagagatgccatcactgaggtgacaaagatgttaaaattatctgactgtagttttaatgcagccatgaaaaaaatgcctctgagatcaattgtgaacacacttgacagaaataaaaagcttctggaaataaacagatagtctcaccaaagacatagaagatacaaagaagaacctaatgggcctttcagaattgaaaaggcaacaaccaaaataaatagcttattgggtggattcaacagcagaagagaagggacatagaagagaatcagtgaactgaagaatagaataagatatattatccagtctgaactatattgagaatatggaatgaaaaaaaaattacagtttcaaggacatttgggactataacaaaagacctaacactcatgccattggagatctggaagaaaaggagaaaaagagaagagcatgaaagtactcaaagcaataataactgaaaagttcccaaggtttcaagatatgtaaacctacagattcaagatgcttggtgatcttaaaacaggataagcctgaagaaatctatggtaagtcctatcataattaaacttctgaaaactaaagacaaaggaaaaatcttgaaagcacccagagaatatgacaacttacctatagggggagcctaattagaatgacagaggatttctcatcagaagccatagagaccagaacgaagtggcagtttttcaggtgctgaaagaaacgaactgttaactcaaaacttaatgcccagtaaagtgatccttcaggaacaaggaaaaaaatcaagacattctcagatggaaaactaagaaaatgtgtccccagcagacccacaataaaataatgactaaaggaagttctaaacagaaagaaaatgataaaagaaggaagcttggaaaattagaaggaaggaaaaacactataagcaaaatcatgggtacaagcagtaagcttttcttctcagtttttaaaattgtctgatagttgaaacaaaaattaaaacactgtcttgatgtggttctaaatgaatgtaaagaaaatatttaaaataaaaataatataaatgggaaagggcagagtcataaagggaggtaagttttctatacttcaccaaaactagtaaaatgagaacttcagtaggctgtgataagttgtgtatatataacataataccttgaacaatgactaagaaagctatgtaagagatacttttaataaaaatggaatattaaaaaaaatgtccaagtaacccacccacagcaaggcacacaaaagaatacagagaaatgaaaagctgatagaacaaacagaaaacaaaaaataaagtggcagtcttatgcctcaacacatcaatcattatatgatgtataaattgtataaatacagttaaaagagattagcagaatggatttacaaacatgacccaattacatactgtcttcaagaaaatcacttcaaatataataatgtaggcaagttgaaagtaaaaggatggaaaaagatataacatgcaaacattaatcaaaagaaagcaagagtggctttattaatatgagataaagtagacttcagagcaaatacaattaccagagacagagagaaggagattacataatgataaaagtgtcaatcctcccaaaagacagcaatactaattgtgtctgccccaaataaaagagctgaaaaagatatgaagtaaagactggtagaactaaaaggagaaatagaaaactccacaattacagttggagatttcaatgctcctctctcaaaattggtagcaaaaaatagacagaaaatcaggaagggtatagaagaactcaacaccaccatcaggatctagtggatatttatagcacattatacatgtggtaggaaaaagaaatgcctccccaaagatatattcactttctaatcatggaacctgtaaatactaccttatatggcaaaatatgtgataaagttaaggatctggagagaagtagcttatcctgaaccattggagtggatcctaaatgcaatcacatgtctctgtaagagagaagtatgtctaggtagacaagaatggacacacaggagaaggtgatgggaagacaaagacagagattggactgatgcaaccacaagtcaaggagtgccaccagccaccagaaactacaaaaggtcaggaatggatccttccctagagcttccagaggatgtgcggtcctgccaacaccttgatttcagacttctggcctcagaactgtgagaaaataaatgttcgttattttaagccacccaatttgtggtgatttgttataacagccacagaaaactaatacacagccatcaacagcaaaatacacattctgcttaggtgcccgtggaacttgtatcaaaacagaccatgtcctgggccatgatatgaacctcaacatacttcaaagaattgaaatcctatagactgtgttcttcaactaaaacggaatgaaactagaaatcaatagaaagcctcaggatacaaagataactggaatatctataaacacctgaaaaccaaacagcatgcttctaaataattagggatcaaagagaaggtgtcagggaaataaacaagcagaccaaaaatacaagaaaaaaatgaaatacaacataccaaaacttatgggacctgtctaaagtagtgctgaggggaaactttacagcactaaattgaatacattaaaaaagaggaaaacattctcagatagttaatttaagctttcaactcaagaacctagaaaaagagaagcaaaataaatccaaagcaaacagagtgaacgaaataataaggataagagcagaaatcagtgaaattgaaaacaaacacaatagagaaaatcaatgaaacaaaaacccgggtctttaaaaagagcaataaaattgacaaacctctggcaagacagaaaaacaaagtgaagccacaaattaccaaatcaggattgaaacacgggctatcactacagaccctgaagacatcaaaagagaaataagaacacactatgaacgattctacacacatgaattttttaataacttagacaaaattaaattgaattcatggagataaagagtagaatgatgtttaccagaggctggggagggtagggggacagaggataaaatggggatggttaatacatataaaaatatagttagaatgagtaacatctagcatacagtagaacaatatggtgactataatatttttaaatatatgataatttatcgtatatttaaaaataaataagagtagaattgaaatgttccctaacacagaaaaatgataaattcttgaggtgatagatattgacgttaccctgatttgtttatcctgatacactgtatgcctgtatcaaaacatcatatgtatcctataaatatatacaactactatgtaccaataataatgaaaaacaaaacatttttaaatgaatgtctcaaaatacaaaactaccacttcagtatgagatagataatttgaatagtcctagaactattaaggaaatttaatcaatagtgtttttttgtttgtttctttttttttcaagtattatacttttaagctctaggacagatcaacgagacagaaagttaacaaggatatccaggaattgaactcagctctgcatcaagctgacgtaatagacatctacagaactcttcaccccaaatcaacggaatgtacattcttctcagcaccacatcacacttattccaaaattgaccacatagttggaagtaaagcactcctcagcaaatgtaaaagaacagaaattataacaaactgtctatcagaccacagtgcaatttaatcaatagttttaaggctatcagaaaagaagtctccaggtccaaacgatttcactggaaaattctaccaaacatttaaagaagaattaacaccaattctacacaatctgttctagaattagaagaggaattctaactcattttatgaagctagtgttatcctgacaccaaaccctgaccaagatggtataattttaaaagaaaaaactacagagcaatatttctcatgaatatggatccaaaaatccttaacaaattttagcaaataaaatttggcaatatattaattataccatgaccaagctggattcattccaaggacagtggttggttcagtgtttaaaaaaatcaatgaatacaatccacaatattaacaagctaaagaagaaaaaatcacatgatcatatcagtcagtgcagaaaaagcatttgacaaaattcaacacccattcattataaagatgctcagaaaacactaatggaagaaaactttcttaatctgatcatgagtatctacaaaaaacaaacaaacaaacaaaaccctaccaataacatatttaatggtgaaagactggatgtcttccccttaagaataaaaacaaaggaaggatatatgacctatagttctgcaaggtctggctagccatctcagtatgtaaagaaaaggagatgaaaacatgcagattggaaaggaagaaaaaaaccatccctatttgcagatgataatgattgtctgcagagaaaatcccaaggaatctacagaagaaatcctagaactcataaatgagttctgcaaggtcacaggatataagaaacacaaactgaaatcacaatgagctatcacttcacacccactaattctagtgggtaaagacagacaataccaagtgttactgaggatgtggaatccctaaagattgttgattggaatataaaatggtgtagtcactcaggaatataatttgatcatttcttttttaaaaaaaatcaatagaaattaggtagatccatttattttttaaatacaagaatagttttggaagggctgtttgacaaattcagcattaactgccaactctatagacatgtttaacaaaacaaaacaaaaaccaaaaaaaaaaaaacaaggcatttactcttggcccttttagtacaggcgaagtgtcctattgcatcacaagcgccagtgatgcagtaacaggtccaagggcataatatcaaagatgtttttttccaactgtgatttagttaaaaaataacataatacaaacatatattaatggctatcaagaccaccagtgatctgcagaatacctagaggcctacctacttagaaggctgaaactagtaaagcagtattaaaatcagtgtttttattcttagattcacaatgacagagtgagatttctttgattccaattttataaggtgtggtggggaattgagaggagatattggggaagactggcagtgtgccctgagttagagttgggaatgtggctcaaattaatcaatattcggattaggatattgttttagaaaattttaaatgtgtcctaaattgtggcatattgaaaaggatattaaggaacaatgattcattagccctaaacacaatttaatgagtgccatcaatgggcttaagaaataagcagggatgggggatggtgaggcaaaatgaggtgaaagagaaaatggtaagtggaaaatatgcttgagcattggagaatgtgaaaaggccaccagagaaactcctttagttatcactcagatgtgctcttcccattggctacctgctcctgatcacccaaacaccagttttagagcacaggagcagtaaccccctttatctgcaatttcactttccgtagtttgttaaccaaggaagccttggtccaaacatattatgtggaaaattccagaaataaacaatttatgttttaaatcacaagtcggccgggcaaggtggctcatgcctataatcccagcactttgggaggatgaggcgggtggatcacccgaggtcagaagttcgagaccagcctggccaacctggtgaaaccccgtctctactaaaaatgcaaaaattagctgggcgtggtggggcagggcacttgtaatcccagctacttgggaggctgaggcaggagaatcacttgaacccaggaggcggaggttgcagtgagccaagactgcaccactgcactccagcctgggtgacagagtgagactccatctcaaaacaaaaaataaataaaataaatcacaagctgtcctgagtgatgaaatctgatgatctcctgctctgtcctgtgcgggatgtgaatcttccctttgtcctgcttatccacactgtgtactacctgccccttagccgcttagtcccgccttggttgtcagattgaaaaaacatagtctataaagggttcagtactatctgaggtttcaggcacccactagggttcttggaatgtatctcctcctgcagataagggaagatgactgtataacaaggggttcagtactatctgaggtttcaggtgtccactagggttcttggaatgtatctcctgcagataaggggagatgactgtataacaaggagttcagtactatctgatgtttcaggcatccactgggagtcttggaatgtatctcttgcagataaggggagactactgtgttacatttcagcttccataaaactttactaatttggattaagaacacaagcctgatttagtaaaaagtatccataaatattcagaggtatagttttgtttcatcaagtaaaaagagcaactaattccaactgttgaagtagtaacaagtaaagacttcaccaggcttgccttgatgaagaattaagacatatttttaggtcaacagcacaagattgctgaataacttgtatgctacaaacacgctccttccactcatcgtaacagcccagcaatctttactattccaacttgctgagaaccatgtcagatgttgccttcaagaatgaaatgtttctcaaaactgttctatcaaatttagtagctattggacataaaacaggtaattatttcagactttagccagttttcatgaagtatttatctccagcttcagtttattccaacattaatttatgaaaggacagttattaaaatcagccatttctcagactgtaactttgaaatcataagaaatggacaattaagctcactagtcaaaatcttgattcaagtgatgatccaatagcttataaatgtcttcaataaactgagctttgaagcagaacaaaaaacagaaaaatctaaaacctctctatcccaagcaccaataatggaggctaagcaattatacctacaaatccttaatgacaggtctctcctaatgaaaaatcctgagatttaagcactatgacttacagaaggcaggttggcttaatgaggaaatttactttcaataaaaagacaatcagcaatattttattttggacacttagcatttcacagatcctcaatatgttttgaggtaggtcaaatattaatagtgtattttacaaacaaaactcaagcagatgctttgttacttgtcccagaccacagaagcagttctatcatggtcaggaataatacggtctctctgatctttcagattaatctttcatgtgtgaatttaatggtaattgcttgcaaatattcatgaaagaaacaaaaggctagatatagaaattctactttgggatattttaaactccttaaatttatcctataatgagtatatacttgctctcattacaaatatatatatatatataactgatctttacaattacaaatgagcacaggactgactatgttgcttttctgccttttggggtgagtagagcaggaagataatcagcaagctttcctcagagcactaggcagcctttaactgaaggtgctatgttcgaggcaccattgactatgatttgggatcacaggggagcagatgtactagtggaaccaggattcagaaaagatgtctggatccaaaaaggggaggctctctgcaagtcatagatgaagagaaaaaccataacatctcaagctactgatcctgagtgtcactctatggcattacaactacttgtgagaggagctcctacaagagcagtaagcttgtcccagtaaagcctattaaagttcttactaactagataagccacaagtaaaactaaattggtattttattaaagtgacatctatagaagcaaatatctaaacatttttaatatgagttttacctgtcatgtaaattcctcattgtcacaagcctaattcaattagctcgtcataattcctaaagtaatttactaaaattcagctcatcttgacataggttcttgagccagtattccaaactgtttcattataaagttccttttatttaaacaattgtagaatattagtaataataaagcccagctctcccagtgcctgccgggccgcctccgcccatgaaaatgcgatcatttcttaaaatgttaagctcaccacagattcagcaattctattcctaggaatttagtcaagagaaatcaaaatacatgtctacataaggctagtatgagagtgttcagagcagtattatgcataaaagcaaaaaactggaaacaacacaaatgtccatcaagtggtgaatgggaaacaacatatggtatatccctatgatggaatattattcatcaatgaacaggagtgacgtagtgatacatgctataatatagatgggccggatgcagtggttcacgcctgtaatcccagcactttgggaggctgaggagggctgattacttgaagtcaggagttcgagaccagcctcatcaacatggtgaaaccctgtctctactaaaaatacaaaaattagccaggcataggggtgcatgcctgtaatcccagctactcgggaggctgagacaggagaatcgcttgaagctggaggcagaggttgcagtgagccaagatcgtgccactgcactccagcctggcgacagagtgagactctatctcaaaagaaagaataataataaaaacatagatgaacctacaaaacattattctgagagaaagacaccaaacagaaaaaactacatagtgtatggttctataaaatgacttgactacaagacggaaagtagattaatgatgacctgggcctatggaatggtaatgggaatgactacaaatgatgcaagacatcattctggggtgatgggagttcaaacactggattgtgacagtggtctaacaactcttgaaatttactaacaaccattaaattatatacttcaaatggattaactttatggtatgtaaattatacttcaatgaaaccattttttaaaaagcaattcgaattatttaaaattaaaacatcacagaaatgtgtaacacagaaaatgacagtgtgtacgcctctcaataccattccaatcgttgttaacaatttgatcatcactgctaacagtttggtatatgttccttcagacacttttccacgcatgctatatatagtaatatatattagtattagtttatatgttactgtatatatatattactattccatgcatatgtacacacacacaatgccaccacactatacataaaacattgtaactaacttgctagcttggcaaattatcttgaacaggaaggatgggtttttaaccagagaaataatacgatcatcattgtgctatagagattaatcgaggatgggaaacctgaaggtggggacccattaggagactactgcaacagtagcaagcagggactggggaggcctgtgcctgcgtgggaacaggctgacctcgaagtcagctctgggtgcaggggcggctgcaggtcctactcacactctgagagagatcctgggtgttccccacattgctgaagtggtccacctcaagagccacaactgtcccagtcttcatgaagccaacctgataaaaggagaaaggagagggatttatcataagtcccgtttcccccacctctctgtctccctctgatcctccctcccacttatgtcacctggaggaaataaacagaacaccacatcatcccgtgaaaaaaaggtgaccttcagaagtcaccagaaggtaacaagtgaagaagagaggaactgacctctccccagtggcacacacttggctccccacccctggaagcccttgtccccacacctcttcctcctgctaccggcacctggcttctggtctcggaggggagtaaggaggttggaaagagaaggctggtcacgatagggcgggggggaagcgcagggaagagaaactaggaaagataccggactgtctcctcacagattttggtcagaagacacaaaaagtttcatttcacaggagcacgcaaatccttgaccttatgtacactgttaaaataccctttacaggctgttttacacacacggaaactgggaccccagaagatcaaggaatcctcttcaggcccacaagaatttggggctaagagaaatataatcccttgctgggagttaaatcatgaaacaaactcagaataggtcaaaggccatgttcaaggccaattcatggagagagggctctcaggtttctagagctaggcggagccccataaggctttgctgatgtgtacagggaaagggtgcattggtcatccacagaaacccagaagagggactgtcccagagagaagtgtggaccgtgtccaaccatggtctggaaaagtacatacccatcctaacatcttgggcctgtccaggcccctgggaagttttatttctcacagtaaattactaagctgtcattccaatttttacatcaggcctgtgatcatgttaatgttgggctaccaagcgcgatggtttaccctgagtatgctggtgaatcatgtttctgagcctgaccagactcagaacacagcaaatccacagaagtcacgaatgccacccttgggagatggggtgccagcctccctcagcactacctttctgtgttgctgttagcctatttgaatttctcttcttgctatatcttatttgaacttctacagataggcaaaaagtaggagtgcagctcaggatgcctggacattcggtcccagctttcctcacaaaatggctcatcccgccccagcacagccccaacatctagaaccttgtatctggccaggaagggatgtctgccaccagttatcagcatgtcctcatcacggtccagcatgcatcgcacagggcggccggtcctgggggttaccgacagtgttagaagcctgtgagccttcaacagcagctcagccctgcaagtctcagaataaaaacagccgggaagccatcttttccacctgcacgctgagcagacctgtacagggctgctttgccatctaggcactgtgatagacaaggtggagaatataaggaagcgaggtatgtgctttcatttagagagctcacagccagtaggagagatcagaggtggatacctgtgccagaccacaacggaacaggcgatgttaccctcccactatgcccaagggttctaaaaacagagggctgtgagaattcaaagcagggggaaactaattctaacagggggaagtcctgaaaaccttcctggcacagacagccttattcttcttcccagagccagatgggagaaacaggctttggaactcacttatatgcagccagggccactgccgtggacaccacagtgctccgggtctccttgcctccaaagcctcctcccattctcttcactcgaaccacaatccggtttgctggaacccccaacatttttgcaacaaagctctgtgagtgaaagacagaacattcgcactgaatgcattacctgaacttatttcaggcctaaggcagagcctgtccaacatgcatggacctaattactgctgcgaattctgaaattccttgattgaaaatcccatgcagctttgtggttagtgatgctggggcctgccagactgaattcagcattggtttttaaccagagggcaagcagttggtcacagaatacttttagaaacttattctgtctgaccaggtgaccagcgactggtagatcatgagagtaggaccagctgccgaaaacactggcaaccgctgtcacattacaggcagtagagaaacaaagaatatttgagctgctgtagataatttagtggtccctgtggctatgacttaatccaacaccttcattttacatatgaggaaactgaggcaggatatgacttgaccgaggccataggcactgaaatgataactgccaacatgtaccaaactctagtctaaatattaaaactcatctaataattatgacaacccacccaggccccattttataaatgagaaaactgaggctgagaaaggttatggaacaaggtcagtgataccagcttgttggtgaaagagtctggctccaggactatgacactcgagtaccctctggaccagcccacatctccctcttcctatttcccacatggccctcctggtctgctaggagctccccgctaccctgacagccccttgagctgacccaaaaggcatctacctgggtcttcatggtgttctgtgtagacacaaagagctccatctcccctgcctcgccttttggaacagcaatggtgcagtgagtctccaggtagaagtgctcttggccaccgatgtatatctcccctggggaagcagtgagatccctcacagtgagcccaatgctgcagaaggggccagcttgcctaaggagagagtatactctgccaagtggtctgggcaggaagcaatggctacctgaggggtaacctcaaggtttcccacttggggtggaaaaggatcccaaagtcttagctatctgggagctgagtgctccagcctcatccccacccccacaacaaagaaagaacgacactgaaatgcatccagtccaaagttctcttctcactgcagcttatggaaatcaaggatttcaaaaaccatcattgtaaaattttggaaaaagtaaagcagggattaatagatgtgattgaaacactgaaaaccagcgcatgttcccgaacctaagctaccaggcctggtggagagtcggcttcataccaggcttgttggagagttggcttcatagtgactttgcaaagcacaacagccaatgtaaaaaacagttccaaaagaggtagtcagctgtgttgtcctggggtgggagcaatggatttgatttcacagtgtcagagacagaggtggagggagagcagggcaaagggaagaggagggaggatgctagttgaagatgggtaaggactgccttcaggtagggggaggatgagaatttatgcggttagaggcctggcagacctaaggctgtcaggcatatgtggctgttatcatccctagttggtcttccggatcagaatactctagaatctctctagaatcattaggtccagcctagagacaggagagtagagattaagataactgaagctctttcccatccaactgtctcctattttgctacaaacgtaagagggaatcttctgtcaggaaatgtccagaaatcacttccctgcttcagggttcaatgcatatctcttgaatttaatttgcaaaccagggccaccccattcccactgcggcatggaacagctctacctgacacaacattatctgcttcggaaaaccccttctttaggtcccctttctcgatcttcagctcaggtccataaaaggagttgttctttatagcatcctgaggatcacaaagaagtttcagaaatgtggcttttagcagggagggaaagataggttctgattagggaaagagaagctctctgaattgttgactctctctttccataaatgaatctctatatgcttcacatacagacttgaagtaagctctactatagcccagagaatcatattcctccatttcctcagctgtaggtggacaaccctggaccttgaggaaaagcaaagaataccacaaggaccagatggaggtaaaattttgagaaggaggaactcagtttggctgttgttagtggactgggcataagatcataaaggggaaggtttcatgggaccccaaatcccagggttgaaagggatttaaaaacccatctagtcaaatccctacctgctgctcaaatcccctccaggggatcctaatacatgcacatccagggacggggagctcactcctctacacaggcagcccattctcagttacctcaattgtgataatggctggtagttcttcataggtgattttcaccccttgggcagctctctgtgtgtgttccggggtgtcagcaaccacagcaccaatgatatgcccaacacaagtaacctagtagcagagacagactgttaaagaacgcaaccaggctcatggtgaaacaaattatttttggattgttcaaaaagccaaaagaagtccctgccctcacaatcaaagcacactttaggaatgccctagggcctcttaatttccttatcctactgattgaggatcactaggatcaagatggcaaacacatttcatctcaagggccaattctgagtatttagtactggcagactattgagaagctgaaccagatagaatgtggcaattgattccttgtttgccatgagcagaaagggggatatggcaccaggaagtgcatttgtcaattcggattcactccaacaccattggtcttcctatggagactcagaaggcaaggccacatttggctagttactattgacagatcatgactaaccttaggccctgacccccagttttattttcttttcacctcaccactctcttttatgttctatttcccagatttataccaaaagcttctcaaaggctgtaaaggctgtaagcatcaatataaggcctgtaagacacgtacttacaagacatgatactttaagtatcatgtcttatacttcaactaatacccaaaagcagtagctctcaaatactggttcttagacttgatgacccataaaaatatttttaaaaatttatatgataatgattgttgttttattttgtttaataattcagtttcataaaagcttaatggatctccttcagagataattgtcatccaacatccccgaaaaagtaaacaacaaaaaatttttgtacaacacatcactttagaagatgaagtttctgacaataggaaccaacaattagtatgcatgtctctgataattatctcttatggcccaaataagctattgactcagttggttagtgcaatggtggttaaatctggctgttggttattgcaatggtggttaaatctggctgactttcactagccataatgctagcactgctctgagaagctcttaaagtatgtaaagcaatttgttcttctatgaaatgctctcctcatggagtctttgttctcatatttttagttttttgttatctccttcacttttacatcaataataagatgaattcactcttcagaagtacccactcatgtctaatttgcaacattggatgtctattggaattacaaaatgactgtcgagaactatcctatgagtaaaatataaggacttttgtagcagctgtcttaaacatttgaaaaattttgtttgttgttgaagaattccacatagttgaaatcaatagataaactttcatgtaagtgaattaccaattcacgtagtggtggtattgtgatttctagttagtgtactaaatgtattcttattttattttaattaaagagcttactgttgtcccttaagaaccgaattgttagttcaaatgcaatcaccagtgttgttttactgccactttggcatagagacatcctgccatgtacaaacagcagccatcaattaaataaacaagtaacatattctatctttttggattgtcctgaatatgggccaactggatgatggccataatccatgcaaatgtataacctttccagatcaggagtttggagcaatgtacacaaattaaaacttcaatacttattcaatttacttcatataaaaaaatccaagacttaccttatccttcgcaaagactgtctcatcattacaaattccagttatgttactcccaggaacatcatcagcggaaatgaaacaaacaaaccctggaaccttcttagcttctgatgtatctatggacctgcaagaatgagtggtgtgaggggccaggtcagcaagctggagcaggggacccatcacctggttggacaaccctgttcttattttgattggcttggctccatcctaattcctcgattctctgcttcttttctattagattctaattcaattatatcctattctgcaaatgttgattaaatcctcaccatgttcaggccactatgctgaatgttgctggggatataaagtgaataagccagccaggcacagtggctcatgcctataatcccagcaccttggcaggtcaaggtgggaggatcacttgagcccaggagtttaagaccagcctgggcaacatagcaagatcctgtctccatttaaaaataaataaagtgaagaaggcaggccaggcctctttggatgttacgtgatgctctgtctggtctccaagtacaagcaagccatatcagaacgaacagcacttactctggagcgctctggctcatgcacacatcacacctaactccctcccaaaatcagcacatggagcccggctgtgccactgatccaatggccctgaacagcttcataaagctggatttgtctccccacattcattgtgctatcccagcatgacagggcatcctaccataattaggcaacacgaaccgcaaagggagaatgcccgactatatgatcaaggataacagtctcaactatgtactcatcacactggcacatgcccccatggggaaatagggcaacacatttcagggaaaggtatgtaaactgccctgaagttctaaccatcttccaaatgcttaatcctcacaagaaaccctgaaagtacttatcctaattcccattttatgtttggggaaactcagactcaaggaagttaggtagtttttccaaagtcactaagccagaaagcagtgtgactgggattattggaactgaggttaagttaggagggttaagctctgtcctgccaaacccacttccaagtgtgtgcagcccaggaaggccccaactgttgcagttacaacaatgtcaaccccctcatcctcttccatccattcacacattgcttggatggaggtggtttgagcgtagacaatgtgggttatggtattgtcaatatgggctcaagacaaggaacaaaagggaaagaatgtatcctatagctgccaaccatgggaacttaaacacttttttttttgttttcagggacctggacaagtttatttatctgttagatttcagctgtgcctggttcaccattcctggagggatcccgtctccaaactaggagcagcagcagagaaaagaccaatgacaaggaaacctgattcctagtccacacagtgggcccaaggaagggcttttcctagctgatctgctcagcagggtatgtgtctaacgcccaccaggaagtgaagttcacactctctggcttgaacatcctgaggcagcacaacacagttgctcacgttgcttggcttcaaattccaactctgccacttaccaactgtgtggcctggggcaagtaacataccctgcttgtgccttagtttcctcatctggaacagagagataataataggacctgcctataaggtcttcccctctctctagcctgggaggtcctggaggcacctcattatctttgcatctccatggcctagcagggtgagagaagtctcctgggtactcccagtggccccctcacagcattccaccagctcctcctggcggtgtcactcacttgatcttggcgtgggcccgggtgctggtgaccagccggagagacagctcattctcgtagcgaggaatgtcgtcacagtacacggcctcaccagaggcctgcatgtccgctgccaggtggggcaggggccggcccaccatgtcctcctcagactgacccttgggcacctcctggaatgacagggtcatcaatcagggtgagctgccaaggacactgcccctctatgggcccaggggacactggtgagcttcatgctacatggcaaaggacaccaaggggtaagaataaagaattcagaggggcgtggggcaaagggaacaggaaggtgcataagtgatagcaagggtggtcctagtgttgttatataaaagaacaacaagaaaaagaagaacctacatttccactaattggggattgggtaaataaattatgcagccccatataacacaatagtatgcaaccattaaaacatacttttgaagaactttaattagaaggattgttcatgcaagcataaaaacgtgacgcaaaacatttgtgtttgtgtttgacaataattcaattatgtaggaaaagataatatatgctataaatatagtatatacatgtccatatacacataggaaataatgaaaagaattaaacaaaaatataataataatttgctctcggaggtggaatttttggtgatttttattttcttctttatgcttttctgtattttctaaaatgttttaaattattgatctcataataaagttctgtttttgttttacaaagtaatcataacaatggctaatgtttattgagtgtttcaccatatcccagggaccatctaagcaatttacttttattaacacatttaatcctcaaaaccatcttatgaaacaggtatgtgattatccacatttgcaggtgggtataattaacttgcttaagaggcacacaagggaataagtaagttgttcaaggttgcacaattaggaaatggcagagtgtggacacaaattcaggcagtcaggttccagagttcatgcctgggacgactacactctagtgtgcagggggcagtaaattgtggcatgggggccaacacaagcccactgcctgtttttgtaaataaagttttattggaaggcaacacactcattcattcctgtttttcctgtggctgcttttgtgctacaatgacagagttgagaagttgcaatagaaaccatctggcccacaaaatctaaaatgttttcaggaaaagtttgctgaccctttacgtagcacctctcaaaaagctggagcagatagatggtttgtttgtttgtttgtttgtttgtttgtttgttttagcatactcaagaagacgtctggctttgtacattatccatcacgtaaaaaaaaaaaatctgtaaggaagaggggcagctaagagtttaatcccaaagagagaaatttaggcaaacaagggagaaatagtgacattaacatctatacgattcccattttcttcactgggtatttacgcacaagagtaaggagttttatggacctatatacaattcaagttagtcattagccgatggtcagccactagccaactcatgtggcctgcaaagtcccctgatattagccatacactgaccgtactcacttggaagagctggacatcggctggggggtctttctgaaacagtaaagttgcactggcgaaagtggggtccagtttaccacacttctgtggagacaagaaaacagaggtgaccaggattatatttcaatcactgattccttccttgcttgtccataaaaatgaccaaactgataactgatccccttgtctcttcacttcatacgcctttgagtgctggctggatctctcagcatccaaacacgggctctgagagctcagaatttaagagcagcctcagcttcactgctagccccccagtggaccctgtagactgaatggtctgtactttctccaacaccccaaactctttccctccttcttgcatttatgcctgctgctgtctctgttgggagtatccttctcctccttccttgccctcctcaattctgtgggaagcatttaatgatatggaaaatgttcacaatataatcccaatggaagcaaagggggatttaaagcgctatatgcagtgtggtcccaagtctatttagaaaataatatatccacatcaaaagataggaagatgacagatattgatagatggatggaaggacagatagaaacagagagagagagagatggggcagacaaacagtatgacagatagatggacagataaatgcaggaaaaaaaatcagaggaaataaccaaaatacttggcagtggttttctctgggatttgagagtaagagtaattttaggttttctttatccaatcctgtatttttaaagttcttttcttaaagaaggatttatctctgctgtccctgcatcagtgacatcctctccactttgggctccctccacactccatctctgcagttgtctcccaagtgtggcctttattgtccatgttctccccgacactgagctgccccctagcacctcatgcaacctggcataggataggtgcaaaataaattcttggtgaacaaatctcaggagctgggcccacctcagcctgcactctctcttgaagacatatcctatggattccacggcctcctggctattgcagccccacctgacattcccattccaccctacatactcatcacactctgcattccctttctttttttcctttctttctttctttctttctttctttctttttttttttttttttttgagacagagtttcgctcttgtagcccaggctagagtgcaatggcatgatcttggctcactgcaacctccacctcccgagttcaagtgattctcctgcctcagcttcccacgtagctgagattacagggcaagaacctctgtcgccaaagcccagcccagcactctgcctctaagccagctggtcactcccatttccaagattcttgtgctgtgaccctggtccctgctattctgccctcagatgtccagaggagaggagcaaatttactacccagaccaacttcttatatccccaaacatgctacagagagcctgtgcctggccaggccccactcacgtcttccaggttctcttggcccagcttctgaaggactgtcaggtagaacttgaagaagaagctgagggtgagggtgcaccggaagtccaccatgccaccaggggcatcgggaggcagatgcagctcctctgccagtcctgcacacacgtcctgcagcagctcctccttccagagcctgccagagagcagggcgtgggacagcgctcccgcccagccctccagacccctttgtgtagagctgtgtgcccagggcctcggagctgtacaaagcttggttcaaaatttggcttggatacttagagttgggtgactttaggcaactttaattaatctcattgagcctgtttcctcatcttcaaaaatagatacaattttaaaagaccaccaaaataataacagttaaaatctatcaagtcctcacaatgtgccaggcaacatcttaagtgttttatatgaattctcacttttaatttaaatttgaaaatgtagtaagcaaaattcctacacccatttaccaatgagaaaactgaggcacacggagattaagtaacttgacttatgttatctatttggtaaatgacaaagccaggaatttcggaaccaaggaaccaaactccaagttaagctttattgatcctatgtgggtgctgtaaggatttcctaggataatgttagtgaagtgttcggtacaatttctgttatataataaccatagaaatagtaatagtagtagcagtagtactaatcacagccatagtggtagcaatagtagcaataacagagcagtagtagtagcatcagcatcaatactactagtaataatactagcaacagcaataatagttgcagtagtggtaacaagatagatagtagtagtagaagtagtaatagtcatagaagcagttgtcatagaatcaacagcaacagtagtaataatagtagtaacagaagcaatgccaaaaagtagcagtcatagcaccagcagcatcaataacagcagtaatactactgttagtagtaatagtagcagcagcaatactagtagcaatagtaatagtagtagtagtagcagtaacagtagtagtagtagtaatttcagtagcaataatattagaagcagtaatgttattagtaaaatactagtataacagcagtaatagtagtagtagtactaatagagtaagcggtagaagaggcagcagtagtattagcaatagtaatagtaataacagcaataatactaatcataatagtgacagtaggaattgcagcagtgatcatagctgcagtgatagtagtagcaacagtagtcatagtaatagcaataatgagtaacagtagtaattttagtagaagcagctggagtagtagcaatcataatattaattatagttgcaataatagtaacaatagtagtagcagcaatggtaatagcatagcagtggcaatactcctagtagtaatactagtagtagtatcggtaatagtagtagtagcaactgtggttatagtagaagtagaagtggtagcagtagtagcagcagtagcagtagttatggtagtagtagcagcaatagtaatactactggtagtcatagtagcagcagcagtaacaatgatactattagtagcagcaacattagcagcagtttcattgtgctgttagctcttacttggaaagctgcctctgagtggtcttgagggctgagatggttctgttggccattccaccatagcaaagggccagctcctgtacctctgtggttcctggcttgaataaaactctcatgccactggttaccttggcaatgtcatcttctctccgggaggcctgcttgaatgctgagaaatactccccctaaaagagatcaggaaggtgcctgttttccaccttgctctgtaggggctgcaaatggcagacccaaaccacagggctatgaggtgaggtgaggggataacaccatcacacatcagtgggtgaactggccccgggaatcaaagatcaaatgtaactgattaccacctgtttaggagaggttccagataacattcccagaagctgaaaaaaaaaacaggatttctccctgctagtcagaaaagctgagggtcagggacaaagtagaactgggtggtctccattgaacaacagctgcaggggaagaagggtgctttcacaaaggctccttagagacccctcatcccccttaccttccctaccctggtgcccactatcagtgcccacccagcctctctggggactgaggctgtttggcctttggcatcctctgtttgtggcctccacagtgccctctctaacctgcctctcccaccagtctgttggcatcgttcagaaatcttggtgaaagaacccgggcacagtggctcacgtctgtaatcccagaggcctaggtgggaggagtacttaaaaccaaatgttcaagaccagcctaggcaacatagtgaggccctatctctacaaaaaaaaaaaaaaattagccaggtgtggtggtgcacacctgtggtctcggctacttgggagggtgaagtgagaggatcacttgagcctgggacattgaggccacactgagccgtgatcatgccaccacactccagcctgggccagcaggcagagtgagaatctgtctcaaaaaaaaagagaagaaagagaaagaaaggaagaaagaaagaaagaaagaaagaaagaaagaaagaaagaaagaaagaaagaaaggaaggaaggaaggaaggaaggaaggaaggaaggaaggaaggaaggaaggaaggaaggaaggaaggaagcaagcaagcaagcaaagcaagaaagcaagcaagaaagaaaatatcactatcacactatgaaacaatcactgcccttgtgctttaaacacattttccttcctgggttcgagccaggatctttctttaaggataggaggagagcatgagctattttccaggaaagagccacctgacttcaggccctttctgtgtcaggttccttttgaggtctgtactcactctggcaccacaaattctgatgaacaccaaaattagcaggtttagggagaggagatctattggaaaaagcacaatgaggcccacagttgaggcccccaaatggccacccacttttccctgaagaagccatggagcccgctcctgatgataaagctagctcagcttgcatgtcatgtgtggctctggggcactgagcccagagtttgacctttgttctggaacagaggtcccaggtgctcactcccaggactgtgcccatccacggggacattctcgctggggtacagtgaactgtcagtgtcaggctgacaataccctttcttgagagtttctaattctgggtattaaaatctcctttctttcatggaaggatgtgttttgttaatgaccatacctggcaaataaaaactgaatagagctacacctgtttcctccccactttcatcactcataattaaaaaaaaaaagtttactgaactgtgaaattcaaaactctgggaatcactgctcaaaatggtctatacagacaagctagaaaaccattaagaaaccacctcagggatataaatgctctaatttaattagcattctcattaaggaggtcaaaattaccaagggcaaaacatgccttagaacactcactaaagctccagctgtgggaaaccttcacactctctctgacagtggctccccaagcctctcccagatgccttttctgacaggcccttttggatgtgttctgagctggtagctgctaagggaggaaagacccacaccaggtcaagacatcacagggcccagggaacaaagaggaaggcagccagtggtgcccagacctgccccaacaggccagaagagccactcatgaagcaggaatccatccgcaccaatccacagcgaggtcagtgaagcaacacctcgtcaagcctaaggtcagcgtatgagggtctgagccacaggcagcttcttcatgcagcacatgaaccccacattctttaccacgggaaagcaaatttcctctgacatgggcaggaatcctcgacagctagatgtgttcttggaattctgttcttagctgctggtcatctccactggcttctaggcatcaccaggaaccttatgaattgtttattttcagtcctcacaataacccgtatagtaagtgacatggtgcccattttacagataagggaattggggctcagaaaggtgaaatggctcactcaggaccaagtttctagctatctggttccacagtccatgccatgtggactcctatcctgcaacttctcattgtccagaaaggagtatggttggttcaacagaggcaaagttcagagagaaaaatcatcaatgtaaaggttgagagatgctcaggttggtccctgaagcagattctgatctctttgtctagagcctggcaataggacttatttgagcagagcctggaaccacttccaacatctcacctccctgctgtaggggatctctatggagagcagtatctcctccgggctcagcagggtctttctgtagccagggaagaaggtgtggtccatctggacagttctcctggtgcctgtacagaagcaagatgaagaggagccaaagtgagggaaaggctgggaaccccccatggggagaaaggataaccatcagtgggattcttcatgctggtctccaatgcccacagtcagagcaaatgactggcacaattggggccaaatcctctctctgaaatccttaagcatccttaagcaatggtgtgctggtgaatctttaacaaccagttccgtgtagggggaaaagccctggtttatagcatttgccaatttctgtggtgtaaatacttccaggccaccaaagttgcatcactgaatgtgaagctgggaagaaggcaggaaagagttagcacagcaacccggactgctgtcctctgtaggggttgcttacaaggctggcccttgggaacttgtacttcagaagggttcccagtgctccatgatggagcagctcactgcgcctaaattatctgtacaatcaatagtttatgctgaacccctgctttccttctgggagtccagactttaggcacatgctagtagaggctgcctatgtgatgagctcccaagaaaacctctgtcgctgagcctctaacaagctttcctggtaggcaaggcatcacttgtgttgtcacaacttattgctggaggaattaagcatgcactgtgtggctccactgggagaagtctctggaagattggacctggttcctccagactttgctcccatgtatcttttccctttgctgattttgcatcctcctgctataataagtcatagccaggaatatgacggcatgctgaatcctctcagtgaatatcagagccggggtggtcttggggaccctctgacaaggcagagatgcactggagcacataattgtagagcatttccaccgtacagacagaacagatgcaaataactccaggagcactgataacagcaaaatgaagtacttacgaagtgatgaattttgagtatttattccttttgttttgaatataatttatttcattgtaattttatacaattttatttttatttttattttttgagacagggtctcactctgtcacccaggctggagtgcagtggtgagatctcggctcactgcaacctccgcttcccaggttcaagtgattctcttgactcagcctctcaaggaactgggactaaaggcacacaccaccacacccagctaattttagtgtttttagtagacatggggtttcaccatgttggccaggctggtcttgaactcctgacctcaagtaatcctcctgcctcagcctctcaaagtgctgggattacaggcataagccaccgcactaccgcacttggcctgatttttattaataactgtgtttcacaaatggttcacagaattcctgaagatccaacagcaggctgtggtgagccagtgcatcccagccccagtaccccactaggtaaggcatgcaggtagcagttcctgctgtgaattctctacagagaaaatatccagctttcccgtccaccaaaccaggtacattctccatgcttccctggatccaaatcacagggaaagctgggtcactgaactttgagctctgtttctccagaaaatgacctatctggtgagacttttctcccccaagtccttcttcctggacctctgcttcaggcagctcacctctggacacaagtgtcagcttggccccactggccatgaacacggggttgaggtcggagatggggctggcagtgatgatgttccctccaacggactaaaacaagcagagagcatgcagtgagagcccaccccaggaaacccctgctcacgtagcaggctcctgaacataccagccaggtgacacctgctgcaggcaaacccctgaggtcctgtgcctactgtagtcacaataccagcatagtgagaacttcggcattctgaaaaatgcgcaaaatttgaaatcagaatacttgagattggatccccactctaaaattttagcaggcaagcccctttaagtgtgtgtgtttgattgatgatttcacccaaccttttcccgaaaggattgaggtgatttatcacagaggccatatagacttagtaaaatagaagataaagatcaaggaaagagaggaggaagacttaaggttgaacaatttgctctatttggatctgaacttcctggtaacttggcaaaaaaaatgtaagaagaatcagatacagggttctcgttattagaaaacaggaagaaaatcagttgcacgatgaaaatacaattcttcctggaaatagattttagcagaactagggaactcagcagagtttttgagtttatgtttccttatctacagtttatgtttccttatctataatcagaagtgacaggtacttggggtgggggctgggaggaataggagtaggctgttttgttttaatttaaaaaaacaatttaaaaatggaagagatagcttttcttccgacaccataaactgttgtgaagagcttccattggcatagggtgttcgaatgccaccatttgcaaactgggaatgtggggacttgtctgaaggctgactgaataatcaacaggtgtattcctccctctgtgggagggctctgtctctggttctccctatagctctgaaaggaaattcccctctcaattctgacttctccctagcatatccatatctcttgttcacctactgtttggctcagccaagctcaggaagggggagggaggcaggaagcctcatctctgcaaccacagaatgaagcctatgagtcgtggagtgcatttcccagggtgccccacagaccaccttcatcagaagcacctgaagagctgggctacatcccagacccatgtatcagaatctctgagggtggggcccaggaatctgcactttaacaagcactgctcctcccaggcaactctaagcgctaaagtttgaggcccactgcactgacacagtgagagtctggctgccctgctttcagatgaaagctccatcctacgggcctcgcttgcttctgagagcgactcaccgccacagacttgacttgcttcccagcaaaccagcgcagctgctccaggacccctctgaacacctctgtcttttgggcaggaagcttagcaacagcatccaccagggttttttccacaatgctcagggggcaagcagctccaaaggagatacctgggaacgcacgttcggaatcacagcaattcttcccacagttcagaagaggctttcatgcacagctcctctgaagctttccagcaactggagcaaggctgaatcaggactcacagctttccatggatgaggaaatgagggcccagagtggttgagtgacctaaccaatgccacacagctaataaaagagccagtactcaagcttgggcctcttgatcctacaaccaatgctctttcctctaaaccagtagttctcaactcattaaaatcagaatctctgaaggtgaagtcctagcattctttttaaaagcactcaggcacaatccccacctccccacccccgcatgagtgattctaatgtgtagccagaattgagaaaaatgattgaagatcccgcagcctcttgcccactggcaccctaccatggatgtttcagcaatgaatggggtctcctcccgcctttccctgtgcaaggtgagccccaggagaagcagggggcagccagagccagtggggagaccaccctgatacctgccacccaccttgtaacctatccccagcctcacagcccctccataagcttggagtgaacctcctcttaccgtcgggtccatgttctaccgaattcagctcagggatccaggctgggcagacaatcataggaaacagcatattcttgaacttcatctcaatgcctagagagaaacaagaagctgaagttgtaggcccattgttgtatcaccagggcaggccttagcagcttttctcaccattacacacaggatatatgacatatccacaatcataatatgctctctggtgactgtaggtgtctgggaataggaaactcagtagaccaggggtgggattagatgcagtctttggactgtcagcccaaaactaggtctttctttccctctcaaaaaacctacctgaattcaaatgaaatgagtttgaattcactctagtgtgtgtgtgtgtgtgtgtgtgtgtgtgtgtgtgtttgtgtacattagaaaacacaggaaattaaggtatgtcaggaacccttctaagcactttccctattttaacttaattaatgctcacaacaaccctatgaggtactatgatttttctgtttatagatgaagaagctgaggcacagaaaagttaagtttcttgcccaaatcacacagctaagaataaccaaatttcagtactggaatgattattcgtgttggggtataatcgtaataaaaacatgaaagtttaacattaaaacaaaaaaggaaaatgggagggaaaacttcaaatctgtcctccagttcccactatctgcctgagttcttcaagttgtctggctttgcggggccacacatctgtgtgtggtttctggccttcctgactaaatgagtcagaagcctctgttaaacaagtgtgcctctgttccttagacccagttggctcagcacctctcccagccctgccaacagtgtatagatggaaaaggttaaaaaagaaatacctgtgacctctttgcccccccttccccccaggtgctgtttaggatttctgaagggggccctaggctttgtggatccccagattccagaatcttcaaagctcccttcagaaatcctagaagcacctgaataccagccccttttgaatatcagcttccaggacaaagaacacagattgaagcagcaagttctacgttactaaggttttctctttgtctgccttcccccaacactctgcgttgactggaggtgactatgctattggggtatgtataagagagaagggagtggcgcagaaggaaatggtcttgagaaatcatttctaattgtggaacttaggtaatctttgttattcatttctcttggaatccaactgggcccaggacattggatggctcatggcagggagcatgcaagtgtgaaatgatccccttgaggctggggtgggggaccacatgagcccatgagtttgaggtgagctatggtgacattgcaccactgtatttcagcctgggcaacagagtgagaccctgtctttgaggaaaaaaaaagaaggacctcctaagattcccccagccaccttaaatcaagctacacctgagctacatgagccatgagtcctgttgagccatggccatcaagatcacatttcttgaggtgtgtctcagcccaccctgctgcctcagtgtgtcacaaaaccacagttggggactctatcttatgtatatgtgcgcacgagggaggcgtccattctgactccatcagcactgacccaagccaggctctcctctctgtggctgaggagccaaccagaactcagggcttggcagctccttcaggaaccagagccaggacctgactgcttagaaggagagcatgcccctccacagcagaggtcctcagctgtcccacggtctcctccttagatcctcactaggcttgggatccagcaaagtagaaataggccatgccaggtttagaaatcgacagagattagcagggacctgggaacctctccccatctcttacagcactggggctgagaggtgcatattctgagtctcccagcctgttcaactattccaggcctcacgtcctaggtggtagcactgacagggcaggtggccatggtcataggcaacacaaacacagtcacacctggagctctcctcttctttaccttatcacatcctcccccagaaaaagtggggtggtggggtcaaaagcgacatttatggaacctctagtgtccatcagccactggcctagacactttgcttaaattagttcctcctcccttagactagaaggcccttgaaggcaaggaaccatgtccaattgagctttgtatcccaagccccttccagagtacctggctcatgctcggtgctctgtaaatgtttgtggagagaagtcaactacatgcaaggatctcatttcacacccaaaacaatccttcaaggagttgttagtatccccatataaaaaacagaaaatgagggtagatgaggacaagcaacttttctgaggtcacacatccagcaaggggctgagccaggcctgtgggactccacagctaggggcctttgcaggaactggagtgtccagggatttccagtgggctccaggtagtcagtggggcagagggatagggtgcagaggcaagtaaagtcagggggaggtgaggatgggcaagaggacctagaaacacccccagaccccctggcagccccagggcagcctccctggcccttaccaatctccgtgttccccacgaccagcttggcgtcagggtgctgagccttgaggtccagcagctccttgagggttgaggcctgtatccacgtcacacgctccccttcaaatcgcagctgcttccgaggagtgtctttcagcctctgggaaatgcagttttcttactacaatgtctccctcttcctactgtcattcctcttataaattgctttaagtcctcaatgggatgttttactgacattcagaatgaaaatatctaacaggaagaagcaaggggaagtaatatgttcagaggcaggaactccattgggactagtctttacaagacttccatgaaggaggcattatgagcctcattttcaccagtgaaagaagatcctgagggtcaaggaggttatgggacctgctgaaggtcacctgccatgaggggtccccaacagacctggctgaaagccagattccttgcagtgccccataatatctccagggggcaccatggacaaggcatgagaagggagggagggagggagagagggagggagggagggagagagggagggagggagggagggaagaaaggaaggaaggaaggaaggaaggaaggaaggaaggaaggaaggaaggaaggaaggagtttgttataaggggatgcctaggaaggctggctttagtgcttgcaggaagacactgggctgagaacgaagccctcaaatcgaactgccagtattttcaaagtttcacagtccagagaaagatctgctggtggcctgctgcaaagccattctctctggcctgttgaagctacaaggtagttttcatagctcaaaactctgagaagtgtgcacttcaaaaactccgagtggcttgattctttcgttgccataaatattagagtgatggtgataaagtgggtgtgagggggtttccttaagacagagctgtgagctgcagatcatgtcctttgaagagagctctcgttttttgttttgttttgttttgttttaaataaatggattgcttatagagggaatacgtttcttggagtgcttatgtattagatataggcaggagatcaacaaatggttatagtgaacctgctacactacacagtgtgcctagagagccagtccctatcctcatggggcttgtcatttagcaaggaacacagacatcaaattaataactgtaactgtgacacacatgaactgaagtgcaggggctgtgggtacacatagcagagactcaacctaggggagtgtcagaaaatggaagggaaatttaagctgaaacataaaggacaagaaagacacaaagttcccagtgggtatgaaaataaagcaggtttccagggactcacagtacagacccggctggatctgtccctgaggcatcacctaccagcaactctgggggaaaaatgggctcctgggttggatccaggggcgtgaactcctctggtttgaataaagatggcgagaggctgacctatggggaaagagaacaggtaggtgatgcagtatctcctcctttcaaacacccaagaggaccaattcagcctttccttccagcaagctcattcccagccccctgcaggctgcaagaggagcaggtaatccctgggaggcaggaatgagagagtctcagttacaggacccggggctaacgtgcaccatcaccatccccacagtctgccatcaccgactcaccgtaggttcctcttccagcccccaccgccagggacatggagctcgtgcactgactcctctaagtctcagattacccccaggcttccagggggagaagaactcacttactgagtggtctttcttctggttcatgcagcaatttggattattcccatctcctccacagcatccaccatcctagagagatgatgaacatctgcacaagggtatttacaaagagtatttgcagaagctaaggaatctagattactaatatccagaacactccagctctgacgcctgtcccagcatcaacagcaggggcatcctgcctgcctgttgcccagagtggaggcctccgctacattccctcttgcttggctaacgtagattaaacaactcatggataaacaaataggagcaacaaggccactgaatttcaggaacttttctccataaaagctaggtcctactttatcaaaacctatcccttatgcccatttctcttcttcagtgctgcttcctcaggaagcgtctatgagggatattcccattggctctctcaagactcaagaggcttgacttccagatcagcaaggttctaggggcgtggctggtgtctcccaggctgggctctctgcaggaccctgccaaaggatgtccaagacgggtgctgagcccagcactgtgtccagccagtgtgcccaatggcctccctactgcttattaggcacttcttcccagaaaggtaaacacccttcactcctcactgtgggcctgttctggagaagtatgcaggtcagaccacccagcatctctgggaaaagacttgctcaggacctcttaggataccagtggcagagcacacacagagtctagaatcactaccacccagcaccgaggcactgcagggtggcagaggggcgcactcagctgactgatctgcagctcagggcttcagaagacagagtcctggagttgtgctgagatgaaaaagtaggggaaactcataggttctgcctcaggcacttttatcgggtagtcaattcctgaaaaagcaggctgggagcagtccttctgcaagtcagccacaggagacaccatgccatgctggcattttccagagtctgtttcacaactcgttgtcttctgcaagaaagcactcatgggatgctggaggtgtgaccttggagaagttgtaagcaggcaggcagtggcatcaggagagaaacaccccacccaccccaccacctggacacgctgctccgtgtgcagactcttcctgcattcacagctccagcactggacaccagacctgctccgtccattctgagcctccccccagccagccaccttgcacttcccctctatatttagaaagaaagaaaggaagaaagagaggtttcttagtgccttttctcacctttcttcttggagaaggagtgatgtagggaaatgccctggcctacctgaagtgaaagtcctgcatcccactcacctggccctctgaggaaggacatatttcacagaagcgccttttccagacaaagtgccagtgcattattacttagatctattttcttgataattcattggtgtgttaatgacataaattactgtgatgtacagtaatgcatcactgccctcaaggtctattgaggttggataagactacattttctcatccccaccctcctgagattcctactttactaaataggctaaggcttctgcactggtgcctttaaaaaaaaaagttttttttttagagtggtttaaggttcacagaaaaaactgagtggaagatgtagagaattcccaaatacccctatcccaacatacacgcacaacctttctcacttcagtatcctcaaaagtggcatatttgttacaactgatggacccacattgacacatcattatcacccaaagtccattaatttacatgaaggttcactcttggtgttgtacattccattggttttgacaaatgcatgattacaggtgttgacccttatgatatcttacagaaagagttatactgccctaaaaaacctctgtaccctgactattcatccctctgtttcccctaatcactggcaaccactagtctttttactgcctccatggttttgtcttttctagaatttcatagaatagatatcatacaatatgtagcttctaaagattgatttctttcacttagtagtagcaattaaggtttgtctatgtcttttcatagcttgatagctcctttcattttggcactgaattaacattccattatttggatgttctacagtttattcacctactgaaggacatcttggttgcatctaagttttggcaattatgagtaaggttgttgtaagcatgcctgtgcaggttttcatgtggcaataagttttaaattcctttgagtcagttccaaggtgtgtgatcactgaggtgcatgataagacatgttcagttttgtaagaaactgccaaattgtcttccacagtggttgtgcagtttgcattctcaccagcaatgaatgagagttcctgttgccccacatcctcaccagaatctgatgttgtcagtgttttggatttgaccattctaatagacctgtggtggtatttcactgttctttcaatttgcaattccctaatggcatatgatgtcgaacttatatgcttactggccatccatataccttctttggtgaggtagctgtgcaggtcttttacccattttttaatttagttgttcattgtcttattgctgagttttataagttctttgtatatttggataagtactttacaagatgtgtcttttgcaaatatttttctcccagtgtaccgcttgtctcctcattcatcgttattaaattttaatgaagtccagcttataattatttcttttatggatcatgcctttggtgttgcatctaaaaagtcatcatcattccaaggtcatctaggttttctcctatgtcatcttctaggagttttattgctttacacttaggtttatgattcattttgagttaattttgagaagtgtataaggtctgtgtttagattcatttttttttgtatgtgaatgtccaactgttgcagcaccatttattaaaaagacaatctttgctccatcgtatcgccttttcttctttgtgaaacatcagttgactgtatttatgttggtctatttctgggctctctattctgttccattgatctctttgtccattcttttgtccattctttttgtagtatggacagtgtccatactacactgtcttgataactgcagctttgtagtaaatcttgaaattgggtagtgtcagtcctctgactttgttctctattctccttcaatattgagttggctattctggatcttgttcttctccatataaaccttaggatcaatttgttgatagccacaaaataatttactgggattttgattgggattgcattgagtctacagttgggaacaactgacatcttgacatattcagtctccttattcatgaaaaagaaatatctctccatttgtttagttctttgattttgttcatcagagttttgtagtttttctcacataaatcttgtacacactttttagattcatacctaagtattacatttgttggagagtattaatgtaaaacgtaaatgataatgtgttttgaatttcaagttccacttatacattgctgttacatatgaaagtgattaacttttgtattgcctctgattctatcttctggaagagattgtggagaattgacataatttcttttttaaatgtttgataggatttaccagtgaatctatctgggcctggtgctttctgtgttaaaggttattaattaatgattcaatttcttcaatagttataggcctattcagattatctactttttgtatgagttttggtagcttacatctttcaaggaattgttttatttcatctaggttatcaagtatatgagcatagagttgttcttaatattccttcattatccatttaatgtacatgagctctatagtgagatctttttattttgatattagtaacttggatcttctcttttttttcttagttagcctggccagaggcttattaatttcattgatctttttaaggacccaaatttcagttatgttgattttctctattgattgtctgttttcaatgaaattgatttttgctccaaattttatttttcttcagcttactttgaatttaatttgcctttttttttctagttttctaaagtgggagcccagattgctgattttatttgtattttatttttattatttatttatttatttatttatttgaaatggagtctcactctgtcacccaggctggagtgcaatggcgcaatcttggctcactgcaacctccacttcctgggttcaagtgattctcctgcttcagcctcctgagtagctgggattacaggtgtgtgccaccatgcctggctaatttttgtatttttagtagaaacagggtttcaccatgttggtcaggctggtcttgaactcctgacctcgtgatccgcccgcctcatcctcccaaagtgctgggattacaggcatgagccgtcgtgcctggtggattattgatttttaatcttcctttctaatatatgcattcaatactataaatttccctctaagcattgttttcactgcatcttgcaaattttgataagctgtattttcaatttcatttaattcaaaatattttaaaatttcccttgagattttctttttgaccatgtgttcttttgaattgtgttgtttaatcttcaagcatttgggggttttccagctatctttctgttatcgatatctagtttaatttcattttggtttgaaagcagacattgtatgatctctattcatgcaatttaaatttgtaaatgtgtgtttcatagcacagaatgtggtccatctaggtgaatgctccacgtgagcttgagaaaaatgtcttttctgctgttgttggctaaagtagtctataaatgtcaattatatccaattaattgatggtgccgttgagtccaactatgtccttactgatttttggcctggtgctgtccatttctgatataagggtgttgaagtcttcacatataataatggattcatctatttgtctctgcagttccaccagatttgcctcatgtattttgaagctctgttgttaggtgcacacacattaaggactgttatatcttcttggagtattgattcctttattatttttaatgcccctctttttctctgataactgtttgctctgtccaaaattaatatgctacttccactttctttcgattagtatatcatggtccacctttctttatctacttagttttaatctatctgtgtcttttcatttaaagtaggtttcttgtagacaacatatagttgggtcttgttattttcatctactctaacaatctctgtcttttaaatggtgtatttagatcactgacatttaaggtaatcattgatatagttggattagtatctaccatatttgttattgttttctatttgtcgtccttattctttgtttctagttttgtctttcactcattttctgacttttgtggtttgaactgagcattatatataatttcatctcctttcctttcataaagtatcaattatacttccttttttctttttttttttttctggtagttgccctagagtttgcagtatacatttttaactaatccaagtccacttttaaataacactacaccgctttacaggtagtgattgtatcttataataacaaaatatttctaatttttccctcttgtttattttatcattgttgtcattcattttacttatacacaagcacatatatatatacatatgcacacataaacaaatgcatggttgctatgattgtcttgaacaaattgctatctgttagaccaattaagattaagaaaaataaaaatttttattttacctttacttgttcattctctcatgctcttcctttatgtagatctgagtttctggcctacatcattttccttctctttaaagaacttcttttaatatttcttacaagatgggtctactggcaacaaattatctcaagttttgtttgagaaaatatttctcactcgcttttgaaggatacttacggaggttacagaattttaggtgctttggttttttctttcaatactttaagtatttctctccatgcctcttgcttgcatggtttctgggaaaagtcagatataattttatatttgctcttctataggtgaggggtgttttcctttggcttctttcaagtcatttttctttacctttgattttttgaagtttgaatatcacatgccttggtatagtttttgtttggttttgggttttggtacttatcctggtttgtgttctctgaatttcctgactctgtggtttaaaatctgacattaattttgggaaattctcagtcatttttgtttcaaatattgcttcttttcctttctctttttcttcttttactgctgatattctcgttacacatatgttacatcttttgtagttatcacacagttcttatttgtttctgtttgttttcattcacttccttttctctgttttttggttttgaaagtttgcattgtcatatcctcaagctcagagattcttttctcagccatgtccagtctactaatgagcccaccgaaggtagtcttcaatttgttataagcgttttcaatctctagcatttctttttaattcttagaatttccgttctctgcttacattatccatctgtttttgtatgttatctattttttccattaaatctcttagcatactaatcatagctttataaaattcctcatttgttaattccaatattcctgtcctatttgactctggttctgctgtttgttcagtctcttcaaattgtgtttgcctttgactatgccttataatttttggttgaaaggtggacatgatgtactggctgaaaagacctcatataaataggcctttagttaatgtattggtaagatatgaaggagaagtatcctatagtcctaggattagtctcagttttttggtgagcttgtgccgctcacctgtgaacttcacaagcgcttctcagggttttttttctccgtttggtgggacaggatggctggagggggctgggcttgtgtatttcccttcccacaggtgaaagactaaaggtcctggggttgcgtatttcccctccccaaggtaggcgaggatctaatataacctcagaagtttaggctgcggtaaaataatttcttctgaggacaggcctttttaagaagaacagaatgctctggcatattccaaaatggttcatttttcccactccctaccagaaacacaaggagatttttctccaacatttactgtgaggacctggtggagatcctggaggtaaaactcacaaaggtgtagagcacccgctccatgactgcatccccctggagtttatatccatgtataaactccagcaattcatcagttagtccttacatcttcctatcctggcaaaggttcctgcagaggtttctgctctgatatgccgtgtctgcctgtctgtctctccaattttttggacaatgagttgtcctgtgacctcattcctctgatggatctaaaaacaactgttgattcttcagtttgttcagcctttttcttcttgtttagatgaaataaagactcctaagctgcttacatgccagaccagaaactggaagtcttgcttgtacctgtttaatggttcctccatttctttccttgtcaccagatagctgtggtcacttctcgccgtgagcagtgtgcccacctctagttgaccctccacacgctttctagtgtgtgctgtggacaggaaagctagtaaccgagtttgttagagctgtgtgtaaaataaaagtaaaaaggctctgaagaaacatctcggagacctccgatgagtaacatgcattagcttctgagcaccttttgtgtgtcaggcattttggctgctcagagctctcagtcttgctctgctctgcactgcagggtagctgaattgagggaggtaagttctgcatggtgaaatcaagagcgatttcaacttccaggagggaaggcaactgctatactcaaaaatccttctcttttgaaaaattaagaggactgattacattatatcactttgagcaggttcttatgaagtaaatagaggcaagattaacaatctctgggtctcaggaaacagtgagtaacttgggaagattatatagaggctactggaagaaatataccagcttcataatttatagttcccatttattgaataacagaaatgtgccaggcattgttctaaaagcttttcaagaagtacttaatttttataaacacagtaaggtagatattctaatgaaatcacctaataaaatcaccattttattaggttggtgcaaaaataattacagtttttcccatacttttaatggcaaaaccacagttacttttgcaccaacctaatagaaacaaggagacttgcccaaggtcgtgcatcaattaagtgcctcaaattgaacccaggtctgcagaatctgaatttgtgcttttaggcattttcatttaattccacacttgttaattcttcatcagcagcagcattaatcagagtgtggtgttttccatccttataaggtcctgtctccttgtttacccaccccttcttggattatacgattatacagacacagcactctttttcatgatgctccaaccctaaaggtgagtggaaagcacaggagtctgtaactcccctggacccagaatcaaactgaaatgagatggtttgatttggagtcaggattaacgtggcccaattgagaagtcaagtaaaacctggggggagattaagccaagaaaggagatgccagctctctgccttccttgccagatggcaggtgtgtgtatgtgtttatataatcaatgcccacacatccggctgtgacttctcactcagagttatatgaacattgcaggggttcacaaactgtctggagatctaattaccagtttcataagcccaacagagtgccagccacagaaagcagccaggagagggaaggaggaggggtgcaagtgctgagcaaggccacgttgttattaaatgctacattcagcacctgtgccatgggctgagcctgccagtctccaagggaaagctgccaagcccaaaggcactgccaagctcaaaggcactctcaggcggtgagcctcttccaggaagccggtctccagaccatcactggcagaaagtcccatgctattcataagaacccttccctgaataagaatggcagactctactccccatgccagatgtccccagagggaagactcactaactggtcatcttatcatcattgtttgtagaccagaggcccttggtctccctccccacagtgatttctgagtgttgccattttagaagcagagacactgatgttctggggtccccacttaccctggcaaaggtccggaagccctggaggatgggtctgtagcctgtgcagcggcacagatttcctgtgggccaaggaaaaaactgcaatgtcagtgcagggccctgggatgggtgaggagtttgtgactttgcttgcaactaagttgggtgctctctttaccaggctgcatattctgttacctctgtctggaaggcctcttggccttctcatatcctgacttcagaaaagttatcatgatttcaggaagtctttcctagaatggaagccttcctagaatgcccagactgagtcaggtacctctcctaagtgctcccacagtggctgatcacagcttcatcagttagcctatcagactacattacaaactctcctcttcagagtatgaactttttgagagtagagggtgtgtcttttatccctgtggcataggatgtgactaaaataactgaataaatgatggaaatggtgaatagatggggaggcttctctattcaattcagagaagcagacacattggtggtcttggccctgcagaatcctgttctggtgaaaactgagagggaaggaaatcatatcactagcccccgtggagttttctaaatgacgtcttcctgcaccagccatgcactgccaaccccactccaatactggtggaaggcagacagacacctcagaaatatggacacaaaggcaggagaccccaggaggtctccacaccaaccaggagttctcccaagtaagagagggttggctttctagcagatcttagtcaccaccttgttggggggcctgagcccttcctccaaagggtagtccctcatgcttctcaccctggcacttgccctgacctctgcagggcctcgtttgccattccacctcctaggctgtgcctgaaggcccataccttggaaggcattctcaatctcctccatggtgggctcgggctgattccggagcagtgtgtacatactcatgacgatgccaggggtgcagaacccgcactgggagccgtggcttttggcaattctctcctaaaagatacagatgacatagacacctgggatggcagaaccctcccaggctccccaaaggactcgactggagccagcacatgttgagagatagtgggggtagtaatcactgcacagagtcaagccccagtgccaccatttaccaactgtgaccttggccagtttccaagccctctgagtctaggttcttcatctgtatgatgaggaccatccttgtagttacctctagagctgcgatgaggattaactgagatattcatgtaaaacccttaacactgtacctgcatatagcaggcagtcagccagtgttagctatgactaggaaggtcccttcaaagaacagtgactatcataaccagaaggcagcttctgaatggattgggtgtggcatatgacagaaacagtcaaaggtgatgtctagatttttgtcttgagcaattgggtggatggctttgccattgactcagatgggagaagactggggaaggaagccattaggaaaagagtagggttttcttaagtttgagattagacatccgtattgagatgtcaaataggcaattggaaatgtaacttctgaggggaggtcaaagctgaagttgtaaatgagagtatagggatgaagaaggggaggggcccaggtcagggctcagggcactgcagcaattagagactgagcagaggaggagcaagtgtggggagagaaggaaaagccagaaccacagtgtcacagaaaccaagagaaaacaaataaatggacaagaagtggaatctggctctgaagcctatttgtagccaaaataagttgattaggaataagaacctgtaccattggatagggaggattttaggttgattatacagatacaacctaatttggtttggctgtgtcctcaccccaatctcatcttgaattgtagcccccataattcccatgtgttgcgagagggaccctgtgggagataactgaatcatgggggtggttcccccatcctgttctcatggtagtgaataaatctgacgaaatctgaagggtttctgttttcacttagctctcatttctcttgtctgccaccatgtaagatgtgcttttcaccttctgccatgattgtgaggcctccccagccatgtggaactgaatccattaaacttctctttctttgtaaattacccagtcttggttatgtctttatcagcagtgtgagaatagactaatacttgactcctatgtttaaactgtttattctttctttcatctgtttgtttcaaagaaaataacaagccttaattaaccctctcacgtctccttcaggttggacaagtttagtaatttcccctcttcctgcctaagaaacaaatctatagatgggaagcaatcccaccccgacctggctggcctcacatgactggcccaagatgccactccaaggaatagtaccagcctctccgcaggaggctccagctccatcgcctgaatgacatgtctcctcaaataatcaagggaggattaagacctgggccaagctctggtaacttcttttttttttttttttttttgagatggagtctcactctgtcgcccaggctggagtccagtggcacgatctcggctcactgcaagctccatctcccaggttcacgccattctcctgcctcagcctcctgagtatctgggactacaggcgcccgccactccgcctggctaattttttggtatttttagtagagatggggtttcaccatgttagccaggatagtctcgatctcccaaagaccccaagtttcctcaaacaaaatgctttggggacaatggccgttccttccaacagggctctactcccctttctttccactcagcctaacagcatcctgattgtctccccaaaccagtctaagattattactgcccatttgccccagaaatgtttcggatttcaatgcattttcaggtggtctgataccatcaaggagaaagccttgctcaggcactaaatctctgtcatcttatttagcacttgctaacctccagtctaatgaaagaggaggcctagcagtttacatttgtactatctgcgggtgggaggtaaggggtgcagaattaccattgcagggagtaagtgggcttataaacaaggggcacagataattaaaattcaaatctgggaaggctgggagtttcctaaacacactccagaacaaagtgaggaagctcttctgcatcccttcctccaagttctggactggtctagccaccagattcagttggcctcttgggtcccttcagatcatgcaatgttataaccaaccagctcacaggaaggagcttcaggcttgggtgtttcttcttttcacctcacggtacccagaggagatggggaggtggccagggtgaaatgccttcttagattaagcagtgaaactcttcccaacaacccaaagcaagtctgcaactttggcatgagcctccctgcagaggaaagagcctgatctcaagagcacagctccctttcctctgtttacctgcacaggatgcagcctcgtcttggtgcttcctattccttccacagttgtcactgcaacatggtgcaaggagcagatgggggccaggcaggcattggcagaaaagtggctagaaccccagattaaggtcattccatttattgtccactcagatcatcagaatgggcctgactgtgagctctggaggactttgtgaggctttatgttacgtctctccgctcccatttatgttcttgtctcttctaccagtgtcctcacctctccactgaagactctgggaaaggaacaaaggaagctctccttataggtaaagctgagcccctccagagtactgtgggatcaggcatcagagcatcctcagcctctgagcaggagcaacggagccagggtcactttcagtcacctcttactcagcctgacccaggaggctgagtcaagaggaaatttctctggcaggctgcagccttaaagcatgctcctgcctgcagggctgttccttagcttccaatcactttgcttccctgcatttcctcgcctctattgctttcatttctctgtggggaaagggggaggaaacccccaggcaacatgagacagcaagcccttagctagaacttccttgcattcttctgttattcatcactcattcacttacattcagcatcagttattgagtgccagacataagtcaggcactctgctgagggctgggaaaataaagatgaataagatgaaagctctgcccttcaacagactgcagtcaactgagaaaaccaaagtccatatgaaggtgcaatttaaatcttgttaaagtaaattaaaaaggagaccaggcctgaagactcagcagaggaaaccagttaggcctcacaagtgacctaaactgtgcttgatttgcagcagagtcttaacttgagctacttcttacgaatatctttatattaaaaaaaagccttacgatcaaccaatcagaagtagtcaacaaacttataactatagtactagggactttccagtgggatagaccaagtaaggcaattgtataattgtaaccaatcaaataatttctttgctttttgcctgtgtccatcctacaaaaacctcctgcttgcatttccctggtggagctcctgaactgcttctaatgtggagctgcttgagctcatgaactgttgttttctcaaataaactgtaaaaattgtatcatgcctgagtttacattgggaatgctgtgcacagggcactatgggaccagcacagtcaaggggcacctaacccagtcttgagagatccaggatggcttcctggagggggtgatatttttgcccagttgtaaagagctagtaagagttagtcagatagagaaatcctaggagaacttcccagcttaaacaaagaccaagcaattagtgggcctgtgtcattggtatttcacaattatctctgcttgaatggagtgctgggcccatggtgagaaagaaaactggagaagaaacctggggcatactgtgcagggccttgcccgctaagcaaagagattttgtcctgggggcaatgaagagctattgaagggctttatggaatgtgatataaatgtggattttagaaaagtcattttatcagcagttcggagcctggtcaatattataagcctagaagatacttgctaagagatcattctacagttttcctgtgcacagattctccataaaaacaggggctcacacatgcgcacatgcacatacacacatacactcatgcactccctcacaagctggtcctgcatcgcagcccccatgtgggtggtcagccagcaggcaaaggatacacgatcttgttctgcagacgatcatacttggagagcatcactgtgcaagccccgcagcccccctctccacagccgagcttggttccactcagccccactgggtggtcaagagttaaggagaatgaactcagggagaggagtctgctgggttgctaggaaatgcctgggcagagctgtgggcagagccattcattcccacacgtgctcaggcccctcaaccaaggaaggcagcaggcccactggcctccttattcagaggggctgcactgcaccctagggaggcagggaacacggccatctccactgcacagaagagcaaaggcatcagaaccccatggacagcacccaagtagcatctcttgggacatgagttctaggactggtcagtcctagagccttctcttgggttgaggtcttctatgtgtgagcaggtaaatcatacacctgagcatacggggcagttctcacatcactcccagctgggcacaccatgaagccacttgggccagaatgagacattgatctgttctgggacctctgagtccttgcttttcactctgaactttttgggctgataagtccccaagaatcaaaattagggctagaccagaggcttttgaatatttggtccaaaagatatgtgaatggaaattaaaatagagtggtttttttaggtctgggtccaatattgggcctcactcttacatatacttgcagaaagaccatctgctactttgagttttaaaagtgcctaactggtaagctattctagagaacagctattgtggaggtcactttccctgagtcacatggctgcttctccctcagacctgcaggcctctaagccacccactacctactgaagatggagggaactgaggatataatcgcctggtcacttctctcattttcaagacaaaatttaaaaacaatgatataacatcttatttttgaaaagcactttcacctagatacctgtttgacctccagaatgatttggttagcaggtaggaaagaaacttcctcacagatttaaaaaaaacaacaaactgagacccaagaggtaacgtgggccacacaagatgacacaggaacacgttaccctgccggtgtggccccatcacagccatcggactccagactgggtgagctcccttcatcacgctccttcctccccagcacacctgggaaggttttctgtgtcctagtcaggatatatgcagctctcagcaggtcaaacaactttgggggcacctgaagacgaatggtggcacctgaagatgaatggtggcagtacaaagtctagcaaggtcttcttccagcctggagacctttctggaagctagtgtaaaagtcaaggctggagttttctcccccatctggaactcccataaattgactctcagcacagatagccataagctgcaaggtcatcctacttatgtgccaactttcagttttgcatttcatttaagatgtgacacagccaattgctgataaggaatttctgaggcttctgggccttcaaaactacaatggaaatgattaaaaaattaaaatttgttttattattagaaagctaaaattgatctcaataatctctgagaatgagcttctcttcccagacctcccaggtagatgggctgtaaatggagttccatgcaatcacctgatccgatctagtgacactttcactccccagcaccaccaggtttatcttctgtgaacctccagatacacccacttaaggtaaaaaatccagaacaaagtacaccaaagccaaccactgtactgtctgataggaggggagcaaaccagagtgaaagcatgggctccagtctcacttctgtgcgtgttataataatctttgctgtccccaaatatgtcactggaaagacccactagacacccccgctaggagaaggagggttttgttgacagaggtcaggatgagcacagtcctgctcacaggccccctggagagttgccagtgcgggtgagaggttgggaacacagctctaggctttggtgcaatctccatcactatttccccagaacacactagcaaaaggcaggtcacttcacatatcaaggcctcagttcctcctctgtgaaaagggagtgttacgcttccatgggattcctgtggagattgaggtgagctgcacaaatcactttgaatcctgcctgtatataggaagtgctcattaaatattaactccaattattattatcgttttagttccagggtcccagaatacttccgatactcagaactaaaggtaaaggggcttttccagaagccccacccacactgagtgaagagcagcaccccagtctttctaaggagtccccccaccctccagggctccctgtttgctgtttctacaatgaatgctacctgtataggattcttacctcacgcatccttttcccaatagacacatgttcccttgcttccctccacctaggcagagctggaaacattccccaggaactccatttatgtattaagcaaatgtcacctaaggaaggcccccctcttcccacagaggaatgaccatgaagctcaccaaggctaatgaggacctttctacaggccctggattaaaccttggcattactagagtcttagcggggagacacctcgaagatcaccacaaacaatcctctcattcagtagctgagaatttcagattacaggtgcaactaaaatgcaagtgtcccaagtcctaatccagtgctctttcctccacacctcaaggccaccccaccagtcactaggaaacaatgtaaggcctacagaatcagtcaccattgccccccttctccgtcactcccactccaaagtcaggatacactttcttctcaggtaggccaaaagggttgtctctggatctgcatttttctccaccacctattaaaataaatgaaagaaaaatatatcataggtatacttagtcatctttctgcaattaatttcttccttcagtgtctcactcaataatttgtagagttagtaggaagtgtgatatagtttgcactctgcccctctaaatctcatgtttaattgtaatccccagtgttgaaggtggggcctagtgggaagcaatatgatcatgggggcagatttctcatgaatggcttagtgccatccccttagttgtgaattagttgtcacgagatatttaaaagtatgtggcatcacccccttctctctctctcttgctcttactggccatgtgatgtgcctgctcccactttgccttctgccatgagtaaaaactcctggaggcctccccagaagccaagcacatgctggtgtcatgcttgtacagcctgcagaactgtgagccaactaaatctcttttcttataattacccagcctcaggtgtttctttatagcaatgcatgaatggcctaatacaatgtgctaaatagatcatgaaaactaaggtatttttatggcaactccataagaatgaacctataaactacagccagacaatgtatatactcaaatccttaaattctaaaattgtacctcaatgctcaccttgggacccaccacagaacatgcaggcattgcaccttccacgctggctcgaccaaggccaaatccccttcaaataaaacctgtcatctcatttcaactgctagatcacacctgtgaatttcaggggcatctgagagcatggcatgcagatctcggactttgcctctttgagtatacaatctcagatcctgcatgtgactgtggaaggccattctgttggcctgtgctcagagcagagtgttggcatgtgatgcgtattagtcaacactaatacatgtcagaaatgaaagagaaatctcaaaccaaagatccatcactaggttcaataaggtggaaaaagtggtctagaaagtgcgatgtcagttcccactgtgaattgtcaaaggaaatctacaaaaaccgatttcagtactcttcacacattaccaaagcttaaaagggtgtatattattgggataataaagagaaagaattcatgataaggttttcgttggagggaactatactacccacaccttcctaaaggagaaggggaggaatatttgcctcccacctcaaacttagtgagggagcttgctttgtgctacataaaaatctaacatgccacctttgcagcataggggaagagataggcttaacaagaaattaataccgacaatgacaagtttaaactcctcattaaacttaagttggagaggtggctgtgctggggttggtatacactcccggagcttggtagagcagaggatgtggaagtgtcgcctatggatgtaatgcaagccattcatgagataaaaagagctggcttggaggtctttaaatcatttcccaaaatacaggatagagcattcaataaagagagactgtgtggagtggacttccccaaactggaggctgatggagaacagcagcctgagaaaagtgcatcactcatatcatgagacatgcatgcaaatattccctgtggtggcccttgaagatccttgaaagccatcacaagaagaatgaaaggtcagctccaaacacctaaaaggctcagaaagccggaagccatcttacaatagtaccaattaaaggagagctttcttgctatcctcaccccgccgtcctgaattgagactgtttggcaacttaaaaataaccataagattttttattgactaagagtaataaaaagttcatgaaactgccagaatttgtcctttgaataaagtttaaaggaaagtagatgaaattaattttcttatgtgattacaccccatgagtccagcttattcaatatcctggttacaaatcatagaagtaatcataaatgcacaaaatagcaatctttatcacctttcttgtagacaacattaagagcctcttagcttaccaccacattgttcatttctcccgtactgcagttctgcttttatcacatcacatcagttccctgctcagtgcttttcatgaccacccacatattcaaggtaacatccaagttccttaggctgtctttcaaggcccttttcaatatattcccaatcttcattttcagcctttctcccttctacttccctgccaagctggtcatcttagtgcactaaaaatacattttatatcttctaattcctgtgcctttgactatgccattcctcttccacctgcattttgacttatcagaagacttcaaacaatttcttcataaaggctttccttatcactccagccacaagtggattgctatagagaatgactgtgccactctcaaggtgtgacagcaggattaccatggtgcactccattgaacactctcaacaggataccaatgggtatcccaaaggaaaaacattttgtagggaagtgagttaaggaaatgttgggttaagcagattgctctggtaaaacttgagcatcaaaagaaataacagccataatgggctataatacattaaatacaattaaaacctatgagtccaaatagagtcaacaaacaaacaaatggaagatatggaaaagctcttcctggcagaagaatgtcatctaataaatatgattggccatcttgtaatcaacacaattgatccagttaagaatcatcaatggaaattagtacagccactatggagaacagtttgaagtttcccccaaaaattaagaatggagctaccatatgatccagcaatcccactgctgggtatatacacaaaagaaaggaagtcagtatataaaacagatacctgcactcctatgttttttgcagcattattcacaacagccaacatttggaagcaacctaagcgtccgtgaacagatgaatggataaagaaaatgtggtacacatacacactggagtgctatttagccataaaaaagaacgagatcctgtcatttgcaacaacatggatggatggagctggaggtcattacgttaagtgaaataagtcaggtacagaaagacaaacttcacatgttctcactgatttgtgggagctaaaaatcaaaacaattgaactcatggagatagagtagaaggatggtatcagaggctggaaagggtagtagggggtaagaggaaagtagggatggctaataggtacaaaaaaatagaaagaatgaaaaagacctagtgttggataacacaacagaataactacagtcaataataatttaactgtacatttaaaaataactaaaaaagtataattagatcatttgtaacacaaaggataaatgcttgaggagatgaataccacattttctatcatgtaattattacacattgcatgcctatatcaaagtatctcatgtaccccataaatatgtagatctactatgtacccccaaaaattaaaaattaaaggtctttccatctccccttcttctcttttcttctggtttttatgtaaatgttgcaatgagccatcagtgactatgagatcaagtgtaatacagaactcctaaaactcaacaactataaaacccaattcaaaaatgggcaaaggacttgaatagacatttctccaaagatctacaaatggccagcaaataaatgaaaagatgctgaacatcactaatcagaactataatgagatttcacctcatacccattaggatagctatgatcaacgaacaaacaaataaacagaaaataactgtttgcaaggacgtggagaaactggaacacctgtccactgttgatgggaatgcaaaatgatacagccactgtggaaaaataagtaggacagttccacaaaaaagtaaaaatagaaccagcatatgatccagcaattccacttctggatttatacccaaaataattgaagtcagggtctcagatatttatacacctgagttcatgacaacgttattcacagtagccaaactgtgaaagcaaccaaaatgtccatcaatagatgaatggataagcaaaatgtgatacatccatacaatggaatattattcaacctgagaaaggaaggaatttttgacatatgctacaacataggtgaacattatgctaaatgaaataagccagtcacaaaaagacatactgtatgattccccttaagtgaggtagtttagtcaaattcatagagacagaaaaaatgatggtttccagggactgggagaaaggtagaatagggagttattatttagtaaatttatagagtttgtcttaaaagatgaaagaagttatggaggtggacggtgatgatggttgcccaatattatgaatgtatgtaataccactgaactgtacacataaaaatgattaagatggtaaattttatgtattttaccacaataaaaattatttaaaaaaagaatatcaatggatactcaaattagtgggtgaaaatttgatgaacaagaatttgtatcattccaaattatcttctcacatagcctctattaattataaaggtaaagaaaagttaccttacagtgaagaaacgtggtggataacaccttagccaagtcaccaaagttcgcatcacaaaaaagacccaaaaactgacgttaaaaaaacaaacataatgacagaatgcagtgagaaaaacacattacttctgtggtattcctgccccccaaatgcagactctgaatctaattacaagaaagcataatacaattcaatgtgaggaacattctaaaaaaaaactggcctgttcttttcagaaacaccaatgtcatgaaaggaaagctgaggagctgttctagattagaggagactaaagacatggcaaccaactgcaaggcgtaatcttggattccgggctggggttggggagttataaatgccagtattgggaaaattggaatacatttgcataaagtttatagtattacaccaaagctaagtttcttgatttctataaatggactacagttttgtaagaatatatttattctggccaggcgcggtggctcacgcctgtaataccagcactttgggaggccgaggtgggtggatcacaggtcaggagttcaacatcagcctggccaagatggtagaaccccaactctactaaaaatacaaaaacttagccaggcacggtggtgggcgcctgtaatcccagctactcaggaggctgaggcagacaattgcttgaacccaggcggcaaggttgcagtgagccgagatcgcgccactgcactccagcctgggcgacacagtgaaaccctgtctcaggaaaaaaaaaaaaaaaaagaatatatttattcttaggataagagctaaaggaacatgatgtctgaaacttactgtcaaaaggttcagaaatctatcttatactatatattcatttatattaattatgtacattaatatatagaattatttacgtacttataatacatacatgtgtatctgtgtgtgtgtccagagtgagaaagagagaataataaagcaaatgtggcaaaacattaacagttggtaaagtacataaagggtatttagtatttccttgtattcttcttgcagtttttctttaaatataaaataattgtaaaatacaaagttagagaagtaatttatttactacaggatttctcaaagttttaaaaattcatccacttattccatccacactagttggacacctactgtataccatgcactgtgctaagtggtttaagaatatccaagaagagcatctcatgctgctagttttctgtgaaatacatttcagaaggtattactttgtctaattataatccatctctctaactagtatatgggctccagaatggcaaatgcctgatcttggagatcttattcccccagtgcatatcctgttgtctgaggcctcagaaggagcttgataaatgttgactatatggggagtgagcaagtgaatgatgagtaagtgagtgagtgagtgagtgagtgagtgaaagtcaccgtgacgatctctgtagctgacactcacttcttgtggggatcactcctggacacctttggctgcacccaacctgccagatcctcccagattcttccaggtgccacagtctcagctagacagagtgactactcagaaaagctagaatgctgccttgcaaaaaggctgtcattacaataaaaataaaatactggacagctctttccctttgactctgactctagaacaaaagaagatgtgaatgaaaacaatagtcatcaaggctcatcaccaccacagaaggccctagaggtattcgacttcttgcatcgaacaccttctgcaggaccccatttagtgaagccagagtcctggacagtggtacaaaacaaggagaggagtaggctcacatttaaaaaccaaacactgcatgttctcactcataggtaggaattgaacaatgagaacacttggacacaggaaggggaacatcacacaccggggcctgtcgtggggtggggggagaggggagggatagcattaggagatatacctaatgtaaatgacgagttaatgggtgcagcaaaccaacatggcacatgtgtacatatgtaacaagcctgcacgttgtccacatgtaccctagaacttaaagtataataataaaaaaaaagagtcactaagttcttacagcttctttggtaactactttgcacaattcctgtaacaaaaggtctagaatatcttctgaataaaaatgaggacaactttctcacagctgccattgtttacccaggaattcccttgcttggtcttgtttttacagcattgctttcacataattactttctgcattgcccctctacctttcttgcagtttctgaagatgctacatcattataaattacaaacatggatattcatcacagaaactggcagtagtagaagcttctagaaataataggatttgatgtgatggtaccatcgaaaaatttaaaattactctcctaaagtgaaagtaaaatgcaagggaaaataattttccccaagccagatttaccttgaaattcttctttctagatttagtgcataacagcaagccatccctgaagaagagcagaaacttatacttttacaggttaaccaatggtttggtttaataaataataaaacctcagagtaagacatgaccttggacgtcattgaatctagctgtttacccaatgtaaaaattactaataaaaattccagagatggctttgtgtaagtagctctcctagaaagccaattgcacaatggtttcctagatttctacaatgtaattgctgaaggaaagaagttgtttgaaatgctggatgcaaaatcttacacttgaaagctttgccctacttcttgggttggtaccaggtgccaaccctgaaaaggatgcagctcagagaggaaactctgaacccagaagaacatggctgtccccattccccagcacttcccaaaggcaccactcaaagagagtccatcaatctttggagcactgacgttgaaacagttcatgaaatttcttttacagtcacccaaacacatcctggaaatttaagacctaggagtccagtgaagcacattattgttcttgaaaattataccaaaagtcactcaaaattacatcaaaagtttctcaactcaatgcaaaaatgccaatatagaaagacaaataaaattgcccttctttgggggacactttgggcacattcatcacgcacagtccacacagtaagttacaatgtgcaactatgggactcttttactatccttttcattcctaagtgggaagttgaacaggtatgagcatctcagcagtgttgtaggagggcaaatggaggctagtgaccatgtaatatgcttgccccctctctctctgcaccacattaaaatttgcaaagattctcactcttgtccaagggctggtacccatgtcaccttccctaagtccctgtgtaccaataaggtaaattcaagtaggtaacagatttgcagcttacatgtagaactcactgtgtgtgggtggggagtggggggaatgcaggagatgccctttatgaaaaaaaaattgtggtttgccacaaggtgtcagtatatgtcacctcacagtgaatcaggactggctgttaaacctatatatataatatattagaatcaaaggctgcgtacatcttatatcctgataaaagcaggaaaacacattcctgttccttctctctgtaaagagagcaacgtaaattttaggatatatttgattaaagacagaaatagaagtgtggtgatgacctcaaatctcacctagaactcaactcccctttctcattctgtgccaatctccactactgcagagagttggcagctagctcacagatgcctctctgcttgcctctctctccctcattctttggcctctgagtatcttgtctgtgctctagccccgagaaggtcttcttccctaatgttaccaaaatgcagcgacacctttaaagcgagagagagaaagacagaacaagtaagaggggacaggaaagacagagaacaagatatggctctgccagaggacacatttcccctcccagggagaagggacacaaaaccaaaggtcagctcctacttacctttctgccattcacaaagaaaaccaatttgtctgctgtcattgtcacaggttggggtccccgaactccaggtacctcactcctaagagacactggcaggtagttatcactgctctgtgac

SEQ ID NO: 478 - DNA, 56385 bp, Homo sapiens
catgatttaaaggtatttaatgaacaacaaaaacacttatttatatgattgcaatttgcatttttcagtaatctacatcatcctcagacctttcaagtttcctatgtgacttatatagtgagtttctgtgcttagtaccactggtgctcatttgtcaaaacagtttgctaaatattgacaatgcattccgcaaacataggcctgagaagacaaatatttccatgtattccaattacaagcgttcggccccttccttagagagtccatatctcagcactcatgctggggtgaccccttcacaagagtttgcaaactcaaatgcttactagctacgtagttccagttctggtgtggaaatgtgggctctgtatgttcagatcctccaactttttaaatgaaactagaatgctagagttttatgaaggaatctcctgatttttaagtttttgaaactttgtaaaaaaaaaaaaaactatatgtctgagccaaacaaaacaggttttctgcccagacgtgcccctctgtctgcaattttcagtctctgcctgcaggtcctttgagggaggcattcaggctgcccctaggagacaccttcttgaacaggtcctgagaactacaaggaagaagctccaggaaaggaaagttgcttggggcttctgctgtacttcatattgttgtggacatctggtggaggcaagcagcatgtaacctcatcattaattctctttgttttacactactcattatttggatattgccactagtttccaaaaacatgagagtttgcaatgtctattgtaaaactgttctctatcctcttagtagccatccagggtcatgttgttctctactctctcataagccacccaggttcatgcctttttgtttgtggttattaaaacctggccttcaagaatagccataccagttttccggggattgtgaaatcttctggaaaacagaggcactcatcaactaagacactgcacaaatttgaaatgaggtcaatgcatcagtatcttttcagcactatgaggagagggctcctgtattcaaggtctacctaataatttctcatctttcctaattaaccaagaaaaaggaagccatgactggggttttcatttgggagtgggtttgctctgggtctttgtggcttcagagtttaaatttctgctactctgttacatgtataaaatgcatacctttaataaggtctataagtactgccttcaagtcaaaaaattcttgattacagagttgtcctgcattgacagggagtgggtatgaagccacatgtacttggattgcccggtgaaagacataggagaagtttgtactttctcagagcaatagctaagaagcaactgtcgccatttggaaaagtggctttttgaagcttcagttggggatcaggataggggtccctggaagggtaggagtaaactctaagcagacaccactcagaatccccaggccagctggcagaacgccaggagacctactattacatatatacgggactattatatcatgaaaattacagtttcagcagcttgacagttttcatcagcattgtgggagctctgctcctttttaatttggttcctttaaaagatgaatggaataagggctttccgagatttggggtagtcctcaaacatcttgaggtagaacctaaaagacaagaaaggaataattgtaaatataatggagcagtggctgacagctgaggtttgctcttaccaaatctttgttacaagtcaacctacagttattttgggcctgactatttcgatggtcacttatgattcttatttctccttcccacagcctatttcttgtaaatgttgaagcttcttttgctgggaaatgaaaagtaacaggcagagggtagtggtgatggctgtgcaatattatgaatgtacctaatgccactgaattttacaattaaaaacggctaaagtggtaaaatttttgttacgtatatcctaccagaaaaaaaaatgtagtatctagaaggaggtacttgtttggattcagctgggaaatacagggaaccaaagactatgggcaaagagaaccagcaatgttcccaggaaaatatcccttcatgaggcctgggaatgccagcaaattgtcaccatgtatcatgggttgaattttgtctcgtcaaaagatatgttgaagtcctaacccccagtaactgagagggtaatttttttttttctgaaactaggaccattgcagataaaattaagatgaggtcataatggagcagggtgtgcccttaatccaatataactgtgtcctaaaaagaagaggagaagagacaaagagactgagacagagacacacaggagagaaggccatgtgaagacggaggcagagatcagagtgatgcagctataagccacggaacaccaagggttgccggccaccatcagaagctaaaaagaggcaaggaagaattcttccctagagccgtcacgggggcctggccctgcctacgcctcgatttcaaaattctagcctccagaactatgaaaggacaaatctgtgttgttttaagccgcccagtttgtggtaatgtattgcagcagccacaggagacgaatgcatcttataagaagcctgtctgcttaagttgccaggctgtcttcctaactagttgatgctggcggtcctcaaggcataatcaagatgacacactgtattaaagtaccttagtttgaattagggggcaaataataagttacaaaaggtggctggttttcggtactgtgatttgagaagtctggtgggctgcctccgcccgtgctgcctctgatgtgagtgcctggctttgttttatagaagccttcacaaagtcctgttagcctattaaaaactatgccttctggcccttctctgggaggtctgacatcacaggatgaggcctcaatttgggttttgttgttgcagcagctggaaacgtctggtggaattaccatccctcccctaaccaagcacagtagagtccctccttcccagggaccctccaagtgctgagtgatgccttctcttctcccattcccgctctgcctctggtgggcagcagacccagcctgaaatggtaagaactgttatgactcttttatgggctaggaaccctctgccacccctcctcacagagtctaggaggtggtaggaataggtcactagctgttgcttcattcatttcagaactgttgtcctcgaacaattctaatcagaaaaaaaggaactcattcttagttaaatcttcaaaactaggcattgagtcataaccccagggtcctggttccaagaccactcattccctgtttgagtatccatagtctccagtaattataggctttctctttccacaaaagccattttagggaaaggatctgacatttacacttggcaagttaaagcctgataacaacctaatatattacctttcacttccagcaatacttttagttaattcttttgtccccactccaccccaggttagtggattagtgaagctttaggccagaccttcagagggagggttctgaaacacctgcaatccctggcatttcccagcagatagggcagtcctaagattgccccatacatgggatttcttgtcctaccttccccagaatccagggttggccttggttatgatttatagagggtgggtgtcagggaaggaaggcagtaccaaaataaaccctggcattgcagagattccaggggaaataatccttctggagttccagggctctgtgattacctgaactgttagcaccaaatcttgttgccaaaaatagcagccacatagtcaccaagatagtactttttcccagtggttctctagcctgctgtgcctcagaacatctgtggaggccaggcgtgatggctttgcctgtaatcccagccctttgggaggccgaggcaggcagatcacttgaggtcaggagttcaaggacagcctggccaacatggtgaaacttgtctctactaaaaatgcaaaaagttagctgggcatggtggtgggcctgtagtctcagccatttggaaggctgaggtgggagaatcacttgaacctgggaggtgaaggctgcagtgaggcaagatcgccccattgcacttcagcctgggcatcagagtgagactccaactcaaaaataaataaataaataaataaataaataaatatctgtggagctttggaaagtgctggccatggtcccacctctggagcacacttccagaaatgtggtgggaggggatgaaactgaaggtggaaatggaagcggcttcttccgcttcttgaggctttatctaagcatctccaggtaagcctgcctggtgggcacagagcctgggtcagctaacccaagaaggtgcaaggcacttctcgctggacagccttcttcaacaagacaggcacaggaccttcccggccgtcacctcagttgcctctgtttacatggacttatgtttgttcttagaaaaaattttattactgctactctcatccagctaacttccaacttcaatacaagcccagcaagtcagaatatgctaacccagattatagtatcaaccttcccttaaaaaattaaatatcttcggtttctcaatcttcctctgcgggttaaaagcctgtttggagaagaagaaagctacgtgaatgctgccgcttttattgaaaaatttacctatggtggtgaaaagctcgcagcccaaggaaacaaagtgagaaaaatgcaaatgcaagtgctgggagggaccaagtggccagggcatagccgatccattcaatgatctcaccgaggaaattggctccagaaacatacgtaaacaagccacctgcgtgcagaagaatcggaaggtcaatcattgcaactgaatcattttgacattaaacccatctgtgttgttccaaaatacacaaaggcagcaagaacaaatgtggggctggaggctccctccatagtcataggagtttggtggaatcctcttggggagaaggggaaacaaagcaacaacagcctgttgcctggagaacattctggagttgcgaagagtggcctcaactgcttaacgggctctatccaaatctctaacaactgctggaccactagctttgggtaggataagggagaggtgtaggaggtctggtttttgttttgttctgttaaggaaggtttttgggccacctcttacctccccgctcctttcctggacacacacacgttcacattcacagtcccaaaatgtgaaactgcacactacattaaaataataaaaatctgaactcacgggagaaggaatttagattctcttatgggatttgcccctccccacccttctgcaaagcactctcctctgttcatgtttaaagcagagagtaggagctgcaggtatttgtcctgctgtaggctggtgaagtcggcttctagattttaaatgtttcattttctatccaaccaggtatttcttctctcaggactgtatctagaaatcagcatatttctaatgatattaaatatatccacactaaattttattacccacattaaactggggatgtttcaaccgaaacaattttgttctttctacagttacataaaaatactttgttttaaatcattctctattataattcaaaagttggaaactaatcttggcaactggttttcaagtgctttctctgctcttctttatttatctagttatggagtgaatgtttttaaaatcaaagccccttagagttgaatctttcttgaagatgagactgcgtcagtggttcccaacctgtgattccctacgccctgggaggaaccacggatctaaagcaaagggcctataaattttctatgaagacagtaaacggcacatcttaacctcctaaattatttttgtttgatgtagatactgttaggatattaacaacattcaaattcatttgaatctgttactgaattcatagtaactttgtcattaatttcttaatcaatgactattaatgtgcactaacatcatgtcataattgaggaaattttttgatgtaaataaagggttgtatttacatcaaaaacggtggaagccaaggacctacacaaatacccatctaaacctactgaaggatgacttggactgatttgctcccatctgcgtatatttgtcaatctcataccctggtttctttggagcagttaggattacaaacatgctcacctttatctccaaaaatgcacttgtgcttgtaaggcctcccatcctaagttttgattaagtaaatatagttctctacacctttaaaagtatatatgaatggcaggaaatacgcaagttctagccttaactgctcacaagataagtctagatcaattggaggggacacatttattggccaagcattcagcatcatttgcaacctagaaaggatcagccctctgtacatgacaaccttacctactgcaatgagggtgtaggtagccgattccaaccctactcaaatctcccactctctcccaccttccgggtattgcggtctcgcaccttcctgagggctctggtagctctctggagcttctgggttcagattagaaatgcagaggtactgtgatgggactgggtttgcaggggaagtcaagagcaagctgagaggtattgtatcattcgtgccctcactgtcccctctccatctgctaccatagcatcatccctgggacaggctccagggaagagtgagagtctgggggcaggggagacattaccttgtggaatcctgtagctgatttctccaggcttcctgagctggcgcaatatatagtcactatgaatgtttattcccattcccaaaataaataagaagacaccttgacaaagaagagagaaaggagaaattttttttaaatgtgtccagattgtggtgcttttttcacaaactaagctaaaatgaaaggaggggcatttaatttctaaatctaagaatggtcctaagacgtggcagaaagtggggagggcaatgagtcctggtcctgaatggggagcactgggtgtgctgtttcctagacttgggctgaaagtacacagtggcaccactgatggagacagattagaaaagagaggagagcaggaggtagcaccattgtccagtatttaaatagataaacaaacaaatgcatggatcataatagtaagcctttagctcattcacaaacagtcaaatcgaggtttcatatctcaacagctgattccagccccttttcttttgccatcccccactacagaggttgcactgagaaagggggtcacatgagctagttccaccaataagatgtaaagtgaagtcttggttgggggacttccttggaaatcgtttgcttttctgataaaaggtgcaggcaagaccggtgcccctacttcgtctttcttcctgtcttgattgccagatgtaatgccttgagctacagtcaacatcttgcaaccatgaagtgatgaataagaggaccacaggtaaacatgctaagaataggggagacacaaagtgcctgagttattaatggtgtcagtaagcaaccacaggaatgcagaagccacctacttcgacacttgttatgtaagaactatgaattctgaattattcccgtcactattatatggttttctgaacgcattcctgactgaaacacccactctcatgaaataacgtgagctagtttggaggcgtggccactaacaaactgacttccatcactgccagttcacacacacacacacacacacacacacacacacacacattctgacattaaaagtagcatactacacacactgttcacatttttatttatcttacttagccacatatcctggaggtgtctccacatgcactatccactggtacagaaagggccctgttctgaggtgaggacagccaggatcagggatgctagatcctgcatcccaaaaggcattattacagcccagaaacactcaccgtcccacaaagaggcccaacccaacctgtcagcaaagcactttggtgcttttcaaaataggcaaaaagcaagaacagtttagttgaaacaatcaagtctattctcaccttatttgatttgatataaaacaaggattttccaccttgcctagtcaaaagatcattagcctggaagaaagggtatctggggcaggggatggtaggggagcggggagggaagggggacagcacacacagcagtgtcttcaaccattttagatagggtggtcagggaaagtccctttgaggaggtgcaaattggtagggaactaaataaagtgaggaaccaacccccatgaatacatgggggcaaagccttctaggccaggcttgtccaacccacagcctgtgggccacatgcagcccaggacagttttggatgtggcctgacacaaattcgtacactttcttaaaacattgttttaagaaacaatgtttctttcagcttatcagctatcattggtgttagtgaattatatgtgtagcccaaggcaattcttctttttccaatgtggtccagggaagccaaaagactggacacccctgtactaggcagagggaacagtcctatacaaaaacactggggctggacaagcttgacagcttgtggcacagcaggaaggccactggcactggagcacagaaaaggaggtgcagggagccaggaaaagaggttgggaaattgaaaagaccaagaatatttaggatttaaaggcagtgggaaggaatttgtattttattttgagagtaaaggaaatctactggagagttttgcgatgggaaatggcatgatatgtgtttaaacaatctctctggctaccatatagagaaaagatcagggtagaggtgagggaggggaagatgggatcattacgaggtcattgcagtagggagaggccatggcgatgtagattgtgggaagggttgttagctgggaagtaggtgagaagtgggcagattcacttacccaagctaaaccgtatgtctgtgtaccacccatcagggtattcagcacagtaaatcagatagtagccttgaaggactccatttccagtgcagaaggcagtgcctctgagaatgagtatagctggataaggcctccctcgattgagcagtgagtacacaaatgtcctgggacacacagggaggaaaggttaggattcactgttaaaaaagaacatggtctcatccccacctctttcttaagctcacaccagaaggtacaaaaaccaggctctgccatttcgccttaacccaatacaaattatcttctccaggaggatgtatatcacaggccaaaataattacatacctgaaaagtacaaccactaagaaataatcaacaacatgtaatatataaataatttatgtaataaataatgaataacatgtaccatgcaaagtggaattatcatgacagaacaacaattttaaataagtacaataaatatccttaaagaaatgtttccttcaaggcagaaaaaaatacttgaaaaagaactaaataaaaataatttatcaaaaattataaagcctattagtgatagagtaagagcaaaatctaggtcttctgataatcctagttttctacattaaacctttctaattactcttgaattggcattttcaaaaagatgtactgtcactgtatgtgaatgagtgatagactcaaaaaagagaatccatagttaagtaagcttgggatctataacatcagacaagacctaatatttactcattgtggggtttcttcaagccatggcatactaaggatatgatgactctccgagaaggaacccctagtttggcacattcatcacagacttggagctccactccagaaaacactttcctaaacagggcagataatcctatacacacaattggatcttgaagctttgaaaactgatatttgattctgtaaattttatattcatttttctttctttgtctcttacacaaaaacacacacacatatgcatgcacacacacatgtacaaatgcacacgcacatgctcatgctagacaaccacacacatctccagagcattcatctgatcttttgcagacaagaaagagcagacaagatctgcagatttcacagataatcacagttgcattttggataggaacacccatccttcaaagtctgggaggtttgtcttagatttccttctcaaaaacaggaagtctaagaaatgccctgggcttcatgtcagggatgtgagtcaccattttttttacctggatcatatgtgagtgttgcctcctaaaattgctgtgaggatgaaattatctaatttgatgcttcctatgaagaagcacattttaaattatggagtgactggcaaaagtatgcagacaggtgttgcattatgtgtgagtcaattttttttttttttttgagatagagtctcattctgttgcccaggctggagtgcagtggcacgatctcggctcactgcaacctccacctccagggttcaagcaattctcctgcctcagcctcccaagcagctgggactacaggcacctgccaccatgcccagctaatttttgtatttttagtagagacagagtttcaccatattggccaggctggtctggaactcttgacctcgtgatccacctgcttcagcctcccaaagtgctgggattacaggcatgagccaccgcgcccagctgagccaaattttataaacataaaacatcaaggtggtattgaagacctgcactttcccccttggcaacagcagttccacatctttcctctcttggcttgaatatggacaattctgttggaacagggaggctgctcaagtgttctcaggatgctgaaacttctcacctctaccatctgctctcctggccagttaatggactatgaggatctttaattatttgtattaaaaagctgaaggggaaagaaaggttagtttcctgtgctgtctccctagaaactaaatgctgtctgctgtctccctctccccttcacacctggactcaggtctactatgtcgtctgcagaatgcctcccaccccacccaatcacaacagtgcctacaattcatgtcagtaaataattaccttctctgtttctcacctccttcaaaacacaaatacacacaacaagagaaaggaaattgagtctctaataccagagtgtgcataagtgaattagattcatgagttttacttccttccccagagggaaaaagaacagagtgaagatgtagtgggagagcaagggctccgtggttaaaaaggtcaggctcgaaggatttcactatttcataactctgtgatcttggacaaactccttcatctgtaaactgaggttaattattaaccttattggattatgaggctggactcattggactactgttttatgagaatcattggattcctacagaaattaaataagatgatgcaggaaaaagtaactgatacaggattgttgctatttgtttctccttgcattcacactccaggaaagctttgggagcctgaaggtgacttcttagaaggaaaggatcctgaaaggctacagaaaggtattttttaaaaagttgtatttttgtaatacttgcagtagaagtatgtattaatcagggcaggctcactactgtaacaaacaactacaaagtatcaaaagatcaacataataaaagctcatttcttgctcatgccacagtaagatgctattcaagcttctgctccacagccattcaggacccaggcccttccaaggaatcttctgcatctatccagcaggcaaaggaagagagaggacaaggaggattgtgtagaagattttcttaatgaccatgcttcaggctggaagtggcataaattccaccctcattcttttggccccacccaactgcaagggaggctgggaaatgcagctgattgggtttcccagcaggaaaaagaaggaggtttggtgaacacatggtacagacagaagactttggagaactagatgtcccggagaacaaataaagttcatctaatctgaataactttgctattggaaagctggaaatagttcaaagcttgtttcactgtagaaaaagacaaagacaatgacagaagcgggagagagtctattagcccaagaggctggcaattggtgctgtagagttgtaggtgagtttccccttcagatcccatgctccacctatggtctgagactcagtttccctggtttgggaccacatcactttaattacctcctacacctctaatgtaaattttcattcttttatgtttgttcttatagagagactgataagtactctgtaaatataaagtttttttatcattgctaagtaaatattcatttggggggattcattggaaagggttaactgaaattgcaaatccaaattaaaccaaagaaaagaagctttaaaattacacatcttgcatagaccaactcatatttaactaagtcttcttcaaatataaatgctattgctaagattatcaagccaattgaagacttttcactatatgaaattttagactcattgtcaatcaaaataaattcaaactctatagataaatacaaagtttccatgtatatatttaactgttctgtatagtaattacacctttcttgaccctgtaaccttgttcatctactactccattttcctgctttcctttatagcaactccagagagttgcttatgctcaccatctctgtcttctcctccacttctttcctccttccccctcctcccatggaaacaaatcttggtggggccaccagagaccatcacattcccaaacccaagaatcaatttacaactctcttcttatttgacaaattaatcactccctctttctggaaacactttctttactcaacttccagcacaccacactctcttggttcttctgcttcactgatctgttctcattttcctttgctggtttctcctcatcctcctgacctctaaatatgagagtgcccccagaactcaggactctttttcttctttatttacagtctctgtctatgtgatcacatctagacatatcattaaatatcattcatataatctgaatgtgttccccaaaatttgtgtgctggaaatttaatccccaatgcaacggtgctgaaaggtggggccttttaggaggtgtttaggtcatgagggctctgccaacatgaatggattaatgctgctataaataggacttgagggagtggatttgttcattcttgccctttcaccttctgccttcctccacgtgagaatacaccaagaaggagtccatcagatgctggcaccttggccttgtacatcccagcctctagaaccgtgtgaaatagatttctgctctttgtaaattacccagtctcaggtattcagttatagcagcgcaaaacagacaaaagcaattatctataggacagcaagtcccaaattgatatctccagacaggatatctgcagtccttaaactcagactcctgtgggcaacctcctactatgcccctagtttaatggatatttcaattttaacacagtcaaacccaaacctctgactccccattcttccccagacttgcacttccctcggtcttccccatctcagtaaatgccaagtttattcttccaattgcttaagccaaagatcttagaccatctttgatctctctctctctctcattctctcacaccccacataaaatctgttagcaatttctgtcatctttatctgcaaaatgttttcagaatctggccacatctcactaactccattattccatctgagtttaatctctcattaaacctctcccgggtatttgtaaaagcctcctcatttgaccaccacatttactccaccgcaatctattctccatatagcagaccaataaagctgtaaactggatcatattacttctctctgaaaacctccttcatgactaaatgaaagcccaaattcttgactgccttcaagaccctagacaatctgattccccaactacatctctgctctcttctaccacttttgtctttgtccatctcactgcagccactctgctcaaatgttagcttccctgaccaccttatgtaaaataaataacctccaatgcctccagcactcactagcctcataaatctactttactttttccagtagcattttttactaacatattctactttctgtgtttattgtccacctcttcccacaagaatgtatgcaccataaagagagaaatgttatctattttgttcatcactatatctgcaatgccttgaacagtgcctgggacacagcaggcctggaatgaattttgaatgaaagagagtctatcatgtgctataagtggcacacatcatacgcatgcagagcttcaaattttatctcactgtatatgcatcataacttttacttccaggggggtgtgaagtggagatgcttttccacattcctcctgctacatataattgagtctctggacgttatttaaaaagcaaacatgagaagattctaaaagttggagagaacaaggcatatgggctagaaaccttaggatttgaagaaaaacaaagcagtgtgttcctggattttcattttgcctcatatattccagatttagagccattgaagttggcaaccataaaatggaaccatcacagatcaaaaaggccaaacaaaatcttactttctctagccaaggaatgagaaaaagggaaaaaccagaaagacaaaaacttttagaatatagttgctttgttataacaaacaccacagaaaaactggctcactctcaccccactagcaaagtctgatggaagtgcagaagcctgtgcttcccccttaccaagctgttataggcactctaaccccttgccaggctgtgtcagaaaaggctgggtagggagtcaggaattcctactgggaagtaacaagctcatcccacttctccacagtgttagtagagacaacatggggagccaggatttcttaactccacatcctcctgctggcctgggtagtatcagagaagccctagtggagagttggaatattcaccgtttcccagtgacaacaaggccaccttccctcctccactgcattccatggtgtcagtggaaaccagttgggaggtgaaaggaaacattcccaactctctcagccaaacagatatcagtggaggactaacagggagccaaaaaccccaccgccacacaaaagtaacaaggagcctccacgttcaggtttcaaaatgtccaggtttcaatggaaaataacttaacataccaagaaccaagaaggtctcaaactgaatttttaaaaatcaatagatgccaatacactgtattatgtaattctaaatgtacgaagggggaatatttaagacaattatattataaatgaggaagaaaaatgtggcattacgggaagtatgttttctacactcaaactggtaaaatgacaacacttttaaactatgaaaaattgtgcatatataatttaacaccaagagcaatcactaaaaaactatatgaaagagattctcttgtatcaaatctaaggataaatcaaaatgaaattctaaaaaatattcatataatcaccaggaagcataaaaaaagaaaacacatagaaaaacagagagaacaaatataaaacaaaaaataaaatttcagacttaagcattaatacattaataaatccaataaatgtaaataattcaaatcattgtaaagacaagagttggctaaagacaattaaaagacaagagttgactaaaacataaccaaacaataggttgatgacaagaaactcactcaaatataacaatatagtcagggtaaacgtaataaaaaggggaaaagatgtatcataaaaacattaaataaaggaaggtagggagagcatcctggggaactgcaagagtaagaaacacgaggaatctgtctccctgcttaggcaataattgcactgacagagtatgtctgatataactgttttggaaatctggagtctattgaaggcttgcaactttcagggaaacatttggatggtacattgcagttaactttgatttcagctcagtcaattttagctcttagcacagtaacagctacccatttcctatccccacccctgtggcaggcagctgtgcatgtattcctgcagcagcttgttgcacacagcttgaaggagccaggataagcaaaatggaccctgtcctctaagtatcaggcatatgtgcttagattgatgattgctgcttctgatcagagaggtacagacaaagaggtggtgggtctttgctgttacaccttattccattgttgcaaacccctccccatccagctgaaatgacttccagagatttaaagggctggcaccctatttccactccctttttcatttttctctttttctccttttgggagccagatattaaagataaggacattcacaaacaactgaatatatggggaaaattagaaagttaacacacatgaccacagaaagatgcaagctcagagaataccagtaaagaccttatgtttacacctcaggctgatccttggcacagagacagactaaagcaatttttataaacaaacaaaacaataacaaaaagcaaacaaccttgaggaaaaagaagagtctgcatcccagagttaccacatcattaaattgaaatacccaactttcaacaaaaaaaaacacaaggcattcaaaaaaaaaagaggaaaatatagcccattcaaaggaaaaaatagtcaacagaaactgcccctgaaaaagacctaacagcagatctactcaaaaaagactttaaaataactgtcttgaagatactttaagaactggaaaagagggagggtggagcaagatggccaaactgaaccttgcaacaatgatccccactgcagaagacctatttaacaaactatctacacacacaaaaagcaccttcgtaaaaacaggaaatcagataagcaatcacagtacttggtttaacttcatattgctgaaagaggcactgaagaaggtaagaaacatagtcttgaattgccaatgatgcccctcccctatccctctggcagcagccacatagcacagagagacaatctgtaaacctgggaaatggacagtacagtgattgtggggctctgcattgaactcaatgctgccctgtcacaatggaaagtaaagctgggctaaactcagccaatgccaacacacacagggagcatatagatcagccctagccagaggggaatcacccatcccagcagctggaacttgaattttcacaagacttaccaccatgggcttaagtgctctgggatcctaaacaaacttgagaggcagtctaggccacaaggactgcaattcctgggcaagtcctagtgctgtgctgggcttagaatcagtgaacattggacaccagccagggtggctaaggaagtgcttgtgccattcctcctgcaacaccaggcaacacaactcacaacaaaatttactcccaccatctgcttaaggaaaggaaagcaaagagtaaagagggctttattttgtatcttagaagtgattattatgcactgcatgcctgtatcaaaatacttcatgtacctcatgaatatatacacctactacatacccaaaaaataaaatttaaaagcctaggcaacatagtgagacctcatctctattaaatttatttatttatttatccaggcatggatggcacacacctgtagtcctagctactcaagaggctaaggcagaaggatcacctgagccaaggaggttgaggctgcagtgagctaactgaaccatgtactacagcctggatgacagagcaagaacctgtctcaataaataaataaataaataaactaaaagtacatgtggatgaagtcaagaaaacaatgtataaaacaaaatgacaatacaaataaagattttgaaaacctaaaaagaacatctggagctaaaaattaaaataacagaaatgaaaaatttactagagggctttgagggaagatatgagtaggcaaaagaaagaatcagagaactcaaagataaggcaatggaaatcatcaagtctgaggaacaaaaagaaaacaaaattgaagaaaagtgagcagagcccaagagacctgtgagacatcatcaaggggctcaacatacacaccatgagagtcccagacaacgcagagagaaagaaaggagtagagagaatataggaagaaataatggtgaaaaattcttcgaatttgaaaaaagacatgaacataaacctccaagaagctcaattaactccaagtaagatgaattcatagatacccacatggatatacattataatcaaactttccaaatacaaaggcaaagagaaaatcttgaaagcagcaagagatagaaatgacttgtcacataccaagcatctgcaataagattatctacaaatttctcatcagaaattttagagataagaaggcagtgggctgatattttcaaagtgctaatataaaaaagaaactgtcaagcaagaacaccatatctggcaaaacttgaaagtgaggagaaacttaagacattcccagctaaacaaaagctgagatagcttgctgccctacatctgccatgccaaaactgttaaagggagtcctgcaggttaaaatgaaagcatactatacagtaactagaatctatataaagaaataaaaatatcaatgaaggtaaacatagggacattgtaaaaggtggtattattataacaatgtttcttgactttgtgttctgtacatgatttaagaaactaatactttttaaaaaaacaattattagtctaaaagttaatatcactgaaactatggtttctaactcattattttttccatagaagagtttaatgcatttcaaggaattatttatgttttgtgacacatgatatataaagttgcaattttgtgacattaacaatcaaagagagatgggaaggagctgttaaagtagcagagttttatgttattgaaattaagctggtttataagttagaatgttataaatttaggatgttaaatgtaattccaatggtaactgcaaagaaaatagctatagaatatatacaaaagggaacaagggatggggagttatacggtgtagagaaaacaaatataaaaattatagaagtaagttcctccttttcagtaatagcatacatgaaaatgtattaaactcttcaaccaatatagatgagcagaatggattttttaaatgatccaaatatatgctgtttacaagagactcactttagctccaaagacacaaataaattgaaagtggaaaaatggaagatgacatttcatgcaaatggaaatgaaaaaagagcagatgtggctgtactaacaggcaaaatggactttaaatttttttaaaaatggttacaagaaacaaaaaaagtacttaatcttaaaaggttcagtatagcaagaagatagaagacttatgagcatttatgcacctaatgacagaccatcaaaataaagacagtgaaaacttcagaattgaagtaaaaagagacatttctgcaataatagttaaagaattcaataccacactgtcaaaaatgaatagaataactagacagaatataagtaatgacatagagaacttaacacaataaaccaactagatctaacagaaatatacaaaacaactctgaccacaacaggataaagttagaaatcaataacaaaagtaaaactgaaaaatctataaatatgtgaaaattttaaaacacattctttaaaaaaattaatggatcaaaagagaaagcaaagggaaattagaaaatacttagatatgaatgaaaatgacaacataacatactaaaacttataggatgcagcaaaagtagtgttaagcatgaaatttgaaactacaaatgattatattaaaaacaaggaagatcctatatcagccaactaactttacaacttaaggagctagaaaagaataagctaaacccaaagctaccagaaagaaggaataattaagattagaacaaagatcaaagaaatcaagaatagaaaaacaagggtaaaaccaataaaaccaaatgctccttctttaaaaattttttttaaaaatgacaattctacacttagattgactaagaaaaatagagacaagactcatattactaaaatcataaataaaagtgggacattactacttattctatgggaataaaaagaattctaagacagcactatgaacaattgtaccccccaaaattggataacctacatgaaaaagttcagattcctagaaatactaaacctaccaagactaaatcataaagaaatagaaaatttgaaaagacttataactagtaaggagattacataagtaatcaaaaatcaaaatctcataatgaaaaaaaaagcccttgatctaacagtttcactggtgaattctaccaatagtagaaatacttctaccatttaaagaactaaccccaattgttctcaaacttttccaaaaaaaaaatgaagaggagagagaacacttcctgacttattctatgaggtcagcattattctgacaccaaatttagacacagacactatcagaaaagaaaattatagagcagtattttttatgaacatcaaagcaattttttaaacaaaatactagcaaaccaaattgagcagcatataaacagaattatagaccatgatcaagtaagacttaattctagaatgcaaggataactcaaaatacaaaaatcaatcagtgtaatccatagcgttgtcaggcttacagagggtaaaacacgtggtcaattaattgatgcagaaaaagcatttgaaaaattcactctttcatgataaaagcaccaaccaaactgagaatggaaggcaacttcctcaacataataaaatctgtatattaaaaacccaaagcaaacgtactcaaagatgaaagctcttcttttaaaatcaggaacaaggcaagggtgctgcttttgccatttctattcaacatagtgctagaagttttagccagagcaattagacaaggaaaagaaatcaaagagatacaaatcagaaagaaggaactaaaattatctctgcttacagatgatatgatcatgtgtctagaacactctaacgattccacatacatttttaaaaaactgttaatagacgaattaagcaaagtagcaggatagagagttgacacacaaaaatcagttgcatttctatacacttacaataaacaatatgaaaaggatattaagaaagtctcatttacgatagcatcaaaacaaataaaatacttaggaattaactaaagacgtgaaagacttgtacagtaaaaaattataaaatattgctgaaagaagttaaagaagaatataaaaatggaaaacattccatgttcatggactggaagacaatatttttcaaatgtccatactaccaacacaatctattgactcaatacaatccctatcaaaattccaatgacttttttttttcagaaataaaacagtccactataaaattcaaatggaatctcaagagacatcaaaaagccaaaacaattttgaaaaaggagaaaaaatattgaggactctcatttcctgatttcaaatcttactaaaaactatagtaatcaaagcaatatagtactggcatatagacaataaaagcctataaagacaaagacatgcaatctacctagatgcccattaatgaaggactggataaagaaaatatgttacatatacatcttggaatactatgcagccataaaaaattaaattatgtcctttgcagcaacatggatgcagctagaggcctttattcaaagccaaattaatacaggaacagaaaacaaatactgcacattctcacttataagtaggagctaaacgttgagtacacttgaacataaagacaaaaagaacagacactggggactaataaagtgggaagggtgagagggggctaagggctgaaaaactaccagttggctacaatgctcactaactgggtgatgggatcgtttgtacaccacacctcagcaacgtgcaacttacccatgtaataaacctgtacatgtgccccctcaactttattttaaagttaaaaaaaataaaaataggctgggcacagtggctcacacctgtaatcccagcactttgggaggccaaggagggcggatcacctgaggtcaggagttcaagaccagcctgaccaacatggagaaaccctgtctctactaaaaatacaaaaaagtagccaggcgtggtggcacatgcctgtaatcccagttactaggcagggtgaagcaggagaatcacttgaacctgggaggcagaggttgtggtgagccgagatggcgccattgcactccagcctgggcaacaagagtgaaactccatctcaaaaaataaaataaaataaaataaaaataaaaataaaagtctaaaaggcacatagacctgtgaaatacaatacagagtccagaaataaaccctaatatatatggttaaatgatttttgacaagggtgctatgatggttgattttggatgtgaccttgactggattaagggatacccagcagctgataaagtacaaattattctcaatgcttcagtagaaactgatcatgtctcccttctgtaaaagggaaacccaagtgatttagcatttgattctaatgattgggctaccccaggtgcatctgtgagggtgtttctggaagagattggcatttgagttggtggactgggtggagaagatctgccctcaatgtgggtgatggaataaaaatgtaaaggaaggacaaattcttgatctgtcttctggagccagaattcatttcttctacccttttcaagtgtacatgggctatataccatggtagattatatttgtatcatgagacaagttcagattctctggtctttggactttaggacttgcaccagcaattctccaggctctcgggctttcagtcctggactgagaattgcaacattggcttccatggttctaaggccatcagacttggaatgagccatgctaccagcttccctggcactccagcttacagatgatctgttatgaaacttctcagcctacataatcaagtgagtcaattcccctaataaatcctttcttatatctcccccgcctctctctacatagatagatagatagatagatatagatatagttagatagatacagatatagatatagatatatatctcctattaattctgtctctctgaagaaccctgattaaaacagatgtcaagaccattcagtggagaaagaacagtcttttcagcaaatcatgctgggaaaactggatatccatatgcaaaataaataaattagacccttacctaatactatatagaaaaattaactcaaaattgatcaaagacctaaatataagaaaaaaactataaaattcttaaaagaaaacgtaggacaaaagcatcatgatactgtatctggcagtgatttcttggatatgctaccaaaggtgcagccaacaaaagaaaaaacagaaaaactgaacttcatggagaatctttaaaattgtacatcaaagacactattaatagaggaaaagggcaacccacagaatgggagaaagtatttgcaaagcatatatctgacaagagattgacatccagaatatataaagcactcctaaaactcaacaacaacaacaaaaaattgggcaatggactcgaataaatgtctctccaaagaagctatgcaaatggcccataagaacctgaaaagatgctcaacatcactaatctttagggaaattaaaatcaaaactacaatgagataccatctccaaccaaaccaattaagatggctactattaagaaaacaaaaaataacaagtcttggcaaagatgtggagaaactggaacacttgtgccctgatagtagaaatgtaaaatggtgcagccactgaggaaaacaatatggtggttactcaaaaattaaaaatagaattactacatgacatagcaaatccacttctgaatatgcatctaaaagaactgaaaacagggtcttgaagcaatatttgtgcacacattgatagaagcattattcacaatagctaaaatgtggaagcaatcaagtgtctattgacagatgaataaatggataagcaaaatgtggtatatacttacaatggctttataaaggaagaaaattctaacacgtactataacatggatgaaccctgagagcaatgtgctaagtgaaataagccagtcacgagaagacaaattccatatgattcacttatatgaggtagttaaaagtagtcaaaagcatagaaacagaaagtagaatggtggcttccaggggctggaagtagagggaattattattattattattattattattattattattattattattatttaagatggagtctcactctgtcacccaggctggggtgcagtggcacaatctcggctcactgcaaccgccgcctcccaggtccaagcgattctgctgcctcagcctcccaagtagctgggactataggtgcccaccaccacaccagtctaattttttgtatttttagtagagagggggtttcaccatattagccaggttggtctcaatctcctgacctcatggtccacccgcctcggccttccaaagtgctgggattacaggcgtgaattattttcttactaggtacagagtttcagttttataagataaagagtcatgagctaaatagaagtgatggttgcacaacattaagaatgtatttaatgtcactcaaaatggttcaaatgttaagttctattatgtgtattttgccacaataaaaaataataaatgttaaaagtaaaaatgaagtagagttactatactaatttcagataaagtagactctgagcaaacaaaattaccagaattagagagggacattatataatgataaaatggtaagttaaccatgaagatatagaagtcttaaatgtgtgtgcatcaagcaacaaactggcaaattatatgaagcaaaaccagaaggaaaaataaatagatctactattaaagctgaaggcttcaacacccatttctaaaccatagataggaaaaccagaaaactaggaaaactagaaaatcagcaaagatataaaagaactcaacaacactatcaaccaacaagatataatcaacatttctattacacagcatcaaacaacagcagaatgcacattcttttcaagtggccatgggatatataccacagtagaccacatcttatatcataaggcaatcctagacaaatttttaaaaagtaaaattatacagaatatgtcacctggccataatagaaacaaaacagagatcagacataataataacaagaaattctccaaaacttagaaactaaacagcatacttttaaataattcatggatcaaagaccaagtctcaaggtaaattaaaaactacattcatctttgttttttgtaaccactttaaaaaataaactaggtaatttatttcttaattttcaatatccccaaaatagagatatccttgtccagatggctttactgcagaattctaccaaacatttaagtaattaataccaattctatgtgatttcttccaaaaaatagaagagcttctcaattcattttataaagcttgtattaccctaatccaaaaaaaaaaaaggtaaagataaaccagataaagacagtgcaaagaagaacaagaaaaaaattacaggctactagtccccataaaaattgatgcaaaaacatttaacaaacagaattcagtaattctatatgaagaattatatagcatgaccaactggagatatagttcagagatgcaaggctggtatacttaaaaatcaattgatgtaacccaccttattaacagaataaaaaaagagaaataacctgattatatcaatcatttaaaaattttataaaattcaatttctattaatgataaaattataagaaatagaaaataagagtagaggaaaacttcctgaacttgataaggaacatctacagctaacattatatcgaacagtcagtaactgaatgttttttccttaagatcgtgaacaagacaaagatgtgcattcttactacttttattcaacaacatgctagaaattctagtcagtgtaataaggtaagaaaaaaatttatagattagaaaaggagaaataaaagtcatttgcaaatcacatgattatctatgtgggaaatccccaaaaatatacagaaaaaaacccctcacttctaatagattatttcagtgaatttgcaggatacaaaatacacaattaaatttctatttgctactaatgaatatgttgacactgaaatttaaaaatatcaccaaatttacgatgaccccaaaactaccatattttgttgtaaatctaaccaaacatgtacaagggttctatagtgaaaactccaaagaattaataaaataaattaaagatcttttttaaatggtgacatatcatgttcatggattaaaagactcaatatagcaaggatattaattctcccccaaaatgacaatgcaatttttattacatcccagaaatttttaaaaaatatagacaagataattctaaaatgtacacatgctcctcaacttacaatgagattacttcctgataaaaccattgttttcaatatatcagaagttgaaaatacatttaatacaactaacccaccaaatataacagcttagcttgctttaccttaaacttactcagaacacttacattaacctacagttcagcaaaataatctagcacaaagcctattttataataaagtgttgaatatgtcatgcaatttatttaatagtactgtgctaaaagtgaaaaacagaacagtgtgtggacactgcgtatggtttctactgaatgcattttgctttcataccttcatatagtcaaaaagttttaagtagaactgttgaatttcagggaccatctgtatacagaaagtcaaaggaacttggataactaaaataattggaaaaaaaaagtcagagttcctatcagatttaagacttattaaatagttatagtgatcaagactatgtgctgttggtggtgggatagacacatagattgacaaaacagaatataggacccagaaatagagccataaaaataggctcaaatgattttttataaaggtggagaagcaaatcaatggaggaaaattagcctttcagtcaggagacaatcctcaggatctaggactaagcaaagaggtctcagacttgacaccaaaagcaccatccataaaaggaaaactcataaattggacttcatcaaaatttaaaacttttgcacttcaggggagtgatatcagcaagatggtagaataaatggtccctcacctcattattccacagaaacatcaagctaacaataatatacacaccaaaatacctttgtgagactacttttatgagaagttgcaagcatcctagatgagcacaaaatgaagaacagccacattaaaacaaataagaagagcaattacactttacctatgtcagcctctccccaaagccagcacagatcaatgccaagggatattgcctcaacccacacttctctcattaggaggggaagagaagtggaatgaccatccggcatcccagtctttcagtgaattgtccaaggggacagtttctatcttgccccacatggaacattgacagtactgccatagtttggacccctcggtcaactcaacaatggaaagggcgtaaacagattgttacaggatagcagagctctgtgagattgggagaaattgcagaacctaggcatctcaccaagaagagagaagagtggtgtatacctccaacctcttggtctttcactacattgccagaagaatgccagtccctgttccactcaacccaaaggactgacagaatgagtatagtttgatgggggcagctaagaacaaaggaaaagaggcagtcagcttgctatgtgagaggctctccaaatctctagctgggctaattgatgaaggtctttaactgtcaacaccactccataaaaactgggagagatggctgttttttcaaatgtgcagacaccaaggcaaagctacaagaaacataaaaaatctgggaaacatgacacaatcaaaggaaaaaacaaatctccagcaaccaaccctacagaagtggagatcttttagatgcctgacaaagaattcaaaatacttatcataaagaagtttaatgagttacgagaggaaacatatgaacaaccaaaggaaatcaggaaagtaatacctgaaaaatgagattctcagtaaaaagataggaactatacaaagaaccagacaaattctgcatctgaggaatctaattgctgaaagaaaaacaatcaatagaaagcttcaaacacagaattgatcaaacctaagaaggaatcagtgaactcaaagacaagttatttgaaattatccagttataagtgcaaaagaaaaaagaatgaaagagttaagaaagcctaagggacatatgagacatcatcaagacaacaaatatatacattatggtgattctagaaggaaagcagagagacaataggaaaaaaagcttatttaaagaaacaatcactgaaaatttctcaaattccagaagggaaatgaacactcagattcatgaagctgaaagcaccacaaataggatgaatataaagaaatctagaccaagacacattacaatcaaattgccaaaatacagagacaaagaaattgtcgaaggcagcaagagaaatgtgacacgtcacatacaaggacacatcaataataccatcagatttctcataagaagccttacacaccagaagacagtggaatgacacattcaaacagctgaagaaaaataaaactgccaattcaactgaggtaggtccacaccacagaatactactctgcaatctaaaggaaggatatttgaggagtttggacaaaggaatagtaagcatagtaagcaatatataaatattagctgtctgtggtcctttgctgagatttcccttactggatgtctgaactaaaattgatttcaatggtctaatataactccaacaaggtatattagctccctgtggctgctgtaacaggggttacggaggtttggacaaaggaatagtaaagggtttggacaaaggagtagtaagttttgataagagaactgaaaagacttgaaggctagtcaatttctaggaaaaataaaccttttggagcatgatagtgcacatctgtgagggatcttgagataattcctatccgtaggaattccttcctacccataacaggaaggataattctactacttgttatcttccaagtgatagctaaaacctacggccaacagtcttttagaagtagaataccacataacatctgttgtgagtacacttgcaaccgatctaggagaaagggaaaaagacccgggtatctttctcaaaaaatgtcttacctcaatctagaagattgaagataaacactaactccctgaaaaaaaagttgagcctgtcactcacacatgcttaatatgaatgctttaatcaattcataatcagatggtacttgccctacctaatagcaactccactgtgaaaatgagcactgtgattacggagatgaagaggtcatttttgcaactggagacaacttggagaaagaagagctctaggtatagtttttcaatatggacattccctgtggtattggatatccccagggaacactgcctcaggagaagcagttagagaagaatcctaaaacaaatgtggaaaaacagaaagatcattttgcctgaagtctcttgatggttgccttgcatgttgagaatgatcacacaaggtgactttggctcatcccttctaaggtggcggataaggagtagtcagtgatgcaggatttcattttgcttttccctggcatcaatttgcatttttcacctggctctctggaaacatgttgctttaaacattccttccattactcaaatggtagaaatttccaacatgtttcaggaccatgaaaaatatgtagggacagatggttcttcggtatcaatcagactgtgttcatgtaggcttattctgtttatgtgccctggtgatgaatagtcctggtaagatggcctctatcctgatcgtgtgtgtgtgtgtgtgtgtgtgtgtgtgtgtgtgtgtgtgtgtatgtgtgtgtgtgtgttaccgccaggccagtgaagaatttaaagcttacagacataaggtaatgtgcccaaggccacacagctacaaagaggcagcagagatggaatttaaatgtgggtcttctgcttcaaaataactcacttatttccaagtggaaagggaaattgtgaccaacacacacaactagaaaaaaaaaaaaatcccacatgtcgctcaagaaaacccaggtttggatttcagacattttagtccaaggacctaattgcatctacagtggtcatctgttgtatttgccacccaatattcattctcccttctgatggtacctacactggttcttcagaacagacctacctctttccacagtcttagcccatgtattaagaggggtcatcctttccaaggtcctcggccaaacagaacaggaaggggtgctatcacattggttgtctcaggcatgagtattcaacccaacaaatctcggtaaggttttgcttacatttttttctaggactgtttattttcatgtgccttgaacctgagagaatgtaggtcttagtacagttgtcttgccagtacctaaggacggcctttctgaaactacagccagcaaaagtagagccaagagctggagaaagaaaccaggtcctgatagtatctttggaaccactgcattgatctggacctgaagctggaattttccagttatgagagttaataaattagggtttcacttaagcctattcagattgatttttctatcacttgggacagaaaacatgtcctgataatgtagcatcaccctgttctcttttaaaataagcatcagacttttccaaatgtaaacccaaaattagccaggcgtagtcatgcagcctgtagtcctagctactcgggagggtaaagtaggaagatctcttgagcccaggagttcaaggccagcctgggcaatatagtgagatcatatctctaaaatgaaaacaaaataaaaaacagccatcattggtgagattttgggtacacattttagcacaaaatagagtttctcaaaaaattgttctctttggagcaaaaccaccaggaagcctttccttgttggagctctctatatgccaaaggccattgggccaaccagtcctctgagcacttgctccacttctgtgggtccttgccgagaagtaactacaaacattgacaataaatagtcacttgtttgtatatttggatggtacctgttgtgtaaataatggttttagacatattagagaatgggatgtgcaggccaaatgtgaagtccactaaacacagaatgagtcagtgatgcctcccatccaagcttactttttattatgccatcttgtatagtgggttgaatggtagaccccaaaaagatatctctatgtcctaattccaggaacttatgaatagtaccttatgatagcaaaaaaaagtgaatattatcttctatggcaaaagatgtgactacattaagaatccttagaaaagcagctcatcctgtataatccacgtgggccctagatgcaaacacatggattcttatacaagaaataccaggagaagaaagacacacaggggaggaagtaatatgaagatgaagcaaagagagatgtgaccgcaagccaaggaatgccaatagccaccagaagctgaaagaggaaaggagcaggttttccttcagagcttccagaagaagtgtggccctgctgacaccttgatttcagacttctggccttcagaatagtaagagtaagatttattttgttttaagccactttgtggtaatttattacagcagtcacaggaagttaatataacttgttggagtaatattacactattgagatcaatttcagttcagacatccagtaagggaaatgtcagcaaaggacgacagacaactaatatttatatattgcgtactatgttccaggcaatgttctaagtactttgcccatattaactcatttaatctttataacaaccctaggagataggtattattattcccattctacagagaaggaaactgaggcacaatgagactaagttagcccaaggtcacataattatgagatatcagagttgggattcaagtccaggtggcactgattccagagtatctgctctctagcattttcctctattgcagtcacatgtccacatcagaggattacacccctggttgcacaagcaagtcacctgagtggctttagaaatattaaaggggaggaatcaccctgaagacaaattaatcacaaccttgggcacatgactttgagcagaagtcattttaagggttcccccagatgattttaatgtgcagccaggttaaaagccaatgacataatgactcccagtggcagatttaactaatttgtttaaatttgcattgcttagatgttttggcttttccaagtctatgtctacacagagaaattggaccgcaaaacctagtaaaaggcttaactcagtaaaaccataattttttttcttgtaatggtctggttgatcaatttttttcaagggttataccataggaaaaactcaatgtgaaggctacctagtaatcaacaatttgttttaattttggtattgagggagtaggaatggagaatgataaaatggagatggagtaggaatggatgagaaatggaaattcatccacatccccagaacccattctggccaatttctggtcaactctggtctggatatctgtgacctagaaatctggagtacagcaccctgggggctcttgattttgcaattgccctagagcaaactcaaaggctgttattgcttctaaaataggaccagcttccttatattctcctgaacaaaaaggaactcatcacgaaagcagcctcctagagcctgctccaggcctgacacaggtcagtgctgcctgaccttctgatgcagagtctcaggttgaacaatcctctgataggactagtgctatctcactttcagatcggcactatgaagcactttagaaactaggctctatagagtccaaatctgccgataataccaatggattttaaagctttttagccatggagcattttcttcaatggaaatcttacttggaaggccagcaaacataaaaatcggggggagtttctatacttgaagagaatctgaacccctacttggccagacctttagtgtaggaaaatacaaagagcctttgccaagagagggccaagtaaacatcaagaactactctgacattgtaaataattctagtaacaggagacctatttggttatcccttgacctgtcctgctctgaagtatgcctggtgttaatttcctaggctgccataacaaattgccgcagactggatagcttaaaacaatagaaatgtattgtctcacagttctgaaggctggaagtatgagatcaaggggttggcagagccatgcttcctctaaaggctctagggaggagtccttacttgagtgttcctagcttctggcaatggtttgcagtccttggcattccttggcttgtcattgcatcactccaatgtttgcctctgtcttcagatggccatcgtcccggtgtttccctgtgtttgtgtctgtttctctcctcttatgaggacactagtcacattggatttagaacctacctaatccagtatgacctcatcttaactacagtcatgcatcataatgacatttcggtcaatggcacactaaatatatgattatagtctcattagattattgtaccccaattgcctacagtagtcagtacagtaacaggctgtagaggtttgcagcctaggaacaataggatatagtatatggtctaggtgtgtaggagactgtaccgtctaggtttgtgtgagtacactctatgatgtttggacaatgatgaaatcacctaacaacacattactcagaatgtaaccacaatgttaagcaatgcatgacatcgcaaagaccctatttccaaataaggtcatagtctaaggttctagagaaaacatgaatttaggagagacatgcttcaacccagtacacagctccagttctacctctgaacttgtttatatggctgggccccaccaccatggccagatctcccccagcagctaccctgacaccagatgccagtggcgtggctttttggcttccatcagcttttattgcctaaatgtttgagctcccagactgtgtgatctccaggctgcaaatgttgccactttggcttgacctgctgccgagtccagaatggaatgttttcttgcaagttttcctttccagatttcaatcaagaaaaaaatgagtaagctgtctgcagaaaatcctatggtatctttccagacaaagaaagacttccctggaaaccactctttgacttattcaatatccctttttttcttaattatggctaatataaattgttttttagaaagtgtttcttactaagtgataccatattttaactgagccgtgctagaacctactattctttaaaaaacctctttattctttgaatattttaacatacatttgcataaaacaaaaaatgttgatttgtatttcaattttattttagttcttcccaaattgctcttaaaaaaagaaaaagaaaagatttaaggccataaacatagatgtataaagtgctgtaagatggcctaaaatttaaagaaaaaggaggcaaatgaaaataaagatatgaaagtaaggtgaattgactaatgaagttagcacctagactctatgtcaacaagtcaggtatgtttgtctactgaataggacaaaaatttatctatgaactttctagtaaccaatacatcagtgcccataagtaaaagtaaacaaacccacacacacacacacacacacacacacacacacacacacacacaaagccatacaacacaccccaaccaccaaagtaagctctgaagagtaatctcaaagtttcctccaggaactgttaagatttaagtagaacagagtggtttgtgaaggtacctatagaactttatcatcactttttaaaaaattgtacgttcccacaatatctatgtacataccaatccccccccccccctttttttaaaaagtcattgaccattgggaatcaagtattttaggtaggtgagaggacaggtgctccaggatattctaagacatgtgattaatatatatgaactctttctgaagtcctggccctatatcctctaatgggacattccattcttctttccatcttgttgctactgctatttagaaatctgtcaagcaagcattgcctttgatgtaagcatctagatagactgtggggatggggagagagttctgaccaatgaacctgaaaccaagatgtctaagggtgtctagagctcccatctcctgtccatcttcccctgattttccctctatatctcacagttccctgaacttctccagcactttttgtatttctgtttaactatcctaggcaatagcactgattcttaataagcccttgttatttgagaaccggcacctgatttcaggctcctggcctttgggtgtaacttgttcaatgctttgcccaatataggcccctgaaaaacctgcatcagcactctctcttctttttccaccttttttgctgcgcttcctttctcctttcccagcttttcttctttttactgttgtatctcctttaaacctctttccccatttccttttactcccctttccctgttccttttatgcacctgctctttttcttcatacccttgccctctgagtagctgctctataatcctatagccctacagagcttgtcacacattacttcaagactttgttactcggtgtctccacaagaatggcctgcaggaagacaagcaaaataaactggataccaagtttaggaagaagatcagaagctagtctcctaagggctgttgcagagaaaggcagcaactcatctagttttttggatgggtgccctccctaaaatattgctcaaagttcccagaatatcattttataaattctagaatcaaaccttctatatacctatcccaaccctagaaaagcaatagagaaatgcctccctggggaaagcaaagtgattccctccacatctaatccctttttctaaaatgaagactcagcacctttccaagagctcaataataatgcaatgagatttgtaaaagagcacacctgactcctctccaagtgtgccctaactggggaaacacacggcctccagtatttacagtgtggattagcccagttttcaggctccaagactctattagcacagcaatattaacctaattactttctctagtaagacaaatattaaggcctcctagacatataatgatattttccccaaagagcaatgactcaagacttcttcccatcttactctgccatgctggaagacagggcagccacatcccattgtcaaccccatgcaaatgttatctggttttaactatctaatggtcctaatctggcagatccatttaaatcatgcaaaatctttgagatgattagcttgtgaatatctaaaatacagcagaaaacctttaagttccctgcttatgtttttaagtatttatggcatgtcctggtaatactgggagaccttggaactgtccactcagtatctttcttcctgcctctacattaaaatagatgttcaatccaaacatctaatgaattaccaaggttttaaaaaactttgaggattccccagaatgatagaaagaataatgatcattggagtgaaacctcccataggcatgctactgaccactggctccattttaaaaaaatttttaataccccagaagatcaaaatcaaagagaatcagatcaacttcatggcctgagtaactaaatcaacttatttgaataactagtttaccgttttctataaattgatcaacttgaggtggattttggcatcatgaaacaacagttgctcagccactcatgctaactgattattacaaaatcaagaaaatacaaatattgacatgggatggttttcagcttgaagtaaaaagctcagcaagcctatgaagagcagctaaggacataacaggcactttcactgttggataaatacatgccatttctctgagctataattttgtctcctttatttctcaatgtttgcaaaaagaaaattgtggttttctaagttcagttgtttagcttcttagtgcagcccaggtttacaggtcttttttttcctttttaaaaaatttttatgtttaatatttgtgggtatatagtgtatatgtttatgtggtacatgagatattttgatacaaggatgcaatgtgtaataatcacattagggtaaaatggggtatccaccacctcaaatattgatccttactgttacaaacaatccaattatactattttagttatctttaaatgagtaataaattattattgactgtagtcagtctgtatcaaatactagaacttattcattcaatctaatcatattaatgtacccattaacaatcccaagtcttctgatgttatttggaagcaaacagctctgtacagttttgcagcaatgaggcctagatattgccataaatttgagaacttttaaaaagtttccacctacatttaaatattgtcctgatacaaagatgggaacaatacacaccagggattccaaaagggaaaaggagggagaggggcaagggttgaaaaactacctattgggtactatgttcaccacttgcgtgatgggatcattagaagctcaaacctcagcatcacacaatatacccatgtaacaaacctgcacatgtaccccctgaattaaatttttaaaacaaataaataaatgtccagggattcagtagccctgatcaaaggcaacattcaaagattgatctacctcagcatatctccctcctacatctacctccattccattgttcatttggaccaaacaaaaaaagaacaaaagcacaatctgaggtttctgcaacataattttccatgtgaaagtttcaaaccaatcattcataaccatctgttggtatctcccactctttatctcctactctatagtcctacagccaccttcccagctgcagctacatggagccacaggactcatgtaaaggaagtcatcattctgctatcccacttagtcttctaagtaaaatacgtcccaaagcattacacgtcaagcctgaagatggaaagtttggggaaaaaaacatgacattgagtacaagtagaggtcactaaaaccaacaaatcaaccagtattgcagattatccaattagcaaagataaatactaaaacccattggagacacttctgcttccagtcaaggaggaataacaggaattggatttatcctccaggctagaaaaaaaaaaggtaagttatatgaaataattatttacaaaacactggatattaggcaatgaaaaacagtgagtggcaagaaaaaaatgactcacaccacctcataactgacccagcttcctggtttgagaaaacttccaggctgaggtacagggaaggggatcccagggagaagctaaaagacttcctgagttgagaaaacaaaattgagatttcaagaaatcaagacatctagaattttcaagacagagtgctgaaaaggacagagacacacggagacctgcagagaattttcctcaagtattagcagagtgttaattcatgcatttgtgtgaggaaagaatcacccaaaagaattaaagggaacagtatccagtgatcacacatggccacaaatagagcctgtacccataagccagatagaaaagctcatataagacattgggtagaatactcaaaaaggctttacctcagaggaaattattaattagccctagcattaacactcttctggaaccactgaacaaatcagatcaaagcctgaaatgatcaaattgtttccaagtaacttaacttcatcccagaacaaagctcaagaatatttatagaaacacaaaaatatccaacacccaatgaggtacaattttctgaccctccaatcaaagattaccaggcatgcaaaaagggaggaaaacactgcttattataggaaaaataattaatcagtcaaaactgacaccgaaatgacacagatattaggttagcaatgatattaaaacagctgttataactgcattccatgtgttcacaaaattaagtagggacatggaagagagaaaaaaagaccgaaatccaaaattctagagatggaaactacaatccctgagataaaaataccagagatgggattagcaacagataagacattgtagaagaaaagattatgaacttgaagaatagcaatagaaattacccaaaagaagcacacagaaaaaaaaaagaatccacaaaaatgaaaagagcatcagtgagttgtaggacagtttaatatacatgtaggtctcatagatattttcctcagcaaaagaaaggagaagtagggagggaatgaagaatagtgtatgaaaatcgtccaattttgatgaaagactcaagctcatggattcaagtttaaggaagcccagaataagaaatataaatacaccaaggaatatagtaacccaacatctcaaatccagtgataacatgaaaatattaaaagtaggcaaagataagaagatacgttaagtacagaggacaaggataagggcaagaacagatttcttgttggaaataatgcaaacaagacgacagtgaaacatctttaaagtaatgaaagaaagcagctgtcaatctggattgctatatcctagaattttctatcttcgaaaacaagaaataaaaacactttcagaaatataaattctgatttcaggtaaaaggaaaaaatgataccacatagaaatataaatcaaccctcaaaaatgaaaagcatcaaatatggcaaccacataagcaaatatataacttttttattatcttatttaaaactgtttaaaagataattgacgatttaaacaaaaataatagtaataagttgaggcttttatagcacatatgtaagtaaaacaacaacaataacataagggcaagagagaagaaatggaagtacattatttcagatttttataccatacttgaagtggtataatatcaccttaaggaagactgataaatttaagatacatgcaataaacctttaagcaaattaacaaaagagttataatgaataaactgacaatataaattgaaataaaataatactaaatccaaaagatggaatataaataggaaataggaacaaataacagagacacaaatggaaacaaatagcaagatgatagacataattcaaactgtataaataatctcattaaatataaacattctaatatcccagttaaaaatcagagattgtcagaatggcaggggcagggggaaagaaaaattgaacagtatgccacctttgagacacacacattaaatctaaagacagaaacagattaaaagtaaaatgttggaataaacatggtagatacatataccatgttaaccctagtaaaaagaaatctgtagtggctaagttaatataagacaaaagtagatttcaaagcaagatattaccaagaataaagaagattgtttcatcacgataaaagcatcaattcatcaagaggacataccagttctgtctctatgcatgtaataatagaccttcaaaatacatgaagcaaaaactgatagagctgtaagaaaaaaaagcaagtctacaattttgatcagatatctcaatactcttctctcaataactggtagaataggtagagagaaaatcatcaggatatagaaatttgaagcacactaacaatcaaaataacctatggacaattttagaacactcctcttcttggcagtatacacattcttttcatgtttacacagaacaattattacgattgatagacccaattctgggccataaaacaagttttaaattcagtaagtttaaaaggatgtatgtcatacaaagtatgctctctatccacagtggaattaaattagaaatgaatacagaacatgtctggaaaattcctaaacatttggaaactaaataacacccttctaaataacccatagatatgagaataaatcaaaggagaaattaaaatacatgaaataaattaaaatggtaacaacatgtcggaatttgtgaggtgccacaaaacaatatgtaggatgaaattcaaagcaataaatgctcatattagaagaaagagaaagtctccatttataaccttggcttccaccttaataaaaatagaaaaaggagagcaaataaaattcaaagtaagcataagaaaaaacataataaagatcaaaacagaaaacaattaaatgtaaaacaaaatcaatagtgaaactcaatgaaataaaaatctagttctgagatgatcaatacaatttctaaagctctagtcaaaaagatctggaaaaaaagtggaaaatataaattaccatgattaaggatgaaagagatgagatcctctcagattcaaaatattaaaaggataatagtttggactttgccaagtgctactttgccaggtaacatgattgcatgttaagggatcatcaacatcttgatacaaaggagaaatagaaagatgacaatttcataagtgggttgtgtcatagcagctcagtgggggagatctcacacacgaagtgtgacttttaaaatccctcagaacagtaactacttatggggtgtcatatctctgctgagatttaattgcatggtcagtttgtaaaatacatcttaaaattttgtaatacagtattatttcttctataaggtataataggagttaaataattaaatactttaataatactaaaaggaaaaaatacaaacctaaattatcagctatttacatcactttatattccaatcatggtcaattttcatttgtacatgtcaacatggattaaatcagagtgtactctttatgtgctactttttaactaaatggctccatatatttatttccatacacagatatagtccatgcaactaatatttttgaaatatatatggtaatttaatcatattgattacaatcaatccccaattgtagagcatttaggtaacttccagtgtttcacagttgtgaatagtaacactataactttgtgtagactgatttcttccttttggattatttcccttgagtagaattcctggccctcctctactcacacctcaaaaaagtgaaacagcttatcagcacttgttgaacatttccagatgaacttcacagaaactttgaacaattctcagtgacacagggccacatatacatataattttttcacaggcctacctagttttcttatttttattgaagtaaattactattcagtcaactgaacctatttaaagggtgcaatttggtgtgtgtgtgtgtgtgtgtgtgtatatatatatatatatctaccagtgcagtttggtagatatatttcatgtcacatgaagccatgtgacataaaaataatgaacacatccatcacaacaaaaggttcttcataccctttgtagttctaccttcttgtccctcttgtgtcctcaggaaaccactgatgtactttgtgtcaccatagattagtttaaatttcatagaattttatataaacataatcataaagcatgtactcctagtttttggcttgtacaaataaagctactacaaacatttgtatacaagtctttgtgtcacgagatccttggggtgtcacttcaccagctggaaacctctgtggccagtagtgccttctgcctgagtattgctcatgcccactgagctcaatctgtccactcagcctggcaggctgcacttggctcatgctacaggcctggatcccacacctgccaagggtgagccaggcacagaatgatgaggggtgtgtgtgtgagtgagcgcagggtccagccactgtgcacagccaggcacactggttgctgggcaaggcaagcagctccagatgacagcataagtgccggctccatgtgaggctatggttggaccagatgtaccccaagtggcttccactgtgggcacccacatctggatgaagggaacatggtggtgcctggaagcttggagatgccaggaaccacaaagccccaaagagggtgtcatagccctggctcagggctcccctagttctgggctccccgaagggtcccagctcttctctccttcttgttgcctgcaatgtgacaagcaggggggcatgtttcagacctgtttgtgttacagctctttcagtccccgcattcagcaggtcctgatttcttgtcccgtgtccgggaacaatgaggtacgcaaacaactggaggatgagcaaggcagagaggagcttcagtgagtgacagagaggctctcgggagacccaaagtgggcagttccttcccacagctggtagtcctgatgtctgcccaagtctggatgagtccagagtttttatagcctcagaaggaagggcgtgctgattggtccatgggccaccatgagcaggttcagaaaaagcaccataaattgtcactctgggccactgactccatccagaattgacagcccagcacccaggcttcaggccatccctggcttgaaggtggggtttcacccgagacctgcccctttccacccaggagcctgtctgcctcctgccaccatccacatgccatccatggtgcccaggctgttagtgccaaggggtgcttgcaagcctgcactaagccaccctcagcccccacttgcccctcctcccatgctcatcagcacccaaagtctggagggggccaaggcggcagggggctggtgtgtcaatgccgccctgagcttgcacatgccaggccgagcaacagcaccttggctcagccacaactttgttccaccccagagcaggtgcctagagtgggaagaggccaaggagcgggagcaggtacttccaagccttcaggggcaggggcgcttcccaggcccctgagagcacagggaagcccgggtccagagccatggctgggtggctgcagctgcgccaaggagcactggccttctgccccaccaacttggtaggggatggggctcatgcctgttcctggccgtgccagctctgtggagtgcgcagccccagccatgcctctaacactgcagccactccagtcaggctgctgctaccaccatttgtatgaacacatgcttttatttttcttagaaaaataaccagaaatgcaatggctacattatatgataggtatatgtttcactttttaagaaactatcaaaccattttccaaagtggttgtcatttaaattcccatcaaaggtatgagagttccagctcttccacatcctcacaaacacttggtatggtcagtattttttatttgagccattctatcagacacatagtgataccccattgtggtttaatttgcatttccctaatcactaataatgagcatcctttcatgttcttgtttgccaatcatacgttttctttggcaaagtatctgttcatataattctcctatttttaaagttaaggtgcaaaggcagttcattggacaaaaagtagtattttcaacaaatggtactaaaacaattgactgtccacatgcaaaaaacaaaaaacaaaaaaaaaaaaacacaacaaaaaaactttgattcaaacttggaaacctactttaaaaattaattcaaaatgtgtcatagacctgaaattaaaacctaaaactacaaatcttgtagaaggaaatataagagaaaatcactgtgaccttagattaggcaaaaattttttagatatcacatcaaaagccaaagaaaaatggaaaaattagacttcatcaaaattaaacatttctgtttttcaaaagacagttaagacaaattacaccagatgtgtaaagaagagctggtaccactcctacttaaactactccaaaaaattgaggaagagggactcctccccaactcattctatgaggccagaatcatcctcataccaaaacctcacagagacacaacagaaaaagaaaacttcaggccaatatccctgatgaacatcagggcaaaaatccctaacaaaacactggcaaacttaatctggtaggacatcaaaaagctaatccaccaggatcaagcaggctttatccctgggatacaaggttgagtcaacatatgcaaatcagtaaatgtgatttacataagcagaactaaaaacaaaaactacatgattatcttaatagattcagaaaaggctttcaatacaactaaacacctcatcatgttaaaaaccctcaacaaatgaggcattaaagaaacataattcaaaataacaagagccatcaatgacaaacccacagctaacatcatactgaataggcaaaagctggaagcattccccttgaaaactagaacaagataaggataccctctctcaccactccttttcaacatagtactggaaatcctggccagagcaatcaggtaagagaaagaaataaaaggcatacaaataggaagagaagaggttaaactattcctgtttgcagatgatgtgattctatacctggaacaccccatagtctcttcccaaaagcttcttggtctgataaacaacttcagtaaagtttcaggatacaaaatcaatgtacaaaaattactagcattcctatacaccaacaacatccaaactgacagccaaatcaagaatgcaatcccattcatgattgcagcaaagagaataaaatacctaggaatacaactaaccagagaggtaaaagatctctacaatgagaatgacaaaacactgctgaaagaaatcagagatgacacaaacagaaaaacattccatgctcatggatagaaagaatcaatattgttaaaatggccatactgccaaagcgatttacagattaaatgctattcctatcaaactactgatgacattcttcacagaattagaaaaaaactattttaaaattcatatggaatcaaaaaagagctgggataaccaggcaatcctaagaaaaaagaacaaagctggaggcaccacattacctgacttcaaactacactacaaggctacagtaaccaaaacagcgtggcactggtacaaaaacagacatatagaccaatggaacaggatagagtgcccagaaacaatgctgcatacctacaaccatctgatatttaatacagttgacaaaagcaagtaacagggaaaggactccctattcaaaatggagctgggataactgactagccatatgcagaaaattggaactggaccactaccttacaccacatacaaaaatcaactcaagatgaattaaagacttaaatgcaaaacctaaaaccataaacaccctagaagaaaacctagaaaatgccattctggacataggatctggcaaagacctcatgacaaagacaccaaaagcaattgcaacgtaaccaaaaattgacaaataggacctaattaaactaaagagcttctgcacaggaaaaaaaactatcaagagagtaaacatgcaacttacagaatgggaaaaaatatctgcaaactgtgcatctgacaaaggtctaatatccagcatctataaggaatttaaactaatttacaagcaaaaaccaaacaattcaattaaaagtgggcaaaggacatcaacagatacttttcaaaacaagatatatgtggccaacaaggatatgaaaaaatgctcggcatcactaatcattagagaaatgcaaatcaaaaccaccataaaatatcatctcacatcaatcagaatagctactattaaaaagtcaaaaataataaatgctggcaaggttatggagaaaagggaacgcctatacactgctaggaggaatttctcaaataatttaaaacagaatcaccattgaactcagcaatcccattattgggtatatccccaaaggaatatatattgttctaccataaagacacatgcatgtgcatgctcattgcagcacgtattcacaacagtcaagacatgaactcaacctaaatatccatcaatggtggactggataaagaaaatgtggcatatatacaccatggaatattatgcagccatgaaaaataatgagatcatgtcctttgcaggccattatcctcagctaactaacatagaaactgaaaaccaactgcatatcctcacttataaatgggagctaaacaccaagtacatatggatactaagagaacaacagcactggggtctacttgagggtggaggatggaaggagggtgatgattgaaaaaatacctatcgggtagtatgcttattactggggtgatgaaataatctgtacaccaaacccctgagacatgtagtttacctgtataacagaactgcatatgttaacttgaacctaaaaataatttttttaaaacaaaagacagttaagagaataaaagagacaagtcacaaactgagagaaaatatttgctaagtttatacctggcaaaatacttctatccagaatacataaacaacttttaaaactcaataataagaaaacaaacaacccaatacactagaacttagatttgtttatcacatgagtaacttttggcaagtaaagggcattgactgacagcatgagacacagagttaagttttaaaagatagaagtaagatcatgtactgctgatacaagagggcaggcagagaggcaagagagaaccagagtctatacatgaaaaaagatcttgggatgtttcgtggttagaaagaaaaaatatcaaaaccaaattaccctgttttcttcacagtaacttctaggatcagccttaacaatatggagcaaatattaaaaaaaagaaattgaaagaggcccagagcctaatttaagacttgggtagtaggactggataatatggcatagttacagaagatgtttggaatctaaaagtagagagatactccaagactgagtatacaaagtataaggcaaatttaagtcacagatcaccaaatgggccccttttcccaacagacatcatgtccccacccagaaatctgggaacaggccattcttcaaggaccaggtcaagtctcccatcttcactcccactcactccatcaatgctctgcactgcaatcacttgtaaaatagcactaataacagggattgcctcaaggacaaaatgagatagccaatgcaaagaacataatataatgcctggaacacccagagcgcaataaatattggtttcccttctctcccttctataaccaaatggaagacaaattgcactgttggccctagttcaggggtttttaaaatttagagctcctatgttgagctgagtctcgttaaaggctcctgggttgagcacagaaacttttaaaacaacttgagtccagactttgatgtccccattgccatacatggcagggagtcaacagcagaacgggaagtaccccaagttgcagaaacaagttgccaggctgtggcaaaattcaataagtagacaacgtttgtattccatctagtaacaaaaaatatttatgctccccctacagctggctgagggcccttcattagagcatcactgcaagcccttccactgtccctcacccattcctcctcaggcaaggaaatgtgaattacctgatgggtcaatctgggagcaggacctgccaaaggatgcgtacagctcagcccttctgctgtcttttcagaacaggtaccactgtgagaggcctgtggttgcccagccatgatcatagctaattatttctgaggtactgtgttataaggcccatataatccaaaaatctaagccacattcccccaaaccagctttaccagtaataaaaggtggtaatatgtctctagttacctaattcctggatctctcagttagttctgaacttgaatggagaagaagggtgccattttgaggccccctcaacacctatccacctatctatctgccccctgtcccatgcacaatcaaacatagacaggcactagggccctctcagatgaatgttcagtggcctggcgggggcccgtgctaaccaggcttctttccccctcagtttacattttcccacctgcctgatattgtcagactgacgttgctgccacccaagtttcacaccagaaagagtgagaagcacacaatgaaggttctttcctgccttcttcctagagggcaagcactaggtattgtactcctatgactcccatgagacctagcatagttctgagcctatagaactctgataaagatcaggagaccaggcttcaagctccactctgccctttcttgccatgtaacttggtacatgtcactttgccagtctgaatccttgaattcccatcgtaattctttattttgtttgttctttttaagtgacattaaattagattttaaatggacaaaaagttggtcctttcttcagtgtggtaaaagtgaagtggtcacgatctccaaagctggtttatatttttggcaaacatagctatatatttttcagatgtgcttatgatgtcattccatttagaatgaaaactccaagactcctactattttcccataaaagttcaaataaaaacttagaacccaagaattctcagaaaacaatatttactgccaagtccccacttacatgtagcagaaattttctaagatatgcccgctgctttgctatagaatttaaccaaattttattatagaattaccagggcactgaatgtaaagccacgccattcatagttttctttagaagggattggtaaactatggcccataggccaaatatggcccactgcttgtttttgtaaataaagctttattggaatacaaccacattcatctgtttacataatgtctgtagctgctttcccgctataacagtaggggtgagttgctgcaatagagatcatgacctggctttttacagaaaaagtttgctgactctcattctaaaaaaatccttcaattaatcttaatttatttaaattatgattcaggaacatccttaacacatgattaagtgatcacaggaatgttgcttttcttgcttgggctttttttttcttaatctctaagaggagagatttgtctattgtttccaaagtagccattaattctcattctgattctcagcagatgagtagtttccttagcaaggtctgattacttctgaatagttgagacatctgcacctctcgtgaaataagagaagcattggcaggggctcatgagaagactcaagttccaactctttgatttccccctaactgacccaaccttttgtgctttgcttctgtaaaatgaagaggctgggcagatgagaactacgtttccttagaacagataattatgatccagtgtgtgaaatgcctcatcgaaagccacactgcctattatgaaagcccaaagaacagcatcacaactggatttagagaaaagaaaagactcagacaaggcttcttggaggaaaggatgcctgacctgaatcttgaaggatgaggagaaattccgctggggaatgaactgactaataaagcaaaaagcaccttattgaagccatcattttatttggctaatcaaaaaaatgtttcagcatctaaacctcaaggaatatctctccgaattcaaacagactctaatgtgtgcattatactctgcttctagatgtatatcatggaaattacattgcccaaaaccttttcacaatgtagtcacttcttctctggaaaaaaaaatgtttctttgtcttgttcattcagttatcaaggtcccatcaaagtcttgaaaaagacatcagccaccacatgcataagtgatgtgactgaccactgtatggaacaccaagacttcttgggaaagtgaagaccaatcagagagtttagacaaggggtcattccacagctgtaatcacagtcaacaagaggtgagatggatggattaaagatttaaacgttagacctaaaaccataaaaaccctagaagaaaacctaggcattaccattcaggacataggcgtgggcaaggacttcatgtccaaaacacgaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaataacaggtgctggagaggatgtggagaaataggaacacttttacactgttggtgggactgtaaactagttcaaccattgtggaagtcagtgtggcgattcctcagggatctagaactagaaataccatttgacccagccatcccaatactgggtatatacccaaaggactataaatcatgctgctataaagacacatgcacacatatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctgggaactgtggtggtctctgtgttggtttttcttatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaacattaaaaaaaaaaaaaaaaaaaagaggtgagataactcttgacttcaaatgcctttggcagtgggattaggcaatgtgcttaggcagcagtcatttccatgtggctaaagaatccaaacagccacaacaatagattctgaagagaggaaagttatctgaattgacctaactatgcaatctcagcaattatgattcccaagtaattgctagctctcctacaattctgtctgtacggttgttgtaagtagagttcattcatgcattcaacaaattctagtgagtaccaactatgtaccagctctttgtatacaatggggatacagccataaaagtgagacaaaaacctttgaccctgtggaatctacattcttgtgtgccatccttgtattgagaaaagtacaatgagttttaacttctatttgatgggacatattgctgctttgaacagtccccaatggacattttgcaaaagagtctgagccaaacctgagccatcctttctccctgtctctccgtcttattctctgtcttagcaacacacagcacgagataaagccaagacagcctgatgcttgttccttaatgcaccctcagtatcaagccaaatgactccttaagcctcgaaacagatatgtatgattatatcaagaccctaaagaatgttcataacctttgaaccacttctggaaatcctaagaaaatagatctaacctttgaaaagaatttagatgcaaaaaatgtacatcacagcttcaatgaacctagcctcaccccaagacaaattaaatgtccaactataaatgaatatataggtaaattattatttttacagtagatgaaataagcagatattaagaaatctgtgataatgttggaaaatactataaaatgttaggtaattaaacagaactaaaaaaccatatattcaacataacaagcatgtgtgaaaatctactaaggaaaaagatttgatagaaattctctaaaacattaatatttaatatacttagatgtaattatgagtattttctacttttgggatttttccatttttcattaggaaaaaatgtttttataatttaaaaaatttttacataataattttaagaataaatatagtttttaaaaagcaagaatgaggtcgcatttatccaacaagtatacaacagtttattatcatacctgaagagcctgagatctggagtctactgcctgggtttgaactctgattcctcgttattgtgtgaccttgggcaaggaagttatttaaccttttcttgctccagttttccacctgcaaaatgggcgtgcctacctaaatgggttggtatgaggatgagtaaattattaactcagagtgtttggcacacagagtgtaacaccctgtaagcactcaaataataacagatcacacactccagtggcttcaaagaaagaattcaaaaaagaggaaagacaaacatcagatcccgatgcctcaggaacaagtagctcaagagttgtacttccagtgggcaattttccctcaggcagaatgaatctccaagtcctttactaatattttaaaatttcctctgaagaaggacaatatgtagatatttgttttatgcataattactcctttgggtttttttttaaatgcaccggtcataatgtattgtgcaaagtgccttttgatttcaaaaacaagcctaaagattacattaatatgattgtcacaaaacactaatcattaagatgaaatgacctcataaaaatattgcttatgttgccaacatacagtagttaatttgaagataaaaataattgttgacaaaaatcacatttctgtcaaatgtctgttcaaaaatcagtgaaataaaaaactaatctcttatctcctgtatccaacatccttctttctgtgcaaattaaaccatctaaatctgagtaaaataaaatctgtgtaaaataaagaatcttgttcacagcaggcttttagtaaatatttgttgaaaggatacagtttagttcttattacttgacaacatttgccttttaaaaagagtgagaattcagttaagattgcataaatattaaatcttgaccaataaagaagattcagaggataagaggaaattaagaaagacagtttgaaatccgtctctgacaccttcttctctcgaaatgaggcatcactttctctttacgagacagattatgccagaggcattctttatcctaatttctaatccaaacttccttgatcttttgaccctaggaatcttctactcaaaataaggcaaaaccttcaaggttttgatttcgtttgataacttttctctgtttatgggctctgttctcttcttgcatagaatatctgcctacttaaaacggctaaaaggtcttaaacctcagagattcacaagctcagatttgcatcttagcgggcaccagctgtattgtcttctttcagtcccataaccttactcagcctcagtttctttgtaaagtggacataataaatatctctcaaaaggttacaacagagttaagtgagaccatagatactaaacgattgggcatggtaggcaatttaacaatgtgttcgttcttccctttccctgtgagactttactgaggctggacagtctttctctgaaccctaacatcccttggtctctttcctgtctttccttcccagagcagaaagcaaagttctcctgaacccggattttttaaatctagaagaacatttgagctgtaagttacccactcacatttcaagtcccagggaaattggaaaggtagatgaattggtggtgtgcttggtcccttttgggaggggcctaagaagcggggaccctcgcttgagtcagtgggatctcactatattctcttccccatctgtgaagtctggatttgggctctacccaccttcctccttagacctgcaaagactaaatcaatgagaacctctgagctgagtttccctcgggagatgccaaacgcgtaagactctcccaagatcccagaactaatctgtccccaccctgcaaggaaaaggtgaaggaagaaagggaagcggggcggggcgcgatatgccacaggtaaccgccgcctgcgcgcagttaaggaacagtcctgtccaataggtctccccaacctgagctttccaggtcgcctcccgcccgcaggacctctttctctcgagcagccagaggatttggagctgctgagagcggatgaggtcctgggggagtgaaggcggcgtctgtgccgcagccgcttgtcaactctctagcgtccaagccccggccccggcccccgccaggtgcgccaggcaggctggcctccgcgttcctcacagcgccccacgctgcctccttggcgttcctcggtgcgcgctctacgctgcgctcctggacgccgggagcagggcagtgcgctgcactgggcgcccgcaagggaaaaacgctacctgtggaagtaatgtaggcagaagaggcccagaagtaccgtcccaggtggcccgaagagggagaggggctgccgggcgaggatccccgcgggcaccgcgaaggaaggcagctcctgcaggaaccaggcggcgcgggctggcaggcgggtagccgccggcttcaggctctccgtgtgcttcccgtagccggaggcttcgcgacgtacaaggccagtgccccaagggcgaccaaagtggcgctgcctgccagcactgggctctgctggcactgaacctgcatcgcgccgtgttcctcgccggtggccgctgccctcccagaagagagcgcggcccccgcaacccctttatgga

SEQ ID NO: 479 - DNA, 77000 bp, Homo sapiens
ttaagtctataagctttattgatactttgcttttacagttcacaatgcattccacagatttagttcagtacagcttaaaccacaatggtataaatcttcattttgtaattaataatttcttgcataacaatgtttgatatttgcaaacaaacaacatttttggaagcattagattcagtccatagattctgtgacaaaattaactacagtcagtctgtgcaatgaaattgatgttggagttctatgtgtgtggcatttcatgttgaaaacagatggtagtgctcctagaaatatttcttcttctagcttatgtgctttggaactacacatgtataaccaatgactgactctgaaatatcaagcactgtggggtggctggaaggtaaaggtctaagctttgtgaaacactatacatatataatctatatttacttatattggcaattaatataacagtaaaagtcacaatacacctagaacataccagaaaagcaagctttgtcattcctgctttaccggtatgatctcgtctaaacaaacatttcatttcagaaaatctgcatcaatctacacggaccatacacagtgcacaaactgaaaagggcttttttttttttttttctagctccaccatctctgcaacttgccaagatgcggcaagactatctgcaacaaagtaaaatatacaggttttttattccaccagtgcctcagatagataggaaaaagatatgattacggtttaaatccatacatagcagcttacaatacttaagatgatgaacacatggcagtcaagacaggtaatttttcctcacaacagtgcatggctaaaaataaagatctaacaacgatctgtgaaactgcactgcaacgtcaaggttcgttcttccctgaccctcccccgtataatcaaatgaatatcccctttaaagatgaactcctactaattattttgggcgttttcattcagctttgcgcttcaatccagggatttttgcttggattctgaaaatgaaaaagtcaatgtaaatatcagttttgtttgctgctgcttaaaataccatcttccaagaactacttgtatgttattcagctaatacaataaatgaaatccttaaagctgcctaattctaagctataattttgccaccttggcctcatgaattagatttaaacaaagccttaaacacataataaacccagaaacgaatggtccaaatgttagaaaaacaatcttttggcaactctgaagtcacacttaaggtctgatagagatttgttactcattatgcctgcaatatgaaaatactgttctcacaatccagcacaccttatcctagtaaaaacactgcagattttaaatacttacttagccatagcatctttaacattcttatttgcaagtcctagataatgatctatctgtgcctgaaagagaggtataaaggaattattaccgttgctaaagaatcttattaaccactactatgtgtcaagctaaaggcttaagaaaccatcacacttctcatttttgtaagacattgaaaatgggcactaatacatccgtaaatcccatgtaatagagtgagtgctctattctgaagtcagcagttagttaggaaattacctgatgccgttcataaataacaggaacactgaagagtgaaatgagagctgaaaagggaaatatacaacttttcaaaaagaacggaatgatttgggaggaataaacactcaaaaaactattaaactggcaactcaagataaccaagcagtgttcctaatgaatgaataaaaacataaggatctctggatgcatctgctgttgaggagccactccagaggaatgaatgaactgtgtgaggctgcagttattagagctaggaaccatttctagcttcaaatcatatcacagtgagatttcataaaataaaggtatccctggttagatttatgactgcaccatcatataaagccaccctttatctggtttatcactgtttgttagtaggagctgtcttcagcaactaaggtagcatttcaataaaccgggaagcagtatcaccaacttatttaaagagaatacaacctcaaacttattttgagatggagtttcactcttgttgcccaacctggagtgcaatggcacgatctccgctcactgcaacctctgcctcttgggctcaagtgattctcctgcctcagcctccggagtagctgggattacaggcgtgcgccaccacgcccagctaattttttctatttttagtagaaatggggtttcaccatgttagccaggctggtctcgaactcctggccccaggtgatccgcccaccttggcctcccaaagtgctgggattacaggcatgagctaccgcgcccggcccacattttcatcccctacttttcatacaatgagaatattctccactaaaatgtctaagctcctggcacacaatctttccagcaatttttcatcccaatggctttgtagacttacccaaaatcagtagtgtcagaccattaaacaaggcaccaacataggtaaatacccacatcaacactgcaaactataagaaaataacattagcccattataaacaaaattcaagtaaagtttcttaattatgctttcaaaagcatcccatctaaatgcctacctacaaaaggcatacaacttgaagactgggtaaagtaccatgagcagttcactattaagtcacgagtctcaattatgaatttcaaaatcctaaaataattaatagatttgacccattttctctggactacactaccaagtagttgattctgctgagatcagacaatataccaagggtgcatcttacccctccagccctaacaacatttaccttttaaatgggaagactataaaggtgttatgagaattgtctattagaattgatttcaaagtatgaactagttgagtgcttgaagatatatgagctgaataattcagacattaatatctcagctgataagcaataattgggcaaagagtacttatcagggaaattacgtttcaggtaccaaaaatatcacctctagcctttgaaggatcaggcacaaagtcagtctgaattttgttaaacattggtcatcatcagttcctttgctttctaattcaaggccttcatgtgtatgtctggcaatcactttgacctacttagtaggtaacaaacatgatgccaccagctacagtgattatttaggcttatgtaacactataaatgaaaaggggagtagtagagcacccccattatctaaagcggggatcagcaaactttctctgtgaagagccagacagtagaattttaggttttatgggccacatagggtttgtgtctcatattattctgtgtcgttgtcataaccctttaaaaatgtacaccacccactcttagctcccacactatacaaaaacaggccgtggcccaaacaagcagtggtttgctaacccttgatctaaagcatatatctttctccatgtattaaacgaactctgactgaatgcttactgaccattaattaagcagtcaaacattagtaagcatatttattacagcttaggaagacactttggatgactctaccaagcaacagttctacaaatagcaacactctggtcaccctaactgaatttaactaatgttcaagtcagtaaatatcaggcattcttaatatctgtcaattgaaaaaaaatttttttaagctgccgtattcttagcaattgctattggaacccctggtagaaaggtttgaaggatgacttcagttagtaaggcttttctctcacagttttatagactcctattgctgaagctaaatataacttttgcacttgagcaagtttactatagagtaagagagttatttttatccatcactatccacaagtctaaagggaaaagtgttgaccttccatattttagaagaaattactctagcaacgaagatgcccttaacatgacagaagatagtaacaaacacaagctaaaataactcctcatttggtcattacagtcactgacaaggcttcactccaagtccacaggggaaaagcccaagacttcacacctgagccactgtaggggctcaaatgtcacttgcctctttgagaacacttcctaaaagccaggctatcccaagacaaagagaagaacacagggaggtctcaaatgtccttagggccaggcaggtgacatacatgtatgtgagaggctgggagagaactgaggcacacagtgatatgcattcttcctctcaaaggggcacttacaaccctgctccatacgctgtggccatgcaaatattccaggccagtgttgccagaaatgtacacttttgtgtgctatcatataatttttaaatgttgcagctatgttgagaaaactgaatacttcggcggcccaaaacagaaatagtggttaagtgtattcagggaacacaccaccaggagagaaaggggtggcagcaagaactaacctagagagtaaccattattaatgggaatccaccacaaatgatggatttgtaacatggcaggaataaggtcaataaacactttaaagaagcaaacaggctgctctcattttggacttaacaaattctacacgattccatggcaaatactttgcaacattatagccaatacttattaactgaagaggtcaaagcttatctctccattgcacagtatcgagactggaggaaggaggcctaaaatgtaatgaagatctaacaaatacttactgaaaaggggcaagggccacatctggtttatctttcttccagggcaataagagaattaaattcactgtgtataacacacctgattaaagagctctgcagatttgtgatgtttcaatttgggggaaggggtatctttaaggcaaacggtgggagagtgcttagtaagatctcagaaattactctggcagttctgaccatttcaaaactttcctgcactctcaaactctaaactctacttgcccttctgtgtctccttcagattcattcattagttggtagtttggactctctctatatccccagcccacttccttctaatttttctgagagctcaagaaacctgaaaggaagctgtcaaaatgtgaatgttaacagctgcctatgagcctgagagctagattttagtgttcttctgggtcagctatttctggagctcaggccgtttttttttttttcttcctctcactttcagatttaagattgtgttctggaacattatagttgcgcctcaattacagaaaagtaagaacctctgctgaaaatacctggtcttagtccctaaaaaagtaaaattattagacagctttttgggatttgaggtttcaaaagacaggaacctgctaagaaggctcagtcagactcaattagcccaaaagctgagcccagtaggcattgtcatatgcttttctttcataattgcgggtgggaagcgaggggagggaggatttatagtttaatgccacaactttttaaaacagtgatttttgccatactatttgactaggaaaatgatcgttgctcactctataaatacttgaaatcttttctaggacttagaagtttgtagttaattgcaaaggagcaaaacaaacggaatattacacaagaatttaaaaggagaactctgcagaacatgtcttatttttattcgcccaagtcaaccaccaggaaacttggaccaggcacacggatacccatcatttcacaccggtgtttataaaaggactaatgagccctggagtttggttatttttttgatcacattttgaaaggccaggctcctccttcactgcccccgccaaaaggcaataagcaaggaaaaggtttcacatgctagcaagagcggctctaaaatttcaatttctgaggaagatggtttcacatggaaatagtcataattgtaggctgggcatggtggctcacacctgtaatcccagcactctgggaggccaaggcaggcagatcacctgaggtcaggagttcgagaccagtctggccaacttggcaaaaccccatctcttctaaaaatacaaaaattagctgggcgtggtggcggacacctgtagtcccagctacttgggaggctgaagcaggagaatcacttgaacctggaaggcaaaggttgcagtgagcctaagatcgcaccaccgccctccagcctgggtgacacagcgagactctatctccaaaaaaaaaaaaaaaaaaaaaagagctagtgataattgtgacccagaatctaaaaatgtagatataaatttgagggcacacaacagattttgcatttatgaagacaatgagttatagagatacttctttcaaattgttgtttaaaaactattattttgtaaacacagagcttgataaaaatgtcttttctaaatgacaaaaatttagaaatgagagtaatttctactacattttcctgaaattaagatggtttccattttcctagctatgaatcatataaaatcaatgtaattccaataaaaagctacttcctataaattttaaaaaactcattgttatttaaataagaaaaaacattcatctcaactggagagactggagctattagcaaacttcccataaatttaaaatctgactgtaaggcattaaaataaatccgtttaaacaaggtaaatacatttttccttatgttgaaaaagtaaaaaaagaatgggaattggaaaaacattttttgcttgctttagggtgacagaatataactttccctaccagtttttgtggctaaaaggcaaaaagtaatacagtccactattaaggaacttaagattaagattttaataattttttttttttttttaaacagacagggtctcactctgttgccgtggctggaatgcagtggtatgattatggctcactgcatcctccacctcctgggctcaagaatcctcttgcctcagcctcccaagtagctgggactacaggcatgggcgaccatggctggctgatttttcagtttttttttttttatagaaacagtctcacaatgttgcctaggctggtctcaaactcctggcctcaagcaatccttccgccttggcctcccaaagtgctgggattacaggcgtgagctactgtgcatggccaggaaaaccttcttctttttaaaatgctctctatataaacaaaaactgtggtggataagtgtggccatacacagaagtctctctagaaaggtaatcctatcaagcgtttttataaaaaagcaaagtgatttttatcagcttccttttttcaataaaagctgttttaaggaagtattcagtatttctgtatattcaatggaaacaaacacatggaatctgtactactcatatacaatgacattaggaaagggtttagctaaattcttgtgtggcaaaatcacaaggtttatcgtttatcaaggaagacctttcatgtacattatcagagtgtgcacctgaattaccaagggctttacctttcatggggagaaaaggacagattccctgccttattcatttgcctctagattttgagatctaaatgccaggttcactttaagtgctaacatgatgaggcaactgttacttatttgcagtcctaaatgaattgccagctggggaagtcaccaagcaggtttccttgagctctgggcttgccaaaaacacaactcagggaaaccaatcaagtacgtttttcttctcttctctttttaaaaggattgctaatccttaaggataaattataattttaatgaaagtcctttttttcaatactaagaaacaacaagtgttccagaaaggaaatctgtctcatcatgtgttactttctgttactttcaaattagcagtcactcaatgcaagaacttatcaagttcgatttctctcatttatgctagcttcctcatgaataacataattgcttttacaaaaaaatgtagttttcaaaagaaattaaaatataagatttaacaaagaaattatttctcaaaactttttttaaaaagtcctcatattcgattctcaaatacgtgtgcaaaacagagatttaaaatgtttcttaagatctcatcagcccctttctaacattttctctctcctcttgccccgtatctacacaatggactgtgtatggatgaaaattttctctgaaagaataaataagttttcttttgattaaagacaagtggaaactttatactcaaactcagaaaactagagcataatgaatcattcccagatcaattttaaaaatagatttattcaagaatgacatttctctcaagaaaaatgttaaattgtagacatatagctgccttcactgctatactgtgcaaacatcgaggatgacttttggtgtatctctgttgccgtgtttattgaatctataaaaacaacaagcatctctcctctcccctaagctcaccaggcttttctttgaagtcacctctctcccccaccaatctttgactactaaattcagagatggtcctttgctgtttgaagctctgaattactacttacagacagtatttcttctcagtcaattcctacccacaaaccatccatcttaagcggcatcagtacctcctcctcaatcacttttcacacatgttctaccctagaagtcagctacgtatagaaggtaataatacatgaataggaactggtttcctctaggctgtatgtacaaggttctatttcatttgctccaaaatatttttagttgatctcttttgaaacttattaaccaagcatgccaaacaacataaccgtaatctttttatttacagactaacatcagatcattttaaaacaccactacagatttagtcactaaatgcaaccactctatacgaaagaggtaagtaataaaaggaaactacattatttacccttgatgttattaggaagtaacttaagttccaagtcataaataaaaataagagatgcggctgggcgcagtggctcatacctgtaagcccagagacgcaaacagctgaaaataacgtatcaactactaggttataaaggctaaaatgtttttgttttttttttttaaaaagcactttaagcacttaaacctattctgaccagttcagaaattgtttttctgagtctaaaggcccagtcaccttattactactatatccttggcatgtgtgataaatataaactagaacatttctcttggaaatgaaaaatgaaaaattatgagaattaccaccactacatttctgcccaggcttagattggaaacaagtctgcctgttttctgcagagtcacaggaaagagcatatacaacacaaatgacaagttctatgaaaaagaaaagcactacaggtccagtgcttcaggcttaaattacacaactgtggtttagtgcctgtttcgtcagtcagaactttgggagagtttatttgcaaggtgagactcttaacagctgcttatgtagcgagatccaaaaactaaagaaaaacttccaatgattaccagttgaagattagttgaagtgtttcagaatattaaatcttatctagaataagaaagagtccaagatatgaaatagctttcatgtacataagtgctagactgtaaagcaaagtcagaatgaataaatctgataatgcattagacgatctttatgcttatagtcaaaattccgattaatttcctttccttttaatctttatgatttccgaaagtattactatatatatatataatttttttttgagacagagtttcactcttgttgcccaggctggaatgcaatggcgtgacctcagctcaccgaaacctctgcctcccgggttcaagcgattctcctgtgcctcagcttcctgagtagctgggattacaggcatgcaccaccacgcctggctaattttgtatttttagtagagacggggtttctccatgttggccaggctagtctcaaactcctgacctcaggtaatccacccgcctcggcctcccaaagtgctaggattacaggtgtgagccaccacacccggcccacaagtatgatttataacttattctcctttaaaaaggaatacaggactctctgtattaagtatgaccagaaaaaaaaagggaatagcacttcttcatccttatttgattggattctgaattttaaaacacaagtttacagccatgtgatttaattaatatttatcatttacttgaatatagaagaacagaattttacactcaactctcttgatactaaattctgggtatatcaaaaatgaaaggcaaaataaacttaccttcagagaatcaactaaatcatcaactaagaagaggcgcctgagttcctttatcgtgcagttcacatgaccaagagcagaattactgtacttctgaaccaactcctcagatatagcaacttcagattccagatatgccctagaaaacaaaacacatcataattgtcactaattggagtgattttcccctaaatgtcaatcagaaattatatatctgtaagaaattaagaaaatattctactataaaagccaactgtttccaaattaggggcaatataaaaactcagcagtaaggggtatttccttgatatgcactgtctgctgactagcacagaaaaagcatacactttgaagccagactgatctgggcttgaatctgatgctctgccacttacctggctaggtaattttgcaaagttatttattcttccctctaaacttagtttcctcatttataaagtggagattatcatgagaattcagtgagaaaagtgcctaatgcaactgagcacaaggatgcactcagtaaatggtagttatgactatggttgtttttttttttttcttaaagttgacactatgttgtctcatcacgttttcctaacaaagatctttttcatttccaaatcctaaactctctcagactaacctttaggggaaattgttcaatatgtcaagcaccagattgtaaagtggctgccaaaagcacagtagcaatcctagcaaaacataagagttacatcatctagatgttttaatccataccgagatggctaaaattgttaaatttaaaagtattgtattggtaataaataaataaataaataaataaataaataaaaatactatactggggaaaaagtcaagtccacaggaatgtaagaaacagtttcattactgtttcaaagaagccattttatcttggcagggtacaaccaactcagaagtgctgagtgttccctcgtatctgttggaagtagtcctcataacctccctatgtctcaggatgccagtttcttacagtggaaataacatcttagacaactccttgtcccatagttttacctctgcaacatgccccaaatatgtctcctggtttttattcacagtgccatcactctattttaagcacttactatttacgagctggaatattctatcactctccaaaccaatctctgatctgcctgcatccaaatccattccgtcagccaatgccagaataaccttatgtgagctatcttagatagtgctgtctaggctgaactcaagcaagagttagaagacctgccactacctagctatacaacattgcaaaaggcatttaacttctctgggtaagtgctccaactctgtaaatttgagaaacagactttcctcagttccttcaggctcaaacattctgtgattctatgactccaacttttcaaccagggacatcctcctaaatctttccaaccttacttccaactactctttatgttgcagccagaaatgagtcattcactaagtattttttaaccttaatgtagcccttattaatcatatggttttcccaatctgcaatgctctcttacctctggtgataccttatttagccagttagccccatctcaaatctcacccatacatagagccttatctgccaatctctttcataaaaccctgatgttctctctcactcctgtataattctaacaatgctttcttttgtgttagtcttatagtatttactagattcagctctgaaatatagacacatgtatacttgtatatttttcctactagagtataagctgttatggaccaggaatgtatctttactaatacatggtctaacacactgttagacaattattaacaaaaaactgaattattaatatcaagttaaaaatactcaaatactcgcactgatatttaaaccagcaattatttgtttacccaaatttgagaaatataggaaagtggctgatataaccctggttggtattctgcttctttgtaccactgttacttgttcttgctgaagacaagatgcctaagcagaagccataaagacagtactccccatcaatgacatcctgtagatatttacactaattcaactgacatttatgtgatattaatacaatgccagcactgttcatcactcagtaaccacaggtattagatacaaaccacataatatcacctctactagtatgattaaggggtactaggaaaaactgtccaacaagcttaaactggtatgttggctgaatttactttataatgactataaaaggactttaagaatataaagtgtttctagccaggcacagtggtgcatgcctgtagtcccagctacttgggacattgaggcaggaggattgcttgagtccaggagttcgagactagcctgggcgacacagtgagacccatctctttgaagaaagtttaaaaaatgaataaagttgtttctaagaaggaaataaatcactaatattttccaaaaacctcaaaaatcaaatgatgtgtaaaattggaacggtagaaaatttagaagttttggcttgacaatatttttacatatttcagcataactaattaaaaatcatacttctttatgatttgtggcttgataataatatgactcggccttttttttttttttttttttttttttgaaagagtctcgttctattgcttaggctggagtatagtggcatgatcacagctcactgcagccttgaactcctgggttctagcaattttcttagctcagctgcctgaatagctgggactactggcatgcatcaccacacctggctaatttttaattttttgtagagatgggagtctcactatgttgcccagggtggtctccaactcctggcttcaagcaatcctcctgcctcaggatcccaaagcactagtattacaggcatgagccaacacgtttggctggctctgccattttcaaactacaatttcaagttactgaattccaactttttccccatcaccccataaaatggagtgataccacctatctcacagaattatcacaaatttaaaataaacttattaaaatatgtacataaaaggttagacacataggagctattcaataaatgttggtctctccccctaaacttgtataacatcattacttcatcacaaagagaaagccagagaaaaatcaccagtctttacaataaacaaaataattcagtaggtctcctctttcaaagtctgtaaatccatttaagtttacccattaatatcaactggatcatgttgtaggtaggtacatagtcatatgcccaaacagatattaccttgccacaaatagttttttcctttgtttcccctactttcaagctaacaagttagaaatagtttttaaattatctcaatctatttgaagaaaaatgatctccttatgcaaaacaattaacatttcaaaggcttagttaatgcagtaggaactgaattttcggatcatttggggtcagggttaggaaattctccaaagagctgggtcttgaaccaaactaagaaccaaataaaaagtatgactgaggcagctaaggaaggcagcatgaacatgggtacaaaactctggaaggggtaaatgagagacaagacaaagacatatggacttcatcctacagtctatagagggccggtgcattttcttttgttttttttctctttagaaaaaaagtggtacttctagaaaaattaatcggacatcatctgtaagaactgaagtaatccgaggtaactacaagtcaatgtagtaacaaatggagtccaattaggggtcagcaaactttctgtaaagggccagatagttaagcattttaggctttcacgtccatatggtctctcttaaaactactgaattctgctattacagtacgaaaccagctacatgaatgagcatggctgtgttccaacaaactatttacaaaagcaggcagcagactgcatttggccatggccttgctttacaggcccctggttagactgaggaagcagtggaaaagaacaaaattttgtgattttcctaacaatatttagtgattttctttatatgagatgaaaacaaagataacatcaaaacaggagcctgaaaactagcatggtagtggtgttatggatagaaattaacaagtttgaggggaaaagttcatttaaaaacgtggtgaattagtcgttgtcgggcgttggttggggagttgaactgttaataagtaggaagtttctttttgtgcgatgaaaatagtgatggttgtagaattctgtgaatatactaaaaaccaatgagttttatggtatatgaattatatgtcaattaaaaaagagggggaaaaacacgcagagtatgaggtgagggcagaagactcaagctgaggttgtgtctccatagcaactatataatgctatagtatacttgtgaaaacaagggtagaagatgatagttgagagacaaggagatgctgaaataaagctctccaaaaaataattaaaaagtaaagccttaagaaacgagaagaaactagataaagaaaatacataaagaaaagcataacagaaaacatcagcatactagaaagatacgaaatatcagaaagcacgttatcagacagcataaaaagcaataaagaatatcctcatcaaacctacccatgttaaaaagatacaacactcattcaagtaagataaccaatgcttaactctaataaatattcctaacaagtagcagagttagtttaatgatacataaacagtctcctccatcatgagcctttaaaacgacttttagaaaatctcaaaagcagatgtttttggtatagctcaagcaaataactgcaattatctttaacaaaaaaatgcatgcttgtaactctatagacagtagatgaagtcttaataccaatcctgtttacactattgccaatgcatgccttgttttccagacatctcacctgaatgggtggccttcatctgatttctggatagcttggatcacacccttgtatatcctaaagctgatggtcacagagagcagggccaaggcaatgtaggctgttacgctcacaatgctgaatactgtcaatgaaagcagcaggaataggctggcaccaaacaccactccagtcttcttaatgtctctccagtacaggaggtcaacaactaaaaattgaaaaagaaatctgaaattagaatgttattttatcaatttggatttgctccatctatgaaaacaaaaacgctactacataaagtaaaatcaaacctaaaaatttaaagaaacactaagttaaagaaacactaactttataacccacattttaaacccactcttagttgtatattagtataacacctttatttttgaccacgaaatgttttttattcaaatttatttctgcataaccaaatcattctagccatacacaatgattaaatgtctccaaagcctagaagacttctaatccaaaacaaggagttacttaaaataatcttgggggctgggtgcggtggttcatgcctgtaatcccagcactgtgggaggctgaggcaggtggatcacctgaggtcaggcattccacaccagcctggccaacacggcaaaactccgtctctactgaaaatacaaaaattagtgaggcatggtggcgcatgcctgtaattccagctactcgggaggctgaggcaagagaatcgcttgaacccgggaggcagaggttgcagtgagccgagactgcacctctgcactccagaatgggcgacagagcaggactctgtctccaaaaaaatcatcttggggtttttcatctcatacaatgcatgctatatattcaaataattcaataaatatattccaataacagaaaaaatattaacacactaaaatgagatacttcagtgataccaaaatatatttatatgcagaaaataaatttaaaaaggccgagatacaaaaactacacatatgaatgagctttttttcttatttgatttttttgtgctagtaataactctgctcttaagatctgtcttttagaaacaaaattgtaacttaacctggctatcattaaaagaagaatttcctacaaagaaaaagacaaaacaaacagcctttcgattacctgaaaagctacttccttctaagagttgatagatataatgccataaaaatttaggggtcaaagaaaaaagaaaagtaaatgtgttacacatttacataatgtttattaatagtaaggagtcagacaaagcccaatttagcatgtctgctcttggacatggccacagggccactgaggggatcaagtaagcatagcctgatgtctcaaaatcgggttatgctcaatgcaaggagaaccccgaagtgtgccaaagtgctcttgaattcataggctgatgtaattaatctctctctgaactgtgaacaattgggagaaaaaaatttatagtaaatatggatatactctttctaagaagaggtgacatcaaagaaaaatcacagttttagggctgctttggttttgatccccaaggtcccctaagatgtatgtaactttcctttgctcttaagggtacttctgtagggaaaactatgtatgtgaactgcacaatgttggatattagtacaaagcccttaactgctgctagtatatcatgagtactgtttaggatattttaaatgcccatcactgtgtccagtacatagcagggattcaaacacttatttcagttgcctaaatggtctggcttgaatgctattaatttaacattctatatatgatttcgaagtttgttttcaaactctgatttcaactatttattcaaatattcccaaacttgtttgttacagcccctgcctaaaacatctaaaggcgcttagtgctattccactagtttctactattgtactagcacaactgaggactgacaagaacttgaaatggcctatctataggttgtcaaagggacattacgaataatgtcatattgaataaagagataagagcaacgctaataggtttctggcaatcagcaaacacttaatgaggtgaaactgttcaagtaactcaacctagcagaatgagaaaactcattctgattcttgaaggtcttgtccaacattacaattctaggaaagataagacatataaaagcaagtcaatgaaggtataaaataaacattgcactgctataagaactcagaaaagggaaaaactggaagaaatgttaagactgtgaaatactgtaaatggaaactgagctgggtcttgaagaatgaatgcgacctagaaaacctaaaggtacaggcctaactgtaagcatctttctgctaacagtggttctaataattaatgcctttttttttattaggagggtacagtgagagaacacggggagtgatgataaagacagcccttggtaggatcactctttcctgtgaggctgcctttgtaccctacaacggtgacttaatacacacaaacagaaaacttaggttctatagttgggtcacctagactaaaaaaatggttgaataacttacgagctacgtgacctcaggaaagtcactaaagtcctctatatttcagtttcttcatctataaaatgtatattaaaataggaatgaacaaaaggcataaagtttctagatagaaaggagaaaaaacttttgagatttactgcaccccagggtgacaacagtcaatagttgtatgtatttcaaataactgagagtaaatttcatgtctcaccacaaaaataataggtaacaaggcggtactttaataagtttgatttaatcacaccacattgtatacatgtcaaaacatattgtaccccataaatatatacagctatgatttgtcaataaaaaaataggaatgatctcattgagatgtgattcactagatttttcattagtaagataattaatgtaaagcacttaatagagtacatagcatacaataaattcttaataaatgtcagtgctatttgttgctgttattattaccacaatcacaatcatcttactcaatacttaaatagtaaatacataaagaagaaaatttcaaacttattattaactttaggttaataaactatactgttgtgttatattgtaaacatgttactttataaaccatatgggaaagaattttaaagcttatctaagtttttactattatagggtaagtaaaagctaatagcccaaaggaatcagcaagtaaggtgtacctcaaatatatttttcttttactttttttttttgagacagagtctcgcactgtcgcccgggctggagtgcagtggcgcgatctcggctcattgcaagctccgcctcccaggttcatggcattctcctgcctcagcctcccgagtagctggggcaggcgcccgccaccatgcccggctgattttttgtttttttagtagagacggggtttcaccgtgttaggaaggatggtctcgatctgctgacctcatgatccgcccgcctcggcctctcaaagtgctgggattacaggcgtgggctaccatgcccggcctctcaaatctatttttcatatgaacaaatgctcctttataaaagtggttctcaaactgctcagaaacattaattaaccttcaaaatcactattggtgagaagttaaagtaaatgcagatgtacttgctattttttaccatcattaaaaactactcagtaaaacctggccatgaaatcaatgactttagatttgagaggtttgcactgtacaacataaattaatgtctaatcaaacttcctaatattataacagagttactgtttaaacaggtgtagtgactatatatgaattatttataattagtctataatttctacctaaatgaatatggtagaaggaaatatcaggactgggattcaagagacccacatcctagcatgtaccagctcagcaattgtgtgattttggatacgactccaacctctctggccttcagttttatcgtccataaagggcattaatcttctaatctctcttttcccttaaggaattaacatgacccacagtcagtacaaagatacacacattagtactgcattcaaattccctgtcagtggatccaaaccgatgaagttttactactggggcattatctgtgctcaatataattttaaaatatttccttcctttttagatctagatttttttggggagaaggaagcttaaatatttttattcataccagtcttctgatttgaaccttcctagaaatatcttaagtaccagacattattaaaactttaggaaaataacaaattcatattcctacaatttttcaagcaattataaactctatcattatggcaactgtatgagagaaactttttaaaagtttgaaaaatgatacgcttaagcctgatagatgttttgattgctgatctacattctccaatctccacacctcctttatgccaaacactgcagtagcctatacaacattatctctttcaattattaaaacctaatgagccactatgcaaagtgggttatgcctgtaattccagcactttgggaggccgaggtgggaggccaggagtttgagaccaggctgggaaacacagagacccctcatctcttaaacaaacaaacaaacctaatgaaaggtaggcttgaaagagtgaaacccagctcctacatgactagacccagatcacatcattaataagtggcagaacatggatctgaacccaggattcctatggataaaaactcatattctccattgtatgatgccaaattgaaggcttagctgattaaagtgcttcaaaatgttatacgtgtgcatgcataacaaatgggcaaagtgtaggcagataattacaacatgcaagatgaatcataaaggccaagaagaaaagctaagtgaaattaacaagatagtttaatcaataagggacaaattttaatgtgaatatttcacctactgttagacccaaaaaccgagaacagggctttactccaatatatttgataagtactttcccacagtagagaactataattaagttgttgaaaaatgacttttaaaaactatgtgaatctaattaaataaaatcagggtatatttatgcaagagaaatgtgtagccattaaaaaaaagtgatacagatctacattatcacagaaacatgtccataatgataaatgaaaacagcatgttacaaaaagactcacagtatattctcacttaagaaattaaacatatggccgggcgtggtggctcacgcctgtaatctcagcactttagaaggccgaggcaggtggatcatgaggtcaggagatcgagaccatccttcctaacacggtgaaaccccgtctctactaaaaatacaaaaaaaaaaattagccgggcttggtggtgggcacctgtagtcccagctactcaggaggctgaggcaggagaatggcgtgaacccgagaggcggaggttgcagtgagccgagattgcgccactgcactccagcctgggcaacagagcgagactccatctcggaaaaaaaaaaaaaaaaaagaaaagaaattaaacatataactatgaagtctgaaagtatatctactaagcagtgtttttatctctgcataacgggattatcaatgagttttacttgcttctttactcttttctgtgccatctgaaatggtcccactctaatggcaagcatgaatcatgactataatcagaaaaaaattcaccccattctgtttctattcggtactactgaagagtcttatgagtgttatttttcccagtaggctttcctattggaaaaagaacaccctgtctgttaggttaataaatatttggatccagccaacagttaaaattctagcagtatataactaagttgatgattctggtgttctgcgttgaatcaagtcaattttcccaaagttaatgataccagaatagtcatgtataaggcccagcagtactcaatgatagtaagccctaacctaccacttcctttcctcttgtcatatggttcctaggaacacggtcttttcaataaatggaaaagctctgaaaattacatacgtaagcccacacatactgaataaaaatatgtaagcagctacatgagagtagctcaaagcaggtatcatgacagacatactgaaacaagtactaggaatgctctggtggagccatcagaccctttagagccctggaggaaaacaaaaagggaagaacagccaagagaaatgagacaactaggcactgatagtcacacataagataatatgaatatatcctagaataggaacacctgagaggcaatctacactgccaccaaccccactgtgcaaagtacagaagaatttccatctttttccgtaaagaagctgaaaagattgttagtgaagctgcaagaatgaaaaaaatattagttgataccaaacagtgtggctgacttaattgacatttgccaacaaaatttctagtcccttacagattcctcaaattggttttaataaaaaaattttgaaagattgtttatacaggataaatgattctcaataggaggaatgtatagaactttattaaaatcccttctgagaaatatagtgtttttctgagaaaaatactgttgcttctaatggtcaacaagagaattattagttaatttagatttattagttaacttagaagtttgttcaatcctgataccaaaatcagacaaagacatcacaagaaaggaaaactacagataaatatcccttatgaatatagatgcaataatccccaacaaaatacaagcaaactggatcgagcaacatataaaaaagattatacaccatggccaagtggcctttatctcagaaatacaagattgattaaacatacgaaaatcaatcaacacaataaatcatattaataggataaggacaaaaaccacatgatcatcccaacagatgcagaaaaagcatctcacaaactccaacaccctttcaagataaaacatttaacatactaggaacaaaatggaacattatcaacctgataaagagcatctacaaaaacccacagctaacatcaaactaaatggtaaaaatctttccccctaagactaggaacaagacaagtacatccattcttgccacttctggtcctgggggtgctatgcagtgcaactggccaagaaaaagacatacaaggcatccatattggaaaggaagagattaaactctatttaaagataacatgatcttatacagtaaatcctcacttaaatgttgaggatagctttctggaaactgcaactttaagtgaaatgacatgtaacagaaccaattttaccataggctaatttatataaacaagacttcattttctatggcatatttctggtcacaaaaacatcatcatattctaaataaaggtcgggcgcagtggctcacgcctgtaatcccagcactttcagaggccaaggcaggcagatcacctgaggtcacgagtttgagcctggtcaacatggtgaaaccccatctctactaaaaatacaaaaattagctgggcatggtggccggtgcctgtaatcccagctactcgggaggctgaggcaggagaataacttgaactcaggaggcggaggttgcagcaagctgagatcacatcactacactacagcctgcatgacacagaaagaccctatctctaaaaaaaaaaaaaaatctaaataaagactcaaaacacttctactattaaacactgaaataaagtaagctatatatacatttaagaaagattttttaaaacacaatttttggtgaatcagtgatggtggttgtagtggtggtgggttaaatcaaggaacaaatgtctgcaaagcaaatactgtggtaggagcacctcctaccaccaccacacagttcagaaacaacaaatatggagggatctctaagtgccttcatactgcatcatttattgttgtgcatttgcatgattattatatactttatgggtttttattttataataatctgtattcattcattcattcgttcattcattttctaagctgcttattccagttctgggtcacgggtggccagagcctatcctgacatctcagggtgcaaggcaggaaccaaccctggacaggacaccattccatcacagggcacactcatacacacacccccacactcattatgagacaactgatacacaccagtgaacctaatgtgtacatctttagaatgtgggaagaaaccacagagtacccagagaaaaccccatgcagacatggggagaacatacaaatcccatacagacagtggccccagcaaggaattgtttttttttctcttcctcatgcacattataacgaaacaacactgaacaaaacaatgatatgagggtctgttgtatgtattttaaaaattctaaggaatccacaaaaagctactagaaataatgaatgagagtccagcaaggctgtaggacacaatatcaatatacaaaaattgtatttctatacactagcaataaacaatctgaaaatgaattaaataattccatttgtaatagcatagaaaaaataagatacttaggaatacagcgaaaagaatttcaagacatatgaactatacataacacactgtcgaaagaaattaaagatgacttaaataattggaaagactcctgttcatgaattgaaagacattaagacagtaacactcctcaaattgatctaaaatacaaacactatcaaaatcccagctgtcttttagcgaaaattgacatgccaattgcaaaattcatatggaaatataagggatccaaaaaatcaagaaaaacttgaaaaagtacaacaaaggttggaggactcgaacctccctatatcaaaacttcctaaaaagatatagtaatcaagacagtagagtagttacacaaggacaaacaggtagattagtggaatacaactgataacccagaaataaaccattacatttatggtcaactgactttcacaagggtgccaaggcaactcaataagaaaaaaacagtcttttaaacaaatggtgctaggacaactggatatccaactgcaaaacaaatgacgttggattcttctacttcatatcacacataaaagttaactcataacggccgaaagactcaaagttaagagcttaaactagaaaactcttttatctttgtttcttatctttttgttgttgttattgtcgctgagacaaggtctcactctgtcacccatgctggagtggagtggtgcaaaagcaggcagcctcagcttcctgggctcaaacaatcctcctgcctcagcctcccaaagtgctgggattgtaagcatcagtcacagcacctagccagaaaactctttaagaaaaaaataagtgtaaattttcatgactttggattaggcaattgtttcttacatataacaccaaaagcagaaacaacaaaagaagaaaaaagataaattggacttcattaaaattaaaaactttcaccacaaataaagtggaaagataccacacagaacgagagaaaacacttgcaaaccaattctctgataagagacttgtactcagaatatattgaaaaacttttacaacagtaaaaaacaatttaaaatagacaacagatttgaatagacatttctccaaagaaggtacacaaatggccaataagcacatgaaaaaatactcaacatcatttagtcattataaaaatgcaaaccaaaaccacaatgagataccacttcataccccctaggatggctataatcaaaaagatgagcaataaaaagtgttaacaaaaagtgatgaagattagaagcctcatagattgctgatgggaatgtaaaattcagccactgtgaaaaacaatttggcagttcctcagaaaattaaatacagagttatcttattacctggcaattccactcctaggaattttcacccaagaaactagaaaacacaaaaacttaacacacaaatgttcatagcagcattattcatgatagccaaaaagaggagacagacaacccaaatgtctatcaagtgatgaatggattgttttaaaaaaaggtatatccatataacagaatattattaggccataaaacgaaatgaagtgcagtagtcctcccttacctgcattttccctttccctggttagagtttcctgcagtcaaccacagttaaaaattaggtgagtatagtacaatgagatattttgagaaagacaccacattcatttaactttagtatactgttaccatgattctctttcattgttaaagttgttaatttcttactgtaactaatttataaatttaactttatcatagttatgtatagataggaataaacagtatatatagggttcagtcctatctgcagtttctagggcatacgctaggggtcttagagtcttacccctcaagaataagggggaaactactgtactgatacatgttacaacccagatgaatcttgaaaacatatgctaagtgaaagaagccagtcacaaaaggccatatattttatgattctgtttatatgaagtgccttgaatatgcaagttatgaattctgtagagacagaaagtagataagtgattgtcaggggctggggaaaaagggaagaggagtgactgctagagggtgtggggggctttttttgggaggggggtgaagaaaatgtcctggaaatagatttaaaactttaaaaaaatagtcatttcaacatacttctctactaggttgtaaactccataaaagaacatgtatgtcttactacctaactttatccccagagctgagcagaaagccaaaaacaactaaattttcaatattactgttgactgattagaatgaatgaataccttatgacaggtcactaattctaattgatttatttaaaaaatgtttctacgctttagacttaacatttattttatttacactattttcagatgtctacatttattaaataacaaataatgctttcaggtaatttataaaaaagaaaacactgttttgcaggcttgtctccccttactagaccctggaaaactgataaatgcctttcatctttatattcccattacctacatcattaatgcttgctgcactgtctgaatagcggccagattatttttagaacagaaacatttaaattcattttcaaattaaaataaaggacacctttcaataagaactacaggatcaccaaaatgctaattttggattcctcagtaatcactttagtggttccttatttttgaaaaaccaaaattaagacaaagagtttatacagggaaagtttaacttttcttggttcctcaagtctccttctatactgcagaataaagggttaatcatacaaggtaaccctattctgtggcctcaaccttactcatacaaaatgttcattaaacatcctttcaaagatctgagatgaatttagcagtacttttccatttacaactttgggggaatgcttatgaattgctaaaaataatgttcatcaattttaacaaacccttgtagtttagaaaaaagtaatttatgccctgcagtccttgccgtttgtctccaagataaaaatgtgaaaaatgactgtgtgtaatagcatctttatcaaaataaaattttaattcaaaataactcagtacacttaaatcttttctttaaaataaaaacttctggctcaatgcacagtaagaagagctgcctacatttggtaatcacaaactgtcatctgccatagctaaaaatagtgtcagcctgcattgtgcatgccttacgtgcagaagtcatccaattacattttgcctcaaatcaaattcttacattcttctttgaacagcccgaagtcaggtttcaattttaaaaagcttttgtctgggaaggcggggcagtggggagttaaactggctgttcctaaaaatactaggacagggaatggctggcagaaaaatacctacttttgaagcaaaagcaaatattaagttctctttaataatgccaggtgaggaatgagaatggcagttaaataggaaataaacaaatgaatatataaatattagaacggtattaaaatttcagttgtttttcacaaccatgtttataataataagtaattatatatttattaagaatcacaacccttaatcaaattcttcccaaatgccaggaaaagtaattagaattcagaattgaacatttagtactacgtaatagtaagcttttgtctcaacacagtaagcattcacctgtcaaaaaactgacaggcgaaggtccacaaaaaggatctgtgcagagtttagctctcttcacaaagacattaagaggaccttaagtcctatttcttttgagtcctatttcttccttcaggttagtatcaatatgatctgagaagataatgtaatctctgtttccctgtgtgtaaaattagaaaaataatacccacccctaagaaattatttgaagctgaattgaaatttcacatatggaaatgcttggtaaactgaacacactggtactaaagctcaagagataaggtcaagaaaggcaatcaaatattatatgtaatgcttagctaagccctgattttttaaaaaaggtgaattcaactttctctgaaagtatatgtaaagaggtttcaattagcaagtctcagcctgatgggtacctgttactgctacaaaagtatctcaaccaaatacctggcaagccagcatctgtcttggctatctcctcttcctttaactagagtttttaaacagatacgtgcaaaatttcaggtccttgtctcttccactaaatctttcctgtcttactttgataacgttacagtgctttggcgaatttgaaccaccacacctaagaaaataacactttacatgacaaacaaatagcactaataaacaatcagcaaaatttctatacttcccctttctacaataattttgtaatctcccagtctgagcaaggcactgtgctgagtacattgtatacattacctcgaatccataacaactctaaaaagtattatctgcattacatatgtgatgcaaatgtatttgtacatttgtaatgtaaacatattgttaaataaattgtgtagggttacaaactgaaattcaagtctgaccatgaaggtctcactctattataccttttgtatttaaaagactatattaatactcaagtttctttttatgctacttgagaataccaaatgctatttctaccttagtttaaataattgagacaggagacacaatttactaacactacgagtagagttataggtgagaccaataaatttcattaagagattcaataataggaataaaccatgttttgtttaaattgttttctagaagcaatctgaattgttctcaccttaaaaataaatttatactataaataacaatctatgtaattacatatgaactataaaaatagataaaaaagacattggtgaatttaagaatgatattaaaatttttaaataagcaataaacttgacaaacacagcatataaagcaacgaaaataccatttctagaaaatctccaggaaacagaagccaaacataaagatgtgaagttaagtcaatgtttactattcattttattaaaaaaccaatcctacacccaggatagaaccttattattattactgagaacaaacggcctttacaattaaaatcgttgtaaacaccgagtgtgttttcacacacatactcctttccccacataacatgaactaaaagatggtttgtgatttaaaaaatatgcgtctctagctctctagtaaccaacactatttgaggagtacaagattctcttacccaagtttagtattgttaaatggtccctgcagttatgaagttgcataggaaagaaaattttcataaataagaaaacatccactaagtaatcttcaaaattaatccaagctcataaatatcccttactgtttaaattcaccatccagcctcactcattacctaaatgtcttgtcagataaaaccacccaaatcaacagtgcaaaattgcaaatcttcctattaacatgaaattccacaaagttaatgttgtgagtgatgctggagaattgctccaaaaaacactgacagtccaacaggcacttcaaaacggagcctctcacttcaaaagattaggaagagcccccaggaaagtacatttttaaaccactgaacattttttgtaaagggacattatatatgacccactgtgaaattcaaccataaagcaaaagaagccattttgtgctagtatacaattttgtggcaaaaattacattcccctaaatcccaaaaacctgattcatcctctatgtattctaaaaccttatgcacggctgtgattataaactaaattatgttaagaatgaactaaaataaatttattttcatagttattggtttttatgtgccaagataaagtcaatcaaatcttattttatttatttatttatttatttatttaagacagtgtctccctctgtcacccaggctggagcagagtggcatcatcatagctcactgcagcctcgacctcctgggctcaagcaatcctgccacctcagcctcccaagtagctgggaccataggcgtgcaccaccacaccaagctaattttttaaaattttgtagaggcagggcctccctatgttgcccagactggtctcaaactcctgggctcaagcagtcctcccactgtggcctcccaaagtgctaggattacaggcgtgagctacaaggcccagccagtggtctttttttcctatatttcaagtagaaaatgcctcaaatatgttgcaggaacataaaaactacctatggctgtttgccatcttctaaggataacacgaatttctctaagagaaaagtgaagttcaataacaccatacatgcttcatttataattaaattcaccagtttacttcattagttcatgtggttttcaatatttcccttaatcctacactctttccagctttactaggagaaaacaagcaaaaaagggcagaaaacagttctaattttgcactcctagttttcctaaaccatgataattttctctttacagaataatcctacctttaatttcattttctctaaggtaaagctaaatatcttctctttaagtatgttggatatacatgactctccctacctgcactcactttaacgatttttcaattgtaaagaatgttaaaatgagaacttctcctatgacaagtctgtatttctgatacatgttgataagcatgtggttattaagttactagaattgatcaagacctgcataaatagaaacctaaaattagaaaataaactggttcaatgtataatttactatagtttaaattttccttcttgttggcccatctaaagcttaaaataagtaggcaccaagtcttagaaacctgaggttactgctcaaaaccctattttctactaacaaaaactaaatggaaaacatactgtcccgtaactctagaaacttgaagcttaatatactggagttgggggaggggaagagctcaaagcaaattactagttcaaaacacagaatgaacctcactagtaagtaaatcagttatatttcttcttccataaccttatataactgttgtacacacaatataaatgttcatcgaatcaatgaacagtacaaataatcattaatatttgataatttggtaatttttcagtttttaaattgctttgagcttcataagaaaatgttatatagaatatggtagtgatatagtatttgaagaaagacgacacaaaatattttagtgtctataatacgtccaatgcctaaggggcagctgaatcaaacaaacttgaaagccatgaagcagattaaaaaaaatacacacacactcagtaatatgtcagccttattcatgatagagcagataaataagtataaatgtggtgtcagatcactgctccaaggatgcaaagaaaagtattgcctaaattaaacatcatcccttagcccaaattctagcaagagatgggaccaagtgaatacagtcagccctctatgtctgcaggttccacatctgcggattcaactaactgtggatggaaaaatgtagctagacctatgatgactgcatctgtaactaagcaagtacagacttttttcctgtcattattccctgaacaatataacaactacctacattgtaaaaagtaactcagagatgatctcaacaagatgtgcgtaggttttacgaaaatactgcaccattttatataagagacgtgggcatctgtggattttggtatccatggtgtagggggacgcggggtggagggctggaaataatctcctgcagatactgagatggctgtacataaaaagggaacttaggggacaaccggagaacaaatttaagaattctattctctgcctagatattctgcctacatcccagcatgtaatccaatcctgaaagatgaaaagaaattattctcctggcccagagaactcccactaggtttaaccttttgacaatacctgtactaaatgactaaccacacctaccttcttccatgattagtgtgacagacaactgcctgccttttttattgcagtgaggacaatacgaaagaagtatacgacattcaataacatgccacaagtagactatgcacaaataaaatatcaaaacatgggccgttttagcttatatacttttcaatctttggttattcaagtgcaaatataaattataaaataaaaacaaaggcttcatgccaccatggacctgtggcatggtcctgtgtgggcctgacaaatatttaaatctctcgttttcttggtttccttgtcagtaaaacaggaaagttggaataaatgattaacagaatgccttatctgcaggaatactctaaaaattctgaatctacagaagttccttcagttgctgaattgttcctttaagaaggggaaaagtgggggaatcctttttctaattgctcccacttgaaatcatattttaaaattttccaaaaatttatgtgggtttaaggccagaagtaaacctggctgaacaatggagttctcagccttttccttcattgacaagctgcaccaagtcaatcagaagacccagtgatgaagccatcactgtttttggccttcaaaaaaatttggaggctggaaaaagagccaagatatttatgtataaataattgtaatagaaagtacaaaatgaaacccctcatgcccttcccttaggggggaaaaaaaagtacaaaatgaaaaccgagagatgggagtgaggaacactgaactacctccccagggaggcttagtgaacacctcaaggagaaccgggcctttgataaggactacttcagcaaaatgaaatgggaagaaagggccttcaaggtggagagaaaaacacaagcaaaggcaaagaacaggtatgtttagaaaacgagtccttcagtgtggctagcgacagggagtaatgacagacgaaattataaaggttggggctaggccatggaatgcctttcaaacatccaggatagacagaagaaacttcatttgaaaagtaagtaaaggaaaatcccttaagtgccatgattagagttgcactttggaagagtaattttaatttcgctgtgacacacataatttagtggaaagatcagttaggggccctggtaaggatgaggagtacacagacttgggtaaataaaatagaaaggctatttccaccattgctcccactgcttacacatcttacaatataaagctggttcttatcaagtaatttaatgagttaacactgacgaaatagctatcttagagtaaaaactgtaagaaaggaatacatactatttaaccttagccacagatccatgatagacactcacattcactgatgaaaataacaatttgtacaatctttctggaaagcagttttgtaaaaggcgcccaaagcctaaataacataacccagaaatttggaaataatcacaaatagaaacaaagacttatgttcagttataatcattttagcattgtttttacaggttgagtattactgtaatatgtgggactagaatatgttggaatatttggaaatattttggaatacttgcatatacgtaatgaggtatcttgggagtgaggcccaagtctaaacatgaaattcattctgtttcatctacatgttatacccataggctggaagtaattttatgcaatattttacataattctgtgcatgaaacaaagattgtgttaagtatttatgtgtggaattttctacttgtggtatcacatcagcgctcaaaatgtttcagactttggagcattttggcttttagattttcagattagggatgttcaacctgtacttgcaaactttagcaataacctgatttaactagatggaattaaaatattgtagtcattaaaatagcgtacagtatttaaaaaataaatacttaatggaggaaaaagactacagaataaaatataccacaaaaccctcccaacacacattaccctgttaaaaagataccccaaaactattctctatgcgatgtgagttttactcttctacttaccttctaaattctctataacacatacctatgtagtgctgcactactaacccaagatctagaaaatgtatctaatgaatgcctaaatattcggttttaacaaagtttagaactgaaaggagagtcgttccaatcagtaggccccataattaattaatgccaaagttcccttgttgggcattttttggccttcccgagtaaggcatttcaaacagcaagacccctgctactctctaccaaaatgtcagtatgagctttattcaaggctttcaaaaaatgaaagtagcttatcataagtaaagatcagagagccctaaaagaatctctacacggaagtatgctgcagaaatggtccaaaactagtttgtcttgagatataattatattgagttttaatgctaggaacatttctttccctatcctacagaaacttctctcaaagattacctctggcacattaactgacaaatccaaagagtactgtaacaataaagaacagtgttgcacctacttttaaaatttaacaagattcacatccatttctcactcatattaaccagcttctctaagtatttaattgcccattccttcttgaaaattctttccccccttagtatcagttacactatcctgcttcttttactgctctagaacctcctcattttccctaaagccgcagacctccataacgcaggttttaggcttttctttcttaatagttctttcagtgcaaatctcctcacatagtattcacctgcctcactctgcatttgactcccaattctttatcattaaacctgtcatttatctgagcttccgagatgttctatcatcacttcaaattcaaagcgtctgaaactcaacttggcatcttttctattttagctctatttctactaatactaaaggactgtcattgccaatatttcactctaattcaaacttcatgttgccccttgagtctttacacctcatccttgtcctgcaaatctataccaaatgccaagtattccttccttgaatttctcaaatctgccgcttcttcttccttcctatttcaggccaaattcaagcctatctactttaaatctgggcacaactacagtcatcctaactggtgtggctataggttattctcccccagttgatcttatgcagcaccctaaaccaactgctatcatttaccattccctactttaaaacttccaaatcctttttatttcttttacaatcaaatccaaaactcaatgtcttctgcggtctggcccagggtatctcttccataaaaccagagaacctctcaactggaaccctgggcagcacgcaaatgaggaaattaaaaccaaaaaggtaagtttcttattctagccaaaatcaaaatataccagaaccaaggcttaaaccctagatcactgtttcccgaatttgcccaacaatatgaattacaccaggatgcttaatatgcagattgccaggccctacaaaatctgatttggtaggtcacgacccaaggaatctgcatttttaagaagcactagatgattctcatctacagagaagtatgaggaaacctaatctagttcatctaaattttctacattccttgaccacaccaatcttatctttcaactcctgtcctaaatattctgttctacccagaaagttatttactgtctcaactatagctttttagtggttatatcattctcctaccccatccaaatccctaggcctacccattccttcctattttaagctcctaaaaatcttttgactaccttaatcaaaattttccatataaccccagtaatcgaatactatgtaaatgtcatttgtcataagtatcctaaacagaaaatatgaagaatatataaaagaatgcaaattattaatgctttcagcctgaaagatcgagtatcttaaataccagttaatcggcaagcaaacacacacacacacacacacacacacacacacaccaccttttaaagaacactgaaatcagagcatctctcaaatctgtcactatgctatactggtggtcagggggagaatgcagtagaaaaatgcctaagtatattttttaaatttacctagaccctagattaggctccttctctgctgtcaaactattttttttttagatgaggaaaaactcattccatgacagcttccaacttctcagtgatttccaacttaaaccttactctgtaatcttaaatattactctgtaataataaaattgtctgctgatagagaaaatactaaaatataatttaaccactgactcagaaaaacaggcaaagttaatcttaccgaccaaaacagccagacaggtactaaaaaatattaggccattccacttacaaagtgaggctccccagagatattcaggagtaaattcaattttacatttgagtacctaaaaataatcaaacaaatctctggaaaaaatatgaactacattggaacttaatttctcctgtctcataatacctttaaattacttcaacaaataaagaacttaagatgttatttaatgatttaagacttaagttattaataaagaaccttaatagttgcagaatgagccctgatacgacttttcacctacttttaaggcctgtatttattgtattattatcatttgtatcattttcacttagcaaaagctaccatatatcaattcatcaatctgtaacgtcaacggctaacaggatgaagaaataaaaatccttctctttaaattcacatgtaaagaaatcctaaaggcaaaacccaaagctgtattgttttctattattttttaagttgcaaccataaaatcttaccaatgtctcaatatggtctcaatcttaaattcaccttttccccacatctttattgaacaaatttttaaaaagacattgtaaaagttactgtaattagctctacatacttttagaaatattgttgccaatcctgctagaaggaaataattttttttaattataaaacttgaatgtagccaggaaaaaaattgcttacgtagaatgtctattttggactacttaaaaatagctctaataatttaaaggtaatttattataagtggtcagatatacagcctaccactttcttttaaagaaaaaaaggtagatttaaccatctacataataaaatattctttaaatattctagtcaacattttaccatttacaggcttaaattcttacacaatgatccactgagatttgaaaggatctgggctttcaagggggaggaaaagggatcaaaatcactgattggttattacaaggacaaaggttagtgacttaaatatagacatgcatttaaaattactgcgtaattatactgtgtaatttgaatgatttcaagatgcacataatctgattaaaagaaagttggtaataattttaaaggttcaaatcagattttcaaagaagaggcttactgcaaacacaatatcttgctacctacaaacctttgcacagaatttcaactacaccaagtaaggttttttaaaatagtcacggaaaatatgtcactgtgaaacacaaaaacagcaatgtgtatttaccacatccaagtgacgaacaaatgaaatctgttagatctatattgtttacaatgtgcaagattagagaacagaacctaaacggcaggactgaaaagactaaaccgaatgccagtgaaacagaacagcatgacattttctggtatacaaccaaatgtaaaaacacgtgagatagccgttttaatcctttagacttcaactcttcagaggtttcactttcaatccaaaatatctaaattccaaagcttattcatagaaatatattagtggtcacatataaaaactgaataagaaattaaaaagcagatatacccttgtccttccaatttttcttctgaccgtccatctcttgtcacgatctgctttgcagctccaattattaattatgcataccaacagaaaagctgtaactgcacaaacctactccctgagacatgaaatacccgtttcctcaaccgaagtctgcagtctcctctgctgcacaactgcagcaggactgaagtcacctgacgtcttctgggtgtggaacagtctgacgcagtgcaatctgtaactaggctactaatactccagcattaatgctttccttctatctgttgattgttttaggcatttgccttgttgctcataccaaatggagctgcatttgcagggagagggcaggctaccaaaagaaaggaaataagggttgttcttagaactaaccactgaatgtatctgaaatgcaattaaagccatatgcagtttttttttctttctttttttaacagatggtcgaattatgctactggttttcagtttcatttaaaactctaaaattaatggttacctaataagataaaaatggactgatcaaatattaatagcctaaatttcaagcttgtgaaatgatgagtctccttaattgctcctaagttcattaagacgtaaaacattcagcattttgcaccttatgaagagataaacagaaaataaaagtcaaattactaatgtttattgaacatattatttgaacagaaaactttagcaacttaatcttcctaatatcttttttcctcttttacaattatggaaatccagagacttacaaacatacacttactcttaatcatcatctgctccaactcaatctttgaatatttattagacacctctacagacagtattaatagattcttagcttggggagatatattcatgggctaatgatataatctgccatgggaaaatgacataaaagcaaactataattttattttattttttatttttttctgacacagggtctcgctctgtcaccaaggctggagtgcagtggtgcaatcattggtcacatggcaacctcaacctcccaggctcaagagatcctcccatctcagtcaccacaggcatgtgccaccatgcccagttaattttttatttttacactttttttagagatgaggtctccctgtgttgtccaagctggtcacaaactcctgggctcaagcaattctcccacctcagcctcctaaagtgcggggattacaggtatgagccaccacacctggcctaaaattttactgaaaaatataaaaacaaatctatgtacagcatttttaaaatctgtgttcaactttataaaactgattttcattccaatgcagtgtctctacttatgttccacaatcaattcacctgatacttatatctgcctaagcagaaaaggcactaacaaatcagctaaaatattttaaaatgcaatttgcgaaaatactataagatacgtagcctatgtacaaaaatacatacttaagactgtatagctaaaatgaaatagagataatattttctggaacctgctatctgtgggctgcaaaatccttaatatcagaagtggcttgatattaatatatactcctattatgtacccaaaaaaactaaaaacaaaacatgtaagacttaaacatagaaagaactaaaattaggaaaatgagaggggaaaaaggaagtggcttgaatatcaatgacacatttatttccctatctgcctctctaactccaaacataaataaagaaaagtaatttttaaaagagcccagtattctcagctcgagttaatatttaactttaaactttattcactgaacccctgcataatgtgatatttgagaacccggtcagcaagccatatcatggcctgaaaatgtctggcctctccacgcaacattcagaatctcaaactatttagtaaatacaaaatactgactttctaataacaagtcccttaaaactgaaagccaataaataacgagcattagaataaaacactcaactatagtactcaaacactattttcaagtcagagattacttcactagtagaagaaaaaagttttactgtgatcaagttactcggcacttaagactacttgtatcttccgtggtacttgatttggcttaacaattaaagaaaaaagtctgagaggggcaagaatgtgtaataagacatacccactcatctaaacattaaacatacttaatagcacccctgacagattaaaaagtcaaaataggagccctgaagtttagtaaacatttcagcctacatagtgacatctacttctttaatttttatggtctttgtaagtgtacaaggaaaactagcttgtggaaatcaactgacattttgcccagttctttctcacaaagtttttcaactagacttgttttaagtttggcaagttaagcaaaaaagtgcttaaatctgaaaaactgatatgacacaaatttgttaaagatgtaaagccagatgggctatgtttattatgaaaatcatataatctctactaaaaatagaaggctttaggacattgcctgacaaaaagtaggcactatgtaagtgctatttacttatcagtatgctaaaaataacaatcaaactaagaagcaacaagacaagtaaggcacatctaagaaagctcatatattaagtccttcaactctaggcaataacccaatctttctaaacagaattgccccctctcatacacaaactattgtcgttgctgtatagttctattattttccagctgagaaaaatgtacatctgcatagtttataggtcctattccacaatgaaccccaacttaacaagtcaaataaagaaaggacataaatctgttaaaaacttatcttcatttattttgttttccttcaactacctaacttttaaaaaaattaattcttttgaggacaattttcaagtagagcacatgtctcaacttgcagaatggcattttgactatttgagacaggaacctcttttcccataaaagcaaaggctcacaaaggagaggccacagaaaactcctttatttatactgcaagccaataaaagtgttgtatgaattctaagccctatttcatattgtgtgtttgtggaggggagaagaggggaaaagtattctccttttcctgaactcaaaatcagctttatacagaacttttgaaataaactgttcaaagttcatatttggcaatttcccactcctcaatgtccatgtccccagtatccccttctcccaagcatgacaaaaaaatcaaagatgaaaacttgcccaaatacatatccataatgtctttcctttgcatcttatgaagggataagctctaaagggtaatatgctgtaaaattacctacacggtttcttttctcacatctcagaccaaaccctcgtttccttcatgcacttacctgttaagtaggaaatacgcataaatcaattcctactaaacaagaaactcttttatgacctcagaaactgtgtgtatgttttttggtgggtttttttttgggggggggggagggtgtagggggggtggtatctaactggcaagatttcagacagtagaaagttatattttagattttagaacaggcagcactaggcaaggtgttaagtccaccccagccagctcttattctaagacattcttccttttccatttctttctttcctctacttctgcacccaggaaaaactcaggtttttgttttgcttcgtttttctttacaacatttagagatgcaagggaaagagggtgggaaagcagcaatcatttggattgaaaatgctactctgaaagttagagactgcttatgtacactgctcttgagagctaaaataatttatactttccagccacagaaaataggcatgttttttaaaaaataagaaacaattatagctacacagtagttttaagcttatttcaaaatttaactattctgagctacacaaaggtatgaaattaacatgtttcaatactgaaaggagttaatttttaaaaccctaccatatgctgtaatataatgccctctatggactaaattacagcacttcaacattactgaattaaatcttaagaactggaaaaagattttagtctagaaaatgaatgacagtacaagttaaaatagcaaaacaacgagcattttaaagtctataaaaaatttaacataaggtaccaaaaatgaatactaaaattcataaactgaaagtgacactatttatgaaaactaatatgctaacttcttacattataatctaaaacatacaaatattcttaaacacccaaagcatttttaaaaattttttatataaaaatatgaaacacttcacaaattctatgcgtcattcttgtgcaggggctatgctaatcttctctgtataattccaattttagtatgtgctgctgaagcaagcatttttttttttttggagacagagtctcgctctgtcaccaggctggaatgcagtggcacgatcttggctcactgcaacctccacctcccgggttcaagtgattctcctgcctagcctcccaagtggctgggactacaggtgcgtgccaccaagcccagctaatttttgtatttttagtagagacgaggattcaccatgttggccaggatggtctggatctcctgacctcgtgatctgcccgccttagcctcccaaagtgctgggattacagacgtgagccactgcacctggcctcaagcacgcatttttaaattctgaattcaagaattaatagtcactaggccctaaacagatcttcttaaactttaatgtcttcatttaagtatccaggtttggggggaatctttaaggtcatttcataatgtttatagtagtatgattaaagcatttgtttgatttggtacaagatgtcaatattcaaaattgtttataaaaattttaaactcatctgttagtgcaaaacgatattcacagctcgctaaatttctctgtccaactgaatttattccacatagtcaattatagatcattccacagacttgatcttccatctgcaacactagatggcaccaacacccgtagtctacagttgattgcccagttcatggaaggcaatctggcaaacattaactttctggcttttccacaagattgctgcctggccctaggcagctagatcagagtatgggaataggaaaacaactctaacaccaaaaaaatacgtggggcaaaataatccctaatcggaatccaaaatcaattttaaatagatcagaactaagtgtaaaattaaaactataagtaaataaaaaatatattttcctttgtgaaaactgaaaatgtccactgaaatgtaaactaaaaatcttttagaaaactgagggaaaactataacacaagagtttacatcctttatatgtaaagaactctcataaaatcagggaaaaaaatgaacacctacatttaaaaatgggcaaagagtatgaacaagcaaaaatcacagaagaaatacaaactgccaacatgttcacattcactaataatcaaagatcaaaaaagcaagtactacttgcacctatcaaactggtaaagggcttttaaaaaatacctagtacagaatgtccagaagaatatttaaggaacgagtcatagtagataactctaggaaacagcactaggcagctggacaacagagagagaggaagaagtgtgactgtcactgtactttctgcattttgtataatgtaaaaatattatctatcaaaaaataagcaatatgaattgttggtgaaagtagagaaatgggtgttttcttcttctgataaaagggtaaaaattagtacaacttttctggtggccaatttttatacaaacccttataaatgctcatacccactaacctaggtttttatttcaaattgatttatggaaaataattcagggatatgtaagacatatttaaatataaagaggttaatagcattatttatcaataacaaaggaacaatctaagggtccaacaatagcaaagtgactggttaaactatacccatactaaggaacactaagtacaaaaaatcagcagcaaaatatttaaagacatggaaatgtttgcattatataagacattactaaagtttttaaaagcttataaacaatatatagagtatgattccaatttcataaaacactattacattcttaaaaatacacatatgcggccaggtgcgctggttcatgcctttaatcccagcactttgggaggccaaggtgggcagatcacttaaggtcaggagttctggaccagcttagccaacatggtgaaaccctgtctctactaaaaatacaaaaattagccaggcacggtggcccacacctgtaatcccagctactcgggaggctgaggcacgagaatcgcttgaacccaggaggcagaggttgcagtgagtggagatcccgccactgctactccagcctgagtgacagagcgagactatgtctcaaacaaaaacaaaaacaaaacacatgtgcattgaaagtagactagaataatatattctaaaatattaaacattgattatgtctgggtaatatgattataatttttttcatctcaatgcttttctacatttttcaaatttgtacaatgagcgtgtattgtatgtcagactgcttcataaactgttgctctaacttcactgatagttatcaagtccttagaaaaaatccttattactaaaatattgaagctcaagtagattaaaacatttgccaagggtcatacagctaaatcagtgaaagggtcagaattagaactcaggtctgtaaaatgcctaaaattaagttatttaaccacattatatttagcaggtatctcttttttatggtacatatttattttcaatctgtattgggcccacagtaagcactaaataaatcctcactaatttaacaatgtcactttttaaaaagtaaatataatcgtttcctttattaacaagagtcaggttctaatttagctacattgtacatctactgatagccttccagttaagattaactacttatcataataaagtccaacttacatcaaaattttccaaatattatttgctcaataaaaatatattttaaacaaaatatcaactcttagtatctacagtacttcagtaaaaaaactcaaaggctatatatactttttcagaaaaatattttaagtcgtaagaatatcaaaacaattcttattcatgaacatatgtaagttcttattcatgaacatatataagtttgcaaagctaatttcgtactatttacctagacaaacaagcccttttaaagtgagtgatcatggtaatactacttggtgaatcctgggtattacatagtttaattataatgaacaaataatcaatgtatggtcggtttacacttcacttaccaatagttccaattagttcagcaagacacaatctatatttcgattacgaactaaaaatattctctgtgcattagtgacaagcaaccaacaaacatatattaagttatcattaagtcaagatctcagcagtttggacaggaaacatgagcacctttctgtaccaatggcctaccaacataaacagatgatagcagttgtccaaagtagggtttttcagtctccacatactagcaacagaatgttaccctagttccaatatccttacatatgtgagaaaatgtagatggcaaccaactttcttgacatcttaagatgtcaagaaatgtcttacattgcctaatggttcaacacaacagatatatgataaaagcagtagcaccttgattgcctgctaaagttaggacaataactgcttattccaaaaccaggaaataactgtgaacggacaaaacctgagttggaatcgcagttcattcttgtgaaactaggtaacaactaatacaaataagaagttagcccaatgtctgaaacacggcagaagctcaaaaacattgtgcttattacataatttaccaggtatccttgaaaaagttacttaacatccttaggcttagattttatcatctataaaatggttccttctttcagattatggtgaagacctaaatgaaacaaatatgtgagagtgcttgttggtcagaagatgttccataaatgatagtcttccctttccagataaaatgagaagaattcagcttttctcaacactttaaaattctcagttaaaaacctaaaactgggagaaagaaaatctagaactgaaacaaatgaagctaattgtatttcaaatgaatatcatagccattagtcagtgggagaaggacgcaggaaaaagaaaaaagaacaaactaatacaagtaatctgtgaataatgtatttgactatatacattccatcttaggcagggttgcagagtagggatttgcaaacaatccagaactcttttatcaagttttttttttattatagtgatatgaaaaaagcattctaaaactcttataggtgtattaaaggactggatataaataatgtattggtggtcttaggaaccagggttctcactataaaagaagagacaaatatgaaatcaggaaagaaagaacaaaccctgtgagaatggattagaattagaggtatctatgtgaactcatttcttaagtatgtatgtgtatgtgtgtatgtttatttttatgtatgtatataagcatttcctagctttatccactgaaagggttaaaatggaaagatccccacagtagcaatgaccacaactagcatctagctcttgatctttaatacctcactattatgaaaatgacctctcattctacattaaaaggaatcaggcatccttggagaaatggctgattccagggctgggacacggtaagcataaaataggcctacaatattttgttaggctagaaagtaagaaatgctcccctcccaaccccaaagaaagaaggttgcatgtccctgagcctacctgaaggaaccctcaaaatatgcaataatttaccaccaaaataataaagttcagtaatgaatcataaaccattggaaagaaaatggaaattcacggatccatactgataattaattagctaattaattcattaatggaaatggaggtctgctgcttaaacaggaatgctgagggtcaaatgaaaaatgtacggggagtactggagttaaaatcatttttcaactctcatggtaaagactggatcaagcaagaatcatcaatggtttactaaattggaggggcgaattttgatagggagcaggatatctgcatgtgttcaagtgtcactcctcagactgcttatcatctgcaagggagaaacaaagacaatataaggaaatcagagctcatcttgcccagacggtcaaaattaacataaccagtgagggactgatgaatagcagataactctagaagtggtgctatgagagggacacatcatcatctatacagtatcataaatgaacccatagcctcaaattaatcactaggaaacatcggacaaatccactaggaggaatgttctattataaagtcgggggaagagaggccctgtgttctttaaaactgctaatgtcataacaaataaataaagactgaaatgggaagtcctacccagagcaattgagcaagagagaaataaaggatatccaaattagaaaagaggaagtcacattgtccctgtttgcagatgacatgatcttatataaagaaaaacctaaagactaccaaaaacttgtaaattctgtaaagttgcaggatataaaatcaataacaaaaatatcgcatgtctttacacaaacaacaaactagctgaaaaagaaatcaagtaggaaactccatttgcaatagcttaaaaaaaaatacctcagaataagtttaaccaaggaggtgaaagacttctacgaggaaatctacaaaacaatgatgaaagaaattgaagaggatacaaacaaatgcaaagaaagacattccatgttcatgaatcataagagttaacattgttaaaaaatggccgtaatatccaaagcagtctacagattcaatgcaatccctaataaaataccaatgaccttcttcacaggaataggaaaaaaaatcctaaaatctgtatggaaccacaagactccaaaaagcaaaagcaatcctgaacaaaaataaagctggcggaatcacactactaaatttcaaaatatactacacagctatagtaaccaaaacagcatggtactggcataaaaacagaaacacagaccaatggaacagaacagataacccagaaattaattaacatatctatagccaatcaatttttggaaaaaaaaaaatgccaagaacattcattggggaaatgccaagaacattcattgatactactactgagaaaaaaaatcagtatttacattccaatagtaagaatatagtttgtcacaaatttctttgtaaatggagggggaggaagaccagaattcattagtttcttgacaaactttacttcccaaaattaataaagcaccatctgcatcacaataccttattcatctctcttgcaaaatcaatctttcttcccaaaactaaaactgatttctgcctacaaaatgtcattttaagaaaacaagaacaggaaagtcctggaggctcacacctgtaatcccagcactttgggaggcagaggcgggaggatccttgaacacaggagtttgagaccagcctaggcaacaaggcaagacctcctctctacaaaaataattagccaggcatagtgacacgagcctttggtcccagctacttgggaggctgaggaccacctgaccctgggaggttgaggctgcagtgagccataatctcaccactgcacttcagcctgggcgacacagcaagaacctgtctcgaaaaaagaaaagaagaacatatgagataataaatgatctgaggaaattagtattttattatttaatagtttaaatgtttaaatgcatatacattaataagacccagaatttttttaaaaacacacttaaatatttcataattagagatggcataaaacttttaagtcatctgagaagagagcttcccttatgttttatcagaccactgctgtattttggtacatttgacttcagtacacttgaacctccctttcacgaagatacacaggtaagtacctatcctcactataacatagatcacaatgtttaactatgtcctcaacagtgtgtctgtaccagctggctgtaagttgcataaagcgcaaaactttgtcttagtttcatctttttccctgccccccccgccaaaaaaaaatctcatatagtgcctgatagaagcatgttaaagcaactcttacctgcttttacacttttttttttttttgtcttttttttctcccttttttgtggagaacggagtctcactatattgcccaggcaggtctcgaactcctgggctcaagctatcctcccacctctccctccctgaaagctgggattacaggcgtaagccattgtgactggccactacttacctgcttttaacagatgcctgttatataatcaagtcaagaaaattattaagttgcaaggacttgagctaatccacccttccttttatagaaaaggaaaatgacatctagagaaacaaagtgattgtcagtggtatagccaagactaaaacctcaggtcacctatattgttttcattatagcaatactgggtttccttcccacaacttttgtagaatatatatattgggtgtatctaaataattctctattccctagtaagttgctatgataactaatatcaaaaaaggttaagtcaaaaaggcaggaaataacaattttctcagagaagggagataaacatattctaaaagagaatgcccaagcattgcttacactttcttccaccattcccattaagctttcaaaggcaatgcccccttttcttcccttacttctaaactattaggctatagatttcccaggtttaacaaaaacaatccaagaaataggtgactcctgaaatactgaaattcctaagggccaccatctactagaggactgctagctttaagttttgggaggaagcactagcggggaggggagacttcaaaggtgttgctacaccgattactccttgctcttcacccagtcatcaccaagctgctctgggcttctgagacccttctttctactgttccctcctaaaccattttactgtgctgtttgaaacccccattccactgtgaaccagctcctctactcctcaacatctttactgaacattcctgcctttacctcgccttcactaaaacctggctgttccttgaagatactggtttccctgtggaacttgctaaatgaaggctaaatcgttctctcatattctacacacctaagggaggagtggggaggtcagtaccctctgctcaccaatgctgcttccagacttttatttcagagaccttgggcaaaagtcttggctattccgctacgtcattctctgtccttcctcatttcttctacctaccatcctgccagttacctcactgccctttaccaaggactctaaccccagtattcctctccacccctagtcctgccatcaccctgggtgacttcaatgttaggtagaagtgcaatacagtatcatggcctcatagtttacttgacctcacctctagcaatcttaatctgactacacagtaggcctttgcctgatggcctaacactggccattataatcaacctgaactgctattcctctgaaattctaaattcaacatccaacacacacacacacacacacacacacacacacaccctgctctcccgcacatgcattctttctctcccctactttgaccacaatctcctatcattctggcatgtatttattcctactactattggttcttaaacctaatctgggccttgagttcactgaccatctactctcctcctacctctcctacctttttctattcacatccttcaacttagatgccacagtccatcacttcaaattactctcctgctatcaccctcaactttcttgacttactgtccttccacagggcccacctgccaaaacacatccttgaatcaatacaatcatttgccttccctgaacccatacctaggttgtttggcacaatcaaagaaaagtcaccctaccatttagaccacctttcaaccttgattaggctcctaatacaatgcctttggtttccctagtcagaggtattgcagatctcttccacccaagcatgatctacttcattcccagcaaatgaactaacatactgctttaaagaacaaacataaaccatcaaataattccctcaactttcagtcacaaaaccctaacagtatcaataccccatactttcctttccactcactacaatcaaagctctatcgttccttctctctaacactaattcttccacctgaactaggcagcacatccccatccccttctgactttctgccagcacctgtaatcagattttccccttcccaccttaaaaaaaaagtcctacctccactgcatactctccttcctgcttgctaatattttaatttttctccaataaaaatctcaaacttcttaagagtaatcaacatttaataaccacttactcaagtctcattcacttctcaatcctagccatgcccatgcacaccacaccatttgccgctgtcatgacaatatcttccctcctttttgaccaacttgcaatccttaactgacctctccagtatttgataattttgaccatttcttccaccttcaagtagtcctcttctcttgattcttcctaattggtatctggggctttaatttctatctctaagcccatgacagacacatacagccaagatctctctcaagagcttcatgtgtataatatccataacttactggatatcttagaggtatgtacatcaataccaacatatccaaaaccaaatttgtatcttccctcttaaacctactttaatctctcatgttccctatctcagtttctcatactgccacccatacaagtgcacatgccagaaatgaaatccagggttcctggggtcatctttacctcttcccctcatcctttatgtccctatccgtcaaacaccaagtcctatgtctctgtgctcatcccactgcctgaatgttcataatctcctctttcttagattacagcaactggtctaccactgttccaatggtgatgagctggactgtactgctgaagcaccagcacttaaatacataagtatattcagtaaatttatcataatcactattttagagaaaacgcagctaaatcagaatgctaataaagagcacatgtgcaaatcaccttgtgcaaatcaccttatgcaaatcaggtatgtggaaaatggatagtcaaaagaaaaaaaggagaatcggtacttttcaaaagaattcataatagcataactcattttatacttttcaacaaaatgtctacactcaatatgcctaactttatacctaccactggaaaagtactatattatatagaaatatttaaaacatactatagaaattttctttaaaaattaaatatggtaatttctgggataacaaaaacacatctgaaaatattttaatatctcttgctcttcatgttatcaagaaacacaagtgaaaaaagaaagaaagaaagaaataggtactaaagccaattcttataaacaaaaatattttctattaatagttccatagtgcaatataaaagtgtaactgtgtggaaaagttaagggtgaatgctgagtgcaagagagttagaaaaagcactaaaacctttaactgaaaaagtggagaagacttcttaccaatgtgacatatgagacactataaacataatataaaacacaaaatgtagtggaatgttccctaaatccaaaagtggcatgaaagcacaaaactgcatatagattggattacctgaagttttactcagctctgctgaaaatatagcagatggtgatctgtcctctttttctgtatcggaaggaagttttttctcagcttctttcacaagaactttgggtttaactatgctctctatctctgcttgagtggccaaagcagaaacatctggaggcaataagagcacctttgatgtagcagacccatttttagaaaagtcatctgagaaactgattttctcttcaactttgggttgtatgttcttcaaagaaaggtcatggggcaattctgtgcaaggcaatgacccagctccatccggggcattagcaatttcacttttgtgggatacttctaggtcagtatattccctggctaatttagaaaatgaatcagttttagaactgatcaatgtagggaactcatctataatttcaattggagatgaatctgaaaacgtttcagtttctcttatctgtgcttccttagaaataaataagtcatcatttgaataaactgcagtactgagctcctccatctgcaaaggaattttctcctttttgctcaatgttgaaacttcatcaggtaacagggtatcttttgtgttatctaaactgagcttaaaagattccaaatatggctttcctccctcaggtggcaaagcactgagtttttccttattttcatattctatcattgactcaaatgaagtctcagtgagactttctttcacaagcatcacagtttcatcttgtttttgtggaacgtcaggtattgaatcatcactaaataagtcaactggttcagaatcaggtgaggaatcttcaactagctcagaatgatcaggcactggctgttcaacttttgccatttctgaataatcagagaaatccggagctggttcagcagaaagctttgtttctttaattaaatcacatgcaatagatatataaggagcttctgtttcttgaagagctgcattaatattttcaggctctttaatttcttcctttattcctgatactttttttagtgatacactcatggcctcttcatatggtggggggttttcaggctcatgttttatgctttcataattaactgaagaagcttctaatggtgatgagctgggctgtatcacggaagcaccagcactaggaactgcagaattcaatggtgcttccataacaatgtcaggcaaaactggtgaaggagtagcttctgactcttcaaatgatgggcaaagctgtgctgcaggatagagtgactcttgcataacttctgatgtttgaaccaagtccatttttgtttcataagcaatctttgtaccagtaacttcattcaattcactttcacatgcttcctgtactaaatctggagtcaggccttcaggcatgtttgccacgacttcctcagtcacctttgttaaattatctgttgtgacataatctgtctcagaatcctgtgctgctacaagaaaagggtttgatgttttggtgctagtattcttctctgttactatttgggccttcttttcttctatttttttttcatcggtcttattttctgaagtaggatctcctaacaaaggaaaaatgtttgttgcaatgctctcagttgctgctgggttaaagggagcacatgtgatatatgctcctgaacgatcctttataccttctggcgtactggggaaagaagtatcatcattactactctcactatctttttcgtgattagtttgctcaaggctatctgcaaaacattttttatccactttactttccaagttgctctcgattttacctccagcagccaacatatcactatcttccttactatctttcacttcccatactcgctcaaatggtttgaagtctgcatattcctccctcataggagcttccactgcaactctcttttcattaaaactgtcttttgctttttctgaagacacaacttcatcctctttaaccaatttagtaagagctgtaggtaactcttgttgattatgaaggatgttattactaactaacttctcttcttcatctttatttttcacgattatttcttccctaggatttgctactattacggcagattctgcttttggagagacactgaacgatgatcccatttctgagtattctaattctgaaaactctgttaaatctctatctatgagtagagtttttgccttctctgagacctctttagaagcttcactgacattttcttgaagtgttccttcagtgggtaatactgttgacaaattaccaaggtattcatgttctttgaaagaagcggctgagagaggagacagagaaggaagagaagcagcagtttcaagcaggacagatgggaaatcctcttgaccagccgaaatagtgttacctggctgctccttcaagtccatattttctgtgaccatggacagaaaggaaagttagagaatgccagtgttctcagagttaatgcaagttttatgacagatccaaaatagtgttagtaaagacttactgtttactaaaatgaaatgttaatagcaattaataagtaacaatagagtagacttcaatcattactgaaaatattaagctattgtaaatataacatatgcatggctacagaggcaattacatgctgtgcaaagacaaatcaagtctgagtaaacctcaaatgttatcaactaagatactaatagctagttttagagaagagaagaatatctgtgaaaagagtttcggtgacagcataggaaagaaggggcactgggtaaatgccatagactggtatttatttacaggaaagcctttctggctatactcaaactgtatttggagaaagggaatggtaaatatgtaaatgtaattcaagggtccaagaattccttatgtacttccaagtattcatcagattttgctcatttttcccttgggcataccatataaaatgcacatttcaacttttccagtagacaaaacattctcggaaccatgctaatttttagtaaacccaaactactctgcatagtgttaacacactaaagagttaaagttagaatacagagaggataaaaggctggcagaaagaacttgcctgcagaggagcgtatcacaggctcagatgcagcaggaagagcaaaaagggtctcatctgaaaaacaaatagaatataacctcagcagaaataaagacagattgaaaggagactaaagataagaggagcaagccagggttcagtttgtaataagttaacaaaaaactttacagagaaagggccaagatcaaaaggaagtcagaaaaagtagtaccattaattcaggttaaatcatcatatgtattataaagctaattaaatgttatccatagaacctatcatttttcaagaggcaatacaacctgtttatgttaaagaaacttatgaatcaaagtggctttaaaatactgttctacttaacatatcacatcccaagctttcactcaggttttcacataggtaaattgtcttgttctattcaggccaaaaacaaaaagctgaatttgaatacaattaacaactacaaatgtttaatcttttgttattggcatatattcaatttaaagaaacacttttaaagaattatgcattttctcttacattctaagttgttacagtcattgtacattgctctttgaagacattagtcctgtgccaatgtccaaatgccagagtccaaaatacaaaaaaaaaaaaaattaactgcctttaggatgacaccattattggttttgcttaaaattaacctaagtgagggctacttgttatttgtatacacaactagtaagtgagagactaaggcaattcaattccagagcccatttccttaatcactgtatgttacagaactgaatgcttatatttcctacaaaactcatgttaaagccccaacccctaaagtgatagtatctgaagatggggactttgggaggtgattagggttaaatgcagtcagggtggggccctgggccaaggggattaatgcccttacaagaagagacaccagagagcttgctgtcatgctccctgtctccccaggcacacacaagaggtcatgtgtgcacacagtgagatggtggtcacctataagccaggagaagaggcctcaaaaagaaatctaccttgccagcaccttgatcttagacttaccagcctccagaattgtgagaagtaaatttctgttcagccacccagcctatggtattttgttacggcagcccaagctaactaatacactctatattggtaatattaactttgtacaatgtcatcttgtacctgcagttgggagatcctaagctaaagatcttccatggtttacactagagaaaggcctctaccatcagacaatttgaaacagcctgagagatgactggaaggtgatattcctttaacagagagaacctaataaatttagacaatttcatctggatggacaagctagacaaggctgatcaaaacagataaaaatccaagaaatgtagctaacatgaatacggacttgtcttccaagcatattacccttaatgaattaggagagctaacttcacaaggtcttatatattttagataaatatatactgggcatgaagtcatacttaaaggattcctagatgagggtgatgacgggaaatttatgatgtgtgtttaaaagggtttcctccaacctagagcactaggtaggatgggctatccagtcaaaggggtaacataatggcttataagatttttaaataaagtgcatatatatgtgtacacatatttaaaagattacttgctatgtgatcttaaattacagtttctcatttgtaaaatgaaggaaagttcccttcagctaaaataatgaattattagcttgtataaaactgaaatttgagggtcaaagagcagaaccaaataattacgcagctgctccatctaaataacagttaaccaattcttaacaaaatggttgtcttttttatctagacaatatagttaaaagccactaattcagaggctagtctatctggaaagtgaactagaaacatatattactgttaaagttagtgggaaaacaaactacatctaaatttgtgccataattttaaagtatttttttaatgtactgtactcttattcctacctagtgcaataatcttttataataaaaactatattcctggaatttttctaagtaaaaaagttttcaaattggtatttcaaagattcattatgtttaagaaaaaaagaaaaatcttcattttgtaaaatgggattcgatccagttacccataaaacaagtactacatttctaaaagctctttaaaaaaatccagaatagttaactatcttctgggacttcaagaatacagttcagactcctaataaagcaatcacagatcatgaaattgaattgcctaagtccaaatcacaaatccatcacttacaactgtaactcttagcctttctgtgcctaatgaaacttgtaaaataaggataataagagtacccacctaaaaatgttgtgaaggagggagagggaaagaaaaaagaagaaacaacttgccctaagtcacagaactaggaggccagagggtcaaaacatctaattcccaagtctttgtgctttataattattattattttttggctaggcttcctcaaagcacgagatgtgcttcatcttctgaaggatgtatttatgtacaagtgcaactggtgcaatccttcttactgtatcagcccctcaagttagttctcctgaaacaaggtaaatcgtcacccagtaaataccttgtaattagcagaaatattgcattgatcaattgcttctattttacaatgtaacaacatttatagaaacattaatgtgggacaggtactgtgctgagccggcacatttgtttcagatgttcattctgttctcaaaactaccctgtaaggtaggtactactgttacccccatttcacatacgagaaaagaggcatttaaatcatatctaattacaatactacaaaaaacctgcattttaaaaccatagaacttctgcttctggctatgagagtaattacaacagactaattcttccaatataagcaactaaaaatatgggcaaaatactagaagcaactatcttgagacactggacaagaggcaggacagcagtgtgaatcctgagaaaagggaaacctgcaagatgactacgctgctttctgtctgaaggcacattctggtctacagtacagagagaagcctaagaataccgcactcttgctaagctgaggaggctgaggagttgtctggaatttgtgagacagggtaacatacaaagtaaagcctcacagaaaaggagctccaaaaatctggataggggttcctcttaaacctctgggtgaatactacgctgcatgtgcacagcacaagactcggcaaggcctagccaagaaacctatggtagagctgcaaattaactggattatatcgaaggtcagaaagtgctgaagacctgatctaaaaattctgaccagtcagaaaggaaagatctctctaaacacctcaagcaggactactctaagcctaaaggatactctagaccaagagtcagcaaaccatggctcatgagcccatattgtattggaacacagccacgcccattcacttctgtgctgtctataactacttttgcacaataaaaacagagacgaacagtttagacaaaggctgtatggcccacaagcctaaactatttactctaactggccctgtaagtctgcagacccctacctctagacccaccctaactttaaaatcaaaacttgaaaggatcaaaatgattttccagcaaattaactgcctgccagaacaaagttaaaaccaccaaatccatgacatgcagtataaaataaattaatggacatgcaaagcagcaagaaaatatgaccataaataagaaagaatagcaaatataaacaaacaaataacgtagacgttggattcgcacttttttttttttgaggcggagtcttgctctgtcacccaggctggagtacagcggggctatcttggctcactgcaacctccacctcccaggttcaagcaattatcccacctcagcctctgagtagctgggattacaggtgtctgccatcacaccaagctaatttttgtgtttttagtagagacggggttcactacgttggccaagctggtctcaaactcctgacctcaagtgatccgccagcctcagcttcccaaagtgctggaattacaagtgtgaactaacacacctggcctggattagcaaatattaaaatgaaaattaaaatagctattaagatattaagtacagaaaaagacagacatatagagtagacagggaatcttggtggagaaatatagactaaaggaccaaatggagatgctagaattgtaaattatattaactgaaaataatcactagatgagcttaaaggcagattagacaatacagaaaaaaagatttattgataaacaaacttaaaaaacaacaacagaaagtatccaaactgaaacacaacaagggaaaagggcaagtgaaaaaaggaacagagcctcagtgctgagagacaatcaaggagttaaaatacctataattgcagtccccttaaaaaaagcaacagtggccaggcatgggagctcatgcctgtaaccccaacactttaggaggccaaagtgggaggaccacttgaggccaggagttgggacaccagtttggacaacacagtgagaccctatctctacaaaaaacttaaaaattagccggtgtagtggtgcacacgtgcagttctagcaactcaggaggctgagatgggaggatcactcaagcccaggagtttgaggctgtaacaagccatgatcacgccactgcactccaccctggacaacacagttaagaccctgtctctttaaaaaagactgaagaagttaaaaaaaaaaaaaaagaaaaaatggcctaaaattggacagaagttggcattttgaaaataccaaccaacagagccacaaagctcaatgtactccaagcagaataaacacaacaccacaaaaaggcacaccataagggtcaaactgaaaatcaaagatagagacaaccctaaaaacagtcagaggaaaaaagcaggtaaacaacaataagaatgacctcacctctcattgatgtaatccaaaaggtaatgaacgcctttaaagttatgaaaaaactgacaatctaaaattatatacagatgatcctcattattcatggattccttatttgctcatttacctgctcactaaatttgtagccccaaaatccatacttgcagcactttcaggacatgcaatgagcagagcaggcaaaccagagcgggtcatccaaagtacaagttcccagctgagatggaacaaggtaaccctaccgccttcttgtttcagctctgccactgacttccctgtttcatatggcccttaagcacagcgctgacatggtatcgagtgtttttaaccacaagaaggctatgatgtgccttacagagaaaacatatgttagataatcttccttcaggcataaattatagtgttcttggccatgagttcaatgttaatgaatcaataatacatattaaataagatgtctttattttttaattgatatataacagttgttttatattttggtagtacatatgatattttgatacctatatgcaatgtgtaatgatcaagtcagagtgactgggttatatatcacctcaaacatttttcttttctttgtgttagaaacattacaattcttctagctattctgaaatatagaataaatcattaactataatttctctactgtactatcaaatactagaacttattccttctatccaactgtatttttgtaccccaggtggctttaaatagaaaaacacataaaacaaggtaatatactgattggttaacaaaaatattatgacaagaggcttacaggagccaagtctgtatttcccctaagaacaatgattcagtatttgctaattccctgtttttggtggctatacagaacatagtgacagcttaaaaaaacagaattggctgtattattcaaaacatatttttttaaataaccaggcatggtggctcacacctgtaatctcaggaccgtaggaggctggggtaggaggattgcttgagccctggggtacgagaccagcccaggcaacaaagtgagaccccaactctccaaaaaaattaaaacattagccaggcacggtagcgtgtgcctatagtcccacctacttgggaggctgaggtgggaggatcacttgagcccaggagtttgaggctgcagtgggttatgatcaggccactggactccagcctgggcaacagagtaagaccttatctctaaacgaacaaacaaaatatatagaaaaagtaaagattaataaaggtatcttcagataaaagctgaaaacagaagctgaaagaatttgtcactaagacacctacaatacaagaaatgttaaatcaagttcttcagactgagagaaaatgatatgagatgtaaactttgatctttatgtaggaataaagaatggcaaaaatggtaaatatatatgtagatgttgaatatacaggtagatgttaatttttctcatttcttagtttcttcaaagaataactttctgaagcacaaattatcacaaaatacaataactataatacatttagaagcaaaacttatgacaataaaagcacaaaggatgaaaatagtatatgaaagtatgttttattacatgtgaaacatgtaaggtggtataatattcttgctattttatgataaattgagaatgcattctgtaatccctagaacagcctcttaaaaaataaagaggtacagctaaaaccccaacagaggagataaatctgaatattataaaatccttgattaatccagaagaagaaacaaaagaagaaaatcaaagaacccaaaaagcagatgggacaaagaaaaaacaaagacacacaaccacacactatcagttaggatacagatgatttaggccccactaccaatgagctaaactgacttttatggaacactacaaccaacaatataatacacattcttctcaagtacatatggaacattcaccaagataaaacatttcctgggctacaaaacaatctcaatctaaaacaagtgaaatcatgcagtctatgttctacaatgaattaaatcacctaaaatatcctcaaatgtttaaaaacgaaactacagaattctaaataatccatgaatcaaagaaaatagggggaaaattaaagaaattctgaatcaaatgatcatgaaaatgtgtgggatgcagcaaagtaatgcttagagagaaatgtatagcttttaaatgcttttagaaaaaaggcttaaaatcgaagtgtaaagcttccactttaaaagagcaagttaaatccaaacaagtaaaagaaaataagtagtaaagagcagaaaccaatgatagaaaacagattaaaaaaaaaaatcaatgaaacaaaaagttgcttccctgaaaagatcaacagaattgataatcaactaaaatgatcaagacagagactgagagacagagagaggaagcaagtattgaaaataaaagagggactgttactgtaggtcctaaaaacgtaagagaatattatgcacacatttatgacaataaattagacaacttagatgagtagacaacttccttgatgtctacttatcaaaatgaaagacaagtttctttatacccagtcatcaaaatgaaatagatgcattccttgaaagacacaaatcaccaaaactgacacaagcagaaatcaaaaatcagaatagtcctatgtgactatacttgtaacttaaaacccccacgaagaaaactaatataaaacatctaatgaatagtaccaaccttacacaaactctttgagcatataaaggaaaagcaaacacttcccataaaatttttatagatttatgcattaataccaaaaccagacaaggatataacacgaaaattaaaattaatttatataacaatattcctcataaccacacatgcaaaaaatcttcaataaaatagtagcagattgaatccagcaactcatagaaagtataatcatcaccaaatggggtttaattccaggaaggtgaggttggtttaacattcaaaatcaaacaataggtcgcacgcagtggctcatgcctgtaatcccagcactttgggaggctgaggtgggcagatcacttgaggccaagagtttgagaccagcctggccaacatggtaagaccctgtctctactaaaaatacaaaaatcacccaggtgtggtggcgtgcacctgtagtcccagctactcaggaggctgaggcacaagaaacgcttgaaaccaggaggcagaggttgcagtgagccaatatcgtgccactgcactccagcccaggcaacagagcaagactgtctcaaaaaaaaaaaaaaaaaaaaaaaaattaaaaaaatttaaaaagtttttttaaatcatataatgaaattcactatagtaacaacagcccgaaaaggaaaaaccatatgatcatctcaacaaatgtcaaaaacttatctgacaaatttcaacacctgttatcataaaaactatcagcaaactaggaatagaaggaagctttctcaacctaagagtcaggatatctaggaaaaatatgcagctaacatcatacttaaaggtgaaagactaatgcattcactcaagattctgtgttaaacaagcaatctaccaggcttctcgtaaagatctgaagagaaaagtaaaactatcttaacttacagacaacaggactgtatagttggaaaatcctaaggattcaaaataaaataaccctaccaaagctagtagtgaatttataaggatacaggatagatgcaaagacagtacacaaaacttaactctatttccatacagtagcaacaaagagaaaatgaaaatattttctaaatatcactcactgtaacaaaaaaacataaaatatttaggcataaatttgacaagagatgcacaaaactgctatactgaaacacactgctgagagaaattacagatgatctaaacaacagagatatcacattcatgggttgaaagatataatattgttgagtgtcaggaaacagttctctatgagtatattgtgtttttacacatcttccctttgttcctatcttttaaaaacatttgtattgtgaacagccttggaaaacagggacagtttcttcttcttcagcaactagcagccatgcttattatatgacacaaaagatttgtttccctaagcttaagatttctgtctataatacaacctgctacaggtgcagatctcactcagccatctcagtgttgctccatgtgaaatggagctgagggaactggcacaagaaaatgctaatattctggctactgtcattgctgtgagtaataaagtcctctgcctctgacccaggcatcttatatcctctgccagcatccatgaaactatgacaggctaacttgttacctttgaagtagtgtaaaatctcaaatcctaagacgtcacttatcccccctactaatctctagattcaatgcaatcccaatcaaattcataacaggcattttatagaaatgaacaagctgattctgaaatttatgcagaaatactaagggacctagaagacacaaaacaattttgaaaaaagatcaaacttgcagtcatactacttaattttacgacttgctataaaactacaataatcaagtattggcataaggatagacaaatcagtagaacaaaatagatatatataaatagacacacttcatatggtcaatttcttttcccaaaggcaccaaagcaattcaatagaaagagaaaaatattttcaaaaaactctgctgggaaaactgcttattatatgtatggaaaagaaacaaataaatctggatctatggtaactcataccatagacaaaaactacctcaaaacggatcaagacaaacaaaagctaaaactatcaagcttctagaagaaaccaaagtgtcttcacaatcctggaaggaggcaaagatgtcttagacatcacaaagaaagcactaaccatgaaagaaaaagtaattatgacttctcaaaattaaaaatttatactcatcaaaagaatcaataaaattaataggcaagctacagactaggagaatatattcacaacacatgtatcagaccaaagatttgtattcataatatatagagagaactcttacaaatatgtaggaaaaaaaaaggcatacaacacaatttaagaatgggcaaattacttgaacagacacttcaccaaagaaaacacacacaaaggacatgtaaaagtcctctaattcattagtccctagggaaatctagattaagaccacaatgaggaaccactacataaccactaaaatggttagaatttaaaaaactgacaatatcaaatgttggtgaaaacgtaaagccaccagaattctcacacattgctggtggaagtggttgggggaacagttaagcaacttcttataaagttaaatatatagttaccccatgactcagcaattctactctcaagtatttacctaagagaaatgaaaatatatgcatacaaaaatgtctatgtaagaatgttcacagcattttgttcatagtagccaaaaactataatccaaacatccaacgagtgaatacataattaaactgtgctattcttagcatggaataccactcagcagttaaaaggaacaaattactgatacctgcagcatcattagtaagtcttaaaagcatcatgctgaatgcaagtagccaagcacaaaatgtatgattccattcatatgattgatgctttaaaatacgtaaaactaatctatgatgaaagaaatcaaaacagtagttgtttgggattggtgttgcgggtaggaaccagagcaaagaattgaaggactgactgctaaggacccaagagatctttctaggatgatagaaatgttctatatcttgtcagaggtgtggataaactaatgtacgcatttgtcaaaatgtaaaactgttgaaacttaaaatttatgcattttactgcatgtaaattatatcttaataaaaacattaaggtgaaaaaggtgtatgggcattcttcaacaaataaattgcagagagagagagaccacaagcaagggagaactcatcgatagattaaaagactaataaatcaaattgatctattgtaatatgtggaccttactcgaattctgattctaactgtaaaaataaaaagaaagaaagaaagaccatttatgacattcagtaaataatagtcaatgtgaggccaggcgcgctcgctcacaccagcactttggggggccgaggcaggtgaatcacctgaggtcaggaattcgagaccagcctgcccaatatggtgaaaccccatctctactaaaaatacaaaaattagccaggtgtagtgttgggtgcctgtaatcacagctactcggagactgaggcaggagaatcacttgaacccaggaggtggaggttgcagtgagccaaacttacaccactgcactccagcctgggtgacaagagtgaaactccatctctaaataaataaatggaaatgtgaacattagctggatgcttgatactaattctattgtattgaagacattttaaccgtagttttaccctcaactcttttagtattccattaaaatatatacatgtttgagtctatcaatcttaaacttaaccatatcccctgcaacatatttcattaacaaaattttaataagggaacaagagtaagtttggttgatgagagagggtaaatgagaaggtatgttgtaggtggcagtttctcagtccttgttcaaaagtgatgtcttatagccctaatccttatggcagatctctgtgcagtacatatagcctataaaatataatgaaatactaacttgatcttctatattctgattttcaataattcacctatgcaagcaaaagcatctaacaaagtttttatcaagttattttatataaaatttggtttttatacaaaattaaaatatcagaatttgataaaataaaactttccataatttaacaatgatgttgatgaattgagactgaagttctagactatgaaagggatttataacacagatacaagcatctttggtaacctcttcagaagagaataaataaaagtaaattcccttattttctgagatcaaaacctctagtagcttaaaaaaaaaaagttgtaacacttttaggtcacctccatctacggttgtcagggcactgagataaatgaactcaataatggcaccttccatttaggcgagtttataaatcaacctacaaagttggggagaaagaacacgtaggcagacctggaatccttaagtaagcttctctctttccacaaaagcagttcacagatctgtaaatatgtcctgtaaggccaatcacaaaactcctctggttttaagagcagaaaattctttacaactaagggcctgtattttttccttcatctgctacctatacctctcataagtacaacctctattcatctttcttgtcctcttactcagccctaggcctagttaaaaaaaaaaaggaatatattaatttttttcttaatattgaacttccaagagaccaccaatataagcagcaactccaaactcttgaacaacaaaactttataaactttctgtatctgtggtaacaattccatcaatgagaaaaacaagctattaaagaaataattatttttgaaaagtagagggccacctatgtaaagagactgctttaaaaaaaaaaaatccagtatttggcagctatagctcctaatacaagagtacagagaatatttctttctttctcaacacaatttttttttttttttggaaatgaaaaagcaggaagacttagctttctttctcagtcaattatcaattgaaaagagagagccaaatacctgtataattcagtatgttacaaggaggctagaatatttatttttaaaagtctctagttcacctaattatatgctaaattttttttaaatacatgttaataaaaaccacgtgtttatggaaaaatacacaatatcaacaccgaatgtatttcaattctccccaaaattaatccataaatgtaatgcaacctactaaaactccaacagagggagaggggacaagataaaaaaaattttaagatgaagtagaaaattatacacacataagatagccaagaaaaatatttatggaaaagccgtttagctagtatttaaaaattatagcacaacagtctgatacttctgtgtgaactgacagataaatggaaaagcagaggaaatatttcacccatactacaagaatatgacaaaaatggtacttcaaagtggttaagaaggataattcaaaataaaaggtattggaacaaatgggaaataatcttgaaatataaaattatttcactacttcactctctagaacaaaacaaactgcaaataaatcaaataattaaatgttaaaatgaaatcataaaaagtataaaagtacttactaggagtaaacatgggggaaaatttttatgatcctcaagaaggattttctaaggattacataaaactcaatgacttttttcacttttatgactcaaagtcataaaagaaaatgataaatctgactacataaaaatttctaaacagaaaaacataccatatggtcaaaatacaaataacaaatcaataaaaagttttcaagacatatgacaaaaggctagtttccttacaatgcagattaagtgaatctacatacatgagaccaaaaacccaaaagaataggcaaaagctgtgatcagaaaaaatttgacacctaagcctatgaaaaatgactcaaatttaaaagaacaatttgctaaacaatgtattagttcactaatatactgtgttggtaaagatataagggaaaaggtaccttaacaggttggtgggaataaaggttggaaccattctttgaatgacactttggcattagctaccaacattttaaatgcaaatatcctttgaagcagtaattctacttgcacagatttatcctacaacatatataatggcatgtattcccaaagaagtgtatacaagagtgttcacagaaatagtatttgtaagagaaaaaactaagtatcaacctaaataaccatcaataagggactgattaaataaaatatggtacatccccagagtcctctgcatctatttttgtggaaaataaagtgaaaaggatatacatgtataaataaatatttatccacagattatctctaaacagatactcaagaaactactaacagagggtggatctacagaagacaatttgtggaaatctgggtaacaggtagaaagagttacttttctgtgtattcttgtagtactgtttggaattgttaccttgtatacataaataaataaatgctttcgtaagatttgggatttttattgagagaagatattatagtaattctagaactatacagaatatgaagatcagcatctttctcattcaacaaactgagtgcctatcacatctaaggcactgcaatgcagacacaatgcatacagtccttttcctcaaagaaaaaggtcacagcacctttcctcaaggagtacactgtctggtggaggaaagaaatcagtaaccataccattaccttatatagaatgatatatactatgaagaggtaagaacagaatattatggaaacacgtgatgaaagcaacttaaaaatcaatgatcatcattccaagaaacataaatatcaatagcttaaatatgaaattatcaactcctcctttggggttaaaaaggatgatgatggcattagtctgagaaaatcttagcatcagtaaagctgggtctcatcattttgcatacctatgtcctgcactagctatccacaaaggtcacattcattcaaacactactgagaactatggttttaccattacagttcccatccctagtgctgtcatcctcagaagaacctgatccctttagaaacaggaacaaaaagtctcaaagaatgtaccataagtatagtatatctgcaacatttacttctatttatttaagggttccagggaagaatcaagaaatagccattcagtttatacttttatcctgggctagcaaagtaccttaaaaaggaaccattaaattgaggctttgaatcaagttattctaataagttgcttgaaggtatattatgaaaataaatggcggggcacagtggctcacacctgtaatttcaacactttcagaagtcgaggtgggagaactgcttgagcccaggagttcaagaccaacctggccaacatagtaagaccccatctttaaaaaaataaaaataaggctgggagcagtggctcacacctgtaatcccagaattgtgggacaccgaggcaggtgggtcacctgaggtcaggagttcaagaccagcctggccaacatggtgaaaccccgtctctactaagaatacaaaaattagccaggtgtggtggcacatgcctgtggtcccagctactcgggaggctgaggcaggagaattgctggaacctaggaggtggaggttgcagtgagccaagattgcgccactgcactccagcctgggctacagagcaagactccacctcaaaaataaaataaaataaaaataaaaataaaaatatatttaggctgggtgtggtggctcacgcctgtaaacccagcacttcgagaagactgcttgacctcaggaatttgagcccagcctgggcaacatggcgaaaccctatctgcacgaaaaacacaaaaattagccgggcgtggtggtacgtgcctgtggtcccagctagttgggaggctgaggtggcaggatcacttgagcccagaagatgaggctgcagtgagccaagactgcaccactatactttagcctgggtgaaagagcaagaccctgtctccaaaatataaatacataaatataaaagtttttttaaaaaattttaaaaatagccagcatggtggtgtgcacctgtagtctcagctacctggggggctgaagtgggaggactgcttaagcccaggaggtcaagggtatagtgagccataatcatgccactgcactccagcctgagcgacagagtaagactctgtctcaaaagaaacaaacaaacaaacaaacaaacaaaaaaacttgccaggcatggtggctcatgcctgtaatcccagcactttgggaggtccaggcaggaggattgcttcaggccccaagtttgagaccagcctggacaaaagtgagaccattgttttttggtttttagatttttaaaaagaaaataactacacataaaacaaagccaattaatggacaataggtaacatgctccttttcagaaatgtttttataacatggcaaatcctttaagtttacaataatatagcactaaaatagcatgttttctaaacactattccatgcagttatttatcagtggttccacatatacccatcacttcattttaaaaaggatttgagagagtttgcaaatcactaaaaaaaaaaaaaaaaaaaaaaaaagaccacaaatttgacactcagttgcccaggaaccaatctgaaacataattcaccatatccatgaggagtatactacttattcccaacttttaaaaataagaaatggcttaaccagaaattattcagaatcacaaaaatgaaagtggggaatggacagggcatgactttcttgtgtttagaagcatccacttcctgggaacttggactttatattaagaactgatacctaatatttaaaccatatgtcactcaaaatcttaaaatttctaatacatgctactacgccaataaaaatgatcatataataaatggcttcatgatagtaaaaactagtaatttttaagccccaacccataatctgtatttatgagcaatattcaattttatacaaattttcatggcaattaaattttggcagtctctgaaactgatttaataagcactaatattcttttctttgtctttacattcatggtttccaagtcctatcaattcgtctttcatacagcctcttcgtaaactaactataaaaacagattcacagccaattaaagaaagcgtgcttcttatactcttatattcctcccttctattccattttcactgaatgaacaaataatgaaatagttcaggccctactcatctttctcagaactactgtaatagctttctaaataattcatctgcttttccttcccacctatcttgaatattgtcaccaattttctaatactgctttcacggtgccttgcctcagttcaaataaccttcaatggctgtcttcccaaagccaaaagctctaattcgagaaggggtgaaaaacaataactttagaaacaacaattaaaaaaaacaattttggtttcataatataaattaccaaaagcaagggcaactggatagcagagcatggattaaagtggaatgataaaatccaaattccttaatttggcattcagtatctttcagaatccagatctacatattttcggtcttaattaaccttggtttagaacatgtccagagaccagttcgaagtcacccttaattatgtttgcactgctctcaaatcgatttctagccagagttttctgcgcatatcctcaaagcctaacttaaccaaccactaagccaagtattttcccatgaaaaatggccctcaagtgagaggttttagtctcacttcagttactgcattgcgatggagatgctctgggcacaacagcaaacagtaaaattacaacttattaacagatgaaaatcagggcttactcataaataacgtaaacagcaatgttaaacagacaagtgtcagtgatctagaaaccctctcttccaggcaggctagtctatgcttctaaccctgctctgcacatttctcacctttgtctcacatcagtcctctcagtagccctgaatcttccaaacttattttagttccaaaatcacaatataattatttaataagcatatttttatttttttaaaaagctaaacatttttaccattgcctgttagagacccccaatgatctgggtgggtaaggccacctcttcactctcccactagtttttctcactagtcttacactagattctcagacacaaagagctcattcctgcctcagggttttgccctgaagttgcttggaaatgttttctctctgcagctcaaatctcaccttctaagcctgtcttagtgtcacctaacctaaaaaagcccccataaatccccatcattctctatgccattatcctgtttattttcctcataacaccactattctgggttctttatttatgtgcttattatctgtactctcccaagggggagcatgtgtcttgcttattgctataccctcaaagcttagaatagatcctgtctcttggtaggtaatcaataatgggttgaattaatgaacaaactcttgaatgcattaagaaatccagacacattgaaaatggttaactatccacaaccataatcacaatgttcttacacttactaaaaaaactaaagtttcccaataggtatcatcaatatggaattagggaactctgtagaacaggcaatattctttccccattgccttccaacctcagcattccaacacacaagattccaagagagtgctgtcaccccctgaatccctaatgttcaaagacagaactattttctttgttcccataccaatacaagattagtatgcttttgtcaatcattaaacttcctgtggccaggcgcagtggctcatgcctgtaatcccaacactttgggaggccaaggtgggtggatcactggaggtcaggagttcaagaccaccagcctggccaacatggtaaaatcccgtctctactaaaaatacaaaaattagccaggcgtggtggcaggcgcctgtaatcccagctactcgggaggctgaggcaggagaatcacttgaacctgggaggcggaggttgcagtgagccaagattgcgtcattgcactccagcctggtgacaagggggagactatctcaaaaaaaaaaaaaaaaaattcctgtttaaaaatatatttcatatttttctcttacctcagtttccctcaagtatgtctttttcataaagaaaaaggaaaagattgagttactcctcatcttctaagacctttaatatggcaattagtgttttgagtagtatgggggtgaggagtccgtcaacatcaaaatattactaaaaagcatcgcaattggcttattttcccccattatggagaagtgaattgagaaaaaaaaaaatcagactgattttcttttaagaaatgaatcacctctaacatcctacaaggctatgaagatttccaagcaggcagttacactacttgattcttgaccttttatacataaaggtcctactgctagtgggacactttctgtccccgaagtagcaagtacttatgaatgtatctaatattatgcattctcaatctctaacaaacgtgatttttttcgcttccaaaataatttcccaagatgaaaacggcaataaaacaacgtgactaataataacatacaatcaggaacttaggtgaatgaaagaacttgaaaactattttacagaccatacatagtcatgcctcgctgaacagggggaacaggatctgagaaatgtattgttaggcaattctgtcgttgtgcaaacctcacagtatacttacagaaacctagatggtagagcctactacatacctatatgtaggctatatggtataatcaattgctcctaggctactaacctatacaggatgttactgtaggcaactgtaacacaatggtatttgtgtagtgtttatctaaacatacctaaaataacactgtacaaaggattaaaagatggcacacgtgtgcagggcactggccatgaacagagcttgccagcctggaagctgctgtggacgtgagtagtgagtgaatgtgaaggcctaggacattaccatgtactactgtacaacttacagacactctacggttaggctacactaaatttatctttagatatattttttcaataataaatcaaccttagcttactgtatcttttctattttataaactttttggctcttttgtaataacgtttaacttaaaacacaaacacattttaaagctatagaaaagaaattttatattcttattctataagcttttttctattttttttttaacttttgttaaaaactaagatacaaacgcattaccctaggcctacacagggtcaagatcaagacgtcgctaggcggcaggaatttttcagctccattacaaccttatggagccaccgttgcaaatgcggtctgtccttgacctaaacgtcgttatgaggcacgtgaccgtattttgattctgtaacctaaaacatatccttctgaaaaacagtatttctaaccaatatatatgaaaatgtctgtctcaaaacatttctctgtgtctcatggtaaatctgccacgagttcaattagccaattcctggcaaggaatccacaggttttcccttctttaggaatgtcaaccattttgccttttatttttttctgtaagattcaattatgatgcactaagaggctgggccaagtccacactaacagcaattcctccgaccctgcagctgaaaccccggcagaactacgccccctcgaacacaatgcctagatcccctttccctggctcggtttagctggtggggagcagtccacatcacaccccggggagctgggcggtggcaggactttaccagaactctctccttcccatttctccacgcaccacaccactggaggcgctctcccttcactgcggttgggtcaatgtggacgttttccactcggccagctccccacgagcac
